United States Patent 7,868,149 (PLANT GENOME SEQUENCE AND USES THEREOF) - sequence listing, part 102

SEQ ID NO: 54825 - DNA, 10916 bp, Oryza sativa
tactagatatgatatatcctaatattacatacaaatatgtacgtatattcaaatttataatattaaaatatattatatctgattatagattcgttttctataggacggatggatggagtatatgccactagtgtacaacatacagctagctactcctccgtcctaaaaaaattaaaccctaggtttgaatctgagcaaacatgtatccagattcaaatttagagtttgattctttttgagacagagacagagtagtagatagttacttcctccgttcaggttagcattgtccacattcatatataacatctatatgaatgtgggcaatgctagaaagtcgtataacctgatacggaggtagtagtacgtagtacactggacgccacgatgtgtgcacttgcgctgctgcatgcgagagctgggaccacacgtacggtggtcgctctctcgctgtgtgtgtctgtacatgtccgtgagtgatcactgtgtgccactggcactgcacgcgtcgtacgtacaacgctcgccggcggcgaggcgagggtacgtacgcgtccagctatagcgccatgcgggcacgcacacgcacacgcacggcgcgtcccccaccgccgcgacgcgcacgtcccacctgccgttctctctcgcccgcgcgtcgccgtcgtcgcgcgggccaacgacacaacatgttaagggcgcgcgtcgccgtcgccgtcgccgcttgctctcgcgcgcgcggcctttagttggcgcgagcgaggcgagctagtgtgacggtgtgaacgcggcgagggggggccggacgacgagaccgacagcgtgtgcgcgcgcgcgagcggggaattaaggaagaggacgacgtgctttgtacactgctacgtgggtcgccatcgctgtgcgttgtccagctagcgccggcggccggccggcgccctcgatcgtgggctagcttaattagaccaagcaactttttacaatcttacatatgcaatttctttccgaatctacagctccccgcagtccattttagattctaggcccggttctttttctcaattccaaactccaacttcctcatttttcattatcacgtttttcaaacggttaaattgtatgtttttttattaaaaaaatctttacagaagttgttttaaaaaataaataaatctatttttaaattttataatagataatatttaattaatcgtgtactaatgacctttctgatgatagaaattcaattactgagaattttgcgaagctaaaaaaaaaccaacttctaactagagttatgaattctgcaactataccttctcataatcccaaaaaaaagttgaactgttttgaagggcttttgattttaggagaagttgtcattgccagaaactccccaaacagactctagctatattttttcatctaaattccaagaatttgtagtttattaattgtagaatccataaaactgactagaaggggattgaagaagctggaaacttagcttttctaaattttgataagtttacaaactgcttttcaaactctggagctctccaatcaaaacctatctgaaacgtcggtagctaggctgggtggtacagtgctggctggtgctactgtttggcagttggagaaaacggtatagcttgatgtaggcgtatacgtagggacgtcggtctccgtacagtggtacatacgtagcccatgccatgccattgtacgacacatctaattgtgattttgttttttatattaagaaaaatcccgtggttgtgtgtcactgtatagaaggggatgtaacctattttactcattgaatcattgataattaaaacagtgcacgtgcaagaaaggtggtagttcgaaatcaaaggattatcttgggagtttttttaattatatttaagtgaaatttgaatttttttgtcgcaaaaaaagatacattgaattttattttttcaagggcgaatgatccacctaaagtttgttttaaaagaaactgtttcagcacgtacacaccacaggtagttcaaaagtgcatctgccggccaattaatgcggcacagtagctcaatataggacaggacctttggaattttattttcaaatccattatatttactcaatgtagccttttccttgctccatttcataatcaaaaggcaaataggcggttccaattaatttgcacaaatttctcgagcgtcaaattcgccacatgtgggtggtgggctgtaggctacggatcccatcggcccacatgacattgcagcggcctacgagagaatggaaggttgggccgtcagaagctaatgtctactggacctattctcaatctactaggcccattcttttttccaggcctattaggcccattctcccctcctcctacccaccacccacccgtccacgcgctcccctcatccttgcagccagcttatttcataatcaaaaactcttcctaacagtctaatttttcatccaaattctaaaaaattatagtcacagaatctagaaaataaacaagcacgaatcacagagcaaatcacaaggtcagaaattcccgtgaacttacctttaaaatgtgttaaaagtgatgtagtataatactccatccgtcccaaatcataggacgtcctcttaaaatcaaagtcggtaacttttgactaataattatactaaccatacatatgctaagtattacgtatgttatatcactagatttatattttaattttaaagtactttcatatgatgttattttcatgtttgttggtaacgtaacatagaataaattaacaaattaacggtcaaagtatgtcattgtagaccgtgtaaaaaaatataaaccttataatttgggactaagggagtattgtatttccgatattcagggagaatacaggagaccaactgacccaaatggtagatatttgcctgacaaatgattgggtttcttgcaggcacattacttatttcattcatattatcacgtttagtacatggatatgtaaatttatgatacagatacaccattggggtccaaatgttcagagatacatcatccagggaattcaggcaatggaaaagaatcaatcggtgtgtggagctaaatgcagaggcctgatcatgccacattagcaagcacaccaggccctgccctaagatcatatctgagtaatgatgaacatgtccatgcaagtcactagctttgcatcctctatctataccttcctcttattctgtatatattcccattgggtgtcccttttttcccctctttttgccacctacatttggtggtggtctaagaatgaatcttagtaatctcccctgaatgtaagatgatggcaggtaccatcacaagggtatgcacagtctgtgtacttcgcgtctgccctatcgaaaaaccagtcgcctactgcttcagcaattctctgcatatccaagaaaaaaagtacatgggatgggtctgatgagactactggttttacatgtaggagctcagagttcagacagtcaggaaatctttcgaagcgagaatgtttttcatggcatcaccgcagagtttgcgtaccttgttaccgagacgaggagaatcccctgcgtaccatgtgtcctgtctctcactttggcaatgtgcgaaacaggagttgataaaaagaccgttctgccttgcgccggagaaacccctcaccgcatcgagcatttgattcctgaaacctgccatcatacatacacagggggtcagccaatctagacttgaattgacagtttataattcacggatctgggagaacagcccagtaccttgtaaaaattgcagttggttgctattacaggaggcatgattcatcctacatcctcgccatagaccttgcggatcagcccttttgggggccacactttgttgaagctggaaaatataaaataaaatcatgtccttgaacattttatagtttatatttgtggaccaactttatcataccgttaacatgcaaaacaactgacaaatacctgccacacatcataagcagtgttcaaaataaaagttggagtttgaatgtttggcaccacattctgggggaaaaagcactgtagagagcaccaattagaaaaagaaattgtgaaaaactaactgtgtatatctttgttagatacttcttgatgttttccttaccgaagttttatccatgcgggaggtacaagacctaggcaggcttcttccggaaccctgtttttggtcgaattttcatgagaacataagcgaaaaaaagatattgagaaaatattttttttcaaaggtatcgtatattctgacataaattaatagtagcataacatgtagaagaagtgttacagtcatgacgaacagaagtatcataacatggtggacagtggcagatacctgcaatctcacaataccattgaagaagtccctcatttctcgttgcccagaaacatcaacactgcaaatggtaattaaatccataacgtaatatcagatgattagcttttactctaccagtattcatccatagcaaagaatgggcaagaaaaactgcatcaaagcaagtctcatttctatatgtgaacttacaagtccagaaacattccagcatcagcaaggcacttcacgtttgtactgccgctaaacaatccacggaactcgtcacagtgaagtatggttgaaacaccaccagcagagcatccagaaagaagtgcctggtagaattgagttgtggcaaggaaacataaattatttccaaaatccaaaaggctaaagaaaacatgattagctgtggaaggatcagtacctggttagcatatctcattccttgggccatcagatcatccatagcagcctgccaaatacgctgacctcggaaataaaggcctgcagactggagaaagaaaactctgataaatgaacccatgtagttcagtagaaaaaaacataaacatgtatattatgtagtaatttttttggggggatgtgaagtatgtatttcttcagaatatttgtttgaatggaatgtacactgtgtgcaatatggaatataggtcactaggaagaaacgtgtacgctaaatattactactatctaagagaacttaaacttaaattgaaaaacattttcctttgggaaacattaaacttaggtgatcagttatcttgattatcttctgaaacccttcagcccagttaaatatcaggaaaccaacgcactaaaatgcagaaacaaaatttgcactcaccgcatcagccccatcaccagtgaaggatccgccatcacaatatcgaaccttcactctgttccagttgtagaaatctaagaagaagagagcacagtcataatttgtcagccaccaataattaatagcaatattcgcatgaactatatcaagacagaattgatcgaaagaataccaggattttcttcaggcctgttactcattatcccagtaaactggagttggctctccatgtgatttgatgaaccacgccgactgctcttgcgaaacacgcagcttttaacatcgttgcaccagcctccaccctggaattccaaacgaatcaccatcagctactaaagcctgaacgatatacaacaatctctagtgccacaaagtgccatttgctcaaacttatctctcggttcacatatatgggaattggggtgtatttctcacctccaaattgacaagccaactgtttgcccctgatccaaaccctcggtgtaggtgataccctggtaagctcccatccaagcatactgccatgataaacaaagaaagctgtcatcgagatttgccaaccaaccctgctataagcaaatggaaacttgggtccaaattattcagaatttatgatacactactcgctagacaatcaagaatgtcaacttaagttaacagaaaacagatagcattgagtccccttttcccccaactaggtagcaaggaaattttcatcatgacaaccaccaaacattccaaggctctagatccacatgcatatatctatcaagatccacacatgatgcatggcatgctacaaccaaccaacaaaaaggttaacactgcatgatcactcaatcaaggagcacctaaacaaaaagaggggcaccaaaaaaagaaaacatgagcaatcacactcctcctaatttacaggtgctctgaaccctctgtccaaccagggtcaactcaacaaggaccggatcacagtatcacaccactcaatgactcaatcagtggaaaacccaagaccccattgacccaattccaagagctcacatgggggcaaggcaaggccaataaaaaagcaatctttgcagccggaaaaaaaatactagaatcaaggaatgaacgaacaattcagggaacaaggaaacatatataccggctcccttggcggccgccgactggatgagcgtaatcccgacgaagacgccattgctaccagagttggcattggtggagtagacctgcgtctgattcagccacggctcagagccatggactgccaccaccaagaagccaagaaccagagcagcaagagcccaagaacaacccatggttgatggttctcttctttctttgctggttcttgggccttcctcccactcccagcctctgccttcttcctgaggaatggatctggaagaaggggaagaggaggagggaagaatggaggagcagaagcggccaagcaagaaaggaagttatacgcggagccaagtgcagctggatgctggcaatggctgacaaaacaaaagcggctgcttctgggagattctgtggagcggtgtgcactgctactagtgcagctgcactagtgcttccagtgaaaaaacgtgtagtgcaattacagttgtgaagcaaagcatctccctatcttgtgaggctgtagaaatggagaagaagaagaagaagaaaagaagcaatggaaggagtcgcccggaacgtggtggtggtgatgacggaactacggaatccaggggagggcggcgaaagggtggggaaaactgtgaagtgcaattactgcttttttggtgggcgtactcgtctccattggagcaagtgacagctgggagctgagctgagcagcggccgtaggcaggctggtcacttcctcgcttgcgcttcttcgctgcagcggctacaagcagcacagctttttcatagggaggcgcaaaataattagtagtgtcggctacggccatgaatgaggaagcgcaatgtaggtcatgtttactttccaatcagcaacaatttttttaatatatacatggagcattaaatatgaaaaaaaaattaattatacagcctgtagtactaactactcccaccttatttattttttataattagtattttttattattagataataaaaaataaataaatatactttacatgtgtcttgcttttaagttttcataaaatttttaaataaaacgaatggtaaaacattgaacaaggaaacctaccactgcgttttaagtggaacggagggagcaaaggattttagttgaataggacacataccattactataaattgaacattcgttatttagattcgtagtattagaatgtgttcaattcaactaaaattcctcgcattttgggatggagaaaagtagtactactattcatactcacaaaataagttcatctatgtcactcttatttatttcaaataagtttgctttttaagcgttcattgtattagaattagagttttagaaagtagaagataaatatactataaataaataaagtgggggacaattctattggaatttagggcatgtttggaggaacttctagctgctgcagcttcttctagaatcagaagctctccaaacagtctagcttttggtccggattgtgagaaactatagttgtaaaatccagagaatgaagtagaagccagaagctaggaaacctagtttttctagattctcagaagctgactaccaaccagctgttttttagaatcttacgctcccaaacaggcccttagtaaagtgaagggtatcttaatcttttaattttgtattagtatgtgtaggatgagtgaaaaatgaaatgattttgggacggaggtaactgccatccttccttaaagaaacaatcaatttctaggaatgatttgtccatatgtatcttaaaaaatattttttaagattaaaataataaataatactcaattaaccccgtgttgatgaattttcttgttttgtgtaccatgaaaaagctcaacctttatgaaaccttatagattgactagtgagacttcttgaatttatgacggtgtagttttcataaaaaaatatatagatgattttttaagaattattttaaattttatacttataaatcgattatgttatattttatatgagtattagttaatttatttgtttgcactctcattatcaaattaatcgatagtaactctcaaataggagtatttagcattcaaccatgctgctagtcaatagtacaagtacaaagacttttttttgtcttttttataatgtttctgtaggagtatttatttgcgtattaatgttggtttaattaatagaggtgattaattcgcgtttgataccggtggctgttactgttgcttcttaataaggaggttaattagacaaagagagaagctgttaaatggtggtacaacagcaacgttttgtcgggggaggttcctagacgaaatcacatgttctgcacaagaactcgtttggacgttagtggtctacaccaactgattgatcgttttgcgacttgcgagctgtgtggcactcagccactcactggtatgggtgccatttcatggtcaactattaggaatacaaatggattaaaatattcaataacttgctcacaaaatttaaaacagaatgaaaacaatttgaaagtgaacagatcataagaagttaagaactctcctcgttaaaagcatatcccatggtgcgcttttggattgagcgtcggatccaaaccctaggtggtatgacagttttcaacaaatttcgatcgatttttttgtttaaaattttaattctcaaaaaatcatttaaaattttcactcaaagatgctttcgttctgcgtcaaaacctcaagatttcactgtttacgatcgggtttcgtcgaaaaccgaaacctagcatagttggtaagaacggggcagaaagtcctagtagtatattttaacttctctttacttctgcactctctcaaacctaaaacataaatatagattatatagagtaagtcacagtacttccccccgttataaatattttatgtttagaataagatttgattaaagttttgactatccaacaaatttttaaaaaatgtttagcttaaaattaaatagaaaggatggtacgtgtaaagttgtctcaataatattatttgcattacaaacttattgaatcaaatggatgtcattcttatataaaactaatagtaagaattttaaaagttttacccagacttattcccagtgccaaatgtagagttggctacaactctaccaggtggagttgccatgatatgtgccattccgtatacctcaacggttaggattaagccacgttaacgttaatatatacttaaaacaagtaattaactgtgcaacaaataaacttgcatcaacaacatgtcacaagatattttaagatatttttttactgtagaattgtagaattaatacaagaatttcatacttcatctattttattaaaaattatacatattacaagaatttcatacttcatctattttattaaaaaattatatatattaatattgatatggttcgctgttgcatatatatgaaaacactgtgttagtatatactgctgcttagagttgatcgactgtatgtgtttattaagaacaaatgagaacataatcaaaatagaggaagcgttgaaaaaactaattttcctatcaagctataaccattaatgttgaggagttactttattaggtaaatttaatgaggcataatctcagccgtagaaaacaatggatgatatagatttggccaactctacttggtaggggatccagaccctcctcatatgagggagtaattgtctcattctggtacacgcacgatacgtccacatatacaataaataatgctggtgcaagtaatccatctccatacaatacggtggggaccattggtcaaggatataatatgctcaaattaatcactcactagtgatagtgattaatgtacgtagcgctcgctaaaacgaagcccaactaacttttcaaccatccagcacgtcccctggatatgtactgatgtactacactactgtacagcttcatctaaatctcctagatactcccttcattcaaaattatttcaaatttcgattgttttttcaaataaattagttatatttgtagtctatatgtatctaaaacttaaatgaagaaacaaattaagtgtatgatcagaattcggaagtcataattctcctgctctatttatatattaatatatataaaggcaaagcttttgcccttcttaaaataaataaatgtactcatgatttctgtatcagtaagatagtatttttttcccgttttggaggaagggagcaagagagagagattcttcttgctcaacttaactaattactcgtaataatctcgtaaagaaatgcatggatttttagctataatgcacggcacaatcatttccgggagtactccctccgtcccataagggattttgagtttttgtttgcaacgtttgaccactcgttttatttaaattttttttgtaaatataaaaaacgaaaagttgtgcttaaagtactgtagataataaagtaagtcacaaataaaataaataataattttaaaaaa

SEQ ID NO: 54826 - DNA, 1540 bp, Oryza sativa
  unsure (1)..(1540): unsure at all n locations
attcctgcagccctgctgccatgatagattaagttaggtagatctatgagatttctttaatggaccatgaattatctaagcacacgcatcagtacaatcacagtagggatttacctatatatcgtactgacagtgctagcagctaatccttgttcagatctgtgcaaaaaaaaattactcaatcttatcggctgtgcgaggtctcaaatcgggttaacttaattcaatcagtgactgacagaacccagttgcgaaatggagtgtgtaaaacagtagaatagtagcgtattccgtacttcaagaatggcgcagaaagcacgaggaagtacagtatcccagttccgtcttagtaaaatacgggttaggataaataccaaaccaaagcctaatatatactatcgtactaccagtatattttgggaagaaatgagtaggtacgagcatgcaatgcgtcaatggcggagcggagtagagagcagaaggcgcgtggaaagctgcatcggagcacatggatctgctctgcatatgcctgattttgcattgctactgcttcagataatttactcccaactctgaacaagtgacctgcctgccatatttatattcgctgaatcttgcgctaaatgtttttttaaaaaaaaaggcgagtagaaatacagaaaccgggaagagtgatctgtagcatgggtcaagcaaggttcagagtcttcagacaatcagacaacatgttcggctgtctcgtctgtgtaagaagttcaacgcatcaatctattatagccgggccggcatatgaacaggaacagccacccaaaaaaaaaaaaaaaaaacaggaacagccaaggaaaggaaatggagcgagtgttggtgctgcttattattcatcaggatcgcattcacgcatactcctatgctgttgctgcttggcttgttgactctcattggctgtaactaaccatgttcagagcaagtagtgtaggaggtttttcacttttgctgaatcagcgtgctcgaacgcctctccaattattcatattgaacgacattagagatgagataaccatttggaagaccgcaaaggttgctcgaatcccctgatggatacgaaactcctatggcgcgatccatcgcttggggcgatcggttccctgccccacacggtataccgttttactttcctattttactaagtttatacatatcaagtttgcacatttaaagtttatacaagtttgtacacctaaagtttgtagacctaaaacatattcaaattcatctttaaatgcatttgaattcaaattcaaatttgaatcagtatataaacttttgacctataaaaaatgtgtaaatcctagatgtataaactttgggtatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 54827 - DNA, 735 bp, Oryza sativa
cttgtgggcaatttgtgcttgtggctagaatagcgagttagcaactagcactgaactgttcaggttgcaggtctagcaatgctcttggctctaagctcttccggtggtgttcgcgcgagaatcacacgtccgtcaggaagctgttggaggtggatggcacgtcagagagatcaaaactcctgaacaaagtatgtgccctgccagcaactggttgtgttcacttgttagtgttagccttcgattttgcaggcatcagtaatgagtttagttctgtatgtttcatctgttcaatcgttccaccatttgggctctaccaagtgaaagctatttatatttcccaagtcctctaattattgttgtgagttcaaactagtgcatagtaaccttgtttaaatacaatgcgcatatacttgtacattaacttccttgatgttatgacctttatagtttaagcctatgcaatagctctacttaatgacgtctggatttgatttgcacggctctctgcttgatgccactcttcactaataatgtcacacaactattcatctgtacttgctgtgaacagtgaacattgtctggattatttatgattgcaggtgtctgttttgatgggttatagtaatacacaagaattaattgagcaagaaagagcccgcagaggatctgctacagaattgatcagtgtatgcaaagaaattgagttcccagaaatgtgtgcagggctgcaggaat

SEQ ID NO: 54828 - DNA, 18699 bp, Oryza sativa
  unsure (1)..(18699): unsure at all n locations
nnnnnnnnnnnnnnnnnnnnnnnnnnnnnnnnnnnnnnnnnnnnnnnnntcactttaaagttcatatttgtcatatcaatcacatcaaatcaaaattttctccattctactctctgcctaccaaccatatattccctccgtttcataatgtaagtcattctagcatttcctacattcatattgatgttattgaatctagacatatatatctatctatattcattaacatcaatatgaatgtgggaaatgctagaatgacttatattgtgaaacggaggaagtatcatttaatagagagtattatactacctccgtttcaggttataagactttctagcattgcccgcattcatatatgtgttaatgaatctaggcacatatatgtctagattcattaatatatatatatatatatatatatatatatatatatatgaatatgggcaatactagaaagtcttataatgtgaaacggaataagtagtcatttttgctaaatagagagtattagcagagaaggatgataggtatattgggatggaggtagtagtatagtagcctcggaaatatctacagcaatctaaccttgtggaaatttatacatatgaggttccgtaacacgatgtgaattcagttatataaagaaagatttctttaaacttgtcattactcttcccatcctagatgagacgtatcctagattattatattttagaacggagttagaattattatgccacgcttacaatctcttaaaactttctaaatcaaaccttacttcaataattctttaagctatttattaactttgtcatatttgttccatttatacgactaatttttctgtctacaatttatccaattatcctgtcggaccccgtcctctgaaaacaaatcatcctagcaacaagatctacttatcaccgagcgcgaatcttaaagctttagagtatcagagtcagaaactgatcaccaggcgtgaatcttaaagcgaaagcgagccgaaaacagggatataatccgaacaataaccaaagccaccaaaaaacgtgaaaagtaattgaaaacctagtttacccgcaccgtccgatctcccgagacgactcgccgaccaccgtccgttctacctataaatccacgcggcccgagccaccgaaaaatccagccaagaggggaaaaaaaaagggaaggaatttttttcttttttttttgttcgcctccgcttcttcctcacgcagctctcgcctcgcctcgccgcccgccactagagaggagagggagaaggaggaggaggcaaatcccagcaaaagaagatgcagatcttcgtgaagaccctgacggggaagaccatcaccctcgaggtggagagcagcgacaccatcgacaacgtcaaggccaaaatccaggtttgattcctccaagctaggctatagctgtgaatgatgcgacggcgttggatggatcgctgtcgctggtcgtgtttccctcttgggggaggggcttgatcgaccgatcgatcgatctagcccgcgcccgtgtcgcgcgatggttcttgccctagttagttatttactgtgccatcagagttgggttttgttcaggttcgaattgggggaagtggttttgagaagctgaagctgtatatttttgtccattcacagtttgtagattagttgcactaattttgagctatgcctaaaattagatcaagcacgaaaggataatatgttcggggagaaattaacattgaggatgaatacggtagtaggataatatgttcggggagaaattaacattgaggatgaatacggtagttgctcctcttgaggttgagatcgccgaattcgtgcaaatttgataatgaacgctccatttccatgtgattgcacaatgtttgtcaggttgaatagtactgtacaattcaataaataatcaataacatcgtcccttgctatgaaatttgacttgtctggaattaaagatgctttgagttgtgtgttgtattagtatatagattattagtcaatagtcaagaaataaagatagatggtaatcttgaaaagctgcctagggtagtggagaatatgtcaaatggtgtggtccaatggcatactcatattttatctcattatttatgacgttgtcctttatttctcctagacatgcgaaccttactgcctttatggaattcattctttcagtgaaggtccccatactctttgtctaatgattgatcgattccatgagatttagaagcgtatcattggtctattggtcctatcatatcgtttgttgccagtttgatcagaatatcatccataattctgcgttgtcgatgcctgtcttacaattgtaaaaaacaagtgcagtgacagtttgtagcagctacttcggtcagtggaaactaagctaacaagttattttgttcactgtcgcaggacaaggaagggatccctccagatcaacagcgtttgatattcgccggcaagcagctggaagatgggcgcacactggccgactacaacattcagaaggagtcaactcttcacttggtcctcaggctcaggggtggcactatgatcaaggttaagaccctcactggaaaagagattgaaattgacattgagcccaccgacacgatcgataggatcaaggagcgtgttgaggagaaagaaggcattcctcccgtgcagcaaaggtgtatattcttggaactgcatttcatattctgctcaaaccagtttctaaatttttcacacatcggtgcaaaggtggtctgctactatatatctaggactagtattatctgagctgacaaaagtatttggtttcttcttgtaggcttatctatgctggtaagcagcttgccgacgacaagactgcgaaggactataacatcgaaggtggctctgtcctccatcttgtccttgctctgaggggtggttattagtaaagctaatgtgctagtacttagctcaataccttcgaatggctgagaaaatttactcttgttggcatggaacttgcgaagggataataacatgctagctttgcacatttgcctagtgggagaggttgtcttccatgttattatcttatatgatttgaggcatattattccagattcaccagtcttcactgttggatgtgctgtggttttagctccgttgattgaatcttctgtggtcgccaattcttttgctaaatcagtgttcagtgatagctgaatttggagatgtcacgtagtgttatgatttttgtgatggcaaatagtgcagtagccagacaagtccagtgcaaaaatcaagtccacttatgccaacatgcaatccattactcttaagttcaatgtcatgccttgcaaagttgcaatctcaagtattctggtataaacaacaggataagtgttaaacaccaacctcatgaacccttttcattagtttttcgcttcttgttcatagacatttccaataaaaggccctagcaaatctctctcaagtcaagatgacactatagtaagctacaacttgataaacatacagaaagcagcaggtagaacaagtgcttagtacttagtgcttacacccttacccccacacctttctcttcactgatctgagcaaggatcaaaccaaaaatgatgtgcagccagctgatcaacttatcttttctgtacaacctaacccagagctaaattaaaagaagtaaacaagaaccctatgaaacagaatatctcctgttcctaagaggtgggaggggagagggcttcacatctgcaggcttagccgacaatggcgggctctgtgagctacctgacgtctctgaacctttgccattctctccctgccccttgctgctccatatcttgtcaaagatcctcctggaccttgactgcagaaggaagccgccaagctggtccttgaagctgttcctgcctcctcccctgtgctcgctcttccggtgctcgacctctctcgcgcttaggctggtcgcttgcttgttcagcgagtttggatgccttggtatccgtctttcgcaaatgtcactctgatccttcataataggctttgcgcacgtgtgtcctccaccatccgttagagcaagcgcattgctggaacccgccctcagctgttggaagaagaggacctgcaccaccaaccggagcggtaggcggtcgttttgcgtggcgtgcatgcttgcatctgttgaaagcttcttgacatctatcagaccgcagatcttcttcttgtcggctttacttatgtttggatgctcctgattagaaagaagcaaatgatcagatgccgttataagttataacatacaacatttacaggggttgagttggatacaagtgatttatcaagtctgcttctatgccagagcaaaagaaaaataaaaatgcattaatcttgagttttagaagagtgcagcaccgagtaacttattgatgagtcacaatcccaaacagggtagtactatacacatatttgtaagtgttatgaacataccttgagatatgcatcaacagctgagtacaagctgtcatgaacaggcctagctgcttctggaaccgctgttgctagttcaacaaatgtagacaatgaaaggtctggatctgaagctacttcagatagatagccatcaaccagctctcctaaagccaaagtggattcttgttcaaagttaagctcaatcattttgtcatcagatttctcaacaaaaccaccattgtgggacatcgctgttcttgcaacaaatctctgcacaagattatggactaacttaacatcgtgtgcgccatcactgggtgaagcagcaggtagtaagagatccttaaccgaagctttgtgcaactggaaactaatccttctcataagttcttccttcacatgttgcccagctccaaccaatatagcaactttcaacagtttcaagagaaacctgcaagaacaacctgatgtcttatctgacggcaataaccatattatagtctcgaccaaacattggttccttctcatgtaatcctccgcgaccaaagcatcataagaatctggcagccatctgacagcatatgctttaagggcttcccctatcaattcaggtgacattctccccttggatttgacagcaaccatcactctcttgtagaggtcaacatcgagctcgcataagtcctcaacccaccagtctttaggagctattgatgttcttcctgttgattcaactatttcagtacagctcattcctttcctgctgtgactgtatgaccaggttacattagctggatccacagatgtctttgaagcaatagcatctatacatctgccgatgaccttcagctcttcggaccaaggtaatagtgcttttgtgctctggagaacaatgatagagtctttccagctacggaggatgctagaatttatgaagacatcgattttgaatatcaagtttcccttgtccacatcttcagtcatttcaaggtactctgctgcacatcttgctgcaacaacattgtgaggactgagggtaacaaccatcccatagcagaacttagcgcatatttcgaacgctgtcactcctccaggaaagccatctatgtggacctcatcagtcccctcctcggtggccttaataactaacctctgaagcttgctgctcttggacagaaggggaaactgcacaagcaatcaaaatcaaaaatattttttcagttatgtttgtcaataagacatttccctgaataccaatcatcaccattcaccagcaagaaaacataaacatttataagaaataacgtttgtacaatgcaaaatgtcggagtttgttttttcttaaaaggtggagaattgcactagtcagtgtatccctcttattccaaggtactgtttctttaagtagtattttcagtcaaataattgttgttgaaacaatctgatagtcacagcaggacttaaatagctatctcacacaacagtaattacttgcaaaagggttgctagcacagagatcaactgatcaagtacagaagtggtccatgcagcctattatttacttgattcaacagcttttcatgcagcatagatcactttctttaagctagaaactttccatgcaaacgaaaatatgacaaggtcactatagttctaatatttacaaataaatactaatcacaccaaacatttattgagatactgccaatgaaaaatttaacatgaaacagtatgcagcttattggaaagcgatagcgcagcaacaatcagatgtgaaacataaatgctgaatagtgaatatgctctgttactgagagtatgaaaatgaaatcctaagtttgagcacctatgcggctaagcctcaggatatactatatgtaagttgtaatacatgtctagcagcagtgcttgtttctacctttgtcactattctaaagaaaagatataatacttttgagttaacttcagtgcagttgtggagaaatattaggagcccaaccttatgtaagtaaaatttgacttcgctgacatgcacaatgacatctgttgcgaggtctgagatcacatatctgcatgcataaaatagaaaccgtaagcaaataatattgcaaaaacaaacatatattttccctagataatataataatagtcctaaaaaattctaataatagcttttacctagttttaacgtttcttatggagttattttttttcaaattacacacatcaatggtggataaccatagaatggtgcaaaaaaaaactagtatatgagcctaaaggcagtctcagatcaatattctgaaatcaaatgcgtatccaaccagcatatggctgcccataaatcatgaacagtcgctctctcaaacaaatgacaacaacaaaacacattcctattattctaaggtataaaggtcttgccaaagacatgcactgtctatcgacaatggacgaaaacatgaggtggctgttaaatagactgcacatttgcacacctcgctttccggttattccagttcacttaagaaaagcatgcgaaaggcgccactagagttggtaatcaggacacgcatgcatctgttagccactaatgtccaaaaacctatcatgttcacttaagattagcaccatccctttctctcttttgaggattatctgtacaaaaggatgacttaagctcaggttgccttgttttcatcaggttagcttgctacgaaagcatcttgccataagatcccaacatcacattctgctttatgcctctcatcactatgttattgcattcatcagtagtacagaactaccagattgtttcaaaagccggccgtaacgaagcaacttgcagtgtggattctttaactgaagggaaagtgaactcctatcaattattaggaagatggtgagatgaccatcgttttcttctttccttaataataaattaaaccatctaactttaccaagttgcccaaaacaacaaaacatagtggtgcctaccatataatagtaacagagtgaagcttaattctcctaaccctcagatctattctgcactaacctagcgccctagccacaaagaggaggaaaaagaaacaagtacatgctcagatatagcaggcataaacaaagcctttctttttagtcgacaaatgactttgagcaatctaattcaaacacaaccaagaaacaactgctaccaagctacggataccaggaaggcaatttggcttcagcttatgcccaatgattaaccgcatcacaacgagagtaatttatttaatcagatgattgcccatcactgtaaactaagacgtttaacagctagcatatagaatcacgacaaggagatagacacgaaagaaaattaatcccaagagaaacaaggaatgccagctcgaaagatcagaaggaaaaactttggtatgtgatggatccagttcacaaaactgtagagaatcacgcatgctatacattagtacaaaggacacagtttgcaaaaagaaaaaagaaaaaaaaagaaagagcagaaacgataaacagcttagcacttcccaagaatcagtagtcaactcacccagcaacttcaaatgggagaccatttttgggaagaaaacaaaagtacaaagtacgaacaaatttggtattagcaatcgaacaggggacttgtaaccaatactcaagcataatgtgaggtccaaatccatgaacaagccacaagatgacaaaagaaaacatagctactcccattctattaattaagagaagctagaaaactgatgcaagaagagaactttccaaacgactcccattctattagctgccaccttcattctcgcaaaacttcataaacacagagaagccatcaaacgaacgatttctattgcaagatatctccccaaaaaagcttcaaaaaaatcgttcttttacaccactacccaagaaagaatccaatccaataattagcaaaccaacatgatgaacagcaaccagacacgttcgtaatcgacgcctcccataaacaagcaaaggaaaaaaaaaagaacagattttgactaccacctttgcatcctaacaacgttatcagagtcagacacccaaagaaacgcaagcgaagatcacacttttcttcacccaaaccgaagctaaagattggagaggagacgaaggcggcgcctcacctgacgtcggcgccgtcggactggaaggcgtcgggcttggagcccagcttcatgaacttcatcttcttcttcttcttcctcctcctccctccctctcagagcctcctcctcctactccttcccatgcacgcacaagcagctgagctagctgcctgaagaaagcaacgcagcagcaggaggagaaagagagaaagaaagaacagtggcgagtgctgctgctgctgcggcaactatacaccaacggagaacgaagcggttggtgaggaggagagtgattaaacgcagcaattaaagaaacagatgtggttgaatggaatggaagagaggagttgccaatgatgccgtggagtgtgaatgatgggatattattaactcctctcactcctctttctctctcctctgccgaagccgccttctcttctgctctcactagcaaattgcaatgtcaacatactgctcctctctctctctctctagacttgttgcctttcctctgatctctgcacctcttttcttcacttcaacgcactaataatagtacttacaccatgaccatgctcttagctgatgctccgagatgattactttcgctatgattatatataataccgtacttactccagcaattagctgggctaatcacttgtttagtagggtgcttttctttggtagtagtgtttcagggtgcgccagcctttacaacggatggtagtgtgattttgcgcgcagctgcacaggtcgctttcggtgtgcggcgcggttcagagaagcaaacaattctttctttttctcgagagaattttgagggtagcaaacttaacgatgtaggctatgtttagttggatctaaaatttagattttggtttaaattgaagatgatgtgactgaaaaattctgtgtgaatgatagattgatgtgatggaaaaggactgaagtttggatctaaattttgaatctaaacgcagccgtaatgacgtatacacaatatccatactctctctctctaatctctttctctctcctcttgtcatctagaaggctcgtccacgtcgtttttgcaatacaaaaatggagagtctcctcttttctctgaacttgtactgtttacatatgttatcctaagtttgacatgcaacatgtatagtgacatttgtttatacaactcgaatacctatgtacttgtttttttaaaaaaaaaaactactatgtactacagtagtagagttcagtgattgaccttctagcaatttacttatggaattctttagaaaaatattagctccccaccattcatttggcttggtatgtaacctattccatccgtcttaaaaaaaaaaggcaaatcttggatgtccaaattcgttgtactatgaggggtcacatccatcaaaggtttgtcacatctctctaaggttagtctttttttgggacagagagagtaggttcttagttctttggaaataagtgtgatgtcctggaaatcttaagggaaactcaaaccttttgtattgaaagccgaattcctccgtaaaaatctgattggttagagttgaaagttcaaaaatgtgtgctaggtgtaagttaattgtttccagcacaaaagccggtttgtttgagataaatgagcaaatgtttctctgaattttgcttggtttatacaaattgatcccattttggattgaaagttacggcagacaaagaggttggtaaggccgcagcgtcatgctacatgcagagaggagagggacgtccatgaaatgtgtacttcacaggaccaaaggaatatatgctaaatacttgaacagaatgtcagatcagaaaaatccacggagaagtactttattggaagaacacattttggaaagtgaatctgaattttaagtagcaaggaaattgatggagctattattttaagcacaagcgtgtatgcactcatcttttcttgtggaaaaaatagtggcaaaaaaaagaagataaaacattgatggttgtgtcattatcagttcacaaatatacaagaacacattcaatcaacttctccttctccatgtgtaaaataaattcgatcttgcatagttgtgaggaatatgtaacatatatgtacaatgatctatgatttctagtcatatcatattttttttcataattatttgaacattgcgtaaaaaaaggagaacacattctctcacaggtttaaaatcccctctaggttgagcatcacagttttaaaaaaaacagtagctgtttttatctgatcttgaatcggtcaagtagtgttaatattcgcttggaatcagattaacactagagcagcggaaagctagcggtttttctattctacagttcctacagaagaacagcagaaactaacaaattaaaaatgatagattgcaaattgatcgtagttcaactggttatattttcttttgtagaactagtccagcccttatcccgatttaaattctagattgcgtacccatcgatagcgagacatctgtgacgatttcgtcaatctcaacgtatgccagcccaaacttttagaggtattcacatggttaagaagtatgtgtgtatttatgacgataagtgtacgtatattgtgagcgtttgtgcttatatcgcttttcaaaagaaaaattaatcgcagattagcaaaacagctagcttagcttccctacattgtgactagtgtcaaccaccttttcatgggccaaactctatctgcttagccgataagccccccctagctaagcacgtcacacctcggaggaccaagctctgaaaaagattgggaggatcaccacataacaatatgttacaaaaagctttgcccaaaagccaccgtgacctccccctccgtcgtaccactataatactccctcgccccgtcacctttctgctgcccctgccgacccccgccgtcggcctcgcgcccgcccgcccgcgtttacgttgccgacgccgcgaaaccggctgccggccgcttgatttttccgccgatcaaccacgcgcgcgccgcgctaacgtacgtacgaatgtacgatacgtcgcggagactactcgcggtggcggtgccctctctcaaaaaaatttttaaccgaaacaccggcgtggcacggtccaagccatgtgacgcgaggcgccgcagcgtgcgtacgcgcgcgcgtccaccagtcgcgccgcgcgcggttgggttttcgcgtggttttctctcgtgatcccgcggtgtttctagtggggcgttgtcccggtggtgatggtggtggtggtggttcaccaccgcgcgcccggatcgcgtgtttggtgatggtggaaatcacgtactcctactgtgtatgtgtacgcgtgccgcatgcggcgtcagtcgatcgaatcctgatgtgcgatgtgctttggtttgttggtttaattaatgggggagaatcttagtcaaacgacgacgagggggaggcggttaactttgtgggtaaggcgggagtgattaattaaacaaatcgccatcaaaccgacggtgcgaaaggcgcgattaattagaggcctaattaatacgccactactcaggagttagggaggtttggttgaggggtgtgtgtgtgtgtgtgtaacatggggatgtgactgtgctttggttagcttgttccatcaaggagttaagtgggtatagcttaatttgtatagttcgtattgtactccctccctccagtcctatattaatttcctttgtcgttgaagcattttactaggatgaataatgaaaatgctctgtagttggagagattaatactccctccatctatttttgataaacgtatttctaaaactaaataatttacttttaatagatatatttcaatccggccacatatcctcttaatgactttattggatttaatgtgtgactcttcattcttctacacaagattggctacatgggcatcgagaaatataaatattaatgaatcgtttgtttacgaggaataactagtagcatgtttagcgaaaaaggcttgtaacctagtggttacaagagcatcaatagcaccttatgtcctgggttagactccccataggagcgaatttttcaagatttaacggcattgtgctttcagtggtaggtgacatacccgtcgacagcgaggcgcctgcggtgacttcgtcaatcttcaggatttgctgcctcagtcttcgaatatactcataggggtaaggtttgcgtgcgtgcgttcataggggtgagtgtgcgtgtgttatgagcgcctgcgttgtactgtgtaattctaaaaaaactagtagcatgtttaaatggatgataagtagaattacttattcttcgtcattgtgccaagatgaaatatggctatcaaaagtagatgaaaggagtataatataaggcataaccacccataatccaaaaccaagaaataattaatatcacatcattgtcatgaaccaccctaactagtacaatacatgcaaccaatagaattaaaaatcttgtgagtgtacaatttaaaataataataatttagaggagagaacatgctaattaattatatgcatgcatgcacgtcttatattacgaaacaactttaaaaagtagtatttgtaccttatattttggaattgagggagtataaacattttggatgagtttactcttatatagttaatgaaaagttgttgtttctccaacgacatctctcctatgcttaaaatgtactccctccgtattttaatgtatgacgtcgttaatttttttaccaacatttgaccattcttcttatttaaaaattttatgcaaatataaaaatatttatgtcatgcttaaataacatttaataataaatcaagtcacaataaaataaataataattacataaattttttgaaacaaatgaatggttaaatattggtaaaaagtcaacagcatcgtacattaaaatacggagagactactacttaggccattcacaactcaatgactaggatagtgttcatagcattaaatagactgccacttaggatgaaaaataatgtggcaagtgaataaataaggaaagagaaggaaaccatgtcttgcatgagatatagtttctacacaacatccaaaatatcatgtgagataagtagcattaaatttaagtatggatagtggtgttcacattagaaaagtagtgtctagtactagtttcttgatgatgtggagtttatgaaaactatgtctagtgtttgggttgggaatggccttagtaaatggccttagtaaatagacaccttaaataatcactagtgagtaaataaggtaatgtttaaaacgacaggaaattaatacatatggaactggagcgaattactgtccttcacattcgtgctacttgtggagattatgggtaccccatacccatacggcatggttatccgactagtcataggggataacttatatctatggaatatgtaatagatcatgactcgggtattacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggtatgatgagacaacctgatcgtcagatcaatacacactcggcggattcaaatccccaaacaggagtagggtattacctctcattgagagggcctgaacctgtctaaatcctttgtctccgcatccatccacttttaggtctcgtacgctacccccttttattattgccgaaatcatgtttcgacagttggggcgccaggtaggggtgcgtcgagttcctcgtcgacaagtgtgatggaaccaatcttcggcatcgccggattcgtgaagcatgtctttttcgtcttggattcaattcagccgaagggattaatctcagcgatttcatcgattcaatctccaacttcattggataattttatcgtttcactagttaaattgatttctagctacagattaatctcctattactttctcttgtttttgcatgccgactgagatcaagaccaatggctgtcatcccggtgtgtcggcccaatacctcgtgttcctccatgcaccgtgtgcagatgccggtggcggtgtaacccgacatgggagcaacgtggaacggcagtgctcacggctcgcgcacgagatcgccagccaccaggagtaatccacatgcacatgtcgaccgatcgacatgcatgatctgggttcatccttttaatttaatctctgttagattagtttctaatcacagattgatattgtttttctaattcttcttttgcacgtccgcatatactactggcggctgagttgctctgatggacgctaactacctaacaagctgctgccgtgcaagacaaagcgctccgtctactcatcatgagtccaagtcgtaagccggccacgtcttcacgggaaccatgcgacatgctgatgcttccaggctttgaccagctgctacgtgcatgtgatttaatatggatatatatgtgctctcgccatgcatacctactccatgcacaggaaagctcaggccaggaaattacagctccctggaaagcatgcccgatgtgttgatccaatcaacacgcgtggattaaaattttttatcatgctatacattaaatagatgttttctagtatatgataagcatctatattttcctgttcactaacagagatctatatgtttgctttctttttgcatatgcgatggattcattgcaagagatcgatccggccgactctagcgcgactaatgggcaactcgccttaacgccgcctcatctgccgttcattggttttcgcctatacggttggttggtcacaccaccgtacatgggcgtctatgtcttcaccaacaggccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgttgttgggtgtctacatcttcaccgttggcttgccttcgttgccgtcgactggtgtttccgcttacacggctggcctattatgccgccgttagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaaatacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagaaagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccaaatccagatatgcataaaagggattcatggctttaagcttatctcttacgctccaggaatggatcagtcagaacatcaccaccggctcgcctcgaccgccgccgactggtgtttccgcctgcacggctggcctattatgccgccgttgttgggcgtctacgtcttcaccgaccggcttgccttcgccgccgccgactggtgtttccgcttgcacggctggcctttatgccgccgtagttgggcgtctacgtcttcaccgaccggcttgccttcgtcgccgccgactggtgtcctcgcctgcgcggctggcctattatgccgccgttgttgggcgcctacgtcttcaccgaccggcttgccttcgtcgccgccgaccgatgtcctcgcctgcacggctggcttttatgccgccgttgtgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgctgccgttgttgggcgtctacgtcttcaccggccggccgccgcatccgccgctgactggtgtcaccgcttgcacggctggcctgttataacgccaactgatgctatcttcttcacggctggctacatcgctgtcactactaataggcatcagtatcttcaacacaagctgcctacgtttgccatgactgccgactggtttcttcacttccatggctgcatgattctgccagtgttgattggccttaccatcttcatcgccggtcgtctcgtctgctgctaactagtgccctcgtctctacatctggtttatacagcctaccactactgatgaacatcatcgtcttccgtcgccgactagtgcttttattttcacaactgcgcgtcttcactaccagtttgcttctgttgccgacgactcgtgttcacttcatcacggcaacacaactttgtcatcatggtggagcgacttcatctttattatcttcggaaccagcaaactctattgctgctacttcacaagttttgctacatcaccaaccatgacgttgttgtgaatctcgacatctcggcatgcgatgccgtgttattttactacaacaagtggctctccaatattcaggatttctacttggacatcttcaacacatatcttcaatcaagcaatgactactcgacgacaagaagctataattctcgactctatgttcagttgtttcccaactaaccaaagagtcgggggctacacaaatataaggctcaaaatttgacaaattttatataagccaatgagtcaactccaggagtcattatcttcatctttgcttcggaacagacattctacttcatcaactctcctccaagtgaagcatctacgacagccataacattaatttgatggattattgtcactgacatcatcaccagcacctctgcttcatcggccctgacatctccgctgttgctaatggatgattatgttttcgccgacttattatttcaccttcacggttgacctactatgcaaatgctgatgagcgtctttgtcattatcattggttgctacactgctattggctggatcaccgacatcgtcttcttcatcatgtcggttgcgtttgtcgtcgtcaactattttcttcatcttcatgattggtggattttgtcatcacctttgatctacctcgtctgtcaccgactgattattttgctgccatggctacacaattttatcgctgggttccttcatcttcattgttagttgatctgtctgccgccgactggtttcttcgcctccatggctatgcgacttcattactttagattggtatcactatcttcactaccaccagtattgttgccacctctggtgggcaatattatctctatattggtcgtcttgtctatatgccaactgcgtcagctaccatcaatggacgattgtgaccacgacagaagggcaagctatatgc

SEQ ID NO: 54829 - DNA, 787 bp, Oryza sativa
acgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacacccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcctgttggtgaagacatagacgcccatgtacggtggtgtgaccaaccaaccgtataggcgaaaaccaatgaacggcagatgaggcggcgttaaggcgagttgcccattagtcgcgctagagtcggccggatcgatctcttgcaatgaatccatcgcatatgcaaaaagaaagcaaacatatagatctctgttagtgaacaggaaaatatagatgcttatcatatactagaaaacatctatttaatgtatagcatgataaaaaattttaatccacgcgtgttgattggatcaacacatcgggcatgctttccagggagctgtaatttcctggcctgagctttcctgtgcatggagtaggtatgcatggcgagagcacatatatatccatattaaatcacatgcagggctgcagga

SEQ ID NO: 54830 - DNA, 3065 bp, Oryza sativa
gcacctgtggcgcgccatgtgcgtcgcccgggggctcccccacgacgccgagtcgcggatgcgcgtcccggccaacatccggcagcgcgtccgcccgccgctcccgtcgccctacttcggcaacgccatcgtgcgcgacctcgtcacggtgcccgtccgcgacatcctgtcgcagccgctggggttcgtggcggagcggatcaagcacgcggtggcgcgcgtggacgacgcgttcgtccgctcggtgatcgacttcctggagctggagtccgagaaggggaaccaggcggcgcgcgggcagttcatgccggagacggacctgtgggtggtgagctggctcgggatgcccatctacgacgccgacttcgggtgggggcgcccggcgttcgtggcgccggcgcagatgttcggcagcggcacggcgtacgtgacgcaggcgccggacaaggacgacggcagcggcggcggcgtgtccgtgctgttcgcgctcgaaccggagtacatccagtgctttgagaaggccttctacggcacagagtgatatgatgcggcggcggcggcggtggccggagtttagagctggaggacatcgagcgacctgggatgcatgatgacgccgaggtggtgtcgacgtctgctgactctgtgtcatgctcaatacataacataatatgcgttatttgatttgcggtagaagtatttagtgtatgctggtactgtgcaacagtgcaagtgtaatgagctgctgccttgttggttgcagctctctctacacagacactttggtctgtcttaagttcgtatgtacaaaaaaaaaatcaaatggaaatgaaaatgactatggaagcaaagaaagttcgcaagcaaacggttggttatttgtagaataagcgaaacagcatatttgcaaatgaaaaataatttgtgaacaaaacttttatatacgtgttcttagcgatttaacttttatatacgtgttcttagcaatctaaaagtaaatattgaaaaataaacttcaataaaaaaaccttaaaatcagctctaaatttaagtttaaaaatttaaattttggctaataaacattagcctaagcgaaaagataaagccctatggtgcacggctcgaaaattcgatcaaaaccggacgaacttcgtgaatttcgttgtttccggcctgggacgaaagcacaatttcgtcagggagttcgaacacttttgagattttccaaatttgagaaggacaatgaaaaatggggaaaaagtcctaaaaacaatcatgtttttgtggtacagactggcaaaaaaaataataaactgcatttgcataaaaattgggggaaatcctgaaagtagtctcttttttttttcaagaaacctcaattgacgaaaataaaaaaagaagtttgcatttgcatattgggccgagaccatgaagcatgacagaccggttaggcctatattgagcctgtatgtttctctatttgtatgctctttctctcgcacgcagtctgttggcatctgaaatttcgctcatctagcttggaatttcgataactcaaccggattttgatgcgtgccaagtggacttctaggatttgaattcaaattttctttactcaatttatccaaaaactataaattttttgaatgactttcgtgattttcgtcatatcgccagcgtccggcatccacggcgtattcagtaatgtaaacctaggtggttactacgttaaccttaaggtgatcatattaatataggatgtatgtacgtatttatacgagtaaatatgcacatgcatatataagtgtgtttgtactatggttcgaaaaagaaaaaagtgtatttaattttatcctaactatttcattgggtcacttaatctttcaaagtatgttttagcttattttaccacaaaaccattgaaaatgattcattttacccattgataaaatttctcctttttaatttgtacagtttatattttaaggtaatttttttacaaccattgataatgtcattatcaaaattttaatagtgaatcatttttaatagtgtactgtaaggtgcaaaaagactgaaaaatagttaaggaggtaggttaaatacttaaatgctttgacgaaatagttagaatatttctttttcgttactggacattgatttggccctcgtccgtgtgactggcgcacacgccgtggcgtgctcacgtctcaccctccacgcgaccacgccgcgcccacctatggcacttggcgcgccacctctggcatttggggggtgagttttgtgatacgcgccacgtgttttaggttgtgtctggttgggcttttcaatctgcttttgcttttgcaaaagccaaaaacaaatcaaagggctaaaagccacaattgcttttgctccaaagctgcttttagtgtagtataaatccaaaagtagtccctacccctgctttcattggcttttgagagaaaaaattacccacctatgccattatgaaaaaacgattcgcactttttctttctttcccgttccccttctcgccagaccgagcgcctggccattcgcagttcgacgcggcactagggtttgcgccaccgccaccgcgcgccacccatgttcccgccgccagcgtgctcccgtcgtcgcgagccgcgtctcccggcgctggcatgctccgacgcccgtctccccattgcccgcccccacgccacccaacgccgccccaggctgcccgatggccgacggctgtctccctgtcgctcgcccggtggccgtctccccgtcgcccacccgacgccgccccacgccgcgccgaagccacctctgctcgacgctgcttgaagacacccctgctcgacgccgcccgacgctgcttcgatgcctttgccactgctctaaccggtttgaaaggtgaggccgaatcgcccctgcccctgctcttgtgttgatgcatgagtcgcccctagaatattacagcaaattgatacttggcctgcaaattgattgaagaaaaaggtatttggttcatgaatgggtgacaaggcagattggggtgatgattttat

SEQ ID NO: 54831 - DNA, 30075 bp, Oryza sativa
  unsure (1)..(30075): unsure at all n locations
aattgaagaggaggatagttattttgagatatggcatcattgtatgaatgctctgtttatgtggaccatatcactttgatggatgaaaaactaatatattttgatgaaaaacttatacattttttctacaaattggccttttaaatacaaaatattgaacatattaggttaggtttgtacgagtaatttgcatataaacagtcctttcttatacaacttacagtttcacagctgctctaaccaaacgggcttctgcttttcccacagtttattttacacagctgcttttccacagcccacagatcacaacagcttttccaaaagccacaactctaccaaacacacccttaggctatgtgaaaatttttgccgcgttacatcagatatacagacacatatttaaagtattaaatatagtctaataataaaataaattacagaatccgtctataaaactacgagatgaatttattaagtctaattaatccgttattaaaaaaatatttactgtagcgttatattgctaaatcatgaagcaattagacttaaaagattcgtctcgcaatttatacgtaatctaactaattaattttttctgtatatatttaatactttatatatatatatatatatatatatatatatatatatatatatatatatatatatatatatatatatatatatgtccaaatatttcactcattttatttcgtgagacagggtgaaaaaattatcagctctccgtctgcccagagatatccgcactcgccttttctgactgctgttccctgaatgcacgtcgcatcaagtcaggagaggcattgaacaggagatagaaaagcccacaagttctcttcgagaaagagaagtattagttttggacaatttttaagttaaccttagaaatataaatcataaataacttttaaattattaagtttaaaaatataaaaattatatgaatagatttgtcttgaaaaatacttttaaaaaaatatacatatatcacttttcaataaatatttttataaaaaaagtcaaagttgtgttttgaaaaccgtatctctatccaaaacaatttcttttataagtacggagcgagtactcccgcatcatctgcagaatttttacgacggttaatttatttttcataagaacggaagtacggaacaaaacacccgcatttcacccgcatttcttaagatgatgataggtgtcgggtgaaaatctgatctgcacactagattagctactaattacacacttcgccattgtgttcggtaagactagaaattattaagaaaaataaaataaattttaccccgttaaattgagtagcttaaatcatacaagtattagttgcatacaagtataattatacaagtattaccccgttaaatggagtagatgcacagtattagttgcatacaagtataattgtacatataaaaacaaaagatcaaatttataatatgaaattcactcctaaatttaatattaatatataaagctgtatataaaattcagctcacgtaagattgcattgaaaaatcccctagtttggactttggactaacacggtagaaaacgatcatgctctttagcttatcagctgcaaccaaaatttaaattttaaatcttaattttgattattttaatcgtagttttttttcaaccattatttttataaatctcgaatcgatataaaagaaaattgaggactgctacaaaacaggatcccgttgcaacgggatagacatattaactattctcttgtacgagtatcacaggtattaggtcctaggtatcacaagtaccgggtaagaggtatcacagatatcaggtaccatgtagctggtaccaaaacaggtatcatactgtcttatagatgatatcctgttacaacatgataccgttgtttgaagaaaattacccacacattatttttctcgcaaatcatcgcttctgaagatcacacaacggaagtccggaacccacgcccaaatcaaaaagaagcggacgccccccaaaaagttcaaaactttccaaaacatcgtgtgcgcggctgcatcgccgcccacccgcctcatcgcattcacaactctcgcctaaaaggctaaaacccttcctccgccggccgaacccgtctggattcgccaatggagttcccccgccgcggccaatcctcccatcccgccgacgccgacgacgacgaccgccgccgcctccgcttccctgactccaccccgccgagcggtaaccaatcccaactcccaaaccctcggtattcccccaaattcgttgtgcgatttttttatttttatttttggctacgaatcgcattatctctgttgcaaatgatgatctggtggtagattggtagtgaatgatgctaagatttgttttcatgatgcagtagttgtaagcggggttagtgattttattttttattttttattttttattttttattttgattttgatggtgttgtgttcatgggcaaaggacgcgaagctaggccggctccggcgcagggggacgcggtgacggcggcgctggggcggcggagggaggagctgctgtgggagctccacaagacgaagatccaccgggagatgctcctgtgccagctggtcgagacggagcgcgccatggcggcgcgcctcgccgcggcccgcggccaccccgccacgccaccgctcccgtggccgcagggcgacctgctcccggcgcgggagtacgcgtggcggagcacgccgtgggaggagcaggcgaacgcgaacgcgaacgcgcacgcgcacggtgccctctcggcgccgcgctctggtgacgaggagatcaccccgtggtggcgccggagcccgtcggcagtgacacccccggtgtacccgcacgtggagcgctctccgtcgccgccgattgcgcggggatggccggccgacgatgacgagcggcaggaacgtggggagccatccgggtcgccggcgatggctcctccggtgcggcatgcacctcatgtcgaacagtccacaccagtgccgatcaagtcgcctgcggcggaggccgtttgtatgccatctgggtcaccggcgatggctcctccagtgcagcctgctcctcatgtcgagcagtccacaccattgccggccaaggagcctgcggcggtggcgaaggtggaggcagatgccattgtccagactgcggccaatgctgatgccgaccaggcgttgctcggcaagggggcgacaccaggagggcaaggttgcactggtcagaagggtgaggaaggtgatttcgccatcgacggccatggcaggcagctgttgggtgagatgaatgtaagcaagagcaccgagcagccaaaacctacagaatccatctctggaggccacaccgatgaacttgtccagaagcgttatcaagataataagccggcagatcaggagattgcaacattggacaagcagaagcgagtaggttccaatgatgaggtgattcgcttccgttactgttgttccccagtttttgctgccttttcatgtttacctatcaagaatgctgttcagattatgtttgcatgtgcccatactccatattgccatactgtgccacacttgtacagtgtacacttgcgctatatatttctttgtatcgacctttcaccagcatcttagcttgtttacaaatccataggcacttataggaatcaaggcccatttatgtgggattttagcttacaatatcaagttcaagaatgatctactagcattttacttgcagatcaggaattgtgtgtggagagctagaaaaactatatcagttttcgttgtgtttacttgtacgggcagattgaggtaagcaaccgaacaggtggaaatttaaaggtgtaggataaaatgtctattcaaaatcagcaagtttcatctttaatgttgcagtgtacaatttatagtagtattagtatatatttagttagttaaactgtaggattaccatcgttcacacatctggccttatttatcactttacctatctgagataagatatttgagatgatactgttgtgttgatgctctataacaaacttgctctggaacagcttacaccagaaaggagatcctctggtgtgaagaggcagctggcttcaggaacctcactggcaaagaagccgaggtcccaggggagctccatcacttgctccctctgcaaggtcaccatgacttctcccagggcgctggttgagcaccgggcatccctcctgcaccggtctaacctcgcgccattgcgatcggggaacaaggccaccactgaagctgcgcagcccgcggagaagaagaccgagaagccagaggcatctgaatggaacagcagtgcacaccaccaccagaatcggatgtactactgcgatatatgcgaagtgaggtgcagcagcgagaagatgatggcgtcgcatctcgccgggaagaggcacagggagcggcacaactccattttcatgtaatgatgatgggacacagtacaagcttgccgctttgccgcagacctgcagcagtgcaaaaaataccattttgtttgaaggaaagattgtttaggccatgtttgtttaggtttatacgatcggtttatgagaagtttaagtctaaacaaacaaatcaatttattggttcggcttttttaagccataagaaaaaactacatgtcacagtagttttttgggattatggaaagtgtattttttactcgaccattaaactcaggcttcgaagtcactgtcttacaaaaacatcctccattcaaaagagttggcttaaaagctagtaaacctaaacaaaggctctgtttggatccggaatcttgctatttagtagtattatacgtagattactgacaaaacccattccataacccctaggctattttgtgagacgaatctaacgaggtatattaatccatgatttgctacagtgatgctacagtaattagccgctaatcatggattaatatacataattagattcatctagcaaaatagcctaggggttatggaatcgattttgtcgttaatctatgtttaataattctaaatagcaagattccagagggatatttaatagcatagaggatccaaacaaggccaaaaagggttttaacttttaacctgatgcttataagtcatgattggtgaaaatatttggggtaaagcttctgtactttatactatagtgtattctgcttattaaaaaaacaatctttccttctattcttagtggtgcaaaagttcagattaaaaaataccaagcaatgagaaaaactctaaaaattaagttgtatgaggttgaaggataaattttgcagaactacggagattttggcatgcgggcgtacagcacgtaacctaggtattttgatgctacaattttacaaaacctcatcctaagcaaatctgtttttagataattgaatgaaatatctcggcctttgctcaagagctacatctaattattataaggttaacacaaaagcaaactcacacaaggagtatgtagtcaaagttaaaaactaaaagtagaagcaaattaataaaaaccaaacaagataaagacctcacaactactaattctatcaactattgattctattggtgaatcttcacccgaatttggcaaatagctacatgattatcgactcaagtttacgacatgcatcttttgttagcttgatatgattctaagcaaatcttagcataagttatcttagcaaaaatttatatacaaaagttgttttaaaaaaccatattaatctatttttcaaaaaaaaatagttaatacttaatttaaatgcaatagtgcttcgttttgcttgccggggaggaggggttcctcctcccgaacgcatcctctaagtatataggatttgctcaaacatttcaaatttagttacggcctctaggccatcctccaaggcaccttgctacagttttagctctttttggacaacggattattatctaggattatttgttttacacatgtaaatttatgttttctaaaaaaaacttagggaccctttaaatcgtagaattgaaaaaacgtaggaatagaaaaaaaacgtaggattttaatagaaatgtaagtataaaacagatgattgcaaaaacacaggaatgaccgtttgattggaccacaggaaaaacgcaggaattagaagagagataaagactcgacggaaagtttccatgaggttctacctcaagttagaattcctctaaaacttgcatggagtattaagcattccataggaatttcattggattttatagcatctattcatttgattcaaagggctatataggaaaaattcctatagaaatgagatcctctaaaatttatatgaatttcatttgaatgaaatgggcccttaacttttctcttttgcattgtccacatgtagactatgtagtactccttacatctacttttgatagtcattttatcttgacacacagaccaatgataaataattctacttatcattcatttaaatatgttactactcattcatcgtaaacaagcaattcattaatatttacatttttcaatgtccatatagccaatcatgtgtggaagaatggagagtcacgcattaaatccgaaaaagtcattaagggaatagtttgttggattgaaatatttctatcaaaaataaaatttttagatttaaaaatataactatcaaaaaatagatagagagagtacaaaagtttgaccggtatccccgccgcttcattgaaagcaaccacctctagttcttcccagtgtcttaattaccggccacgtattcgaagatttccaatgcggatatcgctagcactagtaatttgaccgacgctactagtgctagtactggagtagtatgaaacagtgaaccagccgtaatctccaatgtggagtattcgctttccctattacgatgagtctgaattaaacgacaattatttcctttttgcacgttaatgtgacgcttcgtttttcctttgcctctaagcaaatcattgcaaacgcgacgagtgtgtgagaaactgagaacaaatcagccattaatctctatatcattagctggtcacgcggcccaattgattcctataaaagccgccccactcaccattctgcttctgcgctctgctttttctctgctcttctcgatttctccggtgcaccgctcctctgatcggccgatggacttcgccgacgctccgtcgcacggtatgcatcgacgaagctctctagtctatcaacatcttctactgtcgtctccatggccgtttctttgctggaaaattggagcttagaaccgaacgatgtatagtaaaacgctagtaaaaacagatgaccctttccgtgtcccttggttgtttagattatcagatgcgatgcgatttgatcttacgttttttcatgccatgaatccactttgcatgcatggcagataaaaatgtcgatttcaaaacggatataccctatacaggtaattagcacagatctgcttgtgtgacagatagattctgatgcagaaaagtttcatcaaaactgtttgtttcttatttcgttacaaaaacagagaagaaacatgtccatcttggatcggcactcgatagacttctgcgtttaagccttgttagttgtagtttaggcactagacatgttgctcgtgcttaatcaatcacgaagaacatcatcatcaacaatggctggtgcatatacttgcaggagactcgctggtggtggtgagggacgcgctgctgtcgcagctccagcaggatcgcctccggaaggacatcatcgtcgccgagctcgccaagatagagcgcgccatggctctgcgcgatgtctcgcagtcgccgacgccccggcacgccgccgccgccgccgccgccggaaagactattacaactgtggtgagaaacttgtatatgccatcatgtttttgagtcatatccatgacccatcaattttgtgtctctacatgtatcagagtattgttaagaaaacaaacctgttcgatcagtctatacttcgtctttgttcttttcaatttcaaggtagtcaacacattaatgtagttctttcagactcagtaatactggggttaattagtgtgcacttgcactagctagctaatttacttgtattttcgtaattggtctcaacttcattttctaatggtttactgaaactgcatatcaagcaggctacaccggccaagaaaccatcgccttcagagaaatctgaaccggcagttcagaagtcgatgccaccctcggcatggagctgcgccgtgtgccaggttcgaacaaccagcgagcgcaacctacgtgatcactgcggaggtcagaagcaccagtccaaagtcgcagcactggagaagacaaccaaggccatggcgagaacgacggcgaaaccttctcccggtgcagcagcaagatggggctgcagcatctgcaacatcagctgcaacggcgagtgcgatttcgatacccacctgaaggggaagaagcatcaagcgaacacccaggccttactggaacaaaacaagaagagctcagtgaatccagagtcacagggaaccaaggcggcggcagcaacactgatctgcagagtttgccaagctaagttcacctgtcagtcagacttgcagagccatctcaaggtcatgaagcaccagctgaatctccgggcaccatcttcagatggctctagcttcaccagtgcaacctcggagagtttgagtttggaattgtattcttgcaaggtttgcagcgtgaagtgcaccttcgagaggatgctcgcgtaccatctcactgggaagaagcacctgaaacaggagaatttgcagttgtcctgcgagatctgcaaactgcagtgcaacagcgagaaagtgctctctgaccatcgttatgggaagaagcaccaggcgaagctcgagaaagtgcttcaggcaaagctcaatgcgacggaatgagatgcgtctgattctgattaaagatgctggcgttttgacttttgagcaacgaacatttaaattatcgacggcactgtatgattatttcagattattaatccttgattttgggacttactgctgctgcttcttttcaattgcttctatatactagtacaaaaataatctatacggtttaaaatgccactaatactacttgtgcaaatcaatactcaaatatcgactgtactcttgctcaaagacgcgagtatgtgccctcttgaattattttacaagtgaatggtaccaacaaaaacatcgatttaattatttaaacaggacacaatcacaatgtttccaaaaggacaaaaaagcacaatctgagtgacataagcctactccctttgtcctgaaaaaaacgaatataggactagatgtgatacattctagtacaataaatctgaacagagatatgtctaaattcgtagtactagcatatgtcatattcagtactaggttggttttttatgggacggagagagtagtcaaaatctgagtggatattttatcatatcacattgttacatcgaacttgccttgaggcatgtaaaaactaaatgatatgccagtttatgcaacaggggtgtaactcgatgaatgagtatccttaactcgtatctttatgctgctctccactaatagttctatggagtatcattccatacaaacaatacaaaattctcactccatgcaaaaaatataaggtgcattaattttacttttttttttggacaagactttacccatgattactttattaaagtagagccctatatatattaaagtagacaagacttcaccttatctcatctctatggttctcatggacaaactctcaatagcaagcctgcatagttcatctcaggttattagagcaagtttaatagtatagcccactactagctccaattcatctataatcgatctaatagccaattcatacgatagttgcttactatactattgatatattgttccacctgtcatatacacattgcgtcttggagtccgtgctgcaaccaactacagatctgtagcctgctgcttttctctctcactattatctcactaaaatatatttatagttggctaatagcctgctattgtacctgctcttatgcggcatatttgcaatcaaagtgaaactattatacgggtatcagaagttgtgcattgcatgattaaaagggtagtttttttctaagcatctatacttatggcctcacatttttcaaaaaaaaaaagcctcacattgttaatttagtacttacctccctccatccctagaatactactccaaaaagtattgttttgagcctaaaaaatttatcccttaaaaaatctttttagaatgaagtccagtagacatctttaatactacttcatcccctcttagtttttcgaatgatgttttagaatgcacgccccccttcttagtctaaaatttcatctcgcaaaacatatcttttaggttggggtccattaaatcttttaaatatcactccatttgttcctaaaaataaatgtagttttagagtgttccactgtaccctttttagggcccctttgaatcgtaggaatgaaaaaacagaggaatagaaaaaacacaggattctgacaggaatacaattgtaaaacagaggattgcaaaatacaggaaaaacgcaggaatgaccgtttgattagaccacaggaaaaacgcaggaatcagatgagagggatagactcagaggaaatattccaagaggttagacctcttgctaactttcctccaaaatgtgcatagaattactcattccataggaattttaaaggattggataggattcaatcctttgtttaaaatgccttcattggattttttttccatagaattaaaatcctctaaaattcctacattttttctacaaatcaaaggggacctaatattactctttttttacttccatttttagtcattgaaccaatagtactcgcccctctttcttgatttcctttcccactaagtttccctgcatcatgcgaacgtaggtccgcaggtgtgcgtgagaactgagaacaaagcagcctttttaggctgtgtttttttaggggttgggaaccccttcccttcacacagaaatggaacgatagattaacacgtgattaattaagtgctagctataaaaaaactttaaaaaataattaatatgattttttaaagcaactttcatatataaactttttttcaaaacgtgtaccgtttaacagtttgaaaaaaacgtgcacgatagagatgggttgagaacccataaaaaagaacacagcttattcaccaccattgttggttggtttcgcggcccggttagcatcgagtgccctataaaaggaataagttcactttgactatcttaattagtgatcgaatattatcgtttgatatctcgactctcaaactattaaaatcagtgtaatttgacttccccagtggttttggaggacggttttactgatatggtagtattggtgtggcgcttaggcggtattaaaattgaagatatatatatatatagacccatttgtcattcattagaaaaatgtgagggccacttttctccctctcattcggaaacttttcacactagttaagggagtaaatctgaacttattcctctactaaaaaaactactctatctcccaacgctttgctttttgcgctctgctttgctagctcgctttctccggtgacccggtcggtgcgctgctctgctccggtcctcatctgatcggccgatggagtttcccaccgccggtggtagccgcttcgccgacggtacgcatcgaagctctctttctctctgccctctctacctagccttcctaggacaggatctgtggtcgaaagggtgatccgtttcgtatctctttggttcagataatcagatcgtgttttgatgtcaagaactctccatcctgcattcattacagttagattgcaaactagatgcatcatacatgtcaaatagcacaaatctgataataggacttctcaaagactgttgtctgttcatctggaagtggatttttgtctcttaagaagacatccccttattttatgcatggcattcaaaaagtattaaaaaatttgttaagatagattaatatatgatatatcttttcgcaaatatgcgagttaaaatttaacttatacaattcgaaacaaaaataataatttgagcatgaattgctattcatagtcaaatttgttatttttgtttctatttgtataagttgaatttgaatttgcatgtttgtgaagtgatatatcacatattgatctatcctactaaattttttcaaattttttgatggcttttccccttaggggatgatttgagttttcctgttcatcttttcgttaagataaaaacaaatgaaacttgttcatcttagataggaacctgacctgacagcgattaggccttgctagttctagtttaggtgtggaataattccaatgttgcgtgtgcttgaccaccaaggacacatgaacaacaacaatggatttgtgcaagcagtagcaggagacccgttggcggtggtgagggacgcgctgctgtcgcagctccagcatgatcgtcttcgtcaggagatcatcgtcgccgagctcgccaagatagagcgcgccatggctctgcgcgatgcctcgccgtcgccgtcaccgagccccggcacgccgctggaaagactgcggcaagtcaggtgagaaacctatgtacctgtatgcttctgactaacctttttttcttcttctcacattatgatattcagatatgatcatatatattccatccattttgcgtctctctgcatttgtaaatttgttcatacttcagcatactgttaagaaagttagctccttgtaaggcagatacttgtttgctcggtcagtactttgctaattttcttttcagttgtaaggtaaagaattaaaccatatgtaaggttgatgtaaggttgatgtagttctcccaaactcaaccatatgtatgtggcattagtacggtttgatctattggactaagtaatactccaatttacttcaatttcgcagtttcctttcgtaattgtttactcaaactgcttattaaacagacatggagctgcgccgtgtgcgaggtgcaaacaagcagcgaacgcaacctacgggatcattatggagggcagaagcaccagtcgaaagtggcaggattggagttgaaggcgaagacggcgacagtgaaaacgacggcgaagccttctcctgttgcagggcagagagcacacgctgccagatggagctgcagcgtttgccaggtacactgcaatggcgaatggcatttcgatacccacctgaagggcaagaggcaccaagcaaatacccaagccctgctggaacaaagcaacaagaattcagggaattcagaatcacacgatggaaccaaggcgcaaccgagcaatgtgagccatcacgccgagaagaagaagaggaagaagaagaaggaggaggaggaggaggcgacatggatctgcagagcttgccaagctgtctgtacctgtgaatcagacttgcagaaccaccttaggggcaggaggcatcagctgaaagttcaggccttgcctgaagctgcgaaacaagagaagaacaatcctcccaagcttgcaaagaaccctaataagcaaccctcggaatgggtttgcagtctctgccaggccaaatgtaacactgaatctcagcttgagcatcaccgcagaagcacgaggcaccagcagaaggtagaatctcttggatggaatgcgaaagagagtgacctggggactctgcaaggaatgtcttcggatggctctagcagcaagagtgtaaaaatctcagcgacgatggataaacagaaggctacgtatttttgcgaggtttgcagtttgaagtgcaccagccagagaatgctggcggatcatcttagtgggaagaaacacattaaacagttggagttgcagctattcagctaaggtctgtaatttagctaaggtttgtaatttgcagtgcacacacagctagaaaatgcttgctcatcatcgtgaccaggaaaagctcaatgcaaagaaataaaatgttgcagcagatatgagagttttgaagcaatggcgttatgatcaacggtcatttaaattacgcgatggcattgtatgaatgtgaattgaattattaatcattaatttcaggacttaccgctgatgttttccttttgcttacaatacaacttgcttgatattcataattcatttcacatgttacaatatgatatacatgtcaaaatgccaggatgccagtctgctgcagttgccatttcagaagtaaatggtaacaacaaacaaaaaacattgatttgtcaccatgtttccaaaggatgcagcagaacacaatccagacaaatgcagtcaatgtgcgtcagttcaaaatctgggtggatatttcataacatcacatcatcagatcgagcttgcattaaggcatgtctaactaagactcttgtgatatacaaagcactgcaaaatatttcagaaaaaaataagcagagtgcagttaatcatctgagaaggatgttatttcatagccacatctatggaaggactagaccttcaacgctacacggtcttgccatgaaacactcctcttatcatcgcttgccggagagtttccggtatccctacaagctgataggttgacatcggcagtcataatatcttcatctactccagcctgttcagcctttttaagttccaaatggttatggtgccccgggaaatcagaaagctcatcattctgtagttacagaaaaccacaatgttagttgtcagaaatagattacgttttgtcagatatccataacactccaaaaaaaagttacataccattgcagaatcttgatttaaatctaaatctgttcttttactggtagatggcacttcagtactcgccccataaaaagctgaagcatcattgattcccacatgagatgggactcgcggagctttcttcttcagccgtacttgctgcgaatcattcttcttgaaagaatttaacttcttttgtaagaaccttacaaacaaaacagtttccatgattagttgaagaggataaaagggtcaatactactactactatttatgatagaattcacatagcttgcttcgttaacatcaattgagtagatagatgggaacatggagggacaagaaagaaacggaagtgctgtcatacttgacttcagaaagcaggacgagctttcgcttgtttatgctctctagcttcctcctcttcatctcattatcctgcatcaagaaccgctatcagattcaagtccaatgtagtgcaagtgtatatatgcagtatcaatgtgaccatgtcatcatcccatgctacaaccataaccaattcttgacagccctagtttcgcactaacatcagctatgcaatcaatcctagtttcacactaacatcagctatgcaatcaaccctagtttcgcactgacatcagctatgcaatcaacccctggactcctgcaatcaagcggagcagagtactaggagatatcatatgcaatacaaaattgcaaccgcagcgaattagtagttcagacaaggaggtgaacaaggagattcatcggcgaaaccgcgccgcaaagggcaagggaaaccagagggggcaaacccttcaccttgagcacatcgcggtagtcccgccggagctcgtccaacctgtccctctcgcccctctccgccgccggaggcggaggcggaggcggagcgagcctcttcttccccttcctcctcaccagccgcacctccccgtcgccgtagtccatctcgtgaggaggacgagggcgagaggggagggggggctaggctagatccagacgggggaggcgagggcgaggaggagggaagaccgagggccgcgtggtggtgtgaggggatcaggaattcaggagggggtcagtcaggccacggggaggggagaggttggggagaggaggagatggggatagcgaggaggaggaggagcgcgtnctccctcctctccatatccgatccaatccgatgcggtcgcggccgcgtcgtcttcgcctcngagaggtgggcgggggcggtggcggagcgaagcgctggtcctgggtgggtggatgcgtgcgtgcaggcgggcgaaagcgccacttcttttttttccgccgtagatatccatgaccatccatccgttggacgcggttgatggctgtggtctgtgcggctgtgcccccatgcgactggagttgagctgtgcttgtgttgtgcttgcgtgattggctgggggcggatgtcatgtttgtcttcctccttggtgtccatggttttggccttcgggggcatttttttttttttgacttttgcttcagcaaaatttgtttgggtttaccaaatgttccttttttactcttatatagtaatccctctgtactcataaagaaagtcgtttaggacaacgtttaagtcaaaccttgggaatataaatcataaataactctcaagctgttgagtttgaaaatataaaaattatatgtatagatttgtcttgaaaaatactttcataaaagtataaatatatcacttttcaataaatatttttatagaaacaagaagtcaaagttgtgttttgaaaaccgtgtcgctgtcctaaacgacttactttataagtatggaaggagtatatacataaaagaaaattatgatgatttttctcccttatactatgttaatatagtacatttttatctcccttatgattcatgaaaattttgcctatgctagttttgtttatatgttttccacgatatttatgatttgtccctctatgtttggggtgactttttaactacccaagttcaccatggtatatttatatattttaccgtgttgaactgtttgacatttagaatgtaaacttgcatttttactactaaaggaattgacattttaatacactggtactttgatacaccctcatcaagtattctaactcggaagagggattttacgatgtttgcgagttacaaggaggtggggcgacgtgagccgttgatctgcgaggggcaaggtatggaaagaaaatattgtaataggtggcattaatgtaaatatgatgatattagaatgacaaatgtgtcttttacacatatgaaaaggtatgagaaggtatcgaaggaattagcttgtagcctgttgcgttgcatcgttcttagatacgttctgttcgtacgtaaggtttatgtgttcttcgataagttgaaaggtggagaattgagggccagcggtggacttgtggccggaggcggtggttggagggaggggcggcggaggaagaggacccggaggaagtggtccaggactgcctatgttcgccggagctagaagcggccgcacggtctcgatctgtcagacgattggtttagttttttttcgcaaatcttcctcattgaacttgttttgttcttgttaggttcttaaatcttctcaatttgttgtcctttcgatctttgattacattcatcaaaagatggatcaccaaattgctatgtaaattaatgactaactggaaataattatcaagatcatgcgaatatgatatgtaccacgtaaatcggaccaaagtttggaaaccgacacaaacagaacgaccgaagattggaaaccgaatagaagagaatgtaatttttgtccccaccacgtaaatcatattttacgttacctttaaaaactacttacgcggtaccttgtggtaccttcaaatccacttacaccatacctttcggtacgtccatacgttgttaaacataattgccctgttatcaattaccttttaatccatagtacctttctacctctgatacctttcataaggtacctttcatcgtgagccgttagatctatgccattttaggaatgcaaacactgtaaaaggtctcaactcagaaacgggaggcctacgggaggggctaaacatactagggaggactatgccaacataagctcattatttcgcataggaaaaagtacgaattacccccctgaagtattaggtgagtacgaattacccccttaaacctgaaaaccagtcatttttcaccctcaactatcgatatcggacgaaaaacccccctaagcagctttgcaagcggttttggtctacgtggcagtccagtcagcaattattttctttttaaatcagtgggccccacatgtcagtctctcaccctcttttttacccctcacctctctgtctctctccaaaatccactctcttcttcctccctcacctcgatgatgacggcgggcagagcacgaggcgacgaagggggcgatggagctcgggacgatggcgggcggcggcgaagagggcgcccgcggaggggatgcggcaagcgcgccgagagggaggaggcgggcgcttctctcctctcccccgccgccgcgctgcgcggcactcctctccgtgaacgagctcgtgcgcgaggggcataggaaggccgagagatgaggaggccggactccctcgcgaccgccgtctctagccagatcccagcgagcaggcgtcggggaagggtagtggggcacggcggtcgtcgtcgggccagaggtggtcatcgcagcaacgagtatggctgggcttgtcgtactccggcgggagtggctcaaacgacgacgacggcggaggaggaggcgcccactcagcccgctccctggcctcctcacctctccctccctcctcagcctgctccctagcctcctcacctcttccctctacgcccaccccactattgccagcatgcttcggccgccgccgctccgcccgccccgctctgccaccgctgcttcgccccgctccttctcccgcttctagtcagcggcgaagttgccaagcagctggtgggaggtcacggagccatccatggtgaggtagagatcgtcggtgcatgccgcgagctccttctgtgtgcggtaggtgaagttgagcgcggcggtgacctccttctcgaagcgggagaaggggctcgtagtgtcgtcgagacgcagcttgcggagcttgcagaggctttccccgagctccatcatggcaccacggtggttctgtgtttgtgcacgatcatgtgtctaatcacaatttttactggtggagtaataattaatatgcatagttaaatgtggaaatgagacgatgaaaatatacttggttgaagaggtggtggaagccgacggcgcactggaggatgcgtggagcagccggcagcgtccgggtgggctcgtcggtggtgtaccagagctcctccacgacatcgtggcgcgcgtggaactcgccgccgttgaacagcgccaccgccaagtcgaagctcccacatatgatttccgacgactcccaccgaagcagcggaggaggcgcccgctgctgccggcgcgcgagccgcagccgccggcatcggcgctcgctgctgtcggcgctcgagccgcagccgccggtatctaacgggagtgagagagggggtgagagggaaaaagatagagagaagattatatctgacaggtgggccctatcctttatttaataaaaaacttactgactggactgccacatagaccaaaaccgcttataaagctgctcgagggggggtttcatccggtatcgatagttcaaggtgaaaaataactggttttcaggtttaggggggtaattcgtactcacccaatacttcagggggtaattcgtactttttcctttcgcatactagctctgttcctttttacattatttatcagattattaaaatgaatcatttgctcaatgctttaaaaactttgttcgatcgtattattttaatctcttgtttatagatatatgttaggttaattttgtttagaaaaaaatatctctataatcaagtagataattcgctcaacaaattaaccaaatggggcctagaccaaacattatagtttaaaacagtttcatatgaaaacataggtgaataatgcaaaatacatagcaagatagcaaaagagaagggactctgttgtccccatagttgatccggcatggaggagaggtggaggagagaacgaggaggattatcttgtccgcgagaagaggaagaggatccgatgatgcgaagattaggccggaatccctgtgtcccaacccaacagtgggtatacggtctaaaatttgagtagccgagaacatactactaacactttaaataaattgagtgatataaattacaaatgttctttttatgtgttattcgtaatgattggaccaacactttggggttgctccttcagcttcgacgatattactttaccttatctgtcaggcatggcctaataatctatttactccaacggccatagagaggaggggctttctgcctattgtatgggacatacaacctctgttgacgtttttgcatctatacaggatacaccaatagatggtagtagagagtgtttgctgtgttttgagtagatggtagtagagagtgtttgctatgttttgaggatatgacgagggtgtatgtgatgttactgtcctatgaccacgtttttcactattgcaatgagttagggatagtgaatttaggaaaagataatttttccactattgcagtgtgttagggatagtgaacttaggaaaagatagttcggggctaaacatactaggattgtatcattatttctcatactagacaggcattatagcttaaagcaatttcacataaaaacatagagaactgcaaaatgcatcacaagatagggaaaaaagaagggagctccactggtcagagggctagggggcttgagcccccttgccatactactaaaagtaattcattttacttctagggaataataaccgcatccgggatgattttttgtccgtcattgtcatcatctgctatgcgattttttttcttcaagcaaaacatactaaactctagggtcctcttggctcgatatgaagcagatttggtccgattattggaaaaacgagaagagaggaagataaggatagaaaccctcaatcaattttggattatctccaaggttgcattcaaattttacaaaggagaggcgttaggcagctgagggactctgtgacattgtagcgatggccctacgtgacaatgacaggagcaaggggagtccgattagacttttgattgcttgatgggccggatgtgcgattgcgggctgaggcggaggggaggagaagggaggaaagcgggccagctcgctgcagactgaggaaggaaatgggatcaaaatggtctagatagaaaggagggtttgatttttatttaaataaatattgaaatggtgtttgtattattaaaattagcaattgacctacaaaaattccgagaaaattttagagagtgtaattaatcatggataatttaataaaattaaacccaaccatgtaattttatttctcacacatactttactttacttgtaaattaatttaattctagaccttcctacttagaaatacccaagtattcccaaaacaatgtattttaattaattaaataatgtaaatgtttatcgattttttctaaattttctcgtattttcttcccgttgcaacgcatagacaatttttctagtcttttataaaatacaagattatttagagaccatgtttttacattagttgagacgaaaatgatcttactcaaaaatattcttcttattactattctttccattttttcaccctcatgcaaccatgtttccatattatataggctaagagtcgttgttgagctgttgttacccatagcaccgatgttttgtctctcatctttcgctctttcatgtcaacgaatattcctaattaacaacgccaagagtccgctattaacaaccattgtacatgccgttgcgctgatctcgctttcttgtgattctctgttatctttctgttttaagatcgtgattttctagggtaacaaactctcttttctccttaaaattcaaaggtgtctttccctttagctaaaaggaggtttgcatttctaactgaacattggtgcattttgtgaagcttgttatttatatatttgtaacagcttatgctctttgagacatgtcattgtggatgcctctgttatgatgcgtttgttgttcggcatcgaactaaataagctgttgagtgttgttcattcgtttggtgtggtattatccgtatgtggaagttgttatgatgcgtattgcttctgtataacgagcagcactcttttcatgtcatgatgactgacattacacacccttcatataaagccatatatatcttttattctccaggtgtgttgtattccttcaatacggtaaaacagatgcaaaataatccaaggtttgaaaattgtaccactgttgtgtagccacaaaatgacatgtgcctaactgctgaatttgagtggattaattgatttggaaatcctctagttatctggattagttttggcctttcaaatggcgcactatcgatataggaacctaagtttgcttgtctttttaccggtaatcctgaacttgagtgccttgtgttcctgctcggacgaccactaccatgttcatcattaacctctccatttcaacctgttcacgatcctgcttaaccaatccaaaccatccacacaaattgaaactcctacaacaaagttctcctgatgatttcggcactgaagaataattagcttttgtggccggcagtgctgcctaggaattcagggaaatgtctctctcctccacgctgcattgtcgtgtggatcttggatcgttgggagagattagccggccatacactagtacagtagtacaatgttaattacattggctaatcaaaattacagggagagattagcagtgtaccagtactgcacaacgttaattgcattggctaagtataaaaattagtagggaatcagcggaatggtggtgtgaaaaggtgcatgatgcgagagcaaatcaaggtttagttttcttccctttgaggctttcactcctctcgttataaaagcagttctctgtcgcagcggcgcgggaggaggtggcagagaaggaaggaagccaaacggcatgggctctcgtggcgccgccgccgaccatctccacggcgtcctcgaactgacggtgtacgaggccgacgacctccacaacgccatccatggccggatcatcaaggtacgattaccgtaacactcacgctcacaagtcattctagattcttttgttttttggtttccttctcctcgatcgtggcctagtggtgttcgcttgcttggctctcatggtttcttcttgcttatgagctaatggattggccgtcaaggatgcccttctctttttcagctagagatcacctactgccactaacagtctggtccatctgtttgtcccgaccgaaatgttctctcaagctgaattgctgatgcagttatgctgcacaagtgcacagtttttaaatataaatccttttgagtccgttgaaatctactgatattctagtggcagttcgaacagtgagcaaaccggaaaagtttggtggtgtttgaatctcctgataataaagatgaaaataaagattaagtgtttcacgtaaaacgaggcggtaataacgtgtgattaattaagttttaattattataaacttgaaaaatagattaatctgacacttcctccatctacttttgatagtcatatttcatcttggcacatagaacaaggataagtaattctacttatcatccatttaaatatactactagtcattcctcgtaaacaagcgattcattaatatttatatttctcgatgcctatgtagccaatcttgtgtggaggaattgagagtcacgcattaaatctgaaaaagttattaagatgataggttgttggattgaaatatgcatatcaaaaataaattttccagatttggaaatatgactatccaaagtagatggagggaacaactttcatatggaaaatttctgtacgaaatgcactgtttagcagtttaaaagcatgccacgagtatccaaaatttcatccaagagttatgtgaatagtttttgtgcgtgatggtcaagtaattaatggtggtgccacgtggttcgccggcgaacaggcggcggagagcttgaaggagtcactgggcgtgcaccgtctggcacacaggatctacgtcgacgtcgatgtcggcgcggcgagggtggcgcgcacccgcgaggtggagttccacccgaccaaccccgtctggaaccagtcgttccgcctccactgcgcctacccggcggcgcccgtggcgttcaccgtcaagagccagcacctcgtcggcgccggcgtcctcggcgccgcgcgcgtgccagccgcgcgcgtcgccacgggtgagcccgtggagggctggctcgacctccgcggcggtgagcatggccacgcgacgcacaccccgaagctccgcgtccggctgcggttcttgggcgtggagtccgacccgtggtgggacgccggcgttcgcctccccgggttcgccggcgtcacgccggcgttcttcccggagaggagcggctgccgcgtgacgctgtaccagaactcgcacctgtccggcgggttcgacccgggcgtccgcctcgccggcgggggggcgtaccggccggcgcgcctgtgggaggacatgtacgtcgccatccgcgacgcgcggcggttcgtgtacgtcgccgggtggtcggtgaacgcggatatcacgctggtgcgcgacgcgtcccggatggtccccggcgccgagggcgtcacgctgggcgagctgctgcggcggaaggccgacgagggggtggccgtgctggtgatgccgtggcaggacaagacgtccgtctccttcctcggcaacgggggcctcatgaggacacacgacgaggagacgcggcgcttcttcgagggcaccaacgtgcgctgcttcctctgcccgcgcaacgccgacgcgtcgctcaccatggtgcagagcatcgaggtcgcagcggagttcacgcaccaccagaagacggtcaccctcgacgccgccgccgcctcgccgggcgacgcggacggcagccgtcgccatatcgtcagcttcatcggcgggatagacctctgcgacggccggtacgacgacgagaaccacacgctgttccgggacctcgacaccacgtaccgccatgacttcatgcagaacaacttcaagcacgccggcctgcggcgcggcgggccgcgggagccgtggcacgacgtccactgcaggctcgagggccgcgcggcgtgggacgtgctcgccaacttcgagcagcggtggaggaagcaggcgccgccggagatggccggctgtctgctcgaccttagccaggcggagctccctgaccccggcagcttcggcgacgacgagccgtggaacgtgcaggtgttccggtccatcgacgacgcgtcggtcgtcgggttccccgccgagccggtggcggcggcggcgatgggcctgacgaacggcaaggacgtcacgatcgaccggagcatacaggccggctacgtcgaggccatccgccgggcgcggcggttcatctacgtcgagaaccagtacttcctcggcggctgcgcgtcgtgggccgaggaccgcgacgccggctgcctcaacctggtgcccgtcgagatcgcgctcaaggtcgccgccaagatccggcggggcgagcggttcgcggcgtacgtcgtgacgccgatgtggccggagggcgagccggccggcgactccgtccaggccatcctccggtggaaccggctcaccgtggagatgatgtacggcatcgtcacgaaggccatcgacgacgccgggctgcgcggccaggcgcacccctgcgactacctcaacttcttctgcctcgggaaccgggaggcgccgcgccccggcgagtactcgccgccggagacgccggacgttgacacggactactggcgcgcgcaggtgaaccgccggttccccatctacgtgcacgccaagctcatgatcggtaagccaagctctcttcaacctctgccacgggagctctcacctctgcggccgcctcaccaccgtcttcttctccgcagtggacgacgagtacgtcatggtcggctcggcgaacctcaacgagcggtcgctggccggcaaccgggacagcgagatcgcgcaggggagctaccagccggcgcacctgaacggcggcccgagcggccgcgcgcgcgggctcgtgcacgcgttccggatgtcgctgtggcacgagcacctcatgggccacgccggcggcggcggcggcgtgttcctggagccggagagcgcggagtgcgtgcgcgcggtgcggcgagcggcggaggcgacgtgggacgcgtacacgcgggacacgatggaggacctgctggggcacctgctgccgttcccgatcaccgtgtccgagttcggcgaggtggccgacctgacggccgacgggtgcttcccggacacgacggcgccggtgaaggggaggaggtcgttgaagcttcccgccattctgaccacgtgacgccctgagcttaccgtgccgtgccgcatgtacaaaactttgacgcaacgatcgtctcttcacgaagccgaacaagtgtacatgttggattggatgttgccgagtttatattgagtgaatccaagatacgtcactcgtgatagccactgagtgacaccaaaaaataatctagtttttctttgagtaaattgtagtggtggtacacaaacttattaggtgggtgcaatttaatatacaaacttataaaatgtttgtttcagtatacaaatttgtctagttcgtgcagacgaggaccaaaataacttgacaacgttaattttacgaagctgatgttgattagaatgtgacgtgcatacgtatagtgcgacatatataaggcatgtaatatttataaatttggtctctactttatccttcatcatcgaagtggtgaatttcatatatttctaactttgtatcttgcttagttttttttaatctttttctactatcactatatcttattctactttttattgaagaggtgtatgtctaatagcaaccttctcagatatatgtttacgtagtattctaatcagcccctaaataaaaaagattagccatgtagtgtcctttttgccttcctccgcaccagacaagttcatgcaccgaaatgaccattttacatgttcgtgcactagattgcacacacttgacaagttcgtgtaccggcgatgcaatttactccttattgagctgggacatgggaaaaaaaacaaaacctgaatttcacaaaggtttagggtgtgtttagttcacgccaaaatgaagtttggttgaaattggaacgatgtgacggaaaatttagaagtttattcgtgtaggaaagttttgatgtgatgaaaaagttaaaagtttgaagaaaaagtttggagctaaactcgccttagctgatctttgtgagaaatccagcaatattcgtgcgaaatctgaactccgactctgtgcaagtgtgagcgtataatgtggccttgtttggatttcagcccgttaaataagaacaccaagggccgggctcctcgaagttttgggcctcaacacgaacccgtttcagtccttcctactagtatttttcatctttctctctcctttcttctagcgggaaacccaaaatcggcatcacccacgcgaaaagtcgaaatcccccatttcgccctccgctccggccgctgaagcctccgacgggagccccgccgccgccgctgcttcccgggggcgcctcctcctcccaggacagcggaggcggaccggacggcgatggagcggatccacgtcgccgtgcgggcgcggccgctcacggcggaggacgctggaagcagcccgtggcgggtctccggcaacgccatcgcgctctccacccagccctccatccgcttcgagttcggtaaggaactcgcacccttccgccccgttgctctgctgccagcttcgattccttttggcttgagggttcgtttctcgcagataggatattcggcgaggagtgccgcaccgccgacgtctacggggcccgcaccaagcacatcgtcgactccgcagtaagaggtttcaacggtaataatctgtggtacctctgcatcctattgctgatagcggcgttttctaggggaagctagttaggtcgtgccttttagttatttgagtttttttttgtgtgtgttttagattagttgttttgggcttttggctaactataggcacagtggcttcttttctcaaccaagctatacatgcattaaaagctaaccatatgttttcacgcataacaggcacagtttttgcatatggacaaactaacagtgggaagacttatacaatgagagggtctggtaatgaacctgggataatacctcttgcagttcatgatctattcaggactatcgaagaggtaaattctagaaattcgtataatttaacagcatgcgaactatatatcatgaagtatctttcaaggtgaatctataaacatatacgttatgatgttgaactatgtaaatttgtagaaattgattttcaaagatataaatgtttggtttagcacaaaactagaatggaatgtaatttgaaactgagggagtagctgtcatatcctttgtttgcatgatggtaacaacaggagatatttatttatatattgatgtgtttggttgtgatcttctagcactttggttgctttctaaactgatcctgatgttgttttcataaagaccaaaacaatgctgatgtaacctttcctaaagaccaaaaagacttgctaagtttatatacagaggctttataaaatacccttatcccattatgtcttcgatatgggatctccttcatatgttctactcttaacctgggagtttatttttaacttaaacttttttcactattttttttagcatttggacagagaatttcttctccgcatgtcttatatggaaatttataatgaggaaataaatgatcttcttgtcccggaacatcggaaattgcagattcatgaaagcatcgaggtaaacaatccacatattataatgaaattcataagttttccattctttaataacatggcaatgctgttcttctgaagaggggcatatatgttgctggcttaagagaggaaattgttacctgtcctgaacaagtactggagtttatgtcatttggagaatgtgagctttttttatttgcttgcttgcactgcctattcatgatttatgatttttaataattatgagcaaaactgcagctcaccgtcatattggggaaacaaacatgaatgtgtacagcagtcgttctcataccatatttcgcatggtatgcttactctccactgtattatctgttgtcttacaaaacaacatcataccttgaattctcacatcactaattactcaggtaatcgagagtcgagaaaaggttgatgaaagtgaagcgggagagtcgtgtgatgctgttcgagtatctgttctggtagataactgtccaatgttaaaaaacaaaaaactaaccagcgtgtcttgtatgagatgtagtacttatttaactataggcttttgagtttttgcacactgtaatttatgctcatttgaactttcagaatctggtagatttagctggttcagaacgtgctgcaaagactggtgctgaaggtgtgagacttaaggagggctctcacattaacaaaagtcttatgacccttggtacagtcatcatagaaactaagcgaaggcatagaagagtcaggggtaagttattaacttgttaactagtggttttagttgctttgggttgtgtgtggttcatctgattactaatggaatttg

SEQ ID NO: 54832 - DNA, 3676 bp, Oryza sativa
aagtagacataaattcttctagttttctctccctcataatgaaagaagattggtggattagtttaaaaatgttgctagattgttgtgcttggtattatctattcaggttactgcttgattgatattctcaagtaatgtgtacaatatgtaaactatgcttaagcaatgtatttagtagcataatttggacaactgaagtaattttttaggtatcattgaatattatagtcttaaatccaaacattcctatttgatttaccttttagcatatgtcctcgctgtttactttattttgtgttacaggtccatgcagatgagaccaaaagcagcttacaatttgccagtagagcattacgtgttacaaattgtgcatgtgttaacgaggtattgaaatatctgttaatgccaatcattttactctttctgtgcaaagagcaaaatatataaatttgaaacgcatctttctgtaaagattttaacagatgctgcattattaaaacgccaaaggaaagaaattgaagaacttcgagcgaaactaagggtatgtattgaaaaagctctgtttaagttagtacagcttgatcatgcaaaacttatactttgtgtgatcatagaactcgcaaagtgaacattgggaggaagaaattctgaatttgcgaaacacgctactgcaggttcctttcttatttcttaagcatctctggtctctgttacttgctatgtagcgccttaaataatctgactattttgtctagagtgaactggaaaaggagagaatttctttggagctggaggaggaaaagaaagccaaagaacagcgtgataagaggttgattgagcaagcaaagaaaattgaaaaccttagttcattggtattaaattcagaaagggatgatagaactactgtttctagtaaggtaggaatgcagtttatttatcttaccagcacttgccataaaatgcacttgaacctcatgtttttttctttcttattggtgctttatttccatttagcttattgctctaccctcctttctactaaaaaatgtgaatattttttagacatttttagcaagagggcaacaatttttagacaaataaccataagaagtaatgaaagtatacctcagttacacaggggaacataatagtcttatggctttgtacttgtgctcttcaaacagaacaaaagacggttgacatggtgtcctggactactctctagacaatttgatggtcaggtatgatttatcagtgatgcttgctcacacctttgatcaacatgctgaaaatataaagtctcattgtttgtttcggataaacatggcattgttggtttgttgctcatattatttccaaattgctgtttaagatatcctcccaaaatgttcatttagattgctttgttgtgaatgatttacctttttttactacaatttctcttttgcgtgatggggtagattacatgatttcaacttttgggtactgtctattgatgcatgccatgcttttgtaaatgctcgctattaaatccttttcatgtttaatccattgcacgagtttgtcaaattacatagaacgccagatcttgttaagaatgacatatctacaaatgtccaggttttagagtctgtgcaagaagaccctccgagcagcacagttaggcatggacgtaatatggagatgccactgcattttgaagagctaatacaagaaagctgtgaaagcagtattaaacattatactgatgcttactcatctggtagtttatcctgtgaagatgattctcttccagattcacatgctttgctacatgttaccagccgaagaaagccaaatacgatggtgactgactctctatcttaattttattaatgtcaacgcatcattattgaattttatatttcttaataaaatagttatcatttttcattggtcacatttctactgactgttgaaacacgtggccttgccagaaaaaatcagatcaagaacagcttatggggttggcgagtgaacgaattattccccaagaacttaatgactggaaatacaccacacaaagtcaggaaaacatcaaagcttgtgttaatggtttatctgctcgagaatcagaagcaattcttgtcattaagcaacttgaagatcaggtgcctaattattcccctattattatcctatcacacaatgacttttccccctaccattgccctattatgcaatgacttttcatccccactattgtgctattatgcaatgactttgccataacatttccttaaaatccaaagcagataaagttgctggagttagagaagagttcttttcaaaataacttggatgatgttcttgaattagcaactcagcagaaagcttctttccatgagaagtacgaagaggtgaataatcttatcctgtttgttaaaagttcaaacatgtccagtgttgtgtatattcttgtaaatcctaaattgtgtatattctttgcttgtttacagcttcagcagaatgctctggttgcacaagaacaagctaaaattgctaatgaaaagctttccaaacaagtactttcttattctcttccagttatagcaattctcctttcctcacaaatggcatattttggacacttaatctgttttctattttgatttcatagtcgattaattaacatgaatgattcttggataaaacatttgtatgaatcccaggaagcagcatatgaattccttactggtatatttgtggagactgaaagcatagctgtgcaaatggatcaatcaacacgctcagttgacaatgctctttctttcattgaagagctcttccagaatctcttcatgatggccaaaaacttcactgtatgacagtatctccatagtctatttcccaatttcttgataatcatgccatttgttgaattagctgtctatttaaagtttaccatcgacaattaccaaccattttgctccattatatatattgacctatgctatggaccggatatgggaagggtgcgaatatcgtcgattggacactaacccttgcaccagcagggcttctccatgctgacctaaaagaggttgagaagcttaaactaactttagagcttcattgatagattgataatagagtacatcgggtacctttatatatagggaggactaacttgatatataaggaactaatatctaataagctaaaagaggttgtgaggcttagactaactttagagattcattgattgattgataatagagtacatcgggtacctttatatatagggaggactaacttgatatataaggaactaatatctaattttgtagaaaccaatctactgtctgtaatgtactaataaatcttgtctccttaccaactagataatctcctaatttattatgcctaaactgttgcattcccataaaacctatcaacccacctgaaaatgctctttgacatcaaatgcaggataaaatcttaagaagttttggctttgttctaagtttgatttaggacaaaacaaaaatatcttgtattttgaaacagagacaagtatttagtactcaaagaaattttcgtgtgtgtagtaccatcaacatttttgggtaatgagccagctacattgctataaattgttatcaacatgtcattttttaaacttccaatatgcaaa

SEQ ID NO: 54833 - DNA, 16569 bp, Oryza sativa
agaaagatagcattctatcggagctcctaactctccaaaaggaagtcgtatacttgtcatcatcttctttgatgaaagagaaggagtctatccgaaaggaacttgacagaacaaaaacaaagttaaaagagaccgagaacaaacttaaaaattccattcaagagaagataaaacttgaggtttgtttgttgaaattagtattattaatatgcgtggtacttcaagtttgttaattattttatatgtgtaaacaagaaaaccctacattattcgctaataaccagttctttttactgatgaactatcaatatgtatttcccctagagtgaaaaggctgaggcccagagagaaataaagaagctacagagccaaaggactcttcttgaacgtgatttacggaaacgtgattcgtttactgttgacaaaagacatgaacagagtgtgaagtcgaaggagcttgccggtatctatgatcaagctgtccagattcaggttacaatcatcccttgtattacttttcagtcaatttgttgtgtaggaaactgatctaattgactaattcagggtactggcataatattgttacaacttgcaataataactctaataaatcacaacagtcactcgacaataatattggccaatatgctcccaatcacagaccataccattatgcgattccactgttccagaatatgtgttttagactgtggtggtttgaagctaccaagtgctaatgtggattcaatatttctagtacagggctagtggttcataaaatatgccatctctctggtttctggtttatgatggtttatcacttcgttggtctcacaacttggcaacctgcaatcatggaaaaaaatctatttattgttccgcatagcttttattgcatgttttataacccaaatctcttttgttgacatccagaatgttcaccatttcagtattgatgtggacttatagtcaacaaagtacaaacactcaagagcatccattttttttgtctatttcagtattacatatagtaaatttgaaacagaaggtcatttcctgatatcagttagggaacagtgacaaagatgccatgttgagtgaggaagaagaaatttcagtcatactgtctattcacatatcatcccagcataacactagagagttttacatctgtaggatgacctaactagctatgctatgcatgtagtgatggctcttttatccttttcaggaggactacggaaagcttgagatgcatgcttttgatatggaggctgaaattgcttcgttacaagaagctttagttactaccattgcagaaaaggaagaagcattatctagagtggagcttctcacatcagcagtggaagatcttgaaagtaggttgaattcagcagaatcagagactagttccttgcttgaggagactgctgtcttggtatacttgatttgtcttatgcatattttggaagatttgtttcccatctatttgtctaatcctaaatgttttgacaccatgaaattttgttgtgtttctctttgatgcagactaggaagttagatgcatctgaatctatctctaaaaaacttgaggcttctattagttctttatcaagggaaaaagaagacatgggaattgtatagctctgtgcttatgtcaaattgattgatgttagctgaaagttgaaacttattgcacttctgtctgctgtaaaatacaggaacttactgatgttcttctggaaatggagtctgaaagatcaacgtggactgccaaggagaaagcttatcttgaagccaaacaaaaactgaatatctgcaataagaacaattgcaaattatcagaagatttgattaaggtaacaacaatagagttcccattgatcattgcacatctcccgtgtgcccagtccattttatgtatgcagtcactagtcatgctatgtggttttatcaacaactcaatattgtttagttctggatcatgctatatcaatttgtgtcaatactgtttagatttggatcatgctatgaatatcaatgtgtcatatgtactgctgcacttacctgttgtggttgtttgctatgatattttttatttaaatatttattgcacatttcttttcttgcctagcaacattagtggggaagaaagcatgtttggtttccttgtttggttcttttctggacaagggtttccttcttttaagggagacaaaatttagctcgcctctttagcatgaatttgctttcctaccagcaacttagaaaggttagttgcgtcttgttaaagaactagacatgccctagttgccttgtattgagttgatttacataatgtagttcttctatgttgtcttgccctagacgactagtttcattttcctaatgtttttctttttttgttcaaagtaatagtcaagcaacctccacattcaatgttttttcaccaatattttgaagaactttggtatctctgttactgatattgcaatatactgctaggtgagacaagaattggcgtgttgcagagaacagtacagtattcttgaggctaaaatgattttctccaagaatgacacaaatgaggagaaatactggttagtcttgtagtaattccatcaatctgacatattgtgcttcagtgttgtatgatcgggacaacaagtaatacaacaaccatgtaggagcatgccttaagctacttttaatatttcttttgcaatactttctagtcctgagcctgaagtttaaaatattcttttaaaggagttactctgaaaatatacaaaatgaacaaactggagtggttgtgccttatctaacaagcacatatcttcgatgtgctaaaaggacagttataataaacataaaaatgtttgacggggtgaaccaatagctgtttgtgagcaataggaacagataggtgaaattgtcctagtaggaaataaatacatcacggcctctcttggcgacccgggaagcgaagctcgtctccccagcatgccttgccggccttgccgccacctgcagtgatggtcggcggcggcagcgcctccctccttcctcccatttccttcctctttcctttctccttcttcctctctctttttcccttcctccttttctctagatctgaggtgacccgggggacgtcgttcctgagcttggccctccccacgtccggcaccggtggcctcccatcccggaccgcggtggcggtgaaggctgcacggggcacggcatgatctggccatgctaggtccagatccagcgcatctctggcgggttccgcgcgtctccctggcacgagaggctggagttgcggcggcggccgacggcggtggtgaaggcagcaagggggacggttggatctggcccctccaggtccagatttgggtgtgtcctagtcggggttgggcgaggccggacccctcgtggcggcggcgtcgacgggtgggtggcctgtgtggcgccgatgagctccgcagctcagtggagctccgccggtccgggtgaggtggcagagcaggttgtcaacagcgcttgtccggttgttgtgcaggtgttgcggtgtgcaggtggcatttggtggcatttggtggcttccgttgcggacactatgtttggatgggactccgaggtgaaagccttgctcggcttgccgatgctagcaacggcgacgccatcgggcatcgttcaccttgttgaaggcgttgctattggagccctcgttcaactccacatcaagggatttctccggttaaaaccttagattcgttaggatcaggcgatatcgccgttctgtcggtgttttcttcttgaaggcttcgttttatgagtttttcccttgttggactgctgttattaggttcttgggttcagtatgtcaatgccggggttttcgctggttttccataaattaaccgtgccgttgtaaggttttagggtccggttttccttataaactggatcaactctcttcttctatagtgtaatgtaggagctcccttccgttacctcgaaaaaagaaaacaaatacatcgccatctgttgtttaatatgccgtaggctcaaatgttcggctagctgatttactactgacactagaaagtttgtgcagcagggagacttttgaagaatcagaacgacttctgaagaaagaaagaaacattgacaccggtgtgaatgaaaatgtaagtcttcagtctattccttttgccctccattgtgaaaagtcttcttataacatgagtaaatcaaatggaagaattttcaccctaaatcatatagtcacaagtcatgaccaattactatacatgcgtgagaaaccatcacgtgggaagctacaatgtttcgaactttcgatgttggacattctttgttttcctagtgaaaaaacaattgagcagtaacttatcttgcagtttttctctcattttgttttgagcaggaacttcaccaacaactattgtcgattacagaagaacgtgacaagttactttctgagattaaatatatgaattcagtcatcaatgaatcagaggttttaaaagagaatcatagtaaaaaggcatgttaggtttattgttgacctgctgcacttaatctctgtgagtgagtggttttctcatgtgctttttgattatttgtgcagttaatacaggccaaagctactatagatgagttgagttctaggatatctatcgtggaagccaaaatgaaaaatgtaagcattaatgtacttgtcatttactgttaatggaagtatattattactgtagctgctgtttaaaatatttcatcttcgaatgcagagttactggttaccattatcaaacttaggaatagatgaatgttttgtgagtagggttccatgtgcagcctctcataagagcatgtgcatttgttatcaacaaatatttctacctgatttcattcatttttttagacaaggaatgtcacaaagttttccataacatgggggagtacgacttcaaaaccaaaactgtataaaataaaaagtccaggagtttcaattgaactccagaacagatgccaaaattgcttctgttgcacagtcgaagtattttttttcaaattaccaatggaccaccacaggaactacaatttttttagataatggattttcattaatccggcctctgtattcatgaaggatatacacagccaaaacatacacgagttcttaaactctaaacctcgcacaagggaaaacacaaaagacacaaaaaaagaaaagctactagaagacagcttcaatcttcaacgagaacataatctttctgtcacagcgtgagagggagaaggggagaactggaactggtccttgctgcctttcgccaaaccatctccgcctctgtgtattatgaacgtctataaccaaagtctgtttccgagcttcagcatggaactacttgtctagtaatctaatttaactttcctttctatggttgcttggaattgcaaaccccagttgaaacttgctgtgccccttttaggctgctggttctaagccttgacctaaacatttgcaaaattgactgcatatgttctgttgctattttgacggactattgtaatttatgttcgtcctgcattttgaaaacatggaagcttgacataatacaataaaagtttgccaaataactggaaaacaccagattcaatgaaccgatgggatctagtttattgttgggaagcctgggataagggtggtctgccagcaaagcttgtggatgcatcaggcatgtagtagataagcacagatacatacagtataactcaatcagtgtactgcaaactataaatcccaagggccaaggcatcctcaagaacctggatagccataatttctatattaagagaaaatgttaggcacttaaaaggcactgcatttcctgaagaaataactactgttgagcagtgactctatcattcctgctttgttaattatccaagtgatagctttgcatagaggaaaatcattttccaatttgaatgtatcttatttcagttttccatgtcatttaattttgaaaagcaattcaacgatggccctagttgttcctctttagagaacaagccaccttactaattactcactgacaacttgcacttttctgtatccagtaattccgtaacatgctttcttttgcaggatgcttcggcttataacaaagagaacacaaagcttaggatgcagattcggtggatgcaaccagaacttgatgcacaccgtggaaggcttaaagaagcaataaatgagatgaagctgatggacacaaagtatctggaagcatccaccaagctgaagaaggacctttctttctactgtcgtgaggttctgaggttgaaagaacagcttaaagaatcacaagttaaagcatcttgaccctgaaatctttctgctgagtaattcttgtgtggagaaactcgtggtagtactaaccatatgacaaacaattggtattgcctcaatgccacttcatacaacttttgtatactgctagtgtatttgtttcaggtaggtgtatagtgctacaattccctgtagatcattacttcctaatgcacctgactcaaattataaagcagtggaccgtctagaacttttaacagcctttctcgcactgcgagtctgtgatatagggtgagttattcatattgtgacatatagatactggtttttcgtttggttctggtctgtagcaagtatatacctactacagtacttacgagtatagtggtgaagtgtggacgcatgattgattgcgcatgatgccggtgatgcagagcagtgtaagctgcttgtgccgctcgccgtctccatctgaaacgtggtctcgtcgctctcgcgggtgcaggcgtgcagccggtgccggagatgacgcgacaccaatgaaaatcacgtgagaagagaagctcatcggatcggaacatctagtgacgacgccaagcgatggcccagaaacacacggcctgccgacgccggtgcaatcgggacgggccgtggcttttgtgctcggacgttgggcctcccctgaggggacattggccatgttgggccgaattgacactagattttcagcctaggcggcgggaggagtcgcagcgcagggctgagttcgaagtagattgacgctgaacctctgattcttcttttgcacattttttttttctcgggaaaaagtaattcgaagctgatagctcgcggcggcggcggcggcggcttcgcgggcgatggcctgggaaggaggcagcggcggctcgggaggaggaggagcgcgcgacatggacgcgctgcagggcgtgcgctctatcgtgctgaagccctcggagtccctcgacgaggggcggttcacgaggatcgccggcgccgacttcaacgacgccggactcgggctctccgggatgctcgcgtcgctcgccaccactggattccaggcctctaacctcggcgacgccgttgacgtcgtcaaccagatggtaacgttactactcccttgctgccttttttagtacaattcatgatagagatgaggcagattgggggatactgtagcttgaaattgttgtggttctggatctgtggagcttctgatgaagtgcattttggactagatagggcgtattgctgtgttgttggtgtactcggagagtaggaggtgaagccatagctatgcctgctgtaaaataaaatgggaaccttgcagctattgttcatcctaaagctaacactctactgttggttttctcgataattcctgtgagacgaaaccgttattagtagattggaatggagtagatgtataaaaaaaaatgctacacactttttttatttacatcgtgaatttattggacaaattcaaactgtatatatttgagttttctcttgtataacctggaggtaatccagatgaaaaaaaaatatctctgttataatcttacatgtgtgttccttaatttttttccccatcttcatgcttgtactgatttttctacatgcctaagaggttactaattcctatatttcctaaccctttcttttctgtacttcaatacattgaagttagaatggaggctgtcccatgagaagccacgtgaggactgtgatgaacctgagcttgaccctacatatagagaatctgtgaagtgcaaaatattcctgggattcacctcaaaccttgtctcttctggcattcgggatgttgtccgttttctagttcagcatcacatggtgaatactccacttttttaatttccttttattaactggtttgttagacacgttttggcatgcttttggtaacatactagcattattaaaaggattgagatctcatccctatgatgtagctaattccctatggaaaaaaaaatgtgttatttaggttgatgttattgttacgactgctggtggtatagaggaggatctcatcaaatgtcttgctcctacttacagaggggatttttctttacctggaacgctgctgcggtcaaagggattgaatcggattggaaatctattggttcctaatgataactactgcaagtttgagaactggatcatgccaatttttttaccagatgttacaagagcaatccagggaggtactataacatttttcttctggctgaagcccagtagcttgcaacaaggtgtttgattctatatgacgcacatgtgcttatggctcattagctataaagtggaggcatcatgtagggggcagtaatatgaaaaggcctaacttatagtgcttagaaatccactaatgtaatggtacagaaaggttgtcattatttgaaccagtcttcattagctccgtttcaagttggcctctgtgaatttacgtagtaatggtacatgaataaatccataatccaaatagcactgaaatatgaggttaccaggtatagtttctgtacaactggtcacttgccaagaatcaataaggaaaaggttccacactggtagatatgttttgtaagctttactgctatgcccttgatgtccaactattcaattatcagatatgcgtctttctttcagaagcaactcttccaactacttttgtgcttctctctcttctgttcatgaagcgcaatcagttttacttacctgcagaatgtttggacaccatcgaaggtcattggccgtcttggcaaagaaataaacgatgaaagttcctacctttattgggcatataaggtaacatatttattaactcacctgcatatccttgcaaagtgcaagtgggagaacaaaccatcaatcctgttcataaagcccctgcatctttatcttgagtacactacacaatgatatactaggtagtcttgttgaattttttttcagagttcccttaaaaacaaacaaataaactatattattatttgagttatttttgtatgtattaatgttttctaaatgtggaaactcctcataatagtgccatatgtacatcttttcccctaggaactagtgtgccaccatccttaaagttgtgcttactgatgttaatctaatgtacttggtgtccatatttgaagctttattttgacttttagagttatagttgagtggatttgatcaagatacttgttcttttcctcttgatgttacaatagcatggtattttcatgttccttggtttaaaattcatatggccaagtgcaatgttatgatctgtaactcaaagactgaaaacgagacagtactgactctccaaatcttgatcagaacaatattcctgtatactgcccagcattgactgatggatcacttggagacatgctattctgtcatgcagttcgcaatcctggcctaattattgacattgtacaaggcaagttgtgtgcttggttttcttgcttttgctatcacttttgtttttctcatattatgcttgaaaaacttggcagatataagattgatgaatggggaagccattcatgcaaccccaaggaagaccgggattatagttcttggtggaggtctaccgaagcatcatatatgcaacgccaatatgtttcgcaatggtgcagattttgcagtctatatcaacacagctcaagaatttgatggcagtgattctggagcacagcctgatgaagcagtttcatggggaaagataaagggttcagccaaacctgtcaaggtatgtttctgtaacttgaacaattttcacatgtctttttaatgttttacatacatctaggcagtcaaaagtgtctatcaaagatcatgctgcacgtaaaaatgcctttgttgatttcacctgagatgaagtatgtcaatgatcttggactagattctaatcctaaccatcataacttacctttatttatgtgtatagcttttgctctgtgtaataccacatgtgatgcattaaagccttgaagcatgcagccatttacttttgtttaatgatttatgcgatcatggttgacatgattttgttttgcctgctatagaagatatatgtaagaaattatgacacggcatgatctatgtaagaaattgtgacacgaaaagatcatatgaatgcacttttatttaattcaatacactacgactggttattactgtaaagccgtatcttaataccgcggctcttggaaatgcaggtgcactgtgatgctacgatcgctttcccgttactcgtggctgcaacattcgcacgcaagctgcatgatacgaaacaaacctactaaattttctgggtgctgtgggctaaatcggtccttgtcgaactcctcacgttgggtgttagactgcacgctttttgcaaatgatgcagtggcaaggtcttgttggtaccaactcacgaacagtaccgcccttcccaatcatatttgttccttgtacacttcatgttaaacatcaggtagcagctttgtttttgccccctttggcaattttgcgtgctgcagtggaggcttacattgtacaataactgcaaattgtgaccgatcgggtgattttgagttctggttagtgcgatacaataagtgatattttctctattgtttgcaagtgcatttgagttagttatcggtttgcgcctagatctctcttcctcttcctctatctgggacggaaattgcaatgcatatgacccaattgtctaacccacgtacaactgaatttgatcaatagttgtaaacggttgcagtgtgtataaacatgctctcttttggttgatctatgatagcatgtttttagttgtacaactcatatgggcctctggtttctggatatccccagttggccatagtgctgtactgctgtccaaataaggcaggccaaatcgttgccggcccaggcacggctgtagcaggctggctaatgggccgggccgtgtctgggcggccacaacggcagggcgttccaaaacaagcatggcaccggcacgactcggcactgtctcgtaaaacaaacgagggtacaactaagtacagaatctttggaactggagctagctagcacgcatgggcccctaatgatcaagcgacagtgacccaaggaagcagtagcctccattccaaagcctgtgcaaggcaacatcacaaagctgatcacctcacaatgatcggcgacggcatgcagccgcagggcaagtaaccgagaaaatttgtcggtcgtcgattccctcacgcgagcgtgaaaatggatggccatgattcgcgcaatcacgcccgctaagctgatcccgtctccaagatactctcgaaagacagattttctcgagtgaaataatacgcaatcatagacaccaagacatccccacgctagctaactatagcaggttgtcccgtgtccaccctagtaccccgtctcaaattatagcgcagccccgttttaacaaaaatcaaactcggtagctattaactaataattatattaattatatctacactaagtatgttgtatcactagattaatactttaaagtactttcaaattactttcatgtgatactaattttatatttgttaaaatactagttaaagtatgttattaaaaaccgtgtaaaaaaatatagagcttataattgggggacagagtgagtacgttattactgtcccacactgggagatcggtctcatcttagccgtccgtggccgatgaacggtctggatttcatgccgggagcaacagaaatttaaggtaattgaatttttagataatggaatatagtatcccggcctaatttaaggtaatcgatgatgatgaataataggttagcgtgagagtagagatttcatgggagaggggaagtgtgtgtggtgtggccgcatgattgctcgtgatgccggcgatgcaacgcactgcggggctgcagctagcctcctcctcgtctccatctgaaacaaactcatcatcaggagcatatcatcaatccggtggagacgatgatcatgactgacgagtggccgcgcgtcgttcgagctgagctcgccgtgaccggccggcggggcccccatgtggccgccgtggtttcgctttactccggcaatcattgggcgagccgagagatcgatgatgcccctcttctcacgcttttttttggcttgggttctttatcgtgttccggttcccgagaggcagaaacggccagggacgacgatgaccacgagcagtgctgtagcttcgttcgagtggctggcgccaggtcggtgtccgtgatccgtctgtctcagctagcttctcgtccactgttccacgcaaaaagctccccaaacagcatgcgtgagatgcgtacagtggcacgtacagagtaccactactagatacggatgtacagagagaaccagcaaacgattgatcgacaaatagatcacacatagatcgagcagagagcacgggtgaaaaaacacaacggctgcacagccggttggctaccagggtttacgattctgagttgatcttccgtttcgtgctatggagtaacgacggttttcgtgaaatccgtcggaaagccggtagatttcgaataaactagctgggtggtccgcgcaattgcgcggctaacacccatataaaattatatatttttagtatgattctatttaaaatttattaaatagttatctcgttgtcttaagattttgaaagaccaaaccttatcatcctcgtgtttctaatttcgtagtttttaaaagacacatcagttgctaccccttacttctgttatattattttttattagcttgctcgatctaccattgtttctatttattctccttagaacctttatctaaaaacttatattttttagagtttattgtcctgttgggcttcttttttataatttttagaagtctcgtcaaatgctgctattatactcctctacaaccgtccactgtatcttccctttactgtcattgttattttaaaaatcgaacataattattgtttagcttcatttttttactttctagaagttttgccaaaacgttagtaactttgtcactgtactcctctacagctcgcccgctgccgcccttctttaatgtcattgagattttaaaatcaaatatgattatcgttggggatttttttttactttttagaagcatgaacctttaaaaattgaacattatagtttttagagttttattgtctcgttgggtttcatgttttttataatttttagaaatcccgtcaaacgctgccactttactcctccagaagacccaccaaccatcggcggccctaccattatactcctatgcgacccgtccgctgcgtctcatttttactgtaattgagattttaaaaatcaaatatgattatcattagggtttattttttttactttttagaagtccccgccaaccgtcttgactgattgcttcacgacctgcccgtcgtccttccttttaatcgtcattagaattctatttggtcatttattaatagttttagatgtctcatcaaccgccacctctctgctccactataggcctgttacttaattaatctcgtcatatgttttagatggtcttttctttcatttgtcttattttttatcactagttttagttatttataaattgtattcatagttgaaatcattttttctttttctaatttcagaatttattttatttattattatgttcttttgatatttttatttttaatttttaatttcagttgtttcaaaattatattcctactttaactctccttttaatttgcctaatttcggattttattttatttttattctgaattttacttaatctattattgggttcttatatgtactctcatttcaatatttcttatattaaattccgaatttaagttaattttaaattgtatttctacttgaactcttattttcttttcttttttctaatttggattttttaattttttttattctgaattttaattaatctcgtattggattattgtatggactcttctttcaatattccttatttctaattccgaattttagctatttataaattgtattcctactcgaaatcttctttttttttctttttctaattttgaaatttatttttttattattctgaattttaattaatcatgtattgggttataaaaatattcgataaattttatttatttttatcacaaattttagttatttataaattgtattcctaattgaaatcttaatttttttttctaatttcagaattttttttaaaaaaattagttaatactgtattgtgttcttttaatgtttttattttttattttcaatttcagttgtttcaaaattgtattcctacttaaactctattttaatttttctaattttggatattattttattttttattctaaattttaattaatctcgtattgggttcttatgtggattcttctttcaatattgcttatttttaatttcgaatgttatctaattttaaattgtattcctatttgaactcttcttttattttcttttgctaatttctgatttatttttttattctgaattttaattaatctcgtatttggttcttatatggactcttcttttaatattccttatttttaatttctaatttcagctaattttaaattgtattcctacttggactctcattttcttttctaattttggattttatttttttttattttgaattttgattaatctcgtattgggttcttatatggaaatttctttcaatattgcttatttttaattccgaatttcagctatttttaaattgtatttctacttggactctccttccttttctaatttttgattttattttagtattattctgaattttaattaatcacgtattgggttcctatatgaactcctcttttcatattgcttgtttttaattctaaattttagctatttttagattgtacttttacttggactctctttttcttttttttctttttctccgattattatgggaatttctagcctccacagcgaacgtggtgcctcctttcaaggatgttttaataatataatagatttcataaaccaaaatttaaatataaattcctcgagtttaccaataagctcgcgaaaacctgttggcttaggcgagattccaagcgaaatcatcaaaatttcaatcggtaactagaaaaaaggtaaacttattttttttcctttttttaattcattattcttttctttcctgctgtaaattttagtaaatacatggaatatatcaattttttcgaaaatgtatatcccaataggttaaatgaatatcatactatttataagattttatttgattttttttcttttttatcaattcaaatttgaatttggattaaactcatcgaaatctcagacggcttctactttcgagcatcgtcaaaaccttaaagtttcgcagaattcgatcgaccggttttcgtcggaattgtgaactctccccgacacgcatgcacgcagtacgtatatagcaggagtacgttgtgcactggtgcagctcgtcattgtccggaagggcatgagccgatgagcgatcgatcgatggcgacggcgagcacggcgggatcggaggagcacaaactaacacacggcgaatcgccagggagatatcatatcgttcgtcaggtcggctagatcctccacacacgcgcacgtgttggcacagtggcacggacgctcacctcccacccactgatcaacccacacacccatcgatcgtgtccatttttccgcgcatccgcgcgcgcgcgtcggtcgctgacacacgcgcggcactccgaggggtcgtcgacgccgacacggacgggatgacgggtcccggctcgcgagttgcccgcctaatgcatccagcgtacagtgttgttgtaccagcgcgcgcgctaggcgaggcgatcgatcaaaagtcgtcaaacagcggttgcctttgtccgcgtcgttgaggccagacgtccagcgcctaggccaccgatccaccgtggtctattcatccgtacgtgcatcatgcatatggggggtacgtagtacgtagctgcacgtacgctttatcacgggctatagaattacaaaagtg

SEQ ID NO: 54834 - DNA, 10587 bp, Oryza sativa
agtcagattgccatccatcctgctgcatgcggccgtggggcccacacatcgcgtgggcctcggcaaaccagcagcagctactctcccggccctcggccccaaagctttgccccgggtgaatcacgaggggtggcgcataaggccatcaccaatacctcggcccgtgttccctagcaccattcgttagcctttccgtctccgcgcccccccctgcgatagaacacgtctctctgctagggaatatatccctcgctcgcttttgcagggaacacagccgaaggggcgtgttgggcgcgagggtgtaacttgtggacaccgttcctaccgaaaaatttcctcttccaccctcgcccctctcactcatcgccctcacggccaccggcgacggaagagagagggagggagagaggccaacggcggcggcgagggtggggggggggagaggtaagagtcggcggcgagagggagagggagacgagcggcggagacgatgccaacgacgaccgggatacgatgttggcggcgaccacggatccacgcgccgctcaccgagccatcggcgcgctgggccggagtaggaggcggggccatggctccccgtgtccagatctcgctctgccacgtcctcctcgctccgctcgccacggccaccgtgtcccgccgtgcggagggagagagaggagggcatcggtggcgggagaaagcggcaacagcggcttgagagggagaggagggaggcggcgacggttgctggggagggcgaggagggaggcgcggcggtggtagagagaggatgagggagagagccgtggcgcgtgagagagggagagagaggggagcgatgagagagagggaggagttgccgagggtagatgaggaaatttaacgcgatgaccttttggtaggggtacctatagattttgaggaacccatctagctatggcctccattgtgagacgattgtctatataagtgttttcagttagtgagaacactcaatggatatcttacattgtagatgctctaatacgcatgaataacaaggtcacatagggcttacagcagggctcaatgcacggcacggcacggcacgccatggctggaccgtgggtggctgattgggtggtggtgatggctcaccaaagaaatatttatcactcttacatattcaattaaaatttttaccattaaactaatatattatagatatatgagaactcatataacataaacacgtgagaactcacgcgtcacgaattatgagttataaatttttaattattatattttaaaagtgataaatagttaaataccttgtagagtggagaaaaaaaaaagagatcaaaactcccagctaaaacaagatgcggatgaggagacaccgagagagccagacaggcccctgggacctgggtggatgggtgaagatgatctcatctcacacgatgctactcactacacgcagttcacgcgtccaggccccgaccggccattaatggtgctggcttctacgtgaaggaagcaactcccacgcctcacgaggccgagccagccagacactgcatcaccgattcaccggtgcgcgtgccgtcgaatccgaggaggaaagacaaaaccggtgaatgcgtgcgtgctttagagcaatgtgaatagtatagtccgctggtggctaagagcacccgcaatggtaaagtaaggtgctatctataaaacatgtacacctcaacaatagactagattaatagtaaaccacttcaatggtatgtctacatgggtatctatagctctctaatccattgcctcgtttttctctatagactatctccatgttagtagatagctttgctctctctcttcatttaatctcttctaagtaggaaaatatgctgacatggatctcttgtagagagcttatagataaccactgtgggtgccctaatagaacatggctaaagctaactactggtacaatagattgtctattagctgtctgtatcttataattaaataattaattataacatgcacatatcaatgcatgtgattagcaatgaattgtatccgtgtagctatttgtgttgtgagatgaactttgttcaccaaacaccaagatcatttcacagatcataccaaacaagttatatgttgtataaaaattactacatacaaaacaaacactagtgtttcgtggccaagaaacgctcacgaggaaggattatattccctgttctttttcccctccaatcttatggccaaaaaaacaaaaaggacatgacgctattgctgcatcacgtacgagtatcactccagatgacagctgatgaccagcgttaatcttttccccgatgcagctttgaaagggaggagccaatgcaaatcaaaagaagattcttcgtcgtttcagcattacagcctcatttcaacggttataaataacagtatatatctcgatcgtactctcgcgacttgttatcctgatcagatcttgaagatcggtaaggcgatcgatcgacctgatcagcaagtggattgttagcaggagtggtggtacaagcaggccggcacatcctgcggcaggatactgatataggacgccaagttgccacttgatatctcgaacttatgagacaagggttgacatgctcatgttgacattacagatcatgcatgaggcatctgctactaggtgagagtaagcacattggagtgtggaagggaccaacatgtgtgctatgtcttcggcttgtccggacctcatgcatgtgtattgccatagtttgagctaattttgcacgaaagaaaaataaatcttaagaggaaattcatatagaatacgcacaagtgtgtacggacacctgcaggtggtagagttactccctccgttcgttctaaagtactccctccgttttttaatagatgacgccgttgactttttctaacatatttgaccattcgccttattcaaaaattttatgcaaatgtataagatataaatcacacttaaagtactatgagtgataaaataactcataacaaaataattataattacgtaaatttttttgaataagacgaatggtcaaacatgtgagaaaaagtcaacgacgtcatctattaaagaaaagagggagtgtactccctccgtccttaaaaaaaagcaatcttagatgaggatttgacctcacctaggacaatgaatctggacaacctcatgtccaaattcgttatactaagtgatgttaaatcactaactaggttgttttttttaggacagagggagtaacgcataaccatcactaacgtaaatatcaagaaaaataatttaatcacctcctcgattaaatcatctcaatgcatataagcagtgtgattgatgttaatttgaaggtagaagatttaaaacaaatcaaaatttagaggagaaagagatctgtctagttaatgtatgtcggtatacacgttttatattatgagattcgaagaaaaaattggttgtcttatattttacgacggaaaaagtatgaggtagttaactcctaaacaatactccctccataaaaaaaaatcaacttctactgtttaaattttgtctaaaaaaatcaacttgtaccatcttatctactcccaactagtaaaatgagaatttttatcacttcaatactctttacctatctatcactcttactgtttttttaataaccaagagtattttagtcattcttcatcttcactaattttttttgttggaatgctagaagtggattttttttatcggagtacgttacaacagcgtacatccgaaacaattaggagcaggctgggcacgcgtatggttaaaattgttaaatttaacaaaacctcgatatcagcaaaatccatgattaaattgtcagggcaccatgacttaagcatgaccagtgcattgtgatattggcaccataaattttctagagctgccccaagaaatatgtaatcaaagaattggcgccgttcacccggaatatttagcctgacagcaggtgatcacgttgacatgtttaggctgtgtggtttgatcatggtcggtgcttaattaggttaatacaaacgatagtacgtactgcatgcagacgtgcagacgtgattcccggagaacgatgctcacgcgcaggagccaggaccaaaccgaccgtctgccggtgagatgcgtatatcgtacaaataattacatatggcaacgtgcttggtaggctatcgcttaaccatcctgttcatgacttacactggtggagaaatccttcgtagtcccggttcgtaacctccctttagtcccggtttccaaaccgggactaccaatccgggactaaagatcgctatctttagtcccgggtaaaataaccgggactaaagatctatctttagtcccggttgatagccccaaccgggactaaagatggctcagccgtcccggttggtgttatcaaccgggactaaagatcgagctgacctttttttttttgcatgaccctgttgctgcatggtttatatatatataaaccatgcatatatatatatatatatatatatatatgtttcagtacatatatgcatatataatatatgcatatatatatatatattatattatatttatacatgtttcaatacatatgtacatgcataatatatatgtatttatacatatatatgttatgcaaatgcatatatatatatatatatatatatatatatatatatatatatatatatatatatatatatgaccaaaatatatttacattatagaaaatgtgtacacatgcatatagaaatatatgtagtcatgtattaattacaatccattatatgtcctagctagctacgatttcgacgtagtagtagtcgctagctcagaagctaaggacctatgaattgtgtttccgtcgtagtagaattcacccttgggatcaaggatttgttcgttgatgaatcccatgagttgttcttgaaccgccgcgataaattccttgtgcgtggttaggttatcccttatgcgaataaactatatgaatgtatgaaattgattagtaattaaacaagaaatcgatacgtaatgaaattttgaatttatttgtacgtacattgagctctcttgtggtgatgatttggtctgcaaggcagtggcaatactcgcacacgtaatagccgcacaagttagttcccttcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaaatcctacatggagtttaaagctatgattcgtagtagcaattaacataacaagattttcttaattaacagaggaacttatgacggtacctgtctataagtttgaaaaccttgtcaaacgtagactcttttttatccattgagtcatatacgttgacggtgcaggccgacaggtcgaagagtaaaagcacccagtggaatctgcaatgtgcgtgggatgcattacatatgaaacacttagcaagtttgtacgggaatgaaatttggtataggaagacagtaaaattaaactaactctgtgttgtacggcaacagtatgaacgtcttgtaatgctgcaccttcaggagatggacgagattgtcctctgtggcttgcggatattggtcgagcattgtgacgtttactttccgagggtcgatgaatccagtatcgaaaaccccccgccgtcgggccctttgaatctccattctacaacgataaaagggagtatattattttctatagtctacttatatacaaggacctaattaattaaaggagacgtagtaagaaatctaactgaacgatatacttacaaaatccagcaactcataatagagacgtcgagggcgtccagctggtatagttcgtagattcccttgaaattgatccagagaatgtcatctccttgcaagaagtctgtgtccctgatcctcgctctgatcatctctctaccggtggcgcttatctctatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattcttctatcgtcatttctttaccggtcaccaacggctcgatctcctggtttggttgctctccaagctgagggactggtttggactttctagaagatgctttcttcagcgttcgctcatagtccgatagcttaatggcctccttggcaggtgcagacatacccctgaagaagttcatgacactcgggtctataggaatcttcttttctggacttcgaggcttgaattgtctcttgacttctgatgccacgtaagcgtcaagctcctcttgcgtgcaatcgtaccccgagtccttgttcttggcggcgtcaactttcgccttcttcgtagcccttgtgtgggcaggtggtggagcttggggggcccttgactttgaaggtgacggaagaggagcttgcggaggagtcggtgtaggagcccgcggaggagtcggtgtgggagcccgaggaggagtcggtgcaggagcctgaggtggagacggtgctggagcatgaggaggagacggtgcaggatgctgaggaggagatggcggagccggaggagatggtgcacgagacgccgcttgtcgcccagggaggatgatgtaccacctgcgccatagaataatggcatggcttgtgtctcgtagatgcgtctcaccatctcctccaggataatccagctcgaggtcctcgtatgcgccttcaaccaactcaacttcaaccttggagtatcctgctggaatcagcctgcagtggtaagtacctgaagggtccattgggatggccatgcccgacgccaccttcatgtggtgagaggttatttattagtaattaacatatataagcagcaactagcggaatgggcaaatctaaaatatataaactacgagcttacctttattgataagttcttgaaaggaatatgcagctcacatggtgtccgctgagtgatgtcatcaacggggcaggtggattcgtcctgggtttgcatggcgtccatgctctgtgatcctacctgtcccgttgaggcgcagctgctacggtttcctgacgggctggggatcattggaccgatgtgtggccatgcgttcatcaaccttccttgccacctcatcttgcatgctgagctcgtagctcgataccctgaactcaagatttgcaatcttcgcctcggtatctctcttgctcctcatccgactcctgtacgtgtggatgtcctccttgaacccaatcttccaaggaatcacccatttccctcgtgttcgtcctggatgctctggagtctgcagggcgagtaacagctcgtccctctctctatccggtcggaacgtgccctgagaagagacttccactgcgtctgttagtcgacgcgcaacctctcgtatctgatcgccgaagaccagtgagccatcagctgggttgagcgttccatgtaccaaaacttcgatcgttccggccaattagcggtggccggttcgatacccctctcaagcaagctagcctccatctcctcccacttcggcatcgcgacgctatagccgcctgaccccaagtggtgatggtactttttcttggcggcattttctttgtttctttccatcatcgcctgcccttgttcacctgtcttatatgcaacgaactcgtcccagtgatcccttagctttgggaatgtgtcgaagttcggtgtctgccccttcaggatatatttcattaacctgcctataattgcatttcacgttcacgttcgttggctcgttcacgttcgtctgacaacgttctcgttcacgttcattcaccttgttctcgttcacgttcgttctctcgttctcattcacgttcgttggctcgttcacgttcgttcgctcgttctcgttcacgttcattcaccttgttctcgttcacgttcattcgctcgttctcattcacgttcgttggctcgttcacgttcgttcgctcgttcacattctcggtgtggcggcagcgggacggcggtgtggcggcagcggagcggtggcggagcggcgcggcggataaaacgtaataagcaaatatatgatttaaaattaataaaaattctaataatcatatatacttagcatatgaatgatattattaaatctgtaaaaactctaattaacatacgtatatacatacggcatgatttaaaattaataaaaattgtaataatcatatatacttagcataggaattatattaaattaaattgtgaaaaactctaattaacatatgtaaatgccacatgcatgatttaaaaattttaaaaattcgaatagtcatatataattagcatatgaatgatagtaaattaaattgtgaaaaactctaattaacatatgtaaatgccacatgcatgatttgaaacttttaaaaattctctagtcaattataattagcatatgaattatagtaaattaaatgttaaaaactctaattaacatatgaaattgccacctgcgtgatttaaaacttttaaaaattgtaagtatcgcatataactagcatatacatgatttaaacttgttaaaacctctaataatcgtgcgtaattaacatatgccatacatcaattgatttatatggataatcaatacatccaaaatagtttatatcgtgtacacaataattacggcaatacatcggcggtgacggttgaccacatgcactttctcctcactattgttccctccttgtgatcgctacgtgagtaaggggtgtcttcatttgataggaggatgctagggtcaatcgtcaccgtgaaaggggttgcccatccaactgatcgtaatccttgtcagtcttgtcctcaactccgacgatttttcttttgcctgggagaaccacgtgacgcttaggctcgtcaggccctctgcccttctttcctttgctagacatgttcttcacgaaaaagacttgcgttacatcattggcaaggacaaaaggttcgtccgagtatccaaccttgttaaggtcaaccgttgtcatcccactgccatcaatcattacgcctccaccagtcaacctaacccattggcaccggaacagagggaccttgagaggaccatagtcaagttcccatatgtcctcgatggcaccgtaatacgtgccagttgttccattgtgtcccatggcatcgacacgaacagcgatgttttggttcgtgctcatcatgtcttgggctctcgtgtagaatgtgtacccattgatctcatatctctggaatgtcgcgatcgacccagacggtcccctcgctaggaaggcaagttgttggttgatcgactcgttacccatgagatgttgtcgtatccacgcggggaaagtatcaatgtgatgcgtgtaatccatgcatcggacttaccgatgttcctggcgcgaactagagccaagtgctcctcgatgtaaggagctaccaatgaagattgttgcagaccgtggaatgggctttacggaataaattattgtctaccgtcattattgctttccttccgagagttccctttccccgtagtctcccttcatggcgtgattcaggtatcccgattgggcgaagatcttcgataaattctacgcaaaattcgatgaccttctctgttccataacccttgacgatgcttgcctctggacgagcacggttacgaacatacttcttcagaacgcccatgtacctctcgaaaggaaacatgttgtgtaggtacacaggcccgagaatactgatctctttcacaaggtgacaaagcagatgcgtcattatattgaaaaatgaaggtggaaatatcaactcaaaactgacgagacattgcaccacatcattctgaagggcttctaatctatccggatcgatgaccttctgcgaaattgcgttcatgaatgcacatagctttgttattgtcgcccggacattgtctggaaggataccccttattacaactggtagcagttgtgtcatcaacacgtgacagtcatgagactttaggtttgtgaacttcttctccttcgtgcttattatttgcttgatattcgtggagtatccagacggtacctttatgctctccaagcattcaaacatactttccttctctgccttgctaagagtgtagctggctggactcaagtaatgacttcatttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgctggcgtacgtccaagaattcccaatagggtaactcccaaaa

SEQ ID NO: 54835 - DNA, 4247 bp, Oryza sativa
gacaccttccttcttccacaacagcttaagatcttcgaccagtggacttaggtacacatcgatgtcgttaccaggttgcttggggccttgaataataattggcatcattatgtacttcctcttcatgcatagccagggggggaggttgtaggtacacatcgtaacgggccaagtgctatggccgctgctcatctctctaaaaggattcatgccatccgtactcaaaccaaactgtatgtttcgtgcgtcctttccaaattctttaaattttctgtctatgtttcgccactgcgaaccatcggcggggtgtctcagcatcccgtcctgttgacgctcttcagcgtgccatcgcatcattctagcattccccttgttcctgaacaaacgccttatccgtggtattatagggaaataccacatcactttagcaggaattctcttctttgttagctgcccgtcaacttctcctggatcgtctcgtctaatcttgtatcgtagtgctttgcaaacagggcatgcttctaggttgtcatactcctcaccgcgatataggatacaatcatttggacatgcgtgaatcttctgaacttccagtcctagcgggcagactatcttcttagcctcgtacgttgtctcgggcaatttgtttccctccggaagaatgttcttgacgagtttcaataaatcgccaaatgccttgtcactaaccccattttttgccttctattgcaagaactccagagtggtatccaactttttgtgcccctgctcgcaacctgggtacaacgaagttccgtggttctctaacatcttgtccaatttatgggctcccttttcactttcgcagtcctccttggcgtcttgcaacatctgaccaagatcatccgcaacgtcgttaccatcagcatccctttcctcctcgcccgtttgatttccttcaaatccaacgtactgagcaaagtccggaatattgtcgtcttccacttcatcttcttccatttcaacaccttgctctccgtgggatgtccaacaattatagcttggcatgatccccgactcaaacaagtggaaatgaatagtcctggatgcagaatactccttctgattcttacacttattgcatggacaacaaataaaacccctttgcctgttagcttcagccactctcaaaaaatagtgcacgccgtaaataaactctttggaccgccggtcagcgtacatccattgccgatccatctacatgagtcgaaaaaaaatcgtacaaaaataattattcttacaataatgacagtcatacaataattataagataattacaaactgttttcaacagtcatacaataatgacatatctttattcatacaaaaatcataaaatattacaccaaataattcttttttactatttctaaagttttaaactaattttaatgtgttttacttcttttaattttcattttagtttgttttctagtattcaagattaactttcagtatagttttccttctcaactattttataaaaccttctttagcaaatcaacttaatttctatatattctttcttccccacacaaattttctccctcatcaacttacaactaaattttggagacaaaaaagtgtgcaaatcatagctgcaaatgtaatatgacaaaaaaaacattggaggatgaagttgcaaaccttttaggcacctccgatttgtatgttatcaccaaaataaattcactagaaattttggcatgacctcctctcttttttgaagaaattttgaagcttactcgggcagctgaaggaggcagaagacatatatataggggtgggactttagtcccggttggtgttaccaaccggggctaaagatccccgagatctttagtcccgattggttaccaaccgggactaaagttacaatctttagatcccgaggggcctgacaggccctgacagcatttgaaccggttaaaaaggcaaccaggactaaaaatcaaatatgcccgttaccctttttaaccgggactaaagatcatctttagccccggtttttattgcatccgggactattgtggaattcggccgaccgacgaaagatggtttctccaccagtgttaattagaacattaattaatttctcggttaatatcagtgacagacatagctttaaaatacaggttaatgatcgataaaattaaataacgggacttattatattgcaatagcatataaataaagtacaatcaattaattaagacgcaaaagaacatctaagatggtactgatgcaccagacaggacagtgacgcagccatgatcgtatatagaacagatgcaccgcagaggacaaagacatagccataatcacacatagaacacactcaaatcaaaccatagtaaggaggtcacaaaactagcatcgcacgaatcgtgtcaagcgagttagcggaggagatgaatagtcattacacgagcgaggtggcaagtttagtagtaaagacgaaactagtggagaaaccatctttacccggtcgaccaaaaatcacaataatcccagttgtaataaaaacctggactaaagatggtttttagtcccggtttataagcagaacgggactacacgatctttagtcccggttggtgttacgctgttagggccctccaggatctttagtcccgatttgtattatcaaccgggagtaaagatcacgatgatctttagtctcagttggtgttactaaccggtactaaatatcaaaacgcactatataatccctagtactcatcctcttttcccgtctacacaaacttctctctcttcatctctaatccttatctctttccttcctccttatttcttttctttccttatccctagtcgtgtgtggctgagtagtgcgcaggaggagggggagggcgggccggacagcggcctgcgcggcggcggccggggagatggcaacggctaagccggctggcggcttcgctttcttttctttcttttttttaagattttgtgatccattgtatggattgagatggagaatttgtgattcattgtatggattgagatgtataatttcatttttgagaatatgtgattcatcgcatggatatgtgatgtatatgatttgtgtatttgggatgttactttgatttggggatatgcatcccacccaatttgggagaaaataagttagagattaagtagtaagtagcaataaatgaaacaaaaagaaactaactgggactgccgctcccatctacaccaaccaggattaaagatcgatctttagtcctgagtatttgaaccggactaaagatagagatttttagtctcggatttgtagtgggttacgaaccggaactaaaaacgatttcttcaccagtgcgagatgacaattggtgatgatataggggtgtgggggcggcgtggaccatatatagttggccaatcgccccaccctatgccctatgggtgtgtccatccctgattaatatatgtttttcaattatacacacatgtgcacgttgcatatatatcctgtcataacttgtataacaaataccattcacgcatgcacatatatcatatgtgcatcctttcttacatgcactcaacgggtagagagatcgatactaggtaaatccataaaccttaaaaagagtcatatggtcattagtgtatatcatacattttgtaagaacattttatttttttaataatgtatagaaattcggtttctatatccgcacgtggatagacatagttaaaacaccaatgtttcataaattaattcattaattaagaggtgtataaggaagacctaaaaatatgatccataataaattattcgcttgaaaggaaccacttgagtaatagactcgtagatgcatatataattccaattatcatggttcaaatcccaattgatcactacaaatattatacacacacaagtgatttaatattcctttttaaatttgaaatttaagttagttttaaattatatttctacttgaactcttatttttctttttcttatttcagaatttattttagtttctattctaaattttaattaagctcatatatattgggttctagatggtcttttcttttaatattcattatttctattctaaattatagttattcctaaattttatttctacttgaactcttatctttgttttctatttttctaatttattatttaaaaatcaggatttaattaacctcatgttgta

SEQ ID NO: 54836 - DNA, 2001 bp, Oryza sativa
ctttcggtttttaggagggggatggctagctacatgcatatttacattctgctacagcctttgtgatagctgatcgatggagagatgcatgtgacctatctttggttgcttacaacaacttgagatgttacctttctaattagctaatcattagcagttaatgatgcgcatcttgattaacttcttgatagaccactttggcctatatcagggtcctcaaaaaccatactcctgcacagaattaattgcaaattgctggaccactattggtcgttcccatccacaagaacctggctcaccgtacatacatttttccctcttagaagaaagacggaaccacataaaaaaagacatgactacacagctagtggtagctggttctatatctatgagagactctatccacctatatttcaaataaaattttctcttaaactactcatccgatctacgatccgattacaccgttgtgttcgtaataattaaatctttataacaagatctcacatgattatattttgatgaaaaatcataaattacttttatgatatgtctaaattacttttagatttcactaagttacttcttagacatataaaagtaaattcagcaaagcctaaaggtaatttacatatattatagaagtaacttagaacaaaagaaagtaactttaatgcatgcatttttcattggacatgactacacacctagtcgtagctggtttatactccatctagtgtctcctttcaatttgaaaaatgcaatagtatgtatcttatgtgtgttgaagttatcattgaacttacttttaaaatttgttaaacctatgtgtgttgatctgtactgattaaataaagttttctatataaattcatattttatccctacaatgaatttacttctaatgtcgtgacaaagttacttccgttttattttaatttacttttataatatatataaattacttttagactttattaaatttacttttatatgtctaagaagtaatttagtcaaatctaaaagtaacttttatatatatatatatatatatatatatatatatatatatgataaaagtaacttacgtatataataaaaataatttacaaatataaatattttttcatcgtaatataatcatgtaagattttgttgtgaagatttaattgtaacgaacacaatggtgtaattggattatagatcggataagtaatttgagagaaaattttatttgaagagaaaaaaggcatacatgtctatctcagtccttcctactacgtgggtgtgtcagcctctctgcagtcaaatactagtggagaaagcgataacgtaagccgaaaataaatagataatgagatcggacggtcggaggtgcgtcgcacgattagactaaaacgagagcgcgcactgtttagattttacgtaacaaaaagaggttaaggctaaactcaagatctcgctagttgctagccgtccatttcgtaacactccaaccgaaagctttagctgatctgattagcagtagtgtcgaaacatgatttcggcaataataaaagggggtagcgtacgagacctaaaagtggatggatgcggagacaaaggatttagacaggttcaggccctctcaatgagaggtaataccctactcctgtttggggatttgaatccgccgagtgtgtattgatctgacgatcaggttgtctcatcataccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaatacccgagtcatgatctattacatattccatagatataagttatcccctatgactagtcggataaccatgccgtatgggtatggggtacccataatctccacagtagcccctgagaccttcacagtcggaaaga

SEQ ID NO: 54837 - DNA, 980 bp, Oryza sativa
ttatcactatttaccaacataagttctgggttggaccaacaacagaagtatatgtagcacacattttttttttgaagcaaaagacggcaggagctctgccggatatattagaaggagaagcagttacagaggtcaagaaagagcagaccactaggtgacattttcagttttcatttttatgtagcacacatttcatatcagttaactccgaatgacttagatattatctccctacaagtcacttttctcagttaaaatattacatttgtacttcacgtttctctgatttcctgactagcactagctccacctctcctagagctagagctcagccaaacagttttagctccacccaaaatgggagtggagctgaatggaactctctcataaaatgaaccaaagaggtggagctgggtttaaacggctccataaccccactccagactcaactcctggagttaaatttaggagttggagctctactaaacgagccctatatcatctaaaatttcaagcgcagtagaggagctgctaattgtacttccttctctttctgaacccaatcaaggattgagccctgaagctggacaggtgcgtgcgcagcccaaaggctgaggaagtcagagattccatctgtgcgatgatgcatcttatgatcctgttgtcgcaacagctttgatttcctagctcctcgaatggtcctccgtgtgctcagaatgttcacggtcgccttcacagcatgaagatatgcaacaccatgtttaggcttccaaagcatctgatacactgtcgctttcgcattctgatgaaaataatctacggccctcggcaacatgatctcttccatttgttgcaaggcaatatttgtatgcaagcaatgctgctcattagcattaatcacctctatcacagaaccctcgactgatgggaataggctttctgaagatccgtgaggcgtataggcaagtagacattcagat

SEQ ID NO: 54838 - DNA, 2485 bp, Oryza sativa
  unsure (1)..(2485): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnaatggactggaaattattctgaacaactgtaatggaatatctgtctagttgatgaatagtcttgtgttggcttggcatgtccaccactcaccccatccacgggctcaccaagtcaccaatcagtttgttcaccttgctgctctttttttgcatcttcctttgcatctgcgtttcagcacatgacaaagttagaataaatattcatgtgttttctagtttcattttgaaattatccaaaatattataattttaaaccacccagaggttatcgctgtcaaactgggaatttccagtaaataagccatactggatgaaaataacaaaataaaaagaaagtgcatgggaatatgagaaagcaggcaattgagtgagaaatgataattttcttatagcccacaatcatgatagactcatgtaaattcaaatgaaaccagacacatcgaatgagcaaggctggtacattagacttctagggcaagaacatcatgttatcaccatttgccaacataactgacgagacaaacaacagcagtatatgtagaacatttcagatgaatacactcctaagtacttagaaaccaactccctacatgttacttttctcccccattcttttaattttaattatccctgtttcccttctagtccctattacatcatctaaaatgtcagtagaggacctgctactttcttctccttccgaatccagtcaaggagtgagccctgaagccggacaggtgcatgcacagcccaaaggctgaggaagtcagcgacctcatgtctgtgattgtgtgtccggcgatcatgtcgtcgcaacatctttgctttcctggctcctcgaatggttctccgtgtgctccgcatgttcattgttgccttcacagcctgaagaaatgcaccaccatgtttagacttccaaagcatctgatacgctgttgcttttgcattctgacgaaaacaatctacagcccttggcagcatgaacatttgtgtgcaagcaatgttgctcgttaccattaatcacctcaatcacagtactatcaactgctgggaataggtcttctgaagagccatggggcgtatagacaaggataacattcagatgcggaaattctttaagtgaagatttaccctcaacaattgttccctgttctctgaacccaggaggtgaaacttggcacagtaaactcacttcaatgatgggttctagagaaatatctgttaattctaccttgtgcaagttcccactaccacatactttctgaccatgatgcttgcaacacagtggatttgggcggaaccattcagtagctatactatgaatgttctcccaaccgtatgagtgagaatgtgacaccctggagaagtcttgtgtaggtagttgaataagttctttcctaacagtttcagctgtagactcaaaataaggagtaaacaactgcaagcacttaattgtagtaccaactatgtttgtactctctgaaagttgtagaataatatcaatgtaaaagttgtcctcaggtgcactgccatcattgaaagcaaagaacaacttagcttctattcctcgctctgcagagttattgggccgtacccaaaaccaatgctgcttgtttccctgtattgatttgtactctaacgtttcacctgaaataaggtgcccgataagagggtcaaagaacaagtaacggcgtggtgtgcctccaaattccacagatcttagaaaatcattagctccatctgcaaaccactcgaatctttggacagaagatctacccagctcatcactattgctgtgaaagatggaagataccagtgtcttggtggcatgggcaattcgcctaggaaaggaagaattccttacttgttgttccacctcatcttcttcctggatatgttgcctgcacttccgtagtgtgtcatcacactcttcagtagcacgcttcagcttcttctgccaacgtaacaacgggccactagtgatctgccatttattggatgtctcaagtgcgaactccaacttgatttgtgccatctccagcctctccaggtgatcccgtgcacttgattttcgctcacaccggtcaatcaacccagatatgatcctgtttaccgtctcttgaacgatagcagaaccgactatctcttccatcttcagtaatccttccctgatcaacacagagcaagatatatcaatacatcgatcaaaatatagatagagttaattgcatattggaccggctttctttaccatggtcgcagcttggctaggaacaagctattattttcacttgggctag

SEQ ID NO: 54839 - DNA, 8382 bp, Oryza sativa
attcctgcagccctgcagattgagattcacatacctggctagttggttttagtagagatagagctcaagctccaccagtacagtcatgctcgagctctactcagccagtcagccttcgctgcccctgccacattcattcgtgctcaagatttaatgtgcagccttgattaagtgccctagctccaattaagctagtactgccatggatgaacttgggctagaatgggacctattgactagttggtggagcataagtgtggagtgataacatatggtgttagaatttcccaccgtgccaccgtgattcattggctatgtgctaattgagctcaagctggagctctgccgtgtgccgtgttgagctcaagacggagactaccacacactcaagctcaggcgctgacgtaggtcaaacacgtagatggaacctgaggaagtgtggtgagctcgaactaaaacagggaagagaagagaaaagggggagatctagaggaagaacaagactggttcaatatgaaaatttttgcaaagatttctggttcaaaccgaaaagaatgtcctacctctagtccaacatgcaacaatggtcaataaaagtggcccaggatgcaattttctcatatagataagtgaattcctgataagtacttataaagtatacctttgaagtatatgcaaacccaaccttctgagttgaattagtaggaagaaacttgagggaacacaggtgccttctgagttgaattagtaggaaggaacttgagggaacacaggtgccttctgagttgaattagtaggaaggaacttgagggaacacagatgcaccagagagtacccagctggcagctgccagcagacgataactggattgaatgaacggtgagcataaaggtccatgtccttggtggagaaaactcaagtaaatcaaagatgtggacgttaggtaagccttattctccagttgattatgccctctttgactgaccaatagtaaattttgttattaagactgaaagaccaagaacggctatagagggggggtgaatatagcaattcaaatcttgcccccgaaaatactcatcaagccggatttctcaaaatccttactagaaccgcggctattagagaagccggatctagaaaagaagatagaaggaattcccgaaactagaagaggaagagaaaaggaattcccgaaactagaagagaggtgaggaggagtgagcaaaactcatcatcgcaaagttcaaattgcaagcggaatttaaattgtggaatttaaatggacaagacaaaaacgaaatccttcaaatcatttcattcataggtgatgcaaaataaccgctcaactaggagcaaacatacaccttcagaggaacattaacacaaacttaaaatctctcggacaaacacactccaaactaatcctaatacaaaagcctctcgggcaaacacactccaaactcacacgaaaactctctcaccaagcatctcaaaaggattaccaaaggagcaacctccacccttgcatccatctctctatttatagcctaagacccctaagacattgtctcaaatacccctaggacgaaaccctatctcagatgcaatcctggctgttcattcttccttacatgcgaaggaaacctcttagatgcttgccacgtcgtcgatccgaagactcctcgcacccccgatccgcgtcgtgtccatccgagcctatccacatgcgccatgtgtccacgtgctccgcgcgcgctcgtgctctggccagcgagcgaagtttcccgcgcatcccgtccaaaatctgcgtaggacccacgcggtatagctcccgcgagagagcgcgcggtcaagtccgcgcctgccgcgtgtccctcacgcgcgcgcgccgtcgccgagatctcccgcgctcgcctccgagttgctgcctgccgcgtgtcacgtcttcctgccgatgccgtggtccgtcgaacgggaggacgccacgtcgcccgtacggctcccgccccccgcatgccttgtcttcatgggcccgtcgccgtgggctgtctccatcttgggccagtcaggaccggccatgtggcctcctgctgaccgaacacccgagccggacaggccggttggcctctcttccagccagcccacatgcagtcatgcatggtattggaccatatgcacgtatgcactgccgaagcatcacaagctagctagctaatcaactagctgcccatgcttgcatatgcacacactagtgcatatatgcaagctcttcttccattcaccattttctttgcgcacccggcacttgcacttgaccttgcaaagtccgttgcaaagacctcctcatacggtgttcgtccaccgtgtgcaaccttgtgtccaatcttgtcacccggtatccttgatcgctttggacctcaactcctccctgagtctagtcccgatccaccgttgaccaagatcgaccccgatcacctacacacacatgaaccaaacaaccattgtcttggcacagatgtcgcaacctgaccaatgttagtccacgcacacacttcttgcacttccggtacttgtcaatttcccatcacaaaagaactgtaaccacacatggtttcacaaagacattcaccgcaaccaaaccaaaaaagatgcttccgaatgctgactgaccaatattgcagaaaggctagctgaaaccacaacataatggtaattttccacattccagaagctggaatcatggtaatgagttgccaaggcttgcttgctgatttaattttttaaagttatgcataggatgcattcctcaattagcagacatgtttgcaactccagcgttggcatttgcttgccattccgctggtaataagcctgttcttggtaatattcctccagattacataagattttaaaagtaaaatcttggtatatagttgatgaaacgtgcttgctatttttggtttctaaatactcctcttaatacacattacagaaaaaaaatgctagaaatcttgaatttcacgtagtgaaaagaagaaaaatcatcgtcaccgcaatcacttccagttaggcggctactcatcttgaccggttgaatagatatggcgtaatagacatgatcaggtagtgatatgcagggagatcgagccttacctcgaactagtgcgccacggccgccgagggctcctcctccatccccgcatcgccggcggacgcgctcgtatcgtatatgtggcgccacgtggagacagtagtggcagaggatcgagcaagggaacgccatgcccggacctccttgcgccgccggcgccggtccacgcgcagcctgcctcatcgcggatcgtccggccggcggcggaggccatggctgccggccacggtggcggccgtgtgtcgcctgcttacgcaaatggagacggaggaggatttgtgcggcccagttatcatcagcaaaagagagccgatctcggctccaaaaaagcccacactaacaccaggcaataattacgcagcccgtatgagataaaattttttaggttaattagatccatgccactgtaactttgacaaattaaaaaaatgttactaccattcgtcatatccgctacatgtcactgggaatttttaaaattggaacccagggggaggacggccatggagcagggccttctcggcggttgttggtgatgggagcggtggagccgcgtcgggccgcaacggccgcgaaggcacgcaaggccggtggtgcggcggagtgcaccgggcaacggggggcctgcaggggaggcggaggcgcgcgggtccgcgcaaggacggcagaggtggaggggccacgcatggccgcggaggccgcggagccgcacgtggcctcgtgcagtcgcgctcgtccaccgcctcgtcaccgacggcgacccacactctaccccatggtggacgcagctatgctccgacgtcgccgtcgtgctcgccatcctccttgaccgcttcttcgacatggaacaccgccaagcaaaccgacgacgtcggcctcgcgcggttggtggactttgccgacgtcaagcgcatcaacgacagaatgcatctatgggcgggcaagctagacccgctgctgctacaagggatgtatgaccagggtgccatctgacagtaggtgggcgtgcaggcagccacggggagcgcgagcagcgtggcggcaccgtgccacgctcacggcacgtggggccgatggagccggcagagccgcgcgtcgagcggaggaggccggccggcgcagacggcggagccgtggagaggagggggatgaggacgggaatagagacggcataagagaggaggatagaaattatgaccggagtggcatggttctaattttaataactttcagtggcatatagccgatacgatgaatagcagtggtatttttttaatttggcaaattacagtggcatagatccaattaacccaaaaattttacagccaggtccctcaatgtttaaatgatatcccccgcaaaaaaaatgtttaaatgatacggagtatatggattgctaatttgctatatcattcctaacgatctggttatttacaaccagtcaatcaggtctccatttgggatcgctatatggtaatgatccgaccttttgcaaatcaactccacaaacttttttacacacaggtcaaatggagaaactatttaatgtaaacaatctgaaaactatcgttaattcaaaaaatatatatacgcttgagatttgttcatgtcacaattgcgagtaaaaatttccgtgcatcaccaatgcatcctcaccgcaaaaaccatggcaaattcagctgtaattttactcacagttatgacgtggaaaaatattactatacatctatttttagatccaacagtaaattttcactgtatattttccatgttgtgggtggacaggaagcaaatcctctaacatgaaaccctacatgtcaagcaccatgtttctctgactggcccacatgtcagtcaccacatattagcagaagaggcgagcgccaccgtcgtctctacctttactcccgccattgagtcggcctgcaccttgccatctccgtgcccatcttctccacgcacaggtaggcgacgccatgtcccgacctccagaacacctcgtacgccgccgccgccgacgatccatccaccgtgccatggacgtcgtggcagtggcacaggcgatcgatggcgccaggcagaagaaactcatccacctcgcgcaatccgatgtccgttcgcacggctggctcctccctcccatcgatcgccacgaccgcggcgctctcggatcctgacggcggcagctcctccggcgaggcgtgcggcgcgaagatggccgtcacctgcagcagaggcggcggcccggaatcttcagaggatctcctcctctcgccgtcgccgccgtgaccagatgatgatggtcgcgccgagacatgccgctgcacgaacagtttgatcacctgctccgggaatgtcgtcgtccctgacagctcaaccatgtcactgcttctgctctggccatggcagcatgccggatttggacgagcacggtgagtctcggaatggtggatgctccagtactctggatcagtagaatccacaaaggggaagcagtagaaggctcggtggtgaacctgagtgagctcctgctttgcagcttcagcgaccggcttgaaactagggagaagtgaatccaagcacctggccacaatcccagtcacgttcgtgcttgctgtcaaacgtagaagaattccaagaacaaagttctcctctggcctctcatggttgttgtagcgaagcaacacaccggcttcttgccctcgttctgcgaaactcattggctttgatattaggtagtactgatttccatgagaactttcatactgcagtgctttgcctgcgaggagatgcccagtgagaggatcaacgagcatgtagttgatgctgcctattctgccaaactccatgaatttcaggaactcgccggcgccatcggcgaacctttcaaacctctgaatggttgaagtggagttcaggctatcaacattcttgtcagcggcgaaggaggagaggaatgatcttgtggcaagggcgatccgtttggggaaagagcaccgactgatcttctccgtctcatcgtcttccatggcgcggcgcttgcatctgtccatgacatggctgcactcgtcggaggctcgcttcagcttcttcctccaacgcataagcgaggaatccatggccaaaggccacctgctggacacttccagggcggcctccatcttgatgtgtgccatctccagcctctccaggccatcttcctcgcttgatttgcggttatgattgtcgatgaggaaggtggagatcctgctcacagcctcaccgacgaccgcagaagcgatgacctcagacatcaggatgttcttggtgatcactgctgccctctattaaaaagggaattaaaggtcaggtgacaattattcatcacagaactagagatactggacttcagcacaaaatatacttaccacaccaaactggttgaaactgaaactagtgctttaaactgatagctttgcagattgtgaacagcataaacctgaatccagatggaaatggttcagagtcttcacgataccaattagacagtgaaagtcatgaaggagcatctgtacaatgagtgatgtcatgaagttgacagacattaggtaattaatgtgaccgtgatagcaagatgactagtcttcccttcacaacaccacaagtctgatgatttgaatgtacagttgatttgtcacaatcacacaaaacttaaaaagctgcctcgttgactgtcccaatcttgtaaaaagtctagctattgaagacaaattatcctcgtcaccgcaatccttttccttgaaaattcgtggtaatgcttcaatgtcatgttaatcatgatcttaaaaaactgtgtttcacttgcataaactcctaacagtttcagctgcacatacttaattatagtgccaactatgtatgtacttgctgaaagttgtagcatcaaaccaaagaaaaagttatcctcaggtgtgtctctatcattgtaaacaaagatcaacttagctcatgctcctcgttctacaatgttatttgcctgtatcaaaaacaagtggtacctgtttccctgcactaatttgtaatccagcgtttcaccagcaagaacgtgccccacaagagggtcgaagaacagataatagcatggcgtccctccaaactccacagatctcagaaaatcattagctccatctgcataccactcaaatcttcgaacaacagatctatttggctcatggatattgccgttatagatggataatactagagacttggtggcatgcacaatttgcataggaaaggatgaattccttactagttgttcagcctcttcttcctcgacgtgctgcctacacctgcatattttgttatcacactcttccacagcttcttttgccaacgtaatatcgggtcaccagtaatccgccacttatttgatgtctcaagtgtaacctccaacttgatttgtgccatctccaacctctccagatgatccgctgtacttgattttcactcacagctgtcaatcaacccagatgatcctctgtctcatgaaccacagcagaaacaaccacctcttctatcttcaataatctctacctgatcagcacagagcaagatatatcaatacatcaatcttttgcgaaatcgcaaaagaattgcacgtcaatatattagatcaatacatcattcaggatgctcaaataaaacaaaagatagatcagtgaattcctgataagtacaaagtgcattgttgaattatctgtgaacccaaccttctgagttgaattagtaggaaagatcttgagggaaaacaggtgagccacagagtatctagcagacgataactggtttgaatgaatggcgagaatgaaagtacatgtcttcggtggatagagaatcgagcaaaccaaaggtggttctctttcaagtttggttagtgctctagtctgttctccagttggtttctgcccactttgactgaccaatcgtcaatagtcaatactgaatgctgactgaccaatcttccagaaaggctagctaaagataaatatttttggaaataaacccctgtaggatttgttttcaacatataggtctccatgtacacactcccccttctgccgctgtaccacaccaaaactgaattttacatgtagctctctctcataagtcgatggttgggcgctcgcactcccctcttccggccctcccgctggggcgccgccacaagccaccagccaccacgccgt

SEQ ID NO: 54840 - DNA, 12308 bp, Oryza sativa
  unsure (1)..(12308): unsure at all n locations
attcctgcagcccagtgaaagatgatatgaacgattttgtggcatgggcgatccgtttagggaaggcgcactgcctgacctcctgttccatctcatcgtcttccatggcacggcgcttgcatctgtcatgatttggctgcactcatcggatgtgcgctttagctcttcctccaacgcaggagcgaggcgtctgtgacccgaggccacctgctggatatctcgagggctgcctccattctgatgtgtgcaatctccagcctctccatgccatcttcctcgcttaatttccatttatgcttgtcgatgaagaaggtggagatcctgctcacagcctcgctgactaccgcagaagcaactacttcagacatcaggatgttcttgtcgattaccctagcctgtttgtaaaaggggatggaaagataaggttacaacttacaattatattcacaacagaactagagatatagaggtttataagaatgtagcacggaatgtactcacctcaccaagctgcttgaaactagtgcttcaaacatactgcgattgtgacttgtgaagagcataaatctgtgtggtgaagaggggagttcaattgattcacaatgggacagtgaaaggtccttgagtacatctgtgctggaattgatgtcatgatatagaaatttggtaattaattaacatgaccgtgatagcaagatgacaagtcttccctccacaccgcctgtatttctccaaatactctgtaactgaatcaacttttgagtaatacatatgttcaggccgagaaaattgtgccatagttgtttcaaaaagagatgacaagtcttcatctgtggaaggatccatccgatataatgtgaattaaccaagcaaaagaaaagtctaagattgaacgatagattctggtgacaaattgattagtctcaatcacagactagtcagtcagaagaaataaggcgcaccgcacgacttgtcgacttaaccaaaaacaatgcttccgaatgttgactgaccagtcttgcagaaaggctagctaaagatgaatcctcttcgtcactgcaacatttttttttaaagaaaaaatcattgtcactggctcagtgcaatcacttccaggcttccagctactcctcttgaccggttgaatagatctcgcgcagtaaacgtgatcaggcagtgatatgcagggagacggagcctcacctcgtgctattgcgccgcggccgccgaggggaaacatcggtctcctccatctccgcatcgccggcggacgcgctcgtatatgtggcgccccatggagacagtggttgcagaggatcgagcaagggaacaccatgctcggacctcacctccttgcgccgccgccgcgggtccacgcgcggcgtagcctgcctcctcgcggatcgtccggcggcggaggccatggccgtggcggatgatggtggtcggcgaggagggtgaactggagacgaaggggtggcccagttgtcagcgaaagagagtccatcgcggcccaagtataagcccacacttacaccaggcaattacgcagcccccggatcagatgagatcagaaaatttacaaccaggtccctcagggccgttttggattgaagccaaaacgtgccataccaaaattttggtaatttaaatagaaaatgtgctagtttgaattgatgccaaacaattggtagtgcccatgttcaatttggctatattttagaatcttcctcaccatcctattaaaatttggctttatattggtcccaaaccaaacatagctagctaactttgctctacccaaaaagtatggtagacacgcatgtcaatacatgggtggatgcacgcccccttctaacaccaccggccgtcacattggagcacaggaggcaagcggcaccgtcgtctaccatcagaccagccattgagtcggcctagggacacaagcaagccgacttgcgagctcacttatagatcaaatatgtgataatccgtaggtttttatatcgtggtcccgcttgccacatctagatatgtaaatagatcaacccatatatccatttatagtttaaattaatagataacccgcgagttacccactaaattttgcctataaattaaacgagctcgtgggttggcccgcttgtatctcaaatcggcctgcattttgccatctcggtacccatcttttccacgcagaagttggtaggcgatgccatagtgggacttccagaatacctcgtgcgtcgacgatccatccacagcatcgtggttgtggctttggcgatcgacaacgagtcaatgactggtagaaagaactcctccacctcaaacagcacagcccaatgttcgttcatggcttgctcctcccttccatctatcgccacagccgcgacggccgacggtcatgtttcgggatagcaactcctccggcgacgcatgtgtcacttagaccgccttcatcagcagcatagatgccaaggaattttcagaaaatcaactactctcgtcgttgccgaccagataattgtcgcaccgagatatgtcgttgcacggacaatttaatcaccggccggctttaggaatgcacctgatggctctgaccatggtgctcttgtccttcgcggcatgccggttttgggcgatgtgctagcggctggtgggccttcttgaaaacgaaagggtagatgactattttttaatataaaatcctctaatttttttggagtagaacagagtctcttggagcaaaaagttgttattgttatagttcctttctttatttattattttcctcaataataacgtgtcactgatttataagttctttttatctttaaaaaaaagatatgcctacatatatctaatacgatatgaccgatgacaggtatagccggtgagctggctattctatttgtcaaaaataagtaaatattgtagataattttgaactataatataattttattttgatgatagccacgtaatagcagggccaaccttgctattttttttttacattgagtaatttgtattggtggtacacaaaacttattaggtgggtgcaattaagtatataaatttataaaatgctcgttttaatacacgaacttgtctaattcttgcgaatgaggatcaaaataacttggcaatgctaattatacgaaaccgatgttgattaggatgtgatgtgaatacgtgtagtgagtatgcataagatatgcaatatttataatttgatccttactttatccatgatgaatttcatatatttttaacccttatatcattgcttggtatttttaaaaatctttttctacaatcactatatcctattctatttttttattgaagaggtgtatatctaattacaaccttcttatatactccctctgtattttaatgtatgacgccgttgactttttaaccaacgtttgactattcgtcttattcaaactttttatgcgaatataaaaatacttatatcatgcttaaaaacatttgatgataaatcaagtcacaataaaataaatgataattacataaattttttgaataagacgaaaggtcaaacgtttgtcaaaaagtcaacagcgtcatacattaaaatatggagggagtatatgtttacatagtatcataatcagcccctaaatcaataagattagccatgtagtgtcattttcatctttctccgcacgtaccagacaagttcatgcaccaaaataagcattttacaaattcgtgtaccggcgatgcaatttactctttacattcatgaccctacccggctacttgcaacggatgtcagcaacccacaaatttacaatcaggtctgtcattggatcactaccacaatcaggtcactcatagagattacaaaatttacaatcgaaatccctaattttggcatttctttttttgcaaatcaatacctatcagtttttgttttttttttagaactagggccagagagcccccatttctcttactagaaatgagcatatccttacaaagtcagggaaacaaaaacaaatacgaggaaagaaagctaaagagcttatccagatgcctcacagggctcgatggctgaacacgaataacatcattcggtcatcaaaaggataaaacagatcacaaaaaactaataacatcttcatccttctatcctccagattccaggtctccatccatgtcttgagcagaagatgtcacttgccacctgtcttataagtctggctcccaactgcagtcttcttcgatttgcttccaactttgcaaagatgcccaggaatccacccaggaacaagccataaagaccaaatcagtaggatctcttggaaatttattttcaaaacaagctttattcttggacttccaaattgtccaaatgattgcagctaaaccaatcacaatcaagtgtttcatgtttttatcatgtctatccagccaatgtccaaaaatatcctgatgattcaaagtaggcagtatatccaaagcacaacacatgatattccagagaagtttggccaaagggcattcaaaaaacaagtgctgtatatcctcttttttatcacaaaattgacacttttcattcccctttctccaaccttttttatacaagttttccttagtgagaattttgtttttaacaaacagccaaataaagactctaattttcagaggaatcttanatttccatattttcttttgagggaaagacacctgatgcattttaagggctttgtaaaacgatttcacagaanaaattccatcctttgtcaaattccaatagattttatcttcagagtcatcctgtaagttcagactttccagactgtttttgattctcacccatctctcagtttatctccctctagatctcttctgaatttgatgcattgcaagcctttcattttcacctttgcaattgtcacatgtttggtcaaagctatattgtacagatttggaaactgaatgttaaggggttttccacctattcagctgtcctcccaaaacaaagttcttttcccattccccactttttttgaacaaaatttaaaaaaatcatcctttacttccatcaacccatgccagaaatgagagttaccctgtttaaagtttacctcagacatagttttatttttcaaatatttccccctaagaatctcctgccaccaaccttctttgttttccaaattccaaatccatttccccaacaaggccttattcataatgtccaggtccagaacacctaaacctccttgatctctaggtgaacaaataatgggccattgcactaaatgatattttctgatgccttggtcctcctgccacaaaaacctcctcctgaagaagtccattttttctttcactcctttgggtaacttgaaaaatgagatcatatacatgggaacactgcttaaactagaattgatcaaaattaatcttccccctattgactatcagttttggtttttacatagctctcatagatcgatggctgcgcggagtgggcgctttctcttccatcctcttgttctcccgccgccgccgccaccaccagccaccgcgccgtttccgccgccgcaccagagctgagctcggcgatgccacaacctttcacaatgacacggccaatgagtccgcctgcaccctgccatctctcttcccatcttcttcaagcagaggtaggcgacaccatggccggactgccacagcacctcatgcgtggacgacgacgacgacgatccatcgtacgccgcctcatggcggcacaggcgatcgatggcgttgggcagcagaagctcctccaccaacattcctgtgcacggcttgctcttccctcccgtcgattgcttcgacagcaacgctccgggctctgggcggcagctcctccagccaagcgtgcggcccgatcacggccgttagctgcagcaggggtgtcctcctatcgccatgaccagatgatgatgatgatgaagaagacgatgatggcttctgccatgcagagatataccgccgtacgaccaatttgatcaccggctccgggtatctaccatggtgattgtgtccttggcagcatgcggagtttgggcgagcatggtgagtctctgaatggtgggtcctcctcgagtactctggatcggtagaatcaacaaaggggaagcagtacaaggctcgatggtgcacctgagtgagctcctgctttgcagcttcagcaacaggcttgaaattgggtggtaacaactccaagcacctggccacaatcccggtcacgttcgtgcttgctgccaaacgtagtagaattccgaaaatgaagttcttctccggcctctcatggttctggtaccaaagcaacaccccggcttctagtcctcgctctgcgaaactcattggccatgctgctaggtagtgctgatttccttgagaaatttcataccgtagagctttgcctgcaagaaggtgcccggtaagaggatcaacgagcatgtagttgatcctcctgcctatgctaccgaattccatgaatctcaggaactcgctggcaccatcagcgagcctttcaaacttctgaatggttgaagtggtgatcaggctatcaactttcttctgtccagtgaaagatgataagaatgatcttgtggcatgggcgatccgtttagggaaggcgcactgcctgacctcctgctccatctcatcatcttccatggcacgacgcttgcatctttccatgacttggctgcactcatcagatgtgcgcttcagcttcttcctccaacgcaggagtgaggcgtctgtgaccggaggccacctgctggatatctccagggctgcctccattctgatgcgtgccatctccagcctctccatgccatcttcctcgtttaatttccgtttatgcttgttgatgaagaaggtggagaccctgctcacagcctcgctgattaccgcggaaacaactacttcagacatcaggatgttcttgttgataaaccccttcctgcttgtaaaagtggaacgaaaggtctagttagaactgttcatgacagatctagagaaacagaggtgtacaagaacttagaacaaaatgtactcacctcaccaagctgcttcaaactaatgctttaaacatactgcggttgtgacttgtgaagagcatacatctgtgtggtgaagaggggattcaattgattcacaatggcagggggacttgtcatccggtagcaggatgacaagtcttccctcaataccgcctgtatttctccaaatactccctgtaactgaaccaactttggaataatacatatgttcaggccgataaaatttctttccatactcgtttcaaaataattaaaagaaaaaaaagacaaatcttcttctgtggaaggatccatcaaatataaaatgaattaactgaggaaaataaaagtctaagattgaaagatagattctggtgacaaactgattggtctcaatcacagctagttggtcagaagaaataagtccatgactgacttcgtggagaaaaaggttagcaaagcaaaattgtgttttctcagaagttaagtgggtcatgttggatgtatggtctaattaacatagcacaaggtgagaagtgagaacacatcactttttagactctaattaacatagtctccgtatgatttgtcaagcaagaaaactgccctctatgaccgtccaatctcattgcaaggctagccaaagataaatcctccacgcctctgcaattaggacaatttaaagtaactactcgtcactgcaatcagtttcgggtactagtcttgactcttgtgtggtcgaacagatcttttgccaattctcactgaacttatctttcccctaaaaagaacagtaacccattgcctaaatctgttttgcaggttgtgtacagatcgatagccctgatgcagcgctggagggtgctccaaacaagaaaagactgcgccctgctagagctggacaacgtttttaagaagctgatggataagatgtacaggctgtgtctagtttcttccaaagttgaaagtttggattgaaattggtacgatgtgactgaaaagttgtgtgtgtatgacaggttgatgtaatggaaaaagttggaagtttggattcaaagtttggatctaaacacagccacagctttggcctggagatgccctgccctccgtccctaaatatttaacgccgttaactttttaaacatgtttgactgttcgtcttattaaaaaaattaagtacttattaattcttttcttatcatttgattcattgttaaatatacttttatgtatacatatagttttatatattttacaaaagtttttaaataagacaaacgatcaaacatgtttaaaaaagtcacggcatcaaatatttagggacggagagagtattagggaagatgggtgtgtgggggtgtttttggctggtttactctctgttctcccttcctggagatgggcaaagggcactgaaagctgacgatcccagtggtttaccatgtttccgatctggtagttttatttttctgttgtgtaagattctttcagtaagtttgaggctttctttcaaaaaacagggtaatgaaattacctgcagtttttttttaaaaaagaacagtaaccaaactgcacagaacaggtcgcgacaagcagcagtgaaattgaatgcgagcaaaatgtcgtacatatctgggatggagcgtatctgggatggagcgaattaacgcgaacaccatattacataaaatggcagatggcatttactaggaactgtcttttgtccgtacaactaagtaacataggaatgcgatgcaatagtggtgtggcgtcttgtaaataggtggtggctgcgaagcctcgccatctctgtgcattcttcaaattctcaatatactacggtcggcgtgccgacccggcgaatgcgatgcaataatctaccgtacaaaatgtaccaacctcatcaagctggttgaaactagtgcttagaatatactgtaattgtgccttaaccaaaagtttaagattgaacgatatattctgccattctggtgacaaactgattactctcaatcacagactaatcagtcagaagaaataaggaacacagggcttaaccaacctcaagctttgcaactgggctaagtaaaaatactgaaattattttaaacaataagggaatacctgtctgcttgtctgcttgatgattaaaattgtttggcttgacatgtccaccttcctcactcacccattcacagacccagcaatcaacttgttctccttcttgcaacttttttgtgtttccctttgtttctgtgtttcagtagacgatgaagtcagaataaatatgcatgtgttttaatgtttcatttcggaatcatcctaaatacatataatctgaaatgtaaaccgccccgaggataccactgtatgaaaattactgatatgcaaattacaatttttttacaaaaaataaagtgaatgggaatatgaaatagcaggaaatagggtaagtacaaaattttgtcatcaccttcaatcatggtaaacgcatgcgaattcaaataaaatatgtcacgcccaatgagtgaggatgtacattagattgatagagtatgaacatcatattatcaccattcaccaacataagtgatcagctggacaaacaatagcatatggagacatggagcacacattacagatcaacacactcctaaggacttctaaatttaactacctacaattcacttttcaccctataatattacatttccattcttcttaattctccctgtctccttaaccagtctctgtaaatgatctaaaatttcagacgcaatagtggagatgctaactctgtttccttttctttctgaatccaatcaaggatagagccctgcagctggacaggcgcatgagcagcccagaggttaaggaagtcacagatgaagtcacaggtcacaactgtgcgcctctgcgttctctgatccattccacgcagcagctttgctttcttggctcctcgaatggttctccgtgtgctcgtcatgttcatggttgccttcacaacctcaagatatgcaccgccatgtttagacttccaaagcatctggtacactctagcttttgcattctgatgaaaacaatctacagcctttggcagcatgatctgttccatttgttgtaaggcaatgtttgtgtgcaagcaatgttgctcattagcattaatcacctctaccacagaactctcgactgttgggaataggtctcctgaagagccatgcggcatatagataatgttaactttcaggtgcggaacttctttgatagaaggtttgccctcgacgatcgttccgcattctccaaacccacgcagtgaaacttcgcacttcaaactcacttcaataattggttctagagaaacgttttgtaatcctatcttgtccgtgtttccactgccacgtaccttcgcaccatgatgcttgcaacacagtgggtttgggcgaaaccattcaatagctatactatgaatgttgtaccaatggtttgaatgagcctgtggcacccaggagaagtcttgtgtaggtagcagagtaagttgctttctaacattttcagttgtagacttgaaatgaggggtaaacaactgcaagcccttaattatagtgccaactatgtttgtactctccgaaagttgtagcagcatacccaaaataaagttaccctcagatgcagtgccatcactgtaaacaaataacaacatagcttgtactcccctctccgctatgttattgggttgtatccaaaacaaaagctgcctgtttccctgcactatgtactctagagtttcacctgcaagaagatgcccaataagagggtcgaagaacaagtaatgacgtggtgtgcctccatactccacagatctcagaaagtcattagctccatctgcaaaccactcaaatcttcgaacaactgatctactcggctcgtctatattgccatggaagatggatgatatcagtgacttggtggcatgcgcaattcgcctaggaaagaaggaattccttgctacttgttcggcctcttgttcttcctggacacgctgcctgcacatgcgtattgtgtcatcgcactcttcagtagcacgcttcagcttcttctgccaacgtagcaatgggccactagtgatctgccacttattggatgtctccaatgcgaagtccaacttgatttgtgccatctccagcctctccaggttatcctgtgcacttgattttcgctcacacctatcaataaacccggatacgatcttgttaaccgtctcgtgaacgatagcagaaccgaccacctcttccatcttcaataatctctccctgatctgcgccgagcaagatacatcaatagatcgatcaggatgcccaaataaaacaaaaaatagataagtgaattcctgaaaactaataatgcgttgaagtatgtgaaaacggtaaaccgaaaccttctgagaggtgcaccagagagtacccagcacacgataactagattgaatgaatgctgagcctgagcatgaatgccatgtctttagtggagaaaaatcgagtaaatcaaagttggttgtattggaagttagataaccttttttttagccgggttggccataagaagaggccaaccaaatcttattaagattatgagagcaccttgacattaggtaacccttgacatatggttcgagaagaacaccttaattactattacactatgtgattctcctaattggaactattatactatgtgattctcctaattggaagcattaggagaatctgatgtcttttaatgcgttttttttgggttcttcttagccatggtaaggcgtggtgctatgtttggtgatcattttgccagtctgtctggtgtctgaacttgtaagcagagatgcgtttgacaggggtttgttagggggtagcaacctgaacttttgttgtgaaccttgtaatcgtatcgttttcattaatgaaagcgggaggggcttgacctctctttatcaaaaaacaaaaaacaaaaactatgtgattctccagttttttttaatgaaaacgcaacgattacagaagttccagagaagttcagcacgaagacagagggaacaaaagaaaaaaaaaacagaggacgattctccagttgatttatgctctctttcactgaccaaacgcaaattttgttattaagataagattgaaggcaaccaaaccaacaaggatggatgcttctgaatgctgattg

SEQ ID NO: 54841 - DNA, 1994 bp, Oryza sativa
ccgtccaaaacgaatccaatggagatggcgcttggtcccgcacgcaggcaaaaaaaatctccgtttcggcctaacaggaagcccgcacgcgcacaggacgcgcttaacctcgccctcgtccgcgtacaccggcgcagcctgagacggactcaacttcgcctcgccctcaggtccgcgtacgccggcgcttcacctcgccctcgtccggccaccgccacgagtcagctgggaggcgcgtcgctgcgaccggagaggcaccaggccgccctgccctgccgccgcgaccgggggcgcgtggaggcggccggccgccgggcctgacggcgcggtggtgcaggcgggcagccgcgcagcccgagcccggcgcgtggaggaggccgcgctgctcctgccgcgccgcacgtcccgatttcggcggcctcaactccacgatggatttcagcgtccgagcccgcatccagagcccgcaccagtcggccgcccacttcgtcgccggcgagaggtgacaccgccgcccggcttcgtccagggtaggagtcactgctggttgagtttgtggagaacgacgcaccttttcctgtgcccgcgaggtgtttgtggaaatgccctgccgtctgggatgatgcagagtcctgattgaaagtgaattgttattgtttggctttgtgagattagaagcaaattgattctgtaatcttgattgagattgatttggttgtatgactcatatatgctgtaatttgaatgaatgaatgaataaatcagtaacttctgacgatgttttctaaaaaattttgagatgtttgagatgttgcccaggtccatgatttgttcaggtttaaagtctggaatggacttatagtattgtctggtttatactggacatgagttgtgctgccatttcctccttttcgctatctctgctgtaaatttttagttcatgctaggtgggaggttccatgtcttgttatgatcagttgtcctatgcagcaatgttgctctgaatctctctctctgaagatgctgaatggagtgccgtcgttgctgtagtgctatcgtgaaatttcatggtcagtagttcctgtgcatggtcgccctgatcaatagtgggtaggacatctttggagctgtttttatgcgagattcctgcaaaattcctagtacgaattcatgtgttgcaaacaagcccgtatgtctccttcatttcttgatacgatagggatggattgtgttttggttgacaaaatccaaagagagcaattttgtgaatgaaatgagaatgccagaatggggctgttgctttgagcgatctgatatccatcgtggagttgaggccgccgaaatcgggacgtgcggcgccgcaggagcagcacgacctcctccacacgccgggctcgggctgtgggccgcccgcctgcaccaccgctctgtcaggcccggcggctggccgcctccatgcgcccccggtcgcggcggcagggcagggcggcctggcgcctcccccggtcgcggcggcgccggacgagggcgaggtgaagcgccggcgtacgcggacttgagggcgaggctaagcgcgtgcgggcttcctgttaggctgaaacggggattttttttgcctgcgtgcgggtccaagcgctaccttcgttggattcgttttgaacgggcgagatgcatcgtatgtcacgctgtgacttgccttagctaagtcaccagctgagtccccggcggcggagggcggagggcggaggccatggcggtgggtgaggtggtggtggtcgggttgtgcttgtgcagcccagttgcagtgaaaaacaaggccgagcccaagtaaggcccacactagttcaactcggcccgcacatttaatcatcagagcaatgcaacccagggatgcaagcggtccaacccgcgaacctgcttataggtaaaatgagtgaataacccgcgggttgacttgtggattacctaataatttgatatatgggctgcaggaa

SEQ ID NO: 54842 - DNA, 1289 bp, Oryza sativa
atggtggcccgcgcagattgcgcggctagcatcattatattttctctcatataatagcatatatgttttctcattatattattcaaatatattaaaatgacaacataattttaaattttgcaataactttacaaaactactaatgtgtaatattcatattatattttatatacgtgttagttattaattatttttaatatcaaattttaattatttgtaaattatatatattcctatatggactctagactcgtcttttaatatttcttttttttaattccgaattttctgtaaattgtatttctatatagactcctcttcttccaatattatttatttttatttctgaatttttattatttctaattgtatttctatgtggactctaaactcatatttcaatattctttaatttttaatttcgaatttcagtcacttctaaattgtattcctatattgactttaaactcttcttcccatgtttttcttaatttcgaattttagttatttgtgaattatatttttatacggactctaaactctacttttaattttaattttattatgtttattccaaattttagttagttttaaattcctatatgaactctatactctacttctaatattccttattttttaattccgaatttctattatttcctaattgtatttctttatgctctacttcttatattccttatttttaattccaaatttcagttattttctaattgtatttctatatggactctagtcacctcttctaatattccttattttttaattccgaatttcaactatgtctaaattgtatttctatatggactctagtctcctcttctaatatttcttatttcttaattctgaatttcaactatatctgaattgtatttctatatggactctagtctcctcttctaataatccttattttttaattacgaatttcagctatttctaaattgtatttttatatgaactctgcttattttttctccgattaatgtgagaatttttaggccttgagagcgaacatgttggcttctttttctatggatgatatataatagatagattcatatagacgaaagggttatctattgatgctagatgacagggacagaggaagagggaaacccattaaagcatctccaatagcatcttcattccactctccaaaccaaaatttagctattttgaacaaaaatcgcactccaagagtctctctatcccactctccaagccatccggatgaccaagttcctttcctcactaggggcgcagga

SEQ ID NO: 54843 - DNA, 1245 bp, Oryza sativa
cccccccgcctttgctctcttcgtgtttcatgccatacaattcgttggtcttatgtcaatctttacttattggatgctagcatgactatcgtgcgaacaattgataaacacttgggtagaattaagtgctatttttacttacacttcctcttcgtctttccaagatgatagctcgatcgcctgcctttctgggatgatagttcgcctttctttcttcttctttttttttctttcataatagacagataacaagcagctggttttgcagtgaaatagcaatcgacttcaactgtcattgcaccgtatgtagtccagcttcatgccaatttgtcccaaaatatgctatttttcactcacttttttctctccaggaaacatgtttgtcccacatactgatggcatcctcttttagggcctgttcactttggtgccattttcaaccttaccaaattttggtaaagttgccaaaaaaaattagctacatttagtttgctgccaaattttggtaactatataagaaatcctgccaaaattttggcaagttaccaaaattttggcatagttgccaaaattttggcaatgccaaaatttggtaaggttttttttggcagcaaagtgaacaggcccttagttctttcagctagcaaagatccctcataagggtacaagcaagcagcacatggaactgggtatgtttataccgtgcaccttggtgttgttattactgtcatatggagctggaggcatcaagggcggcgcatcaacgcaagatggggacgtcaatggcacggacttggcctcgctcctagatttcaagcgagcgatcacgaacgatcctttcggagccatgagctcgtggaacaccaacacacacttgtgccggtggaagggcgtcacatgcgaccagcgggcgcatcgcgtcgtggcactggacctcgttgggcaaacattgaccgggcagatctcccattcccttggaaacatgtcgtacctcacttctctgagcctccccgacaacttgctctccggccgagtgccacctcagcttggcaacctgcggaagctggtgtttcttgacctgagtggcaactcgttgcagggtattattccggaggcactcataaactgcaccagattgaggacgttggacgtttcaaggaaccatctagttggtgatatcactcccaacatagccctcctctccaacctgcgaaatatgcggcttcactccaacaacctcactgg

SEQ ID NO: 54844 - DNA, 3440 bp, Oryza sativa
aattcctgcagcccttggtaaactccggaagatcgaacagcttggtcttgacatgaacaatcttgaagcaagagacagttggggatgggaattcctagatgcattgagcaactgcacgcgtcttaagatgctctcactgcaccaaaatctactgcaaggtgtcctgccgaattctgttggcaacctctcctctagcatggacaaccttgtgttgagtaacaacatgctttcagggttagtgccctcgagcataggaaatcttcataggttaactaagtttggattggatttcaacagttttactggtccgattgaagggtagattggaagcatggtaaatttacaggctttatacctagacagcaacaacttcactgggaacattccagatgccattggcaacacctcccagatgtcagaattgtttctttcaaacaatcaattccatggtctcataccatccagcctaggaaaacttcgacagctctcaaagttagacctcagttataacaatcttgaaggcaacatacctaaagaggtcttcacagtacccacaattgtccaatgtggattatcccacaataatttgcaaggcctgatcccttctttaagtagccttcaacagcttagctatcttgatctttcatcaaataaccttactggggaaattcctcctactttgggcacatgtcagcaattagaaaccatcaacatggggcaaaacttcctctcaggaagcattcccacatctttgggaaaccttagcatcctaactttgttcaatctttcacataacaatttgacaggatctatcccaattgctctaagcaaactacagtttctcacccagttggatttatcagataatcatcttgaaggtcaagtgccaacagatggggtattcagaaatgctacggccatctcacttgaaggcaaccgacagctttgtggaggagtactggagttacatatgccttcatgccccactgtttataaaagtaaaactggacgacgacattttttggtcaaggtattggtccctacattaggcattttatgtctcatatttctggcctaccttgcaattttcagaaagaagatgttcagaaagcagttaccattgctgccttctagtgatcagtttgctatagtttcttttaaagatctagctcaagctacagagaacttcgcagaaagtaatctgattgggagaggaagctacggttcagtgtacaaaggaacgctaacccaagaaaacatggttgtcgctgtgaaagtttttcatcttgatatgcaaggtgcagatagaagtttcatgacagaatgcaaagctttgaggagcattcggcaccggaatctacttccagttctaacttcatgctcaacaattgataatgtaggcaatgatttcaaggctctagtgtataagttcatgcccaatggcaacttggatacttggctgcaccccgcaagtggtacaaatgcttcaaatcaactgagcctgtcccaaagaataaaaatagctgttgacatagcagatgcattgcaatatttacaccatgactgtgagaatcctataatacactgtgatctaaagccaagtaatgtcctcctagatgatgatatgactgctcatttgggagattttggcatagcacatttctacctcaaatccaagtcacctgccgttggagattcgagctcaatctgttcgatcggtttgaaaggaactatagggtatattgccccaggtatgtttctctagctgtaactttgtcacttatgtgacagacaactgattatttacatgaactcttaccttaccttgcacatttcacatgaactcagaatatgctggaggaggattcctctcaacctctggagatgtatacagctttggcgtagtactattggagttgctaacagggaaaaggcctactgatcctctgttctgcaatggacttagcatcgtcagtttcgtcgagaggaactatccagatgtgatagatcatatcattgatacttacctccgaaaagatctcaaggagcttgctccagcgatgttggacgaagagaaggcagcataccagttgctgttggacatgcttggagtggcactttcctgcacacgccagaatcccagtgaacgaatgaacatgagagaggcagcaacaaagctgcaagtgatcaacatatcgtatatatctggaatgtagagctaagtatactatacacttcattagtgcgcgtaccacagtgtataaaatggcaggtggcatttacaagtaactgtcttttgttatccatacatttgattataagggcaatgcaagtacaaaatttactcatctgtagacgcgggcagtctccccgtagctgctgtagcctgttttggaggagtttggtgtagaatgtaatctctgtagcttgattcaaaaaaaaaatgtaatctctgtagcttgtaactctcttgccgaaaaatcttaataaactttggctggcatacgccagcctgcgaaaaagcaaaatgtactcacctcaccaagctggttgaaaatagtgctctaaacaaactgcaattgtgactggtgaagagggttagagggaggttcagtatcttcacaatgtcaattggacagttactgcaatgtatttctccaaatagtctgtaactaaaccaacttttgagtaatatctatgtttcaggccaacaaattgcttgccagttctcaaaaaataaaaataaaaatgctgtagtagtttaagaaaaaaatggcaagtttttgtctttggaaggatccgtcaaatataaactgaatcaactgagcaaaagaaaagtaaaaaatattacattccgttgataaactgattgattactctctatgacagattaatcggttagttgtgaaagggtatgtaacctagtgattgcaatgacctgagtagcaccacaaggtcctgagtttaaatctttataggagcgaatttcagattaggttatttgagagctaagttccctatttgatagactaagtttctaattttaaaaggttgcatatatctggttggatgtagaggccagataaaaaatatccttctctaaaaaaaataaaaagaaagactaatcagtcagaatactgatataaggtagagtctctctacctttttgagtcaaaaaaaaaaaatcagtcagaagacaaggtcaagcttagcaactggactaagtacaaaaattttggaattcttttgaacagctgtaatggaaaacctgtctgtttgacggattagaattgttccctttcggagtcatctgttggcttggcatgtccacccaccaatcagctttttctcctacttgctgcgttttgtgtgtttcctttgtttctgtgtctcagtacacgatgaagtagaagaaatatagcatgtttttttttgttaca

SEQ ID NO: 54845 - DNA, 2486 bp, Oryza sativa
agactcgaaatgaggagcaaacaactgcaagcacttaattatagtgccaactatgtttgtactctctgaaatctgtagtatcataccaagaaaaaagttatcctcaggtgcagtgccatcattgtaaacgaagaacaccataccttctatcctctctgcaatgttattgggccgtatccaaaacaaatgttgcttgtttccctgaaccaatttgtactctagcatttcacctgcaagaaggtgcccaataagagggtcgaagaacaagtaacgacgcggtgtccctccagactccacagatctcagaaagtcattagctccatctgcaaaccactcgaatcttcgaacggtagatctagtcggctcgtcgatattgccataaaagatggacgatatcagtgacttggtggcatgggcaattcgcctaggaaagaaggaatcccttgctacttgtttggcctcttgttcttcctggacacgctgcctgcacatgcgtattgtgtcatcacactcttcagcaacacgtttcagcttcttctgccaacgtagcaacggctcactaatgatctgccacttcttggatgtctcaagtgcaagatctaacttgatttgtgccatctctaacctgtccatgtgttcctgcgcacttgattttcgctcatacttgtcaatcatgccagatatgattttgttcactgtctcatgaacgagagcagaactgaccacctcccccatcttcagtaatctgtaggattccctccctgatcaagaatcaatatatactatatcaatcactaaatcaaaagacagaccagtgaattcctaataagtactaacaaagtgcaatgctgtaggatatgaaaaggccagccttctgaattgaatcaattttgtgatataagagatattcatgcagggggcagtgaaatgaaataatgcatgattccatacagaaaaaagtgagaaattcaaagttcaatgtaaggcctaaccttctgggttgaatcaataagaagtaacttggggccttgggggtcagacaggtgcacccagagagagagagtacctagcacaagataactggactgcagttttcaagaatgaacagtcctgtaacacaaggaggtatttatgcaggggggcagtgacgtgcatgattccagggagagagaaaaaaaaagtgagcaagtcagagttgggtgctaagcgcgtctttgtttgatgtgtatggtggagagaacacatcactctagtctaatctcctgttgattcgtcaatcaacttaaaggactaccctctttttgagcttttgaccgtcctaggtgggattgatgatctgccacactcttttagaccggagatttgatggtttgcaatcttgggctaaagctaagcatcagtcgacactgcaaagtctgcaatcaattcagttccggctactaacctttacggcctgtttgaagagaaggaaagaggaatggaagttttaaggagggagttgatagtgggattggtcatgggagttatatttttagtccctatcctttcttttgtttcacatcgaattctctccaagtctcacgaattaacaggcctcctccaggtaagagattggtgggaattggacctcttaattccccatcccaaaccccttcgaattcccaaatctttcaatcaaactacaaacttaaacttccagatatcatacactctcattccccattatcaactcccaccaaccaaacaggccgttagtcctttaccatccctttcacctccttggttgtgcatatacttcgtcaatatagagcctggactaatgaaaatcctcgaaatttggtcggctccttcgctgacccggcaaaaagttaatgaaaatccattatcttaaaaaaaaaaaatctctttcacctcctaaacagaattacagaacagtaattaagcatggaaccaaagaaaaaactggttgcgagatgcggggaaactgagccgtaccacgggctagtgcgcaggcgcatgaagcggccgccgcgaggcgcgagcaaacagccgctctcttcttcttccctctccgcgtcgccgcacgcgccaccacatacggcgccacctagtggtggagttgcagcggatcgacgaatgcaacgccatgcccggacctccctgcgagcgccctcgtcggcgcggactatcgatcgaccagaaaccccgtcctccggcgacggcggcggcggcggccgcggccgcggaggccatggccagccgcggcggcgtgcttgtggtggtcggccttcatgcggcccaagtgtcagtggaagcttggccagcccatcgagggcccaactaaagcccacactaactcacctggttgttacccttcttgcttcgctgccacaatacaactttgtttacaaataaagtcatgcagaatattgtgtatgatcatcgagcacaatattatcatcaccaactggcgtcatcacaccatt

SEQ ID NO: 54846 - DNA, 12690 bp, Oryza sativa
taaccccaaaagaaaggaaaatagaagtgcatgggaatatccaatagcagaaatctgagcgagatactgatatatgctaattttctcatcaccttcaaggcttcaaacatattacacgcatgtaaattcaaatagaatatgacatccaaatatccagtggtgaaactgtacattagatttccagggaatgaacatcaagttatcaccatttactaagttctgcgctgcgcaaacagcagcagcaaatatatggagcacacatttcagatcaatacactcctaataacttggagataactccctaagtcacttcccctgctagaatattactccctttgtcccaaaatataagcatttttatccatattcttagctaaaagtgcttatattttgtgacggggtagtacattttcattctttgaagtatccctatttccctgacaagtccctattacatgatctaaaatttcagatgtagtagatgaggtgctaactgtgcttccttttctttctgagtccaatcgaggattgagccctgcagctggacaggcgcatgcgcagcccaaagatttaagaaatcagagatcacatctatgcgactctgtgtccaatgatcatgtcgtcgcaatagcttcgctttcttggctcctcgaatggttctctgcctcagcatgttcttggataccttcacagcctgaagatatgcaccaccatgtttggacttccaaaccatctgatacactgttgttcctgcattctgacgaaaacaatctacagcccttggcagcatgatcccttccatttgttccaaggcaatgtttgtgtgcaagcaatgttggtcaacaccattaaccatctctatcacagaactctcgactgctgggaataggtcttctgaagagccatggggcgtatagacaaggtgaactttcagatgcggaaattctttgagagaaggtttgctctcaacaactgtgacctgatcttttaacccaggcagtgaaacttggcactgcaaactcacgtcaataactgattctagagaaatgtctggtaaatatgtcttctccatgttgccactactacataccttctgactacgatgcttgcaacacattgggtttgggcggaaccattcagtaactgtactgtgaatactgtcccaatggtatgaatgagaacgtggcacccatgagaagtcctgtgtaggtagttgactaagttccttcctaacagtttcagttgtagacttgaaatgaggggcaaacaactgcaagcacttaattgcagtaccaactatgtttgtgcactctgaaagttgtagcatcatacctagaaaaaagttattcacaggcacactttcatcattgtaaacaaagatcaacttagcttctactcctcgctctgcggtgttatttggccgtatccaaaacaaatgctgattgtttccttgcactaatttgtactcaagtgtttcgcctgcaagaaggcgcccgataagagggtcaaagaacaagtaacgacgtggtgtccctccaaactccacggatctcagaaagtcattagctccatcagcaaaccattcaaatcttcgaacagcagatctaatcggctcgtcgatattgccgtgaaagatggatgatatcagtgacttggtggcatgggcaactcgcgtaggtaaggaggaattccttacttgttgttcagcctgttcttcttcttggacgcgctgcctacatttgcgcagtgtatcatcacactcttcagcagcacgcttcagcttcttctgccaacgttgcaagggcccaccagtgatctgccacttactggatgtctcaagtgcagtctccaacttgatgtgcgccatctccaacctctccatctgctcctccgcacttgaattttgctcatacttgtcaatcaagccagatatgattttgttcactgtctcatgaacaacggcagaactgactacctctcccatgttccctccctgatcaggacagagcaatatatatatcaatcactacatcattatgcccgatagaatcaaaatacagacaaatggatacctaataagtacttaaaaagagcaatgttgtagtatgtaaaaaggccaaccttctgagttgaatcaataggaagcaatttgtggtcacacaggttcaccgaagagtacccagcagacaataactggattgcaatttgcaggagagcttagtgcgaaagacggaaagactgacaatagtgtaagataacagatatttatgcagggggcagtgaaatgcattaatgcatgattctggtgaggaaaaagtgagtaattcaaagttggtgtaagcgagtcttgtgggatgactatgtcatccaggagaatacatcattctagtgacctagtctagtctctagttgaaactgccgtctcttgattttgactgtccgatcctgggctagctaaagttaaatccttttgtcagttgtctcttgtcagtgaatggccatggcactggcttgcttgtcacctgcttacgtggtggtggtcaaaggggtttattgggccctttgtcagtcaaagcttggctggcctatcgaggcccaagtaaagcacatattaactctccatatgccatatggattttccctttttactactattattatgttaataaccctgacctcctctagtcctatagtaaaatggaagaaaataacttgagatagagaggtgtataatagtacaatatcaagatttcagcagaaaatatactcacctcaccaaactagttgaaaataatgatgtaaacagattgcactgcaagcctgaagaccataaatgtgcgtccagctggaaatggtaagaggagagttcagttcagttgcattcactgttcagttcaattcagctggaactgtgcgtccaaactagttaaaatgtcaattggagggtgaaaaggcattattacctctggtatttctccagatattctgtaactgaaccaacttttgagtaatatatgttcagaccggtgaaattgcctgccacactctgtttcacaggattgcaagtcttcttcctttgcgaaagggtccatcagcatcaattataaaatgaactgtacatactagtgacacaattaactattctgaatcatagactaccaaccggtcatgctttgtaattggaccaagtattgggattcttctgaacacttttaatggcatacctgtcttccatatgcattgaaattgttctatttggcaccttatgttggcttggcatgcccacctccacacagacccaccaacagacacaaaaaatgacttggtctcctccttgctgcattgttctgttttctgtttcagcacatgatgaagtcagaatatattattacatatatgcatgtgttgtcttctctcaattcaaaatctcctaaacatatagagtagtttgaactaccatagagatggtacaaatgtcaaactgacaatttctgtaaaaaaaatgcgtgctggatgcaaacaacccaaacaaaaaaagaagtgcatgggaatgtgaagtacagaaatttgagtgagatatgaaattttttcatcactttcaataacgatacatgcatgcaaattcaaataaaatatgacatatccaaatttccaatgatgaaactgtacattatattaccagagaatgaacatcatgttatcatcatttacaaacataagttttgagttagaccaacagcagcagcatatgtagcacacatttcatatcaatacactcctaatgacttagaaatcaactccgtatgagttacttttctctgctagaatattacatttccattcatttaattatccgtgttttcttgaccagtccctgttacatgatctaaaatttcaggcgcagtagaggaggtgctaattgtgcttccttctctttctgaatccaatcgaggattgagccctgcagctggacaggcgcatgtgcagaccaaaggttgaggaagtcagagattgcatttgtacgatgctgtgttttatgaccctgctgttgcaacagcttcgctttcctagatcctcgaatggttctctgtgtgctccgagtgttcatggttgccttcataacctgaagatatgcaccaccatgtttagacttccaaagcatctgatacaatttcgcttctgcattctcatgaaaacaatctactgcccttggcagcatgatctcttccattagttccaaggcaatgtttgtgtgcaagcaatgttgcttatcaccattaattacctctattacagaactcttgatttctgggagtaggtcttgtgatgagccatggggtgtgtagacaaggtcaactttcatatgcgggcattttttaagagaaggcttgcctttgacaattgttccctgttctctgaactcaggaactgggacatggcactgcaaactcacttcaataactggtcctagagaaacaccctgtacagatggcattcctagattgctactttcacagctgtggttctgaccatgctgcttgcagcataatgggttagggcgaaaccattgggtagtaatgctgtgaatattatcccagtgttttttgtggcatgattcagcatatggcacccaggtgaaatcttgtgaaggtagctgagtaagttcattcctaacagattcagctgtagacatgaaatggggattaaacagctgcaagcacttgattacaatgccaagtatgtccacactctctgaaacttgtagcagcatacacaggaaaaaatcatcctccagtgcactagcatttttactgtcaaagatcagcctagcctctattctattctctgaaatacagaagggccgtatgacaaacaaccggtacttattttcagacactaatttatactctagtgttttgcctgcaagaagttgcctgataagaggatcaaagaacaagtactgatgtggtgttcctccaaactccacaaatctcaaaaactcattagctccatctgcaaaccactcaaatcttcgaacagcagatctacatgagccatcgatattgctgtaaaataaggaggacactaatgacttggtggcatgggctattcgtctaggaatagaggaattccttacttcttgttctgcctcttcttgttccaggatgcgttgccggcatttgcgcagtgtgtcatcgcactcttgagcagcacgcttcagcttcttctgccaacacagtaatgaagaatcagtgattcgccacttacaggatgtctcaagtgcagcctccaacctgatgtgtgccatctcaagcctctccatgttctcctctgcgcttgattttcgctcattccagttcaccaagccatgtatgatttggttgactgcctcatgaacaaccacagaactaacaatctctgccattaggactcgatcacatatcactatgcccaatgtaataaagggacagatcagtgattcctgatctgtaatgaattgctctgattatagtagaactacttcagcctgctgagtttgaattggtagaaaagaacctgggatggaaggtattgccaaagagcacatgaagtggcactgtggcagtataagaatctacccagcaggctgagaccagattgcctgaatggcgagctcacaattctgtaatatatactgatatttggaagggacagaagaaagtgatcagattattgtggaattaatgaaatgttcaagtgggcctcttcggccctccgctgatggctcaaaaaagaagaagaaaaaactattgtggataggaatggattgtgatacccaggacttttgagggttaatgggtcaaaagtggttagcgagtcctgcactcagttggttttgttatattctcaaggagaagaaaatggccaaatggggaccatttgctacaacaatctcttgcgatgaggtgactggtctttgtcatttggttaattcttcaatgacccttgtcaaactctggtcattgtttaatcatttagggagaagaacggaataatatctagtccgatgcctggcatcacgttttcctcgtacacgaaagtgaaatcagtttccctttcataatgggatgtccttttctacagcataaaaccgattagacggtagtatcttatcactattgcagaaaatgtgaaagcaaacgtaagtaacttctaaagttgttgacgatgcaactacctataaagcacatccatggtggaaattaaattgacccctagctaattttactcccttagtatgaacagatggtagaaaaatcaaattgatccctcgctaattttactccctagtgtgaaagatggtagcatcattcgagcaggcggtgaaaaatcttctccatcatctgacgggacgccggcggtaacaacagtaaaccaaccggagatgcgagtgaaccgagcgtgcatacctcgagcgctcgccgcggcggtagtcggtgggtgcgcttgtgcttgcgcctcctcatctccgtcgcgccggggcgcagctagcttccccctccatgctccgcctcctacctccccgtgccgccatgcgcgcggcggctgcggcggcggcgccgccgctcgccgccagcgctctcggtcaccgcggcagtggactgggccgaaagcaacagcttgaaagcctcatttggctaggccgaaatgacagcccgcttacatagattaatacacgtgggtgggccagaattgaggcccatccaaataaggcccaagagataaatattgctcatctatttcagcaatgagatagtaatgccgattttgttatatatttgtcgacgtttttttctaaaaattatattgaaattacaatgaaattttttctgtcaacaaattttgctatatataaattacaatgtaattatattgagattgtactatatttacatttgtcaaacttttagtacaatctcaatgtaatttcattgtaattacatgtaactatcatgtaattttgaaccattcgatttgctttaaaattcgtgtatgaaaaaataactaactgtgacagaaaaaaaataagaactgaacaatagctagcagatgtaaaacatgtacatttgcattgaacatacaggaaattaattaacatagactggcttgtcaagagtcaagactaagatgggccttggctaaacctaaacacactggctcgtactagtacaatattatacatcttttaatttgaaggggaacatcttcagtaagcatatacataatacatgattaaactgtccgcccctaccaaaacttacactagttatgtcttgtctttgatactctcctggccttggatctgcaactagaattggttttgcagctccggatgcgcggcttcatcagacaaaggtatccataaccatgaactgaatgaaaagacagtgaataaaaccccaagtcaggttgacagacgaagcaatccattaccttgggcactaacactgccatctcctgcatttcgtgcagactagcatacatacacttatcagttgctccccgactactgtaactcccccgattggcttcagggtgcgagaaatgaggcgaaatattgatcaccatcttcaggatagaccaatccctcacaatattgcttgagttgtacaagtaattgtactcaacagccgaaatgtagctgctgcagcgcacatagataacttgttctggaatatcatatggtaaattgggcgagatggtgttgtcagcacaaggatcgagcctcttttctctgcaacaaaatggatcagggcgagcaactgtagctcgaaaggcaagaaagctccgatggtagtccacggcctgaagtgctagcagtggttcgaggtcttgaggatgtgagtgttgtagagcagcaagttgaccaattgcatctttagccaaacgcgtgaaatgaggcccaagtaactgcaagcaattgatgataatcctaactatgtccgtgctctctgagagtcgtagtatcagcaacagacaaaaatttttcagtggcattctgctatcctccttatttaactgtatcaatgcctctacgccacgcccttcaagagatacaggtactattgtaataccaagggttttgcttccttgcaatggcatgtcatacttgagatgtttcccttctagaagtggtctgatgagagagctaaaaaagttgtagtgccaaagtgtacggccagtctccacatccctcgcaaacttaccagccttctttgcaaaccattcgaatctgcgaacatgggagcaactcaaaagatattgcttgttcatgccaaggaaagacaagacatatgatttcatggcttttacggcttggacaaactgcttgggaaaatagctgtgtgttaccccttgctcttcagcaacttccaaaatccgcaccttgcatttctccaccacttcactgcactcctcataggcacgtttgaacatcctcctctgacgaagcaaggaaacatctgtgatgggtagctttgaagatctctctagggcgtgctccaattgagcgtgtgccatctccaacttctccaagttgtgcctctcggacaccttctcccggttgctggacaagtaggagacggctccgcccaaaacctcttggacaacagttgaggccaccatttctgccatgaggactgtttctacagaaaaaaaaaagaaaaaagggagcattttgacagaagacataaagtgaaagtgattaggttgcagagagagctcgaaatggggcaccatattcgcttaagggacgtagaaattatcacattaattgaagaaaaaaaaagtaaagatattggccatttgatcgtgataggtccaaattataatgatatagattgatcgatatagttgtatataaaaaatacagccatgtctatataaatagtagaaagtaagagttgtctatcaagtatcaaatccaattctaatgttagaatctgttatatacaaattacaattgaatctaagaaacttaagctaagaattgttactaaacctgatcctacttttgaaatctaggtctgctcaaaattgcgcagggaaatcctctaaattatgttacatacatacatacatacatacacacatacaatatgtgcgcgcgtgtgtgtgaagctgtttttaagaagttaaggacaaagtgatttatatttaaaaattataagatttaaaaggaaaccaatttcgggctctcaatttagtggtatcctattaatttaatgaaattaaaaattgacaattagcaaattgtaattgatgtctattcttctttcaatctaagcttataattcactcccactagacggatgaatggatagaaggtgagtgagaaaggaggaactattactagatatgtagtggcagcaatttattcactgcttttcctattaagatattttcttgaagtacccagttagtataagtataggtagatggtatgcataataaaattctcacctttgcctcttaggctcttactaaagaaccgagatactagccactgatcccaactctgagaagatttggaagctggccaggtcacatgcagagaattggcctagtggcgtactggtgttattgatttgtattgatggacctggacaaaccatgcatgtaggacagtaggagtaagcagctgtcttacaaatgaactaactgtctatatatgaagaagtagagcagattgagattattgtaatattactaaaccttaataatataatgagtattcaaaaaagtaatattactgaagttgaacatatgaaagacagaaagagacatgaaaagtttccacgaaggaggaggaaagttcctaattaagatgtcacattcacccgcaaaaccgtaggaagttgcaaacgagggtagatttacattagcatgggtttgtctaatctgtgtttatctacttaagcgcgtcatttagccaaaaattctgtaatcaactatgccatttccgcatttcgtttccaagataggagtaatcaatacttgaatcgttctcccaaaaagaaaataaaacaatccaatccttatcatgctcgctggcggaggctactcagtcatcgacaacaaatcttgaattcttaagatcatcacccaccctaccacttcttttatctggtgtttgttgttacctaatgatgatgggatcatgtgacagaaggtgccttagttccctgcaatttacgatcatatagataaataggataagaccctatagataaatgatctcaattaacgcgaaactacgctataatcgcatcgatgaaaaccaaagtggaaactaacacgcgcttatattaatttattagacccaaaactcagtggaaattataggagactactagaatgaatcaagcggaaaatgaaattgagaaatagtagttggtgcatgtacttgacgcgcggtggcaggtgaagcctccttcatcctcttcaccctttgcctccgcggcttctccggccgccggaggaccgcctcgcctcgccggacccgtaccccgtcgtggtcgacggcgccaccgccgccgccgccttcctcatcgccgttcctctctctctccggttcttccccttgtgactcttacggcctataatactatgggctttatctaatgtagtgtaatgatgggccgggcccattagcgcaatgggccaataaatttaccaacctcgaatgaatttccgagaatttcaggcaaaaatcaaaaacttttctccgaatttgaaatcccaattcgaatccaccggaaggggagaggcggcgcgacgcgaatggcgcggcggcggcgggagaggcggcagctcgctcgcctctgcgacctcgtcgcctgcgcactcctcccccacctcgtaagcagctctctgcactggcctctgatgactctggtctcctagtcctagcctatcactccgtgcgcgccgctcacaggaacccaagccgccggccacgcggctcacacgggaggacgagcggcggatcctcctcgcgctctcccgagtaatcctctcactagggttcgcgattgttactgctgcgctctattgcccttcccttccgtgatttttttgggatttttttaggtaagtaaggcgattcgaggatgggaagaggaagaggaggaagaggaggaggaggacgacgacgaagggtgcgaattggatcaggtattgcctccgatagcctttttttggtcagtttgattgttgaactgctgtaggtttagtcgaaattatgcgactgactgagcatttgctttatattggggttgaggaattagaacgtaatgataaaatctattattagcacatggctttaaccctgtagtgtaaggtatcatcacggagcagagagggagtggtttgggattgtgatgatgatgtagaatggcttgtgaaatgtctttatggcatcaaattacttagttcatgtagtaactgatttctgttttgtgagggaatttgtttgattctgtcactcaggttccaagtattacattcatttgtttcttaccctttttctttaggagattatttcatgttccgcggaagttcacagttgcagtttaccagctaaccagcattttgatgatggatttagctgcctggccaatattatctccatattggtaagaatatttcatatacagctttgttgcgtcagccatcaactttccaatcatagtcagcgggatcctcatatggtcccagttcctcataaccacctgttacagtattaaatatgaagtgcacaatattacccttcgtccctgccattgagcaatggctctttagactaaatacatctggcactttttatgctactatgaaccaataagtaattgttggggtctttgggaagcgaagggttctgggtgctagtgcctgactgcctgagtcattcattgtttatatagcaacacaaagacaatgagcaacactggattagtcttcattttcattaaccttaatcttttacatttgttcaggcatattggcatcaggatatataagtagggcataggcgttatcccgatcacctgtgggtctctatcaacaactttgaatcatgtcatttgatccgtaagtagtgttaatgtgtcatccactcttaccaatagaaaagggaggcatgaaaaaataacaacaaaattaaccagaggaagttgttgaaactgtggctccacaaaaattttaaactacgtatactgcttcagaattagatattattgacaattgtggtgactgtatactgttttattacatttcgtaccctcatgctttttttcttcaacagcttactttgttagtatatgacatcatccttttcaggttggcttctttggtttctgtagcagttatgttaaacactcagctgggaatatcctgattgtcatctctgactctctaatgaagtttgtaagcttctcatgctttctcattttcaatctgatccacacttctctctcaaaaatatttattattccatggttgttgctctattttaggaggttgtttggattcaatttgttgagctggtctggatagctatacatacagtatcaacatgcgctcatagtgctttaccttctttaattgactccatcagcagtttcagaaaagactcgatttgggctgcaggaa

SEQ ID NO: 54847 - DNA, 2242 bp, Oryza sativa
cactattttaaagttccttaaacacactgataatgaactgaaagaggacttcatttgtatatctgctcatcatattcttatggttgattgggatttgtattatcaactcaatgttggagaacctctaaaccttgtcaaggatagcacatttagcttgagtgatgatttgaaacagttaggatttctttcaagcagtctcctccaactattgtgctctttacttgagcaaagtgacctggaagacaacaatggacaagatatctatgctaagcttgtaggtgtaattcctaagttagtggctatattaccagagcatcaggatgcccccaaaagtctctctcagtacttaaagcacaaatttctggtaatttcagacatgcaaagattttctattactgcactgacatttttgttgcttttcattttttacgaataagaattgtaaaacagtttttgattaatcaggtgcatataaagttcttctatgaaattaaacattttgtttttggaccatcatcagtctgctatttatttttcaatgcagatgataatgatgcggctaaagccttacatccagaaggattgctcatatattgtttgctgcctgaaattacttcgacaacatttccaggatcttcttcatgaacctataatgcaacatattgctaaaccagaaaactgtttggaaggatccccatttttgttgagcactgtaggtctgggtgagactcatgataaatccactaggcacttacaaagacaggctatgtatttgtttcttagcttttgcatatgtttggctcacaatggcaatgacagtgcactgcaatgttcatgcaagagagacgatcaaatgcttggtcacaaagttctagactgcagtgatcattgtgactgttttgccttatcagaaatttcagactggtttcagagatgtttcttagataagatttttggcttcaaatcatctacagacaatgctctgtgctttctgcagttatatatggaggaggtatgcatctgttacaattgcctggtagctaattaaccttgatcaatgttcaaggtagaaaatatgtttcatcttgttggttttgtttaagtagtttttggtaacttggatttggcagtagttgcaagtatgctgtagttgtcttcggaagtgggttgttgtggacataatttgtttccttacagtaggatatttctcatacatttatattactctacactactatagagttgcctgttatgtttggcataagccccagtgaaaaggcatgttagttattacagagaggtgctaatgcttttattccagttgtatttgtcttctctgcactttctgtttttccaaaccaattcatctagatgcttaagttatttgtcagctaagtttgttaattttcctagtgttaagtgttaacataatactgatctgttcctttatactttaggatgacatgctgttcaacgttctcttacaacttcttgatgctccactcatttcctcgaaaatgtaagcaaagagtaaagcagtttgtcttagaaagttatccagatctgggtgtagttaaaagttatgctctttttttttctgaacttgcagagatagcatggagaatagatgggcttctgaactgattggtggcaaactgttctcgagcatttttgacccagttcatgttttccatctcttgcttttattggtgagtcagtgaaaatacttttacttcatgtcactaggtttataagaagcacaactctctgcatggtggattggtggcattttaaatttcagttcttgttcatttctctgcacaggcatactgctgtatgtagtaaaaatatagtagcaagctttagtaatcagcagtgttcaaaactgtttaagataggggggcatcctttactatttatttggttgcggattccttcttaccgtagcttgtactcaaaaaaaaataaataagacactcttatttatgttccatgttctttcaagttcagacaatcatatggagggttatacaatgtgtaaagggacattacaaacttaataaagtctcatgcatttgctggctcatgcaccattacttttctgtagatttccaatttcttcttctgattccactctacaatatgagtcttgaggataatagtatttgtttattttaatgtcattctgcagctgcactatgatcacttggtgcttgttgattatctgatatctaaagatgta

SEQ ID NO: 54848 - DNA, 1679 bp, Oryza sativa
aaatttgagtagcatgttgttacatgctactcgtggaatgaccttctggtaatcagtttatcctttgctctggtctttatgttgtatggtccgattcatgcaacaaacaaatgttgaattaatcttctgttctccacaaggctcatccgccgtttggcatccttgtcagggtggccgctgcaaaatggaggtgcaatcagcttgattatcttctcttgatttactagtatacctttagccctacttttctgggcctaatttcatgttgcttatgagttacatgaaccattagcagtgaaatactcattctcctgtctcgccttaaaactgattgatcattttcatacgtgaacactagcctgccccttgaaacgaatgaaattatcctgtacatgttactttctaactgaactctcctgctacatcaatacatataaggcatttcttgcctaagttttcaaaacaagaaaaagaaaagaaaagaaaatgaatgaacgaatgaatgttacttcactagctagtagcctagtacgaagtactatttatttaactagcgtgcatatactagttactttgatagattgctacaattcgatagagaaaatgtgaaacttcttaattgatttgagagagaaacaataattttgtagtgttctatgtagtgcagcttggtgagcctaacgtattggactggaccagcgctagagctgctacataaatgtcatttcatattggccaagttttatagtcgtatctggctaactaacccgtacgttggtttcgccgtggtgtgcggctaactgttcctactatatgcgccgtgacaagtgactcaaatatgtttcttttattccatttgcaggcccggattgacttggtcagtcaggtacttcgtgcgatagacaatgcacggtcagagaaggcgagagagcaaagtcattgctccaagacttccattgcttgctagtctgaaagcaaagcttgtgtctcattcagaatgaacagcacataggctggcctctccgtgcatctatataaactggccctgatcaatctcatcttccatcagagcaagctcatcacttcctgcaaactaaagctactcttcagtgggattgcatttcgaccgagctagagagatttatagctaagccaatggcatcacaggttgagagccaccgtgccggcgcggagatcgtcagtggagacggcgtcagcaggaagaagtccatcgagctgctggaggagctcggcctccccaagggcctcctgccattggaggacatcgaggagtttggctacaacaaggaaacaggattcatgtggctggtgcagaggaagaagaagatcgagcacaccttcaagaagatcaagcagaccgtctcctacgccggcgaggtcacggcgttcgtcgagaaggggaagctgaagaagatcaccggcgtgaagacaaggagctgctgctctggctcagcgtcgtcgaggtctacgtcgccgatgcctcgccggagaaggtcaccttcaagactggaactgggctctctgataccttcgatgccactgcttttgctctcggggagtaagaactaaggtctaatgagtcggctactcctatcgtctaaattatgtaaaaggcttaaagccactttcttacatcaccatgtactggtgtatctctg

SEQ ID NO: 54849 - DNA, 3299 bp, Oryza sativa
ccacccaaaccctcgctccagcgacggcgagcgagccgcgtcctcccgcatggcgtcggcgccggagttgatcgacgacatcgccgccgagatcctcctccgcatcccgccggatgaacccgcgcacctcgtccacgcctccctcgtctgcaagccctggcgtcgcatcctcaccgaccccgccttcctccgccgctaccgcgcattccaccgaacacctcccgtgctcggcttcctccacaacgttgacggcaacaaggcgatctcctccgtcccccgcttcgtccccactaccgccgcgtcgccattctccccaccggccatcgatccccccaactggtggtgggcgctcgactgccgccacggccgggtcctctcccacctcttcaatcccatggaactcatggtctgggaccccatcaccggcgaccagcatcgctttcctctgcccccgcacccgcacgcctactgcactggcgccgtgctatgcgctgcaagcgactgccaccatctggactgtcaccaaggccccttcctcgtcgtcttcgtgggcacaggaaggcatgatcactcatgggcgtgtgtatactcgtcgaagactggagagtggagctcgcaggcctccattgtgctcgattcctatgttgagatgttgcccagcgtcctcgccgaaaacacactctacttctactgtgagtatggcacgaaaattctgggatatgacattggcaagcatgagctttcagagatcgacccaccattggggcatgatggtggcatcctcatagaatcagaatatggtgggctgtgatttgctactgtggaagcttgcggcctcgtactgtggtcgcagtatgtgtgttatgatggcattgaggaatgggaacaatccaggataattgagttggacatgctgatccctaacttcttttactcaggtggtctggttggtttcgcagaaggcacagatataattttcatgttgacagatgttgacttgtttgcaattgagctcaaatcaggccaagtgaagaaggttggtgagagcaggccctactatgccgtcattccctacatgagcttctacacttcaggtaatagcctagatcttgtacagcttgccttagttgaaatttcaaaaattcagactaggcattgtttgagttagtggcttaaaaagtatgggttaccacatatatgccctgtgcttcagaacagtgtttatatatatatatatatatatatatatatatatatatatatatatatatatatatatatatcaaaattcaatgtcacatatcacatagatctctgttgttcttacccaattttttgtttggttctagtacatgttacgaaatgttcctgaaattagctaaattgcctaggcatatcttgatgacttgatctattatacatttatacttccccaaaaagtattgcatgccttatttgggtgttcatgttgagctattatatatggttatgagttctattctttgcatatcttcagatcttgctaggaagaggttagcgcagccagctggaatgcagtgatccattcagaccgatccattgagctgcttctaccttacagagctagtcctttgaactttaagtcttctttttttcttttatcctttttggtggggagtggaagtaagaagaaagtatgtgatcgtgcgcaatgaaaatgtttgatttcagtttgtaatgcaagtgagaaaggatgactcacgcaacttgtttcttctcgtttaactgcttattatcgttacccaggatctatctttcaggtttacatttcttcttatttgagacaatactcaatccatgactgggaagccctcttggaactgatatattgaatattccgtttttgcacgtgccctagtgagtagtgataaatttaagtggttgactctgtgtagtccagacttcgaaaccgggagatttgactacatttaaactgctgtaatagcttcagttaaatggagctgggatttttggccatgttattctaaaaaggatttgactgtatgactcatcattcaatgttcttaagtatagtaccaacaagcctgccatgaggaactccatgcctttagtttgtcatttgaagtaaaatacagcagattgaaagctgtcaatgttgtggttttgcacttgtcttttttttatctctttttgttcctgtagctttttctgaaaacaattgagtggaaataggcatatagcacattcacttgatgtttacttaatgctttaacaaactacatagttttttttttggtctcctgtagcctatcacaaaccatgtgcatcagtctcttgacgtattgattattcctaagccacagtgtggcgcactagcgtatatgaccatatgcaaatagggcacctgactccctgcatttttttaggctgaatttgggtaggtgtgtttgtttttttgacacagatttgggtaggtgttcgttttatttaaggatgaggtttatgaatttgcatacggtgtttgtaaattaacttgatgatgacaggtcacttgcagtccttttggtggcatggcagctttgttttcctccaagctcaaccttttgttgtgtgcaggatttctatatctgcctttgtgaattgtgatcataacttagttttgttgccttcctctggctcggattagttaaattaatattgagctagtaaacttaaactgatgaaccttactaaatggatgttccacaatatctatttcatctggcaatgaagttcattagtgcatgaaaaacttacctgtttgctataattatgctttgcctttgattctgatgctataattatgttttgctcttgatactgaccgaagtgcttgctgcaaggcatgcagtgttcactggcatctctaaaggaactgagggcatgaggtgggctgcaagagaaagttcctcacgacagaaggcaaagctaatgactcttaagctttaggaattcacaaggtgagtaaggatggggtgttgcagaacaattcattgtagtcaatccaatgcggatgctgtgttaaccctttaaattgtttttcacatcgctgaacacacaaaaaaaacttgaaataatatgtactcaagttgtttagtttgagcactacagtctatgtgattctttttttagctaaagctatgccagttattatcactagtagtagaatactatggggatcaacaatcttgtatgtctgaactctgaacatcatttcagattgaacacacatgcattatttatctcaatatgtattgcta

SEQ ID NO: 54850 - DNA, 13020 bp, Oryza sativa
attcctgcagccctgatgttacatcagttggtttagcatcgttttttactatgatgtaggcgtgtcaacatagtgtgtgggtagttctaaagctgaaatctgggaagtaatttgaactatcggagtagtagtgagaattcctgggtcaagtattctagatgggagggttggaaagctgaacttattttcgccgggtgaaagctgaacttattgcaatgtagttttctgtttagctggtagtgtaaaatatacgtgttcattctaatactagtgtttactatgtgctcttgtaccagttgactttcaatggacagccatggtggaatggccataggcgcatctgatctgtttatgcgatggtgattgacaggaaggaggcatcatccctcctgatgcagtaacttgcgggcgatacttcgaggcgaacaagtgtaacaagaagaagtgatcagccacatgatgggtcagtgcctcgctttgtatgtgccgtgcatcttctttcaagacagaaagttaagagttgaagagcaagaaattcagagttcgcaagggaagatgagagctctcccaggagagaatcaaaagcttacatggaactaaaggtggtagacttcaagaatattggaagtgatcagaatagagccaaatcttgtaattacagctattcatttgcattactttgactcgcttgtgcattcatcttaggcttagcaggtttgtaaaatttctctcttgaaattgtattagttggtacttgtaaagtgagcatactttacgaacctgtactgtgcaaaattacatggactgaagttgtatgaaagtgtgtgaaacttgaatgttagcttgttttcgaagaacgggaagtagtattcatgctagatcatgagcccagcgaattggaccggaccagtgctaattggtcagataagtcatctctggctggctgcccagcgtacatccataaccgtgctgtgtaacattgcttgctgagatgctgaagtgtgtagtattcatcagtggatggacttggtcaggaactttgtgctacgtcagagtgaatatgcatggtatggtcagaaaaggctggggtacagttgtggcatgactcgaggctttgttcttcacgacttgaaatccaaagtccataatctttgcctctacagtctgaacaaatcttgtcagaatgaacaaactttcacaattctatataaacagaaccccacatctcatcttccatcacaacaatctcacaacccatttgcacacaacccaaatttcaaactaaaacttcttcacctgaaactacatacccaatggcatctcaaattgagagccaccgtgccagcgcggagatcgtcaatggagatgccatctgcaggaagaagtccattgagctgctggaagaacttggcctccccaagggcctcctgccattggaggacatcgaggagttcggctacaacagggacactggattcatgtggatggtgcagaggaagaagaagatcgagcacaccttcaagaagatcaagcagaccgtttcctacgccggcgaggtcacggcgttcgtcgagaaggggaagctgaagaagatcaccggcgtgaagaccaaggagctgctgctctggctcagcgtcgtcgaggtgtacgtcgccgaggcctcgccggagaaggtcaccttcaagactggaaccgggctctctgataacttcgatgccactgcttttgctctcggggagtagaaattatgaaagaccataatctcaactgtgtaaaaggattaaagccactatcttaggtcaccatgtacttactattatctcttttgtattacaaacattcgagtatagtcctatatatatttgttccctttcatcataaagagaaaagaaaaaaaacagtgactaaggactaacgtgcacattgtcattgctgtttaaattgctgaaaattcttttgggtgccagagttcgaggtgcaaaacaaacaaaaacaaaggacccttcacccttgtactcaaactgatatgagcatattatccctgccaataaataaataaataaaattgagcatattatgagcagctgtgattgtacacgactctcatcgactcgtgggccccactcgagacggttgtcttgtccaccaccgccttctttcctctcgaccccaccccaactccaaattcccaaaccctcgctccggcgacggcgacggcgacggcgagcatggcggcggcggcgccggagttggtggacgacatgacctacgagatcctcctccacatcccgccggacgatcccgcgtccctcgtccgcgcctccctcgtctgcaagcgctggcgtcaactcctcaccgatcccgccttcctccgccgctaccgcgcattccaccgaacacctcccatgctcggcttcatccacaacgttgaccacagcagcaacagctcctacatcccccgcttcgtcgccaccacctccccctctccattctaccccgatttccctccaccgagcatcgagttccccacctactggtgggcgctcgattgccgccatggccgcctcctcctccaactcttcaatcccatcgacctcatggtctgggacccgaccaccggcgaccaccgcatcttccctcagcccccgtacctggacttctactgcactggggccgtgctgtgcgctacacgcggctgccgccatgttgactgccatggaggcccctacctcgtcgtcttcgtgggcacaggagaggatgaccactcatgggcgtgcgtgtactcgtcggagactggagagtggagctcgcaggcctccattgcgttcgattcctatgttgagatgttgcctggcctcctcgtccaagacacgctctacttcagatgtgagcgtggcaagagaattctggggtatgacattggcaggcatgagctctcggagatcgacccgcccccattggggcatgaggttggcatcctcatggaatcaggatatggtgggctgggatttgctactgtggaagattgcagcatcctactgtggtcgcggtatgtgggtgatgatggcattgaggaatggaaaaaatcctgggtaattgggttggactttctgaatccggtgggtaacccgtcgttgtcgtgggaactggccggtttcgccgaaggcgtgcataccattttcatctcatcagagattggtgtgttcacaattgagctcaaatcaggccaagtgaagaagctgtgtgaggagggctactataccgtcgtcccctacatgagcttttacacttcaggtactagcctagatcctgtacagcctcccttaaatcggaccaggcattatttcagttagcagcgtaaaagtataaaattacgccattatggatatttgactgtaagctttagttttcagttatagcgacttaaaaagtatgagttgccatatatgtgctctgtgctcaacaacattgagtttataaaaattcaatatcacataaagtattaaattctgtttctcttaccttgttttttgtttggttcgacatgttacgaaatgttcctgaaattagctggattgcttaggcatatcttgatgacttattctaattctactatttttcttaagtatacattccagaacaggactgcactacctccaaaattgcatgcctcatttggatgttgatgttgagctatttcatggttataagttttataattgtgtattttcagatattgctatatggaggccggaggaaccagctgaagactgaagtgcagtgacccatccattaagcttctggtatcttacagagctagtcctcttattatcttttaagatggggagttgaagtaagaagagagtactatgtgaccgtgctcagataagatgtttgatttcagtttgtaatgcaactgagaaaggatggctcacacagtgaacatttgtttcttctcatttaactgcttatgatcgttaccatgcatatatatctttgaagtttacatctcttcttatctgaggtaatactcaatccatgatttggaagccccactttgaaccgatatattgaatcctttgttattggctccttgctctgatgagtagtgacaaggtttgagtggttgaccctactaccctatagtagttcagactgtgaaaatacagaggttactgacttagtgttctttttattttggggagcacatggtttagtaaaaagtaaactgaataataacttgaagaaatcgtgaatataaaaacctgtgagatttgactggattttctgttatttaaacttttgtagaagtttcagttaatagaactggggttttaggccgtatcatcctgaaaaggattgggcagcatgactcattaaagcatgaacttgatgttcctaaatagagtagacactagcctgcctgccatgaggaactccatggcattaatttgtcatttgagatcactcaatataattatataggagtaagattgaattgcattgacagcagagcactttgccttctggtgctgattgattttgatattattctaaaatggatttggctctatgaatttgatgttcttaaagagagtagatcaaactagcctgcctgccatgaggaactccatggcattagtttaccattcgagctctatataattacacaggagtaagatgccttctattgctgattgaagctgccaatattattactttgattttgtgatctgccttttgttcctatcatcctatggctatttctggaaacattgaattggtggtgctaggggatatggcactagtgtctagtactgatcatgaaccaaatgaattggaccagaccagtgctaattaattggtcagataagtcatccctggttcctcccaaaaataaataactgaatgaataacagtcatccttggctggttgtatagtgcatgctgggatgctgaagaagtgtatgcactacataattagtggacttggtcagggattttgtgcttcagaattataatttgcagttatcaactgcatggtcagaaaaggctggtttcaattgagaactctatataaacagaactcactatctcatcttccatcaccaacaatctctcaccaacacatttacaaaccaaagcattttttttggcctgaaactacatatccaatggcatctcaaattgagagccaccgctccggcgcggagatcatcaatggagatgccatctgcaggaacaagtccattgagctgctggaagaacttggcctccccaagggcctcctgccattggaggacatcgaggagttcggctacaaccgggacactgggttcatgtggctggtgcagaggaagaagaagatcgagcacaccttcaagaagatcaagcagaccgtctcctacgccggtgaggtcacggcgttcgtcgagaaggggaagctgaagaagatcgccggcgtgaagaccaaggagctactgctctggctcagcgtcgtcgaggtctacgtcaccgaggcctcgccggagaaggtcaccttcaagacgggaaccgggctgtctgacaccttcgatgctgccgctttcgcgcttggagagtagctttaaggagtcaatcagctactataagctagtagaaatgatgcaagactgcaagtccttaatcttaattactatgtaaaaatggcttgaagccactatcttacatcaccttgtactgttatatcttttgtactattacaaacatactcctacatgagtatattcctgtagtttattattttttttgaacgagtatattcctgcatttgttcctgttctgagaaacaattgttttgcacaagacaacacaagtcaagttgattaagcaacactggaacagggcacttacaaaattgtaagcttgaatctttaggtctcctttcccaaaaagaaaaagatatgcagagactaacatgcacattatcactaacttggagtgggtttcaacttgcagtttaaactgataaaagttctactggttcgagtttaaggtgccagctgcgccgtgcttataactgggttttgttcgtcttctctgaactttgcgatcaggttctactgtgttcatcaatagatgatgttggtcttttgacagtaatctgatatttcatctcatttaataattttgcacaaatatatataaaaatatagtacatgcttaaagtgcctttaaaaataaaccaagtaaagaaaatgaccattacatatgttttaaaataagacagaggttaaacttatgtacaaatattaacggtgtgatctactccatccgtcccaaaatataataatttttagcacttcagatttatcctaaaatataacaacttcctcaccaacatttccttcccaatcaatcacaaccctctaccattaacttttctcatctacctccacttcttaaccaatcacaacacattcctatttaattctatctactttcttaataaccttgtccaactctaaaattctctatattctgggacggaggaagtattgaaaaaccggctgcccatttttcggttagttataattttgggttgatccattgtcacaatgtgagggcttccttttcattttcgaagtaaaaaaaccgctccccaccagcttacgaaaaaccaaccgaaaaccaataaaaaccgatgattttcggtcaacgccgtacaaaaaccagctaataccagtcggcttccacaaactatacctagcggtttcacgaaaactgaccggttttttactaggtgaatttggaattcattcctatgttcaaactggccggagcgcagctgtgattgtacacgaaaggagtcccactctcactgacttgcgggccccacttgacagcgactcccgtcaagccaccaccagcgtcctcctgcccgcgacgagttcatcgcctcctcaccacccaaaccctcgatcgctcgctcgctccggcaatggcgtcgctgccggacttgatcgacgacctcaccaccgagatcctcctccgcatcccgccggacgagcccgcatccctcgtccgcgcctccctcgtctgcaagccctggtgccgcatcatcaccgacccggccttcctccgccgctaccgcgcatttcatcgaacacctcccatgctgggattcctccacaacgttgacggcgacaaggcgatctcctccgtcccccgcttcgtcccaaccaccaccgccgcctcctcgccgttctccccaccggccatcggttctccccactggtggtgggcgctcgactgccgccacggccgcgtcctcatcaacctcttcaatcccatggagctcatggtctgggaccccatcaccggcgaccaccatcgatttcccgtgccgccgcacccgcacgcctactgcaccggggccgtgctatgcgctgcgcgcgactgccgccatctcgactgccaccaaggccccttcctcgtcgtcttcgtgggcagtggagagcacgggtaccattactcatgggcgtgcttgtactcgtcagagactggagagtggagctccaaggtctcaatcgtgttcgattcctatgtcgagatgttgcccagcctccttgtcgaagatatgctcttcttcatctgtgagaatggcattagaattctggggtatgacattggcaggcatgagctttgggagattgagccgccattgtgggatgattaccaagggggaaccctgatgacagcggaggatggtggactgggatttgctactatggaaacccgcggcctcgtgctgtggtcgtggtatgtggatgatgatgatgggattgcagattgggaacaactcagggtaatcaagttggaaatgctgatcccggtggataacccctcagtctcacttgatctggttggtttcatagaaggcacacaaaccattttcgtgtcatcggatgtcggcgtgttcgcaattgggctcaaatcaggccaagtgaagaaggttggtgacagcaggccctactattctgtccttccctacatgagcttttacacttcaggtactagtctagatccttattgtaatttcagttggtggcgtaaaaagtcttaaattacgccattatggatatttgacagcaagcatgatttttcagttagcaacttaaaaagtatgggttagcatatatgtgctctgcacttaagagcactgaatttatgaaaattcaatatcacataaaagtgtaaaactctgttgctcttacatcattttttgattggttcaacatattatgaaatgttcctgaaatttggtaattgcctaggcatttcttgatggcttgatctattatactgtttattttttctgaattatacattccaaaatagcactgtgttaaattacatgcctcattttgggtattactgttgagcataatatggttataagttttatacattatgtattttcagatcttgctagggggaggtcgtcgcacccagctggagtacagactgtacagtgacccatccagacccttccgttatgcttctggtatcttacagagttattcctttttattatcatttcagataggcaatcgaagtaagaagagagtatgtgaccgtgcttggttgaggtgtttcatttcagtttgtaatgcaattgagagaggatggttcatgcagtgaacaatttgtttcatttcatttaactgcttaggaccgttaccctcaatcttataggtttacatttcttcttatttgaggcaatgctcaatatggaagcccacttggaaccgatatattgaagcatttgttttttgctttttgctctggtgagtagtgatattgttgagtggttgaccctactacctgttgtagttcagactgaaaatacaaaggttactgctcatgttttttctggagcaccttatttagtaaaaataaattgaataataaattgaagaaattatgaacacaaaaacctgagagatttgactgcattttttgtgctttaaattgctgtaactgttcagtaaaagcaaactgttctaattgtttctgttaatggaactaagggttttaggctgtgttattctaaaaagaatttgactggatgactcatcaaagtatggatttgatgttctttaatagagtagagaccagcctgcctgtcatgagtttgttattcgaggttattctatataattacataggagtaagatcgaatcgcattgactgcagagcactttgccttttattgctgattgaagctgccaatgttatgattttgtttttgtgctctggctttcgttcatatggcactagtgtccagtattgatcataagcccaacgaattggaccggaccactgctaattaattggtcagttaagccatctctggctccttgccaaaaaaaaaaatacagaacaaataaagggtcatccttggctggctgaccagcatacatccataactgtattgtatattgcatgctgggattgaagaagtgtatgcattacaccattagtggacttggtcaggggctttgtgcatagaattaatatgcagttatcaactgcatggtcagaaaaggcgggtgttcaactgagccatgaatcattgagtcatggctcgaagctttgttcttcacgagttggaatccaaagtccataacctttgcctctacagtctgcacatatctttatcagaatgaacaagcagacaagtcttgagaactctatataaacagaaccccatatctcatcttccatcaccaacaatctctcatcaaaccatttgcaacacaataccaaaccaaaacttctttgtgtgagccacatatccaatggcatcacaaatcgagagccaccgctctggtgcggagatcgtcaatggagatgccatctgcaggaagaagtccattgagctgctggaagaacttggtctccccaagggcctcctgccattggaggacatcgaggagttcgggtacaacagggggactgggttcatgtggttggtgcagaagaagaagaaaattgagcacacgttcaagaagatcaagcagaccgtctcctatgccaacgaggtcacggcattcactgagaaagggaagctgaagaagatcaccggagtgaagaccaaggagctgctgctctggctcagcgttgttgaggtctacatcaccgatgcctcgccggataaggtcaccttcaagacaggaaccgggctctctgataccttcgatgctgccgcttttgctcttggtgagtaaggcttaaggagtcagtcagctactgtaagctagagatggtgcaaatctgtaatcttaattatgtaaaaggcttaaagccactatcttacatcaccatgtactgttatataaatcttttgtattgtaatttgctaacatatatgagtatattcctgcatctgttccagtattaaaaaaatactgttttgcacaagaccttagtcaacttggttaatgaacactgggacagggcacttaaaaaatcgtaagctttgtagactagtgcacattgtcagtaactaggagtgattttcaacttgtagtttaaaggcaaaatttgctacgggacatccaaaaaacgtgtaattagctgggagacaccgcaaaaatacttatttgctataggacaccacaaaaaactggtaattagctgctggacacccgtgggattattttactatatccggagaaattggagagagaaaaaatcattaaagacaagtttgcccttggctcaaaggaatccaaacatgggccccacatcgctggtggcttctccgagttcgagtccaacctgcagctgctggccggcggcgagattcgtcaccccgcgcagcctcttcaactgcggcagaagcgcaccgccgccaccggagttctagtatcacgatgtcgcgccgccgttccccatgtccctcgtcgccaacacccacctcagaggcaaaaccaaaatcatcttgttcttgatgatgatttaattcttgctcaattactgatcggtaagtaattcttggttaattattaatttccgtgtgcaggtcgcgagctgagatgctgctacaaggccaacgtggacggcttcagcgcgacggacttccaccgtcattggctgcatggccaccgccgctgccgccggcggggtcatgccgtcatgttcggcaggttcagcccacaggggtaccgaagcacggacgactactacgacacgctcgacgccttcctcttctactggccggacacggacacggatgccgcagcgacggcggcggtcgtgctgccaaaggtgggcgggagtggggcggcgctgttcgactacgcgagggccgcagttcggcgccgacgggctgctcatcgggccgccgctgatcgccgtgatgggggggggaggtgttcacggggcccgactccagcaccggcgccggcgacctccgcagcacgcggtcgcgtttcgggctgtcgtacgcgaagcgctccaccgtcttcatctacaactcggcgacgttccggtggaccaaggtgcccgcgcaacgccgccccaaccgaggtgcccgcactggcgcgcgcctcgctgcgccggtcaccggcgctccctcgggctaaagagagaaagaatgagagagagaatactaacgaaggagtagagaaggatggagaaaaaataaaaataaaaaaaaattcaaagggtagaatcgtacttacacagctgtttctctctccaatttctccggatataataaaataatcccgcaggtgtccaacagctaattaccagttttttgtggtgtcctttagcaaataagcgtttttgcggtgtctcccagctaattacacgttttttggatgtcccacggcaaattttgcctagtttaaattatcttctctgaactttatgatcaatttgtgttgggttctttttttttatcctttcggatggggagatgaagtatgcgatcgtgttcagaggtcagttaagatgtttaatccagtttgtaattcaagtgaaaaaggatgactcacacaatgaacagtttgtttcttctcatttaactgcttatgatctttacccatgatctgtttttcaggttggcatttcttcttatttaagacaatattcaatccatgattgggaagcctaattggaactgatatattgaattgctctagccccactgagtaagcattaaaattacagttctttttttgttttttggttgtacctggttgaccaagtagtaattggtaagctgaataataacttgaacaaatcgtgaacacaaaaactatgagatctgactgaagttgctgccttttaaactgctgttcggttaatggaactggggttttggctgtgttattctaagagatttgactgcatgactcatcaaggtagggttgatgttcttagatatatagcagaggcaagcctaccatgaggaactgcatggcttcagccttcagcttgtcatctgatattttgaatcactatattatactacagcggagcaagatcgaacctcatttaacagcagagcactttgccttcttttgctgactgaagctgccaatgttatgagttttctgcactatattttgttcctatagtagcttttctgaaaacattgaatggatatggcacattcgctcgatgatttgttttatgctttcctgccactctgtaggctgtagcaaacggcaagttttttcagtctcttgtaaccatgtgtatttgcgtcttgacgtattgcttatccttcagatattgccggttgccgggcaccatcagcgaggaaatgagcatgtgttggaccagaccagtgtcatgacaaaagaaattcctgatcagcaagcaacatcgcagagcagaggctagcagatattgtacagtttcaggctcagcccttactgtatgcaccgaagtgatgcagcaactgagaactactcttgaggaaacgcaaattaaccgcaacactgcagaacgggctgcaggaat

SEQ ID NO: 54851 - DNA, 22556 bp, Oryza sativa
aaaacgatggaatcttgtcatgatcgcagcaatggacatataaaccgagatataggctgcatatttactgagcaattctggaaccgaagatctcaatgctgaagatatctggcagacaaattctcctcaaacttatgcttgcccgtttctgttgcaacaaaaccaggccgcatcgtggcctccgccacgtccttctcctctaggcctccctgacgtcacggtcgccgtctttatctctgcaacgacctcgcatggatcggagtcggactctgggctaacatatcagcgaattttaattcccatgtgttggatggaatgctgaaattttgttgggatttcgcaagcgacagagatgtgtttcatgtgtttcaagtggcctgtcaaattgagctaccagcagcctgcaggcaggcaggcaggtaggtttgttccgacaagtgaattactgaacatcaatcaacatttgcaaatctacagactgcagcttacaattcacagttcagtccagctccagcagcaatagaattgactgcaacagctgagaacttgaaccctcagatcgatcgtgcacacgtgcaaattaacttttgaattcgagtctttgagattttcgtctcaatctgttgaaatcttcaggataccttcaacgatacacaacggcactttggatgatactcactgatacaataacaatagttgatgatacatgtttatacttgcttatattgattaatgcacgacgtgacgacaacactcaaggataatgactgagtttttattataaagaacacgggtttcttcatcacactatgggatacactaaatctcagtatcatgggggatctcgcaacatctgcagcctggacagatcttcatcacaatgaacaaacaaattaacatgatacttgggaactctatataaacagaaccctacatctcatcttccaccacagcaatctctcaacccatttgcacaaacaaacacaacacatttccaaaccaaaaacttctcttctaattttctccgaaactactgctccaatggcgtcacagatcgagagccaccgcgccggcgcggagatcgtcaacggcgatgacatctgcaggaagaagtccatcgagcttctgggagagctcggcctccccatggggctcctgccattggaggacatcgaggagttcggctacaatcgggagaccgggttcatttggatggtgcagaggaagaagaagattgagcacgtcttcaagaagatcaagcagaacgtgtcgtacgccggtgaggtcacggcgttcgtcgagaaggggaagctgaagaagatcactggcgtgaagaccaaggagctgatgctctggctcagcatcatcgaggtgtacgccgccgaggcgtcgccggagaaggtgaccttcaagagtggcgccggaatctgcaagacctttgacgccgctgcgtttgcacttggggagtaaggacttggaattaatttgcttgcattgttcgaaatgatgccaaaagtttgtggtaaatgtccgttcaaagaaagatggtagtacttttgttgtttcatgcattaaactcgagtaatcagcagtgccatgtacatgtacactgcgttgtgatcaaatctattattttaaaaaatgtacattatattttttaacaaataggcgagccgccaatttcattgaaaatgtaaggagtaaactgtacaggtccaagaaagtgtacaagctcagtacctttggaccaagctatctataaagttagtcagttgccgaggatttctgcgcccgctagttgctagaacccatgttttttttagagaaaattccctatctagcataaaaaaaattgctcttccctctatagcacccaaacttcaaaagttccctatctatacaccatcaaaatttttgttccctatctatcacttccgttagttttgagggtgacggtgttaagtagcatgaggaaagacggttttgcccttctgtattttatacttttttctctttctctgttcacagtttttttttgttctttatttttttcatttagtgtcctcccgtgccgccggcgctgcactcccatgccgcgacgggctggcttcccgtgccgctggcgctgcccatccgggggagcccgccggcgccaatggccgcccgggggcttgccatcctcgccgcctggctgattcgccgtcctcgctgtcctcgccacccggggggtcgccgtccttgccgccggccatgggggcggtgatctagggttttggcggcgtggatttggtgagaggagcgcgcgggttggggagagcaggtcgcggtcgcgatcagtcctggagaaagagcaacaaaaaaatcctgagggtgggtccatgcttgttttgacggtggaggctaacgggagtaacggaagtgttagatagggaacaaaaattttgatggtgcatagatagggacctttgaagtttggatgctatagagggaagagcaattttttttatgctagatagggaattttctcttttttttattcacccttgatcttggctagaaggctagttgacgggagctccttttgttggaaggtactacgattccttccattccatatctcccagaccactagcaacataagggtccgccacgctttcttggacgcatctttggtatttacagtggcctcccaccactcaagcagcgtcaaggcgttttgccactaggttgtcctaagctggccgcatgctgttcattccgctagtgccgtccagattcttttcatgtatctgcatccccctagtaggtggagggctgtttcctggttcctacgacaaagggggcaaatggagtcattctgccatcctcgtatcacgaaccatatggtatggtttatctaaaaaaaattctccagaatgtgcatctttgcattagagcatcaccgacaacatcccaaagttttggttatgagaatggtaaacagaatttgagatgtcaaaattttcatccctccaaaagattaattaaaattagcttcctaaaaactaaaaagtgagtcccctaggaaacttccaacataagggggtgtttagatcccactccaaaattttacaccccatcacatcgaacgtttgaacacctgcatgaagtattacatataggctaaaaaataactaattacacagattgcgactaatttgcaaaacgaatcttttaagcctaattgctctataatttgacaatgtggtgctacagtaaccatttgctaataacggattaattaggtaataaattcgtctcgtggtttactgacaggttttgtaattagtttttttttgacccaacaccctatgcgacaccttatataatacccgatgtgacatgccaaaactttacgcccttggatctaaacacaccctaaatatttggtattttggatatgggtgaatagccaaagtggtccttcaagttctaaggctcagtctggtccttcacatttcaatctgtccatatcagttcttcaaattttattttagttcaaacttatccttagacccacttaaaagccatatgggtaaacataaccaacagctctctttaccccctcattcacatatataagaaaaaaaaggtcttaccattcatacgatgaaactgtatgacgagaccctccccgcaacacacacaaattcccaacttcctattgaagtactgatatgggtgtttttccattgaaatttgtgtgcaatgaattcgttttcccattttattttacttcagcctgacgtcgcatgacgcatgcgtgcaaactactttaaactattttttcttttaaattatttatccaaatcatgatcatattgcaccattaaattcgttacaattaaatctttaaaacaagaccacacatggatatattccgacaaaaaagtttagcttattattgaattatttttaaatgttacacgctgttccaccaagtatatcggaattgtttcactaagtagatcaaaaatgtttcaatcgtttaaatcaggtgttgtttcaccttatataaaaacaatgtttccgcaaatagcgaaagaatgtttcagttcactgcaacatttgatccatacatagtgaaacattataagtacactatatgaaacattttttgtggagacacgtggcaggtgggggcaggacacatggtggggcctagggggaacgtgcgtgtcagggggcgggggagcactcgattttgctcccttggccggtcgcccgagcagagggaaaatcagttagttagtagtagtagtaatatgatgttttattcacttcatcccaagtaatagaatggaaacctggcaattcaggatgtgttttccctcaccctaaccatggctataaattgcgtgattggtttgataatgggaaaaccttcttcttcttcttcgtgtaaagatctccttcctcgcttaggctttttcaaagtggatcttaggggtttgagtttgagggtaccttccgggtagctttaccttatgcttgctactcaaattttccataaggccacataacctgctatatagaactcaatttttccataaggtcacataacctgctacatggatggtgacactaatttgggagctttcttcatctcttcttggaatgagttctttttattgatcgacttggcaagcatattgcacttctgccttcttttttttctatgttaggctaatgcatttccaattgtgttgtaacattgaagtaagaaagaaacacattttcatcttgggctcctagtctcctatcgttaagcctagttatccgatcatacttctcagaactaaaattttaagcagcacctcctcgtgtcatcatgatatatataaagtcagcaacgccagctattaagatagacttttaatgcgtagatgatgtgatggttccatgatattgttttcatctaacggttgagtttagtaaatgattttgctatgattatgtgttgcccttaatattgacaagagcgcttgtcgtgtcatatctaaaaggtacaagagcgcttgttgcagggccagcgtgtcatatctaaaaggtacaagagcgcttgttgcagggccagcgtgtcatatctaaaaggtacaagagcgcttgttgcagggccagcgtgtcatatctaaaaaggtaccaagggtatgaagtgagcatggcagaagaggttcctctcggcagaaaggaatgctaacagtggtgctagcttatggaatcagcaaggttagtaatgattagatgtaacactatagttcgtgtattcaatgcaataatatatttgctattttaaaacccagctggttatggtcaagttcgttattgttactatattagccataaagatctacctgaactttgagaatgtatagtattattagtatctctatatatcttaatttagaatgcttattatatcttgtaatatatattctcctatggatactagctagctagtgcattattgtaaatagaatgtattgtatcttgtacggtaattagtaccaatagtagatagaatacacttagcattattgtactcctagctccatacttgtttaaacattatttgaaatgattagatattttggtaagctaaccaacgctgtcttttttacttacccttacatgccgacagctaggaggatcaatgaatggggtagtaggccaattagatcaaaaactgagtttgttcttatagcaatatttaatgtgatatgtcttgggctgttgttgtcagcatactatgaagacgataacacagaaatgtatcatagtatgctgcaccatagattggaaagacttagcgctgagataagagtgagatatgatggaaattaagccggtcatcaagtgcccttgagttgataagacttgttgcgggatagagtgagttgtatttgattaaggtggtgtttggattacatggactaattttagtccctgtcacatcggatgttcggacgctaattagaagtattaaacgtagactactaacaaaacccattctataaccctagactaattcacgagacgaatcgattgagcctaattaatccataattagcttatgtgatgctacagttattgtacaaacgaaaagcttcacgtcgaaggacgtggttctctcagtggaatgattagaaagtaaaacattgtattaattaataattttttttgggatccccccattacatggtcctaggggctagttatagtcttagtacacgctcatatcctctagggtttagtgtgtacaggggaatttacatagatactctttagatagggacaccagtgagggcatacaatgtctattctaattatgggcccctaggtgggtcctttggcccagcccataagaggcaaatggccttcatgggccacgctagcttgatgggcttcctagcgaagccagtcttccatggggcgaacccttcatgcttcgccttaaggcttcgcccagagggagaccagatggtgagccctccgagcttggtggcgaaccctcttgacttcgtcctttggctttgccttgaagcttcgcttaaggcgaacctcctagacccggttggcgtcttgctgatttgatggtttcggtaggttcagccgaaggccctcatgacatgcctccaacatgcccctcacgggcaagggtgagtagggagtttcggccgagaccgtgcaaacatatggtatggcaatgaggctcaccctttcggccaatgttcctaccgaaacctctcttaaccaacaaagccttaaaacttattattacatatttttcattttttatgtttctttctactctacttgatttcgcacccttatttgaatcagtaactcgtttggagttgagtcggttcggatgcttggacagactccttctctttgcctcccccttctttatttagatcagttttgggccgtattgcactgtttccgcggccttttactgttcagcccatccggaagaggaagttactgctgcctcccttcaagggcaccacgtgtttggccactattggccggtagccaaaccgttgcgtcttcggggttatatatacccctctgggtcgctttcattcttaccgcagtcattctcatttcaactcccccgctcttagtgacctctcttctctcttcctcgtttggttgccgtgcgtgttccttcgcccccgcaacctttcgccacttgcaacctttcgccctgctaccgatggcagcgtgtaagcctgctaaggccgccgctaccgtccccgatccaggtcgccttggcgaagatctctcctgcttccttggcaagtctctcatcaaggagtcggatcttgcctccctggtggcctccggagccatcgccgaagggcagggcttcgtgtcgggcgaagctctagttccaactccgggcgacaggtgaacgctggtcttctccacgttcttcgacaccaggcttcgcttctcgtgcgatgatttccttcccgacgtcctccagctttacaagatcaagcttccctagctgagcccttccgccctggcgcggattgcagtgttcgactaggcatgtcataccgcgctggcttggccccaaccgcggagttgttcgacgccatcttcactgctaccatcctttccaaaactgtgcagacggctgctgggccgaagatgatggtcttcggcagtgccaacttcattcttcgaccggaacggtcagatgtctagctcgtccatgcttccatgcccaagtggcatcaccactggatgcaaaagtggttctaccacaacattccatatgtggtcggttccgaacgggcggaggccttgcactgccgtcaccatgccatctccatcgaactgaaaccgaacgtggaggtggaaggcacgctggagtcgaggctcatacttcttcgcaagatcgccctccggctaagcacccgcgatcttgttgaagaatactacatgcttcgcatatgccctctgtcccgagactgcggtgtttagcttagtgcaaacgaggaagtctatggcctcccccgtctcgtcttgcctgcatgttttattattacttcgccatcattcgcgccttttcatcttcgcaacccgattggtgctggagacacctctttcatctttgtttggcttggacagtgcagtcgctagcagaggccgagacaaaggcgaataatattattggcgagctaaccgcacgagagtatggtatgttgctctcgcgacaaactagcggccgcgcgaaccgtgttttcgacagcgagcctcccgctcgggcgaacccgatcaaggttgtcacgatcgtcgacggagccgagtcgtcgaagaagcgtaagagaggtgttgcgaaaaccacgctagggggttgaagcaaaacccgccgagcaaccagatccaccgccccttcacctgctgaatcggatgcgaacgatgaggaagaggaggacgagagggatgaggaggaggaggaggaggtggtggtggtggaggaagcggccgaagaggatacggagggcaagaactattcgccaggttacaccccaagtccggatcatccggaaactggcgtggcctccagctcgtcaccccttcgccagaaagacctagagggggcaaagaccctagctgctatagtgggtgccacctcgaggaagggtacttcggctgccggcaagaggccagcgaaggccgtgaccaaaggtttcgtgaagatatatattcaatgttacatctaatgaagctaatttgacgttgtatatgttgttaaattttctataaatttgatcaaatttaaagaattttgacaaagaaaagtcaaaacgtcttataatataaaacaaagatagtatcaactaagcatatataaagataattataaacaattattattattttttcacgtccattctacctatgcaacctctatgggtggaaaagaaccgggttcatgagcggcaaacgagtcaagcccaagcctcgtccatgaacaaagccagagttggcttggcttgcgagcattggctgtcatgtagtattcacatttctcgtttgtagaatattattcacgtaacgcatattagtctcatcttttcatttatgcttatatttattagacaaaatttaaattttcaaccttaaatttaaattgattttaagatttttttttcatcataatttatttttcaacttttattggtagggaggaaagaaggcgatagtggtagcagctgccactgcctccatggtagaggtaacgttaccaaaacttttagtacaaaatttagagtaaaatgcataggcgggtcttaaacttgaaaagttatgtcatctagatctcctagctctcaaaatacggattcaggttccagaacttatctaagtgtatcatctaggtctcaaatcgacacagcctctctaggatcctacctgatgctatagatggccatatggcccatggcccacggcccggcccaaagcatggctgtttggcccggcccaagcatggcacggcccaactggggtcgtgcccgtgccggcccggcccgacagccgggccgtgcttgggccgcaccttcggcacgctgggccggcacggcacggcctggtcaaataaaaaaaatatagggctttaaaatagacttaaataatcatataaggcaaggcccaagataagaggtatacaaaatagacttattttccagccatttaaacacagcccacaaagttgagggaccaaaaatagactttttctgcgaggaggtatacaaaatagacttgttctccagcatttaaacacagccacaaagttgagggaccaaaaatagactttttctatgaggaagcacggtgcgccgtcgtgccttcgggccggcccggcatggcccgagtagtattgggccgtgcctgggccgcggatgctgcccatgggctggcacggcacggcccggtatgtcggtcgggccgtgccgacccgacaagccttggcccaggcacggccgtgcttgggccgagccgtgccgggcggcccatttggccatctatacctggtgctgatgtggcatgccacatggacgtgacatgtccttttcttttgtttttcttttttgttttcttcgcattcttcttttttgttcctttcttctgctcgggtcacagagaaaggagaagaaagaaaaaaagagaagaaggagaagaaaaagagaagcaaaaagatacactatcgccttcttccctccctacgataagttctggtatttggatatgtattttgagagtttaaaaacccagatgacacacccctacaagtttaaagaccgcccatacactttactctaaaatttaagtatctcgagatacttcctcaataaccataaaatttcttttcatataaaagcgaaaataaagcttgcatgtctcgactttcatgaacaaataactaaggcaacttaaccagaattcagtcatagacccccaatcttacgtgtcaacttctactccccaagagcaaatgcagtggcgtcgaaggtatcagacagcccggttcccgtcttgaaggtgaccttctccggcgaggcctcggcgacatagacctcgacaacgctgagccagagcagcagctccttggtcttcacgccggcgatcttcttcagcttccccttctcgacgaacgccgtgacctcgccggcgtaggacacggtctgcttgatcttcttgaaggtgtgctcgatcttcttcttcctctgcaccagccacatgaatcctgtttccttgttgtagccgaactcctcgatgtcctccaatggcaggaggcccttggggaggcccagctcttccagcagctcaatggacttcttcctgcagacgccgtctccggtgacaatctccgcgccggcacggtggctctcgatggcctgagacgccattgagatcgatagaatgtgtgatgaagcagagagacacgaattatatgttgtgtggaatgtttgatgtgggttgatgctgagatcgagttggttcttgtttgtgatgagtgcaaggcagcaggtgcaggttgcatatatagcagcggtgtgtgatggagttgatttgagtggagcgtggattgtttgaccgaaaatacatattactcgttttgttagcccagaagggaatttgtcaagcttttgtgctgttgcaggcagatatagtcttttatgagtataatacatatatagtggagtatacgccaaaattgacttcacatgggagggaggagaagaattggtgtacaaaattgactttaagttctggcttcagagtcacttttcacattttctgaagcgagtgtgcacggttacctacttgcctatcgacttgagctaccggcggcacgtaggcaggcagttctgttcatcacaacatatgttactaatccttgacagatgattgattagcatgcagattgtggagatcaatactggaagatgtcttcttggaaagccactgtttgaacttgccaatagtggccttgtttagattccaatttttttcttcaaactttcaacttttccgttacatcgaacttttctaaatacacaaacttctaacttttccgtcacatcatttcaatttctttaaacttttaattttggcgtggaactaaacacagccaataccaagaaaaaaatgtgttgtcagatacaggaaagtatggactgaaatattacaaggttggactagaaaatgtcccactcttgttcaagtacactgatgatcaaattcaaggatgctacgttgagcgacaacatcaaactaacgagcctaattaatagctgaaaaatgttgactgttacatggtcgtagtctcatttgtttcctgacccctaggctcatcatgcagacactagctcgtctctcaagcaggattgttgatttgaagcagtagcgcccgtgtagcaaaacaaatgatacaacgcattgactactccctccggtttcattttaatcgacgttttggacaataacatggtctacaagatatatctttgaccttatttttctactataatatatataataaataaatgcatgtttacttttattatagtgctttaaaatataaatatatatatgttgttctagttcctttaaattaaatatttttaaagttattgatgatcaaattataaaagtttgacctcaatcttgtccaaaacgtcaattaatatggaaccggagggagtagttgattagattaagttatttcgtgttcaaatacgagaactatttattccagtgtttggttggttcatggataatatataatgtggtactccatgcgaccagtccaagacttctatctattgcagttgcaggtaatcttgagtcctgaaaaggattaataacacagtaatatatcactctttttcagctgaatggatgatcttgttgaagcacaatattcatggtggcatttgcatttgttgcatatggagaagtttgatgcagcaccacattaaagtgttcccacttccaactgcactcaacaatgcaggtgtatttccccattcgattcaaaactttgtgcgtttgcaactgtttgccaggtgtgggcctagttagggcccaggagcaaaggcccacgaagaataatcggtgtggaccgcaaaaggcccgatccaatggcatacaaaacgccatacgggtacgaaacacatattttgacaatttgaacctttgcaaaaattaaggggccctttgaatcgaaggaatgagaaaacataggaataggaaaaacataagattttgataggaatgtaagtgtaaaacagaggattgcaaaacacaggaaaaacaaatgaatgaaatcctctaaaatttctatgaatttcctttgaatcaaagggggcctaattatacaacgagcaaatgaaccgtggccaaaacatatttcaaaaataacccttttcagcgctaaatcccatggcgctaaacttaaacacctcggcgccacatcaactggcgctgaatgtcgtgccactgtggatagaagtctgagttggcgtgccaactcacattcagcgccacgttatttggcactgaggtatctaacttcagtgtcatgggatttgacgctgaacaaaagggtcattttttaaataagttttagccacgatttatttgtataattagttttacaaagggtcaaattgtctaaatttgtggatacgaaacatccgcagccaaagccgagcgaaaccctccaaaaagccctagccctagccctcgccgccggcgagcatggcgccaccgccgctgcgcgttcgccgggcgctgatggacgaggccatagccggcgagatcctcgtccgcctccctcccgacgagccggagcgcctcgtccgcgcgtccctcgtatgcaagccttggcgccgcctcgtcaccgaccgcttcttcctcctccgctaccgcctcttccaccgcgcggcgttgtaacggagggagtagcttatattcttacccaacaacccagaagtcatatccatcgagatgccaagactgcagctcgttctccgtgttctggaacaccacctcgatgaactcgtgcaggctgagcctcaccaccggcgtccccgaccgcggcgccgcgccgggacgctgtcccagccgatgacattggcgatgttgtagttgtccacgagcttgagcggcgtgtcggggacgacgaacgacacgccgctgacggcgtaccggcgcggagctggcgagcatcagcgtcctcgacgtcgcgatggtgccgtagtggaacgacccctgcgggttgggcctcgccgcgctcgccgtcaggttccaccggaacgacatcgcctggtattatgctttattataatatcatgtattatgacggtgcctttaggttaatacaaaccgcaaccgttaataaggtgtctgttactatgagctactccagcagagttgattttatttttctttcggtaatagtatatactgcaggagtagttgaaaagtccgattctaattttggcaattggcatggattagagtttcaaatacggaaggccgcgtggttagacttaccgagtcggagagggaacggcaaccctatctagtcgtaagtaagatcgagagagaagaaaaaaaaaggaaaagaaaaagaaggaagagggttgaggaggaggaggagggaggtgatggcgatgatgcgatcggctttggcgagggtattccaccgctccgcctccggatcctgttctgctccagcgggggtgtgccgccgccggccggagatcatcgaccaggcgccgccactgccctccctccgccccgccgcgatgccgcacatgtctgtagccgccgccgctgcagctgcgcccactcgccgcctcctccaggtcttcttcgattcgcttgctcccctcgcaccttttctttttttaaaaaaaattattatatatatctatctatctatctatctaaaacgtaggataaatttctgatgcttggttcgcttgctaggttagtttcttgtacggccgcccggtcgaaaaatgttactaatttcgtgtaggtgtttcttttgattccagagtagggttttatgatcaatatgaggttaatttcgtgtaggtgtttcgtttgagcttttgatttcagaagaatagggtttatgatcaatccgactacaaattgattgcgagctttgtctacagtggaactttgctagtctatggcagatctcctgctgctttaacaagatctctagaaacaatgaaatgatgttctattattcactccattccaagtgcttctgcgtatacacaactagattggaggaacctggcaacgcagcacatgttttctaggggctgtagtggtattctgtggagctctagcttccattgcgtgccacctaataatttaggcaggtggcgtaacacccttcaacccattttccccttgatttccaaatggatgttacctggaagcactatattttgggctgctaatgtaacttctatcggtacatacttaaaaattttcatcagtctaattatgaaagcttttggatcattgctagagaccacagtccacaaatcggttcaattcatttttctcttcccttgctgtttttctcagtttctctattagtgtattgggaatcgggactaaactagtgtttttttcaatattttctataacataggttgaggtaggaaagatagatagaagcaacacttttgttgtggcatcatgatatatttaagagtaaattgcaacttgggctcggtattattaccaaagtttcactttagactagggtacaaccaatattttcactttgggctaagggacatggcttttgtttcagtttagacctcctcaatctttcttgtccgctcctagctcctcaccaccgcagctatatccaggccatgtgttctcatcctctagtctagagtctagacgcaatgacaactcaatgaggaatgtgcccatggtgagcaggtgaggtccatctgtgcacaaccgatcaaactccatctgcttcctcctagaactttgctccttgcttcctcttccttcacctgtgctgttgctcttcacaccttgcggcagcagcaacagcttcatggtgtcggcgatggtaggatgtgcaggcagtgcccagccgggtggtgggaaaggtggcacaatgtgcaacagaaggaaagaaactctagcccaaagtgaaaaaattggttatgcccttgaacaaagtgaaaatttggtaactaaatctgtcccggtatacaatttactctatatttaattcagtaaggctggctgctaagatagtcctgtgatgcgtatgctggctccgcaatttttatttcttctgatgattgggtttaagtaaataattttgtgtaacaatcaagctctgtttgctatgattacgtgttacccttagcagtattgaccagagtgcacttgctggcagggaccgcgacaattcctcgtcatctctgaagcaaccgagggtgtgaagtgggcagggcagaagaggttcttctccatggaaaggaatgctaatggttttaagcttatggaatcagcaaggtgagttaaggatatatataggatgtaattaacaacacacttccttgtaacctatgcaatatttatgcacattgtgcttcatattgctcaacgaaccgtgcttctgctttatgcacttaggttgttgctagctagtcttaaaaccgatctgatcttcgtgcttgccccgctatgctaattactactactagtattttctttttacaagaacggatatgaggtctcaatgtcttcgatttagaatgcttagctcttttattctaccattgatacaattagcgtgatactaattagggtccctactacttaacatgcatggtaataaagctaaccatgcgatgcaattgcttttttctttttctaatcttgtgtaggctggcagtcaagaagatcaaggcattgggtaatgcaaggatcgagattgatccacggaatgagttctatgttgtagcagtagcaactgcgatatctctttggctgatgtcaagacaatatcgaagccttggcgaccccacatttcctggtggcagcatgaaaaagcttcaggcttggaagcgtgtttctaaacttaactctgggaaatctaataatgctgatgagtgatgtcgatggcactcttgatggagggtaatctttgctgcaatatgcgtggtagagttggtcgtatttattagttaagtcagtaaagaacatgtagtagagtgactggtattgtaattttatttatatgaatatttactgtgccttcttctcgtactagttgactagctaaactgaatgaagaacttatccagttggccccttgtccatgtgaaaaattccatacaatggcctgttaatggttgttttgccggatcagccaaagaaatataggctgaccaaattttattaggattgagaaattttacagattacaagttgagaaaaacatggacaagaagttgttcgtgctatgcagcaatatgtattatcttcgagaagtgagaattaatgccaacctgatctgtaatttccggccgcctcctcatgggatcctcggcagccgcatcatcggagttaaaatttaactcgcagatttactcagaagttaaaattttaatggagttaaattttaactcgtgatgacatggacgaatcttagccgttggatttgttttgcaggatcaagatctaccttatatcacattatgacatgtctaccctgtatcacccagtctgaatcttatgggttgttcctcggcagtgagggaaacggccggagcagatggatggaggcttgtacgatgagaccgagggccgacgagcactcgggcaagcggcgggtatgttcgtgcctgtgccagctgcggcacaataaatcaaaaaaaattacagattagtgattacacaacaggaaagagagagagaatgcaagataaatcaaaaaaaattacagattagtgattatgtatcagcaatcaaactgacaagccttatcgatccagaaaggacgagttacatctaaaaacaaaaccaatttttgacaactgctccgtttgaaccctcttgcagaacctactagtctatcaaacaaaatatcattacaagtcctggcttaaatcaatggatcgagttcttgaaaatgagatcaaacatgtaaaatagatcaaataggataagagcagttgcagaaaactcaaatgcacaagagaagaccatgcccaaccatgatctacctccttaattacctcacgggcacaaaccaccaatctgataagcataaaaaaatattatttttagataagcatcaagtagtaaacatgatgaacaaaaaaaattatattatatgggtaacgatagatggatacatgatccgctaatgaattgaaatcaaatcccccataaagaagacacttccggaactagtacaggtttcttatcttatctcaaaggtgcttatcaccattttctctcctcaatcaggaagagagaagaagctagagaaccaaacaaagggtcatcggcctgaagaagctcttccccgcactccgccatggccgcgccgatgtagacctgattggcttcctcgccgacggagcacatgccgccattttcgttgagattttcatcgaagaaactgaagaatgtcctgatgagaaattcaagaaatcgaaatcggagatggcagcgttgaacagagcaaatcttggcgtgttcatgatcgagctcaaatcggagcaggtgaagaaggtagcggagggtggtagattctacaccatcttcccatacatgagcttctgtacaccaggtatctcatcttgttctatataatcgcataagatactacccgtatttaaatatggcgctgttagcttttgaacatatgctttgcctatttattctattcaaaaattttatgcaaatacgtaagaatataggctatgtttaaaatacctttgatgataacacaaccaaataaacgatatttagaattttttttaataagacgaagctgtggtggagccaccgcccggctagcccaggcagccacccaggctcgcctgtgaaaactccacaaaattttaatattgatgagtaaattgacgatgaaatttgtacagtaaatactgttatattgaagtttgctcagactaaaaaaatctttctggctctgccaactgagacgaagaatatgtcataacaaaataaatgatatttagatatttttaataagacgaatgaccaaacacatgtttaaaagtcaataatgttatatatttagaaatgaatcctataaggctacaagtacaccaattttcagtttgctcgagaaaaatgtgcattgggtatatatgtatttggatcatgggatcggatggaattaatggtgtcatcgaagcacctgctgtttaatttgttaagacaacattctatggtcttctttattgcccattgtgagcgcacaccgaagtagctctagttaacctaggtacttattgatctgtctgtacatttatcttgagctatatcatcgttgtcctcctaagtttttactcgttgtgtgtatttgtagatcttgcaggaggtagcagacaaccatagccagctcttctcagtatcttctaacgagccacttaatgagagtggcttcacctggataattcatgattagtctgcaggagtttcttcttgcctagttgatgccattaaggtgttcagtcatcgtgttgaattgtgtttatttttaattcgttgtgatcttggcttcatattcaggtcatgcttaacgcaacatgcatggaacttaaattattctgaactttggtccattgttttatcctgaattgtgaatccatgggtgttcaatttttccctattgtctgttttattccttttatgacttacatggtccagtttcagtgagaagcttgcaacttctcattatatgaagctcttgttgctgcagatagttctatagatcgttagtgattgctcctactatgtaatttagttgtaaagaatcttttatttctgaactgaacatttgaatatggctcttctctacactggcaatatggtatgggagaagggattcacagaacaaagtcaaggagaaggagccatcagcgtcagttcagaaatcagaagctagcagaaactattcccctcttcagtgtagctagcagaaactattcccctctccagtgtcctttctaccaaaatttgcatcagttttgcccaagcgctcgctcgattcatgtgattgagtttgaaatagtatactgaatctataatggttttttttacccatgtagtaaggcacaatagttgctgctgatactgtcgtaaaaacatcactgaatagcataataatagattgatgcggcatcagaaacagagcactctgcaccattaagcctgaggccttgtccacaggctacaaactcaagagaaaaacactgacatatgatcaaagaatagcacatcagttttagctacaacaaacatatatccgaaatcgtaattctgaattctcatcttcactttcacctatagtagtagtagtatgacttattctactagacatataccaaacgacgaaggatggatcgaactatgcaactctgaatttcttcttcatcatcttcctcagtgtccaaggccggcagctctaccgcagagtatggcgttggtcgggatactgtactcattggagaagctctgctgcggcgtccacactctcatgtacagctgctggccgaggtattgccggtcccagttcgccgacctcaggttccacatcccctggttgtccaatgacaccaagattgccgaccatccattcgggtaaacctgatgaaacgaacatcgtcaatgttcagaattcagacttcagagttaactgttcttcaaatgcattggaatgttcagacttcagaattaactcttcttcaaattggttaggaatgttcagaattcagactaaggagttaattgttcttcaaattggttaggaatgttcagaattcagacttcagagctaagtgttcttcaaattgattaggaatgttcagattcagaattaattgttcttcaaattgattaggaatgttcagacttcagagttaattgttattcaaatccattaggaattttcagatttcagaatttctttttttttagataacagaccacccatgtggcccagcttttataacaaagccaaagcatgctttctgaattaactgttcttcagaagttcagattcattacgagtatgtcaacacatacctgaactgtatgcctcgcttgcgcatcaaccaagttgtaggttgtccgctgattctcagtccactgaccattgccatacctgaatccatttatcagagaaagaaatcatcaaaggtgaatgaacagatctttctcatgttgatgttcatctgagaattgatgcaactgaaaatctgaaagtttcagtggttgatgggaatgtagcttacccaacaacccagaagtcatatccatcgagatgccaagactgcagctcgttctccgtgttctggaacaccacctcgatgaactcgtgcaggttgagcctcaccaccggcgtccccgaccgcggcgccgcgccgtcgggcctcgccgggacgctgtcccagccgatgacattggcgatgttgtagttgtccacgagcttgagcggcgtgtcggggacgacgaacgacacgccgttgacggcgtaccggcgctgcccggcgagcaccggcgcggagttggcgagcaccagcgtcctcgacgtcgcgatggtgccgtagtggaacgacccctgcgggttgggcctcgccgcgctcgccgtcaggttccaccggaacgacctcgcctggttcatcgaccactccgcctgctccggcggcggcgccgggagcgggccgggcgccctggacacggcgctgctgtagtgcagcgtccccgtcgccatcagcggcgacgcgcccgggctgaaccgcgcggacgccacgacggcgtagtcctgcgccgccttgtcgagcgtgacgaggaacgccaccgactggccgacatggacgtcgagcgagtcgtacacgttctgcaccgggtgcgtcccctccacctccaccaacctcagcgagtgcccctggatcctgacattgacggacgtcttcaccccgacattggacaccctgaacaggtacgtcctcccctggtcgccgacgaacgccgccgccgacggcatgccattgatgagcagcgcgtcgggcggcgggagcgcgccaccgccgccggcgtcgagcgcctgcctcagctgcttatgcccggccttgtaccagtcgccgacgaggagcgtgaagtcgccggcgggcggcgggtacgggacggggatggccgggcgctggtagacgttgagcgcgccgaagccgccggcggcgcggtgcatggcgacggaggggaagtagacgaaggtgccgatctggtccttggcctggaacttgtaggtgtagttggcgccaggggggattgggcagttggtgcccagcacgccgtcctgccacgagttcttgcgctgcttgatgccattccatgtcaggaggaacggctcgtccaggttgttgaacacgttcacgatgatgttgtcgttcgtcacgcagtcgattcgcggcccaggaaactggccattgatcaagatgcccttcgattcgattcaaccaagcaaccaaatcaattatcagagagagagaatgacagaattcaagaactgcatctgcatttgcaagaagaagaagaagaacatctagtggcgttgtcagtcacctgctgcggggtggagccgagagggttgatgctgccgtaggtgacgttccaggtgaagaagcggtaggggtcgtcggcgccggcgagggtggcggcgacggcga

SEQ ID NO: 54852 - DNA, 9311 bp, Oryza sativa
  unsure (1)..(9311): unsure at all n locations
attcctgcagcccctgtactcgtacacaaaattacaactggaaagcaaagcaaagaaaagcaaaatctacgcgtagatggatggatggatggatggagaagaagaatgctagtggtggtggagaagatggacagatggggcgctttaaattggaagagaattctccgcgtttcgcagcagcggcggccattggaggagtaaattaaggtcgcgaggaacatggcggcccagcctgtctcctcctctcctccatggctaccatctttctctctggccatctctctctccagtacagtgatcagtgacgcagtgatgctgctgctgacttgcttgttgaatccggcattacgctgtcgtacatctcaatgtgctagatactgtacagctattgaagaatttaaaggaggaggatttgttttctgccaagaattttcatgaacatggtaacaacaattcctacggttgaggaattaacaaaaaggggtttcttttgtttctgcaaaaaaagttcatgaacatgaaaattgtaacaattcctacggttcaagaatgaacaaaagacggcttttttttttggttgtgccaaaattattcaagaatatgttacccattttctgtactgcaattacagtttcagggcgcattatgtgctcgaccgtatcatcatttcatcacggaccatgaacatttcgtatttaccagggaaattaatcgacgagaacaaaatctgaaggtgaatcgggaggaaatgcacttgccacgtgtgtacgtcgcagtacagagtgaatttttttgtccaaaagaacctccattcttggcctcgtatcaatcaactcctccatccgtattccgtagtaattgtaccaagtaatcttaactaagggtgtgtttagttcatgctaaaattgaaaatttgattgaaattagaataatgtaatgaaaaagttgaaagtttacatatgtaggaaagttttgatgtgatgaaaaaattgaaagtttgaagaaaaagtttgaaactaaacaaggcctaagcaaatggcatgaacaatgcatggatgaatggtacggtttggaaaaagttttttttaaaaaaaagggagggcaaaagttttgcctcatatatattgatagagcaggtttttcaaaaacgttttaacttggagtaaagaaaggtgcattcggcagcgcaaattttcaatttctacctcctcatttttcacacatacattttctgaacccgctaaacaatgtatttttttataaaaaatataagaggttgtttttaaaaattatattaatcttttttaaaaaaactagctaatacttaattaatcatatactaatgaatcacttcattttacgtgtgcgggaggagaagttttcaaccatgttcgaacacgagacctagtgtaattaactgcctgcaatttcatcgaccctctttctttctttatttcttttgtttatttctttatttcttcttctttcttttcttttcattttgttcggcttttgcttctacgagtgggcgatagttctagatgatcctatgtaggagtggctcttgtgtactctacaataattaaattctttcacaggacccttagcttggaagacaaccaaaatgaaaaggtgcttacaagtatgcacaacagtcaaaagagggaaaatttaaaggcaagaagataaagaaaagaagggaacaagttaacatgcatatgtgtaactcttttgatgggcacatgtataatgatccaccactaccttgccttgaggccctgttctttttttttaattctggtattttaaaacaattcttaacttactacacggtgtgtttcgtaaaaattaaaagtatataaaatttccttgaaacacttttctaaagcaacattttaatttttctaataattaattgatttgtttgtaccctccaataactataaaagaattagattgtgcataaattttagctatctcaaacaggttctaatagaaaatggtgtgtcacgctaactgcatttgcatcgaagtttctcattggtgttggcactagttttgcatttggctcgcttaaaacacatgaatctttcttcttttttgtacacaaaataaatcattttaatttatgtgaaattcatgtaaagctaatgtagaattcgtggctttacaaaggagtgtgtggtccctccctcacggaggtatagacggccgtgaaaacccacttgtttaaaagaaaaatgacaagaatattctggttttaaagatctgaactttggtcatccaacaaccagcccctgatacacatgcttttttttcttttctaaaaggaatgtgtgtctcttatataatgatagtatcttttacactttacagatatgaactaattgcccaattagttatccacaaagacataccctgatactcctttcttttttctaagaaggaatgtgccatgtgtggtgcttattaatactaggagtatgttacatttatttgcaggtatcctatgaaagcatccatgtaattaatattgcagtaactaattaattgtctagttgacaagagaatgtaatacagaaaaatagccaaccaattggtcaccttgcatgggagaagagcagaaaataagaaaataagcttgcacatggtcgccagtttgttaatttgtcacaggcatgcatgactacaactagtacgtactacacttttgcagacaaaggctagaatggaggacaattagtattgtcttatggctttaattaatatacgcgtggtgattagtggagcaggattagttataagtggaaatcctaatcctttgaccatgctgtcatgcaggcatgtggccgttgaaccgtgtcgaagtagtacaggagtagcaggcaggcagcttgcttttttttgcttaattaccctagaataattaatggataaccctaccatggcattatctggcctgccctggcctgatgatgatgcttaaattactttttacaaatgttttgctgggtgagttcaaaagaagccgtaatttgtgccgcttaattagatggaggaggacaatagagttaatgaatgctacagagacttgcgtttttttgggtgaaggtaccgacatttttttgcgagaggacgcaagtggggagctgcttgttgccagctttcttggtttcaaacgatgtacggttttactacaaaatcttgatcaactgatgagttacaaaagaagttggtgaaaattttgacgttcccgagcttggtaatgcaagaccgtattaatttaagcatatgcaagcctatccaaacgatggttctgtactgagtaaactttggctctgtttgggagattctaggagctgtaattttttcaagaatttccagctcttaaaatagtctatattctcacttagactctgagaatatatagctataggatccagaaaaagaacttgattttttcagattgtcagaaactacctaccagtcgactgctaatattaaactctcccaaatagaactttaaatgcgtttgtaaggattaatcatattattaaaacaaatcatttgtttcatgcttcaaaaaacatgttttcttaaaaaaaatcttcaactgttgtgttgcttttatttcttaaaatatttaatttatacttataataaaatcaataatatgtgataataatatgcttaccctaagactatgtgcttatagattttctttaaatactcccaaacatttgaaattctcatccagagaatatataacgatatactaattcagaaaacaaagtaaaagttgataaacctaacccttttttttcatactcttactagctctttctaatcttaatatcctcaaacagtgtgactaaaccacgtactcccggtggtactagcagtatagtaatttaatggagaaaagttccatttctataatttatatattattatgcgcaaattaaggagccctgaaagttgagacagcggcattgcgtatttgcgtgcttgctcatcagaaaccgcgggagaaatcaggggcacgaattgcgtttccgcgtggacggcagcacaaacagctggagtttgcttgttctgcgtgcacgaatcacgaggcaggcagcacctctcttcctttctttttgagtaaaccctcacatgcagccattttgcctcgtgatccataccaatatactccatccgtgatccatcctgccctcgtaaacccaagttaccaacctcaaatccacaaaagaaatgtgtctagtttactgcaacttactcatagattataatacttcaacttagtttgatgatgattagtgttggagcaagcaaagcatgcctctgcatcattttgccttgtagagaccgttggtgaggactgcatctgacggcactctgcatgcttacttttccatcatttctaggaactcatcgctgcctgcccaaactcatactggcaagttcagtacaacggcagaaactcataccagaagaaactagtggcaacctagccagcatttgaaactccttcaagattcagatttcaatcacctggtaaggaattcaagttttcagtctgaacttgctgagatatcaagattttataagcctgaaacttcctgggagtttccttcagttttccgaatttctagcagtcaagcccaatatccaataataggctttagagttggaataagttcacctgccgtccctcaactttacaccgagtttgtttgacataccttatcctaaatactagaaatctttgcctcttaaatgttcagaaccgtgcaaattaggtcctataaaatcggtggagtttcatgatttgggcataatagcttacctggtcgtgcaggtttgggttttcttttcggcccaatgctggcctgggcgcctggcccaacaactcaagcgttcatgtgaaaagcttgcttgcagcttgtatcagttggttgcaaggacaagataaggaaggcctcctttgaaactaaggaaaagcaataggaattcttgaggattttatcctacaaaaaaataatccaatgaagccatttgaaacaaaggattgtttttctttgaaattcctatgaaatgaatcattctagagcaagtttttctcttcaagtgtatagaattcctgtattttctctgtatgctaatcaaacaatgtttcgaaacattcttgtgttttaaaatccctaggaatccaatgagtatgaacattattatattcataagttttccctattcccgtgttttctcaatcccacatttcaaagtggcccaaggcccatctcacatatttgtgtatttggccttcacgcaaaagccgggcctctggccttctctctaaaaatctcacatatttgtgtcacatttttttccctttttataaattctgtactttgatctactactgtgaactcagtttgtttcatgtttccagttttcaaaatgaacgcaaacaagtgtacgagatactctgcaactctgctgattgacattgactaattctactcccagcaatgactaaacttttaaaatttatttgaaaagtacatgtaaagtcagcctgaagatttgaacgcgagagacaaattgaaccagaattatattcatgtggcacaactgcagcatcatcatcaagataaggaataaaatggtagagggtgttgaaaagttcagctaatgcagtgcaggtggtctacatcaaaccaaaaaaaaaacaaaatttaatttctgcagaagaagaacatccccattagtgagtcagcaccaacaagaatataccgattgattgatgaaactagcttctggttgttgaacattgggctgtctccactctgcagagagtgacagacagaaagatccacgaatattcaccagcacatccaagaacaatcccattttcaacattggatacaccagcaaccaactgatttatatgctccagttaattcatatctgtacatttgcatgaattttctccttttcaacacacaagatgaaaccccaaagtagcacacactttacagcattcatctgcaggaagatgatggaactgttaactgaacattacctgaaacacactaatttcatttcagctcctctgaagaagtcacaaaactgatgaaaactgtcactgtcagtaaaatatcgatcttgatacacttgtatgttacacacaagacacgaccagagaccaacataaggatgaagatcataaataaaaatgcaagtgaagccatgcttgcacaggtcaaggctggggacaagttcaaagcaagcatcaggaatgctaataatgcctcagaatacaatagattccggataagaatgggtgatcatcctgccctnnnnnnnnnnnnnnnnnnnnnnncgaacaaatttatagtaatatttagcagtgcaaactttggcttgattgcatgcagaggcatgcataaacgagaggtgaagatgagttcagatgtgtcatgtgtgacgcgacttctcggaactgaaaaacctcacggcaataactaaaatcacaagaatgttactactagcgaagaaacctgcagacttgcatgccaagaatgctcacagtttcgtcgagaaataatcggagtcagaaagatgcagtctcgcggttttacagctcatgagagattcttggtgtgtgatcctctccgtcgcctcctcttccggcgccgcatcagattcttggtgtctgctaatctttttctctctctctttccttttcccttttgtttactctgatcgcatactttttttttgcagcaggtatatttatactatcttgatgtaattgtctaaattcaataaaaacttcaattatcttaaaagaatgtacgtgtgtaattgtttaaattcaatgaaaacttaaattatcttaaaaaaaatgtacgtgtgtaattgtttagattcaatgaaaacttcagttatctttaaaaaatgtacattttcagatatatgtggtgaaaagaaaaggattgggatatatgtggaagacagaggtgttgttggtgtcatggcttggctggtcagttggatgaaacgactctgctgcggttctggacaagaaacttattatgatcaggattcattcaggggtaaggaccacctcaagtcccaagaaaaaggatgaggatccaaagttttttttttccccttttcaattcaagaatccaaagatttttattattcttccttgttctggctcttgatgccgctggaatgttgatggccatcagaagccagaaacatgccctcttggctcttgctaaaataggcctaaaaccactgtccatttcatatacttcaatcagcaagaacagcaatgtcaagcttatcagaactatagtaatatgcttgattgaaatggaagatatcaagaaaatcactcaagagaggttggaaacacgatatgggtaaaattctcagggcgaaaactgtagctctgcccgaatcctttaaccggcaaaactcgccgcaaaactgtagctagtatcatctctttcgatatacatgacaacaaccaactcaccatcagtttcatctcaagcactcaaggctcgatctcactgtatacaaacacctacactagtctctcctctcaaactcctccctgaagatctggtattatttttcatcgccgcgccgcaattaacctaacccaccaaagctgtgatgaaaatttctgatgcaacatcatcttggatcatttccagccatagctctcagacctgccatcctcctcctcgcagctgaccgtcgccgccgatgagccgccaccggccatgcctgagcctgagaaatggagaggaccctcaggggatccagactgggagctgctttgctcttgaggaatgtaacagagcccttgcatgagcacaatcggttggttcacaattgttgagcttggcactctcggccggttgtgcaggcggtacttctgcgcaatcagaatcgcaaaaatcgacatcagtatcatcgcaaatccgtcgcgagaagtcatgattgttactgaacattgatgaagaaaatcttgtggtaaacaaaaaaaacagtggtgaattttcctcacctgaagatggcttttgacctcgtcatttgtcagtccatccaccttcatcagctccctgatttgctttggagtggcaactgcacaatcaatcaatcaatcaattcaggaatcaatcaccatgagcaactaattactaattccaaagtaattaatcaccacatgcagatgcaggtgctcttagctctagaaatggcaattaattaatgaattaattaagtgtaccttgagggccaccgagttgctgcaaggcggcgacgaacttgcggtggaggtccggcgaccagcaccgcctcgtcttcctcgcctgctgctgctgctgcgccgccgccggctgaggctggggctggaggctgagagcggggccagacgccgccatggcggcagccctcgccgcggcctgggagaagcccacgacctgacggcggctttcgtcggcggcggcggcggaagcaggcggcgagagcagcgacagatccggcatcctgacgtcgtacgccatgtcctccttcctcatcaagctctgcttcggccgcgcgaaagccggcgcgccagagcccacaaacgcgccgccgttggacttcgcctccgacgagatcctcaccttgtcctgcttctgcgacgatcgtccaaatttcagccaccgaaatccacgcaaccaaacaaaaaagcatccattgaagaatcaaacgaaacgaagtctcacctctggatcagcggcggcggcgtctgggccgccggaattcccagtccagagctgcgcggtgctcatccagttgctcttgtcgccggcggcgtcctcctcatcctccttacgatcaccacccttcttctccacctcctccttcatcacatcaatcactgcacgcaagccatgcccaaatcaacaactcgccaccacaaaacaaaacaaaaaagaaagaggcttttttttttgtttaatagttattaccgtcggcgaggaggcggacgcagagggggagctcgcggcggaagacctcgatcttgcccatctcctcctcgagcctccggatgcagtcacccatggcggtggtggtggtgtccttgcccctgacgcggccgaagctcttggcggcgaacatcttgagatccaggctcaggtccgccgcgccgacgccgatttcccccacatccagccccatcgcgcatacaccacccctccacctcgatcgagaattcttcgagaagcttgttg

SEQ ID NO: 54853 - DNA, 3643 bp, Oryza sativa
agttttcacgtcacctcttcattgcagacttgcagtggaggagggatacttttgtcaaaacacccctcatttcttcgtctatttctctttagccccattccatttgtttatgtgtcaatgaagttattgttatgtattgtacataaataatgtatatgtcaagaaaaatgatactgatttataaagttagttttttttatgtagatgttgtaattctgatggttttatggggttgtgacatggaaactgaaatatctccgtggtgagggtcggctactcggctggtgtaattaatctgtgggcgagaaattgattgaagatattcagatttgggacggattaattgctagaggtaaagatatgcgtaggatagaacggacggatatgatgctattaaaaaccgatatctagaagatatcggtttttaattcttgcgcttttcgattgcttctctttgaagcgatgagttgttcgtatatgcgtacaaaataacataattattatttttttctttttggcttgcttcgaatgattcggtaacagcacacgcctttaattcgtcgagcacctgcagtgacatttgtgcacttctcctttgatttgtcgcttgtttaacttcttgtctatctttttgtcgcatttgctatagcattttgtgctttctggaattcaaaattgtgtgatgcgcacattggtttagttgtgtgcatatattgctatgcttgtttacaccttatagcaccaaacatcctaacaaacatcagcttcaacatacaagtatgtgataaaggtcagcttttgatgttgtgtgatttgcccggtgtgtgtgattgcataattcaccactaaaccccatcacaaagtacttcttgaaattttgattaccgtaacatttttaccccttgcgatatactactgtgtaaaactcctttgatttgtcacttgtttttttttctttttgtcgcatttgtcatcttcattgaaatttgtatgcttctcctatttttctttttgttgcacttgctagatcatttttgtgctttctagaactcataaatgtgtgccacacacattggtttagtcatgtacatttgttagtatgcatgtttacaacttatagcaccaaacatcctaacaaacatcggcttcaacatacaactaatgtgatacaagaagtactttcaagaggctagccttttcatgttgtgtgcttcgcctagtgtgcatgattgcataattaaacactgagccccattgtacttctcgaaatttcgattagtgtaacatttttaccccttgtggtatactactgtgtaaaacttctttgatttgtcacttgtttgtctttttgtcgcattttccatatgtagtaaaatttgtatgcttctcctttgatttgttgcctatttttcattttgtcacatttctagactattttgtgctttttgcaactcacaaatgtgtgtcgcacacatttgattagttgtgtacattaattagtattcatgtctagaacttagagaacgataccaagaggtactttccagtagaggctagcttcaatgatgtgtgccttgtttggtatgtaatcacacaattcaccaccgagcgccatcacgaagcatgccttaaaattccgaataatgtaactttataccgttttcaatatagtactataataacacacatgtgttaacgaccaaatttggtgatatcagcatcgaaaaagaagattagatcaaagtggagtcgaaggcagagatcgatttgggaacagaacaggaatcggttggagtccagatcggctacgattaggatcggctgagtctgagtcggactaggtaagccaatgcagccgattccgacaatacaacttggtgtatgacatcgggttgaattgaggtgtttcaagatgattgccgcacatggatagagtcctgagaaggcaatggtatctattaattaggatattttatgtaatctccttagagatatgcttgggcaaaagtctgccgtaaagacttttggtatcttagagtttgttagagataagagtcgtttccgatatgaacattgtttgtaattttcgggtataaatagatcccgaaccccatgtaatcaagtaacacacacgttcaatacaatttcggcgcatcgccacccttttgctttagttttatttcgacgagttcttgctttcgggttgagctacatcggtttcgatcttcaacaagaggtaaaacttgttatgacggcttgcgttctcgggattagtgcttccatctttataacactctaatcttgtttatgtaattcatcgggttatcatatatcttacataatctctggcaatatcgctatctaacctacaaccggctaacatctctcgaagaaggcagccaattaggttagattttgacgttgactcagattatataagatatctaccactctatgaaacttccagcagcttgattgtctagatattgttcttcttttcatacttaatgctgcatcagttgagtttgatctattaagtcgtgcttagaatatcaatctctagcctgccttctggttgccgattagggtagcatcggagtttcagccgatcttatctgatttaactatatttgctctatatgcttcattgacatgttaaatctgcccttgtgtcaagatattattgcatttatgtatattaagcttctgtttggtttattatacctgttttaatatcctgatatagagtagcatcgaagtattagccgatacatgctagatctatctgatcggctatgctataaacatatatagtcctgttattaatatatatttcgatctaagtgatttatactgtctcgcatggtggccaatctatcccaatcacttgatttaagtatatatcgatataagaactatatattggtaatatctacagccgatcgagtagatttagttctttattatctatttatattcgccgatcgattcacgtatgacatcggctcaaagatgaatgatatgtcatcggcacttagccgatcggctatcatttatggatttaaccgcggtttctttctctatttcttgttgattacaggatcaaatcaattggcacgctaacacacccgaaggcgagctttggacctgcactagagttaagcagatctcccaggcctcgtgtttttcatcaacaacatgaaaagtacatatccccatggttgtaaatatttatcataaactaccacacacttcatcaaagaaagtgtattctcagaacattcagtagaatataccaattatacatcaattgcaaagaagatgccatgccaccttgatgattaaagaaattcgagtcacgaacaacaaaccatgaatgagatttttgggtgccgctttgaagataagaattggccatttgatatttgtcttattgggaacagtgacatcatttcaacatggcatatacacggggtttcgaatatccatctagaagatatatttgtcttttaaaatttagtcacttgcaaagttgtgtccatctgtagaatagctatatggtatggtggtgtcatccccactacttatttgtgctaccatttaaaaatgcaaaatgaccatttatgttacactctataaaatt

SEQ ID NO: 54854 - DNA, 2392 bp, Oryza sativa
catgaaatctctcgtccctttccttctctctatgtatatcgtgtggttgcaatttgtttggatttaaaaaaaaaaccttcttttagttggaatattgacgataggaatttaggagtatctaggtgagacaattttccatcatcctttcatgttagggaaggagatgctcagagttactgcttgggcaggacaagagcatcaggatataggaatcatctatgtacaatttgcaaggtatattcagaggatgaaaacttctctcttggtttttgggaatcgtggcccaattcatgtaaatatcttgtaaattacatatagattttcttagcttaaacatggtctttcctagggaaaaacactttacatatctctgataatatcatatgacacacatcttgttatttttttcttttctatttaaattgtcagtacattctctttttcgctgagttagaaacgaagaaaatcctaccgaatttttttctcaagtccttgaagaactgaaccaatccctataaaaaaccctacacatgattttgaaaatttctactccaaataagtcttgattgcaacattctatttggcctttctcaaccaagccaaaatatttggcaaactaaaaaatcttccatctatttggtttcagagaaaaatagacattggcaacttattgggcttagttaaatacctaagtgtgactttgccagcaaaccaaacaataatctagccaacttctattgaaatttttgtcaaatgacctatttttaccaatgccaaaattttggtatggttacaaatgacatactcccaagacttttcaagaaccaggggacaaagcaggaaattaattgggtgatagagcagtttattgccgccaccgttggtcttggcatccatgaaggtgactactccaacatctatcttgtcatcaaattgacattattcaccaagagatagccaccttattcgtttttaccactagtgaggcactagctgttactactacaattttaacccctgcaagaatggaaaaccccaactgggccgtaattaacaatattttatttactagataagcatacatgtatgccatgattaaggatttgacaactagatcccatctctttgtcacaacctaatctcaactccctccatcacagaataattaagttcatttttagcctctcagatttatcttaaaataaatttattgtttataatcactgcagtcgagtttataaaaatagaggataatacattatgagtagataaaaagataaataattacattagaatttgataaaattatgagattatattttttattgatatgtatggaatgagtgaaaaataaacttattatgagatagggagagagtagtatgcctgccctacctggccactcttatccaaaccttagggtgtggacaaattcaggcacgagagcatgcctgcactgtgggcccttgtggcctaatccataatttgtattatatatgttgtctgcaagggataaaagtattgtatactcaatagtggtgtaccttgaaaagtaatgtaatgagttgaaaccatgggcttaattaagacttgtaaggaatggtaattacatggtatgatcctatctgtaccttaattacttattactactaatttgtaaaagctatctgtcggtgtgctaattaaggaacctagtgacaaatatatttttgcacctaacaagcaggggttaatatgcaaaaatctcatgttctcatatcaatggcaattaattaattaacagttctaaaccaatgcaagaaaggtcagatatgataaagaaggcatgcatgtttgaacagggtccatggttgaaagattcgttcaagaagtaagaatcacacattattctgtcatggctgtcaagaacaagatgctttcagattagaataacactagacctgattatacttttatcccacttcaactgagaggactcattaatttaatctggagccaataaattccagacacaccagagactttgcattgctgatgagatgaaaagaatttaaaccaaactactggaagggcactagaaagcacagaaagaaaccaaacaaatattgaccatctgtgtatatgtgcaccaaaagagagaatccagaggtagcaacatgatgggatcttttggcacctttcaaagtggtggattcaaaggcaagcaaagatgagataggtgagcactttggatgtgtgcactggcttaggaatctcttccatcccaccatctaaaagggaggaagaaggaaggaagacatatgcaaggagaaagctagcttttgctaggtaccatcaaaggacacatgaaagctagggcaaagcactaagctagcaagcatttcattagtgc

SEQ ID NO: 54855 - DNA, 6010 bp, Oryza sativa
catgtgagttgagtttggaccttagatttttatggagttatataaatatgttgtatgagtgttgtcaaatttttccagaatttttcataaccgtttggatagtttttaagcaaacgaggggacatttccttgagggatcaaaatagttccccaggctcatcagcgggtgcgtagtagaattttaatgttattacaaaaaataaataaaatttttacagcaaatatatatttaacgtagttagatatatatgctggggctcttaaaattctggctctaccattgagttgaatacctgaatccaagacgaaattaattaagaggaaatgcgtggtagcaaatgtcaattaatgaataatatttccttgctttgaccgtgacaacggttgcaaaggtacggtgagtgtttctgatagtcgacacaagtctagctcactactgttaacacaataattgaccacctgttgttgttcagatttcagaaattcagatggaggcatgcagcatcaagctgtaccagtgtacctaacgcaagcaggcccaggaatattcagcagcatggatcacaaccacaattacaagggatcgatccaaaaaatccaatcaacagaagagggtagctgcatgtaggcaaagctaggtggtagttggcactatgcaaaggatgcattgcatgcaccgctatagcttgacgaattaatgatgattagcatcacctacaagagatgtttaatccttagcaatcaagcggctcctcgtcgtctccaggaggcagagctagtatatcaccctctttctctctcatctagcttctctctaatccttgtattgcatgccatatctgtcgtgttcgaggaaagaaccattcattcttccaatgagattgatcccagagaagagaagagaagagaagcttctcattgacagctactcctcctcctccagctttgattaattatcttatttactgtaccatactacttgatttgatactagcatcttctctagttcttaccattttctaagactcttgatagtctatgtggtactagcttatagacaagaattccatgtgtatatataaattaaccctgaagagattagcatgaactctaggtggagtagattggtttaagcttaattaagcaagagctgaaaggtactggaagcttgccagtggtttctgattggcaggtgccagtttgcatcatatcagacagaattgggacctaattaataaaccttggatacatgtgcaaaccggaggatctaaagaaagaaaaatgcctcttcaattccatgatagtttaatcactaaaccagattagagcttactatcagttggcccttacaatccattggagtcgttcttccatttcttggtttgtgttgaccctgatggatcatggatggatgctattattgttaatagatgatctcgatgcgagattcttctacagcgacaagatgataatgtattctaccacatattggtggtctagaaatctagaatcttgagaatatcttggcatgattcgatcgccagcgagtaattaactgtttggaagatcgatgatcacaagtatagtatagctagctggagttgctcttgatcgacagatcgaagaaagtctggccctttgaccgattaacaacaaccacattgccacatttttctttcctgatatatataaattaatatgcatgctttcagttcaataatggttcagtaaacgtcaacctcagaaaattatattagctatttaaggttctcttgttaattgcactgatccttccatgtgtgtgatttctatgctgtgtttacgcttttgtatttctatttctttttttgcttgattgtttgtcatgacagatatccatatatttttggaaaatgaaactctcttgatgctgaactaatgaaagtaattggggattttttttactaattcttgtctcaccttttaaaaattgttgtttacaccctttctcttttttaggccttaattaatttcataactgtaaatagtgcagtcttactaatattgcaaacgaatggattaattagaataagcaaaactctcagtataagatgtacaactgccggaactaggctgcattcaccgtgtacataacaacaatgtacatagttcagttaaggggagaatgaaattctccatttcttgttcagattcaactgaatatcgatctatctgctcctctgtcaacatctagttgtataagctatgccaaagcttctaattggattagcataaaaattaagtctttaaggcatatatagtatacttgagcaattctatagaagcacattcctgatgcatttagccctcatcacatccatgtacatagctcattctctccattacaagatcctaccgttatcgtacctaaactaattaaacaatgttttgacctaactaactggtttgtacaattagtaatactctataagtcgtttttgactttggtcaaatttaaactacttcaagttttacaaagtttgtagagacaaatatagtaatatttacaacatcaaattagttttattaaatctataattgaatatattttcataatatattattttgcctatttgttttggggccttgtttagttcccaatttttttcccaaaaacgtcacattgaatctttggacacatgcatagagcaatagataaaaaaaactaattgcacagtttacatggaaattgcgagatgaatcttttgagcttaattagtccatgattagccataagtgctaagtaacccacatgtgctaatgatggattaattaggctcaaaagattcgtcttgcggtttccaggcgagttatgaaattagttttttcattcgtgtccgaaaaccccttccgatatccggtcaaacgtccgatgtcacacacaaaaaatttcttttcgcgaactaaacaaggcctgggttaaaattgttatacttttttctacaaatttgatcaaatttgaagcagtttgaattcgaccaaagtcaaaacgacttataatacgaaacggaaggagtacaagacaacaacgatctaatctaaatggtgcccaaccggccaacacacataaaagtatcaattccattgacttttttttactaattcttgtctcacttaaaaaaaatgtttttttacacccattctcctttttaggccttaattaatttcattaactgtaaatagtgcagtcttactaatatagcaaacgaatggattgattagaataagcaaaacactctcagtataaggtgtacaactgccggaactagctaggctgcattcatcgtgtatgtaaccatcataacaaccatgtacatagctcagttaaggggataatgcaattctccatttcttgttcagattcaactgaatattcctttgtcaacatttagttgaataagctatgccaaagcttctaattgggtagcataaaagttgccccgctatggtgttttctattgatagtagaaagcaatctaaaccattgttttcatttgatcgaagggttcaaatttatttatactatcaccacaattagcggtagtagaaatatggagggacgttattgtcaaaaaaaaagagggtgcagagaggtataatttttatttagcagtaactaaaccattttttctcacttttttggctttttttatgaaatatgagcgatgctagcacaaagaatgatcatagatcgatttagccagaaaaaacataaatgagaaagtaactcctaattattatattagtaaattactaatttacccctaataatatcggtagtataatgttaccaataaatagcaccggagcatcgctctcaaagagcaatctttaaggcatacatagtactatacttgaccaattctatagaggcagattcctgatgcatttagccctcatcacatccatgtacatagctcattctctccattacaagatcctaccgttatcatacctaaactaattaaacaatgttgacctaattaactggtttatacaattagtactacaagagcaacaatgatataatttaaatggtgcccaacccaacacataaaagtatcaattccattgacttttgcacaatgtcaccatgaacagacaaaagtacaggggtactactgcccctgcccctgacctcaaggaaataaagagccattctttcttgatcgctttctttcttcaatttatttattttttacatgcaaagaggcaactacaagtgggcagaaaggggttactgtttgagatttctttttcttcatcttttgacaaaaaatatgattgactttttcttggcaggccggcaaacgccatcagatctccacggcacacaccaacatgtacaaacacaatgaatgccaatgcactttattcagtttatcctcctcttatctgtctgcaaaattgcagatatttacctactttgaccttgaatgctttctgaaatctcatctaattggtcccaaatgtttctgttctgcactgcccttgcacaaactttgtcatctgcaatgtgtcaatgtgtcatagagaaatgagcccatggaagatagagttccagccagtagtagcatatgcatttttctttcaagaaaaagaaaagttgaagtagcagaatttcacaaaggttactactgtagtagtagtgcagaactacatatggatgaggtgattgagtgaaagagtggcagacagagtcatggcttgtgctgttcatggtaaaggttgttgttgttgttgataagtcagaaggaagaaaaggtcttctttttatgatcatgacaaatggagtagattgttgagcattttgcattgactgagtgattcaaactgttactgaactctgaaatgccaagctaacaaacagttgagacggctctagaacagtctcagatgctcaactggtagttctagttaacctgataatgcttttattccttactgaaagatggtttggttcggtcatccagcatcttatatattcttattcagaccaatttgacagattgaacttattctacgagccatctcattttcagcagaaaaagaaagggacatctgaaagtaaattctctgctgctaagaacagaagaagtcacaaattgatccaataatatcgcagacatttttatgcacacttgccattaacacatcccagaaaattgcatttctgcttttatttaaagacttaatagtatcctagctgaaaagccattaacggccacagttgcaggacacctgtacggcaggagaagctacacaggtcaggacacacttgcaagttgcaacaaacaactttgtgaagtgatttgatttaattctcttttctgcatatatgtgtacaaaaaataaaatctcttttgatgttttcttctattgattgtgatgatagagccagtagatggagtgatcgatcgatcgatcgatcggaatctcgcgaatgatctttggcgacatggacgccaactagaatccacccactcatcgatcacagagaccctgaaggcgacgccactgacgttaacagatgcatcctcatcgcctcaaaacctcatgttcatgttcatgttcatggacagacctctcccaagtaaaaggaaaggactgtcgcattgcattgtgtctactgttagctgtgaacagatacaagcttttcgtcttcgtcgacagtgtcagttaagttcttcagaatggagatggaatatattttgcattcagatgctgagatgcagaagaagaaagtatatataccccactacttcacatggaagacagcaccatttcttgagctttcacagtccaacaatggccatgtatgcatgcataccggaacacgccattgcaagttgcatttttttttttgaggagatgatcagtgtgcagcatcaaatttgggggcagaaaactgtctgcagtctgatcctgacgaacagatggatggatatgcaatttgcatcgacaggggcac

SEQ ID NO: 54856 - DNA, 25067 bp, Oryza sativa
tatcactatacatacagttcatcctctcctcctagtcctgtctttgtatatgcttccccctcaccctagtatccttgtatcgaagaatgaaataattccgaccagtctgtcgtttaattatgcctttcaataacatcttctaatgagtccaccaacattctgtgcaatgtcttgtttggtctcgactgaaacaggtggatcaccaatatacatatcgaagaaagcccctgttcataaagacagcataaggaatttgccaaataaataatgacagataacagtaattctgtctttttttttttctggaagttagaaagaacgaatatatatacttactgcaaagatctttgctctggacagcaccaatttgtttgccatcaactgcacaaagacgttccatgtcaacatttttgtcaggtgtaaaaattctaaccatgcagaaccaatcaggcatacgatactaactttcagttatgagctggccatcagaggtttgccggaagtcgatctttgtaccctgcagtcatattgacttcagtatcttatgatgagaagtaccaagttaggccagacgtaatattggaacttaccgcaggtatacaaatatcttcactaaaataagaaccaaacgtcttcaagcaatgataatcagtattaggattcatctggtttgaaatggtacagagaaattattttagacctatataattagccaagaatatttttagctgccgaattaacaagtaccttctgcaatcggaagcaaagggacttctcaaatgcactgaaaagagtgttaaagaaaatgattagcttgcatattgagagattgtatcttctgaactacagctaaagataagaatgtgctgatattagcacaagaaaactaaaatacatactcccgcactgtgccaatgctaagaccattgtagctaactatcagcctgactgtcatatgaatattttccctgtacaacatgacaggtacaacacaaacctgttagatcagagcgaaaggaatgcagatggggcaaaaattaagattcctcttgtttcttatgcagaatacaaaaaactactcaaatgaagtcctcaaaagcacatcaaatgattgcaggtttggaatagtcccattaacctctagcataaaacagccaatacttttaatgatccatataatttctgccaaattactaaatgaacacctggcgttacacaagtactgcatagtatgtgttaagtgccagaacctgggaaagatctgcataaaagatgaatagagcatgcacacctcaaaagatcttcatagaaatctgggtggtccttcagttcagaaactggaacagaagcatactttgggctcagccttttgcaaatagaatctggttgtatatctacaagaatacaacattagtaacctaaagaaacatcgtttatgtggtatgctaaaaggttcataagtaataatattaaacatgacattttattatactcacataatccaaaggcatagagattcaggtttttgaccctcattattcgcatgcttctaaagcccatcccgacgagcacctgtaaatttaaccgttagttgaactcgttaagggcctaagggggtcaagatcaagcaacattatggatttggaataaaacattgtggtattattttcgaaatactaagttgctaacacaatgtcaagaagctatttatcagcattcatgaataaggaaaaaaaaagaacagatcaattatatacaagattgaaaaatacctctgaagttggatttgaattatcctcgagaagagtagggaactttatcccagtttttggttcagttgcgtcttctggtaaaattattcttggcacagcaacacaagtacagcctgaatggttttcctccaaagaatgctgatcaacaggttctctggtacgaccattatctcttcccaatgtcattgagtctgcaagcatcttcggcgatcttgtccatgcaagaaatgagcagtcgataaagtacacatagaatgaaaaccaaaatacaggaattagccaaatggaacaggcattggaagtacaaaaacaatataaatagaagaacctacatgttttcaaatggtggtacagtagcagcagctaacataagaatgttacaggcatggcgctcctccacctcgttccacagtcgcccaaatgttgcattagcaagctttgctaaaagaatttgtatagcgtgctcttctctaacttgagaaccaaaacgcaatccggccaaatgctgcatgcaagaagtcacttgctttatttgcgactggcaggctcttgaacttgagcctgcaatagctgacaacctgtggaaaatcttgggatttgatgctctagaaagccagaaatagaaagcaccagcaaacttgttgaagcaactgaatgcttcctgaactgctccattccctgtagaacatatatgccttggatgctgaaaggaactctcgactaaggttccaaaatgtgatatcaatcctaatccaatatcatgagatattggagaatctattgggaatttatgcaggtaccctccattgtggtcaaacttggagaaaattgaccagtccggtttcatagtgagttcacttggaaaactatggcaacaccgaatgtctttagaacgagtttatcaggaggaaagcccagtataacctgccaatagaacaaagtaaccgaataagaagacagtactaataaattactcaataatgattttgcatcgatttttactcctggagacgtttgctactaagacaaatatgtaaaagtcaatctccaacttgtctgctaggatgtgttgctaaaaacagtttttacataaattctgatttctactccctaagctatttacattagttcatatagtgacacgataaataatcatctgaaaacaaccgtgagaactctgaagtccttttttctccttagcaggcgttcacaaactgaaactcacacacacaaaaagagagagagaaacatggtatgatctcaatattgccaacaaaagtagcgatcgaacacactagttgcttatacttttatttcccatcatcaaagcctcacccccagctcagaaaatcacctaaaaactcgacccggaactcccgaattagcaccaaaacaaaccacgatctcactatccccaccagattcacgcagagcaccaaaccaacccccaatgcagcacccaaattcccccaaacccatccccaccaccctcacagaaattcccccaaacccacccgcattcgcgatccccaccacccgaagacttcaccacacgcgcaacgaacgccgagagcgcctcacctggcctccctcgctagctagctggctggccgcggatcggggacgatgcaggcggcggcaacaacagcagcagcagcagcacgaaagggagcgggtgcgtgcgtgcggcggcgcagccaacctagggttcccgtgccttccccggctggtgcttcttctctgctcggattcgagagcgtggaggaagaggaaacctcgcaaaatccaaggaaatgggggaggaggaaaccgaaagcaagcggcttcgtttccgtatttactcgccctctctctctctccttctctcccccaactaaacacggcgcgggtctccttccgcttccgcccgtgcgaaggcgagcaacacgtgcagccgatttatgcctcgtcgacgaaaaggttattactacgcaattttagacgctttttatttttcatccaaagttaaaaaatgagcttgtgtcaacaagaatagtatatcaaaaaatatgattttcttttataaatttagttatgttgtggtagtatttttcaaatgtcctgtgtgtccatgagacttgacaatgacgtgctccagaaaattcaaatttgtcaagaaaataggcctaccagctgggcatctcgacccgggggaaccgtggaatatgctgcttttggtcggacgtggagcgctactggccgttgatgctgcagattccggcggaggtgggttgcgccggcgagcatccgcacgattcgcggaatctgcagaatcaacggccagtacaacgtgttgacgcgagcgcacggccggccgccgaactctgaaattttcttcattcccgctctgtttttctctgtacggcccatctgcttttttattttttagcatacaccagttaaaaccatcatgtttcacgttttcagtcaagcccaacatgaaggacgataaaacagtgttaacagccagccaaattattattatttttcaacaaaattaaccaactgtagtcaacagtagtgcctgagtcgtaatcgttgcaaattaactaatcgaaatgatgcaatcccatctgcgccctgtctgattaagatataagaataacagaatgtgtatgtctgacgcggagattaggaacaagatgctgaaagggcccttgtctggcaaatctagaactgtactaattgtgtctcttcgtatttggtggcatgcattgcacgggcttgtgttgtggggggggggggggggggggtgatccatgattcgatcaacggaacggatcctatcctgaagtcgcccaacatacagtaggggtacaatgtgagtatgtgaccactggatgtaaactggggaccatagcaaccttctgatcatgtgattttatttcaaaaaccaaaaatcatgtgaacttacataggctgtgtttagttcagcgtaaagtttggattttggttgaaattggagatgatgtaactgaaaagttggttgtatgtatgacaggttgatgtaatagaaaaggattgaagtttggatccaaactttggatctaaacacagccatagtgaaaccggatagctcggcgtctcaatcctgtttaagagagcaggagattcttagaaataaccggtgatactagctggtataaaattatgagttatagttcatgttctatattctacgtaggactatatagattcttagaatctgaattgtttaaagaaactacaaacttacaagaacagctgctaaaaggcaaaagctcctccatggccatgactttcttggcggtaggccggccggcgagaggatggcggtggaaagggcggaagccggcggaatcaggatggccggtgtgccggcgctggtgcctgccaactgctacctgcaacctgctactccagctggtaatgctatcctggctagttgcgtgaatgtgagcatgacagcgcgtggttcgttgccgctcacatggattacttgccaaccatcttgcaatgccacatgcctaactatctcgttgaagcctataattgtgacgcttccaggccccagacgaaaaaggcaagagaaaaagaaagggatgaaccggggacgcttctttgctttgttcttccctgtccctggacatgaaactgttgtcgctaggatattctttttaaaaaaagaatacacatattttgcatttgccttgtagtgcttgtcattgtttgttcacttgctctcttccctctgcatggggtaaccatcaatcaagcttgcaggttccaaatcactgaaaagggccccaagaggtagaagcctgatggcatggcatcctctgctttgtctcatagcaaataactatattcattgaacctggccaaaaaaactgcaaatagcgggaaggtgaaatgaggacaaaaaaaggagtcattttcttatggacatgctgcaactgtttatgaggtgaaaaaaagaagttgatttctcgaccggatcaacgttgacctcagattttaaaaagagagaaaacgagagaatagttacataacatacaccgaacagaaataatcttgactctggtgcttacactcattaagctgaccaaacaaacaaaaatctggtcaatactgcaaagagatgaaacaaggaaatatggatactatcatattacaatgtgcaatcaagttaacacagtctgcaaaggcttgtcaataacaaattgaataattattagctgttcagtgaacattgttttagaaactaaccaaaaaaaaattcggaagttccactttctgtattataccaccagaaactggcgggaggacaaagtttcatcgtccatgaggtaaatgatacattggtacaagtacagcattacatacgatacgccaactctcgtaaaagttaatctagcaggaaatggggatcaaaattaattattgcaagtaacaaatcaaattgcctacgggtatgcaggtagctcatatgagccaaaactctcttctatatcaacggtttcgtaatcacagatttgtagtcacacctgagagcaaagcctgcaacagatatattacatggtgtaagtaataacagaacaggggaagattgaatgtggttcagaaatggcatagcagaagagcttgttcattgccaacagaaaaactggcatagcaggggctcgttttagcacctgtggttctaagtattatcatttgactaaatgcaagcaattcacataagattgctttgaccaaaaacaaaaggaaaagaatcaacatactaggaattaattggcatggtttgtgtttatcattatttcattttgcatattatgatcagatatgctaaccggcatagaggtgcagagaaagaagatgtactccctccatcccaaaatataataacttttagctcttaggatttgtcccaaaatataacaacttctacaccaacatactcttcctaaccaatcacaagcctccaccattcacttttcccacctatctctactactcgtccaatcataaccctccaccactcacttctacctactttcttgataaccgtgtccaactctaaaacttcttatattatgggacagagagagtaccttttctaaagttggtgcaatttatcactcatgtggtcctttctattgctctaagcggcctgatagataagatcataatgtgaggtgcaaaatgaaaataggcaatgattatgtgatacacgcaaaaggaacataacaaaccagaaaagtggaaacatacatttggcgcatatggagcgaaaatggctttgacatcttcaaacacctcaggaattggttttgcagcatcaatctgataagataacaagttttacaataggtgtcaaaagtcattagaaaataagtaggcagtaattcatgtaagtgtgcaaagaaaatcgtggtcagaaactcataatgatcatgggaaactttaatatcatggtagaatagtctttcatattattatactcctactacttccacttcgaatgtatagcatctaatacctattgctatccatcctttttgttgtttttgcatcattcaaagagcaatagtacctttttaaccttgtcctttgcattatagtactcaatgacaggcaaactggattcaacaaaaactttgaaccttttcctgatagtctcaatgttatcgtcaactcttccctgcaaaagaaaaagttggaagcagaaaacaggttattcatgtggcgataaggtggtaaggtttaaaatggaatggagaatacacttaagtgatgaggaaaacctgattgcgtcccaaaagacgtctttccatctcttcctcagaacaatcgaagaatagcacaaacgcaggagttatttttgtctgaaacatttgacacattaatgctattagtgcattgtcattgtgtgtgtgtgtacacaggctgcgagtggcccctgaagaacgttctactaaggagtcatgactgtttgctacccaagagtgaagtgatctaaaattttgaagtacaaggagaagatgtgcttacaacgttctcaaatgcagcacgattctcttcgttccttggaaatccatcaataaggaacttatcatttccacttttaatcatggcttcctgcaagagttttatagttacctcagatggaacaatctttccctcctttatcatgttctcgatcatagttctataaaacatggaagtgtaacaataaatatttagtagtaacagacagaaattgaacaaaggaggaaacataaccaaattgaattttggaaaagcttgttccaaacaaaaggaaacagttgggtttcttatggaatgaaaataagatacccgttctcagagccagatttgatctctgcacgcaaaaggtctccagcactaagatgaatgaatccaaagtgttcaacaatgttggcacactgtgtgccctttccactcccaggaccacctgtgtaaatttttggttagaaacagaagataatatatctctttatttatatataatatataactatgtaagtacttaaattttatcatgtcaattcattgcatatctaaagtttcctataagttcgtttcctctcatatgagacttacattataatcaaacataaagtagaaggtaagcagttacctagaacaaatacaactgtaactttcttgtcacccaacatgttgtcagtgacctcctgcatgaggggcagatttcacccataagacaagctatggatggcataaattatagtacagtatgaggcaaggatatgaactgaataaacaaataaatgagcttacgttgtgactcaaggagtcaaaatttatattggtataatagtatacatgaagattaaatgaatcatacacaacagaaatacatcgacatattctagcctaaataaatggtttttaaatttataaacagaaaggaagcaagatttcaagctccagcccttgactgtagcgaaactcacagccaaaggatcaggaaatctaatttataatctctgatgcctcaaggaaaacatgttgcacattctcagataacagttgtgttctaaaaacatactcaaataatataggaaactatctagcagttcattaagctcaaccaataaacagtagggaaaattattactaaattagtacaccaatagcattatgcgtacctcctgtccagccacaactgttggagcatccacaaccgaacccatggctgcaaaatcattgcactaatcagtttccacaagtaatctcacactccatacattgcacaacaaaatgaaaaaaaatcccaaacacctaaaaaccacaggaaaacacaacagatccggcgctgagcagccgcggccgcaacatttctgaacttgcaagcagcgatcgcgggggatccgtaccttagcggagggcgagatcggcgagacgagatctgggatctgaaatttccaatttccaaatcccccgggcgcgtgtgccgtgcggtgagcgaggtgcgaggaggtggccttgctgccgctttaatgcgcgtgaagcacgggcacgcgggttcgcgggttcgggtgggggtggaggatccggtaaggctgccgccgcgtgcggttgcggtggcggccggagtcgtcggcgaagcgaagcggagcaggcggagcttcgattcgattcgaggaaggaaaggaaggatgcagtggaacgcgagaggaaggtggccgggaaagagaggattcgtggctcgtacggttggaacccggcgcgttttttatttttatttttttgggaggaatatagccgctggatctcgatcggacggtccagatgaggtcaatcctaccgtgagtttgaaaaaggcgcttcagtaatccttcaataatcagtgcttgccgtatttcagacgcagcaaattgcttattgcttgaggcaacttcagaagttgttcagatgcagaactacaaaattttgtatggtaaaattataacaaattggactcgtgcacgaagtatgtgatatttgctcaaatgtccctattcatttgaagcacctggttgttcagggtcgtttgttgttgcattttcaacaaccaaaggccccacaagtttctttctagagattaaagaagacagcatcaagcatagcagtgtcaacaatagtaaggatgggggcctaccggcctaacgtcctaacgacatgtggaattccaccttacaatttgcaagtagattaataaagaatgggacaactcgaggtagaattttagcaaaattattctcaggaacattccttggttctgtattgacttgtcggtgttaactttctccctctaccagttgtccaaaaggaaaaggagggagaagaacgcttttgcacattggttgttggtcatgagcttcattgcccaagacatatgtaatataaagctactaaactgtgaaaaagaactagccaactgaatctaagatagcaaagcaaactgaatcaaagggtagcaaagcatctcagactgcagtacagatttgatactctcaactcagaagaaattagaagtctgatatacctttttgggggagcttaggcacaaatgctcacttttcatttcgcaagtgctcagaaaacaatgcacaactcttgccatgataagatgtcattgtagaagcatcaggtagaagcacaaaaaaccagtgctgcaccatactctcgaacaacatttacaaacatcaatctgtacattcacgagagaggtgtagcaaaggcatttttcctttccttgatgcatatcagattgagtgatgatcttgtaccttgctttgttgttagcgaaactggactgtgttggcactcttcttatcactagaggtttggaattcaaggatatcacaggtggcacctttagcagctgaagagttgataaacctgctcaaacatcgccataggtgaatatatcctgaaaacaagggagatcaggtgttttgatccttgtaagtctgccctcggagttttgcaatgttcttccgtaattcaatgctcgatatttgctctgcctccagtgctctttcaagctgttgaacacatgcaaaacaatgagagataatgctagtacaactcaacccacaacagaactttagccagtgtacctttgctgctcgagcgctccattctccaagaatggctctgagtctatcattttcttcaatatactgcatccaacatgtttgtaatcaagcaggaacagtttggaagacgatataagtaaaataagcatgatccacgtgctaagctaaacctcttgatggttacttgtgaaaatacctgattattgctcacacgaatgcgctggatctctgagtccttttcatcaatcagactacgtgcaagttgaagctctgaatgcacttgattcatctgtgaattcaattagtatggtattagtagaagatgaaaattttaataaagactttacacctttagttatggtgctaaagatgaacaactcaaatagatggttctcaacttatcatttacagctacaaagttgagctataatataattttaagaaattatcgtgctataaacatctatagtaatagcttttgcaagagttcataaaaagtaggccaaagacaggtgagattttggagacctgcctggccagaatatagaaaattgcttggcttaagataacaacgcggtcaaaataacaaggactggagtgtaagcaggcaagttaattatgttttgtgatcagaggcattatagcattacaatataggtttaattacctcagcggagagtgctctaagttcttgatcacgcgatgctaatagatgagcaagatcggcctgtagaattaaaagggggttgatgcaagtccatcaattcacataaacataatagctacaaagttcctttctctaattttgcacctacgaagctggtcagttaattaatgcaacacaatcaatcagtgttgtgcagacctgaggagtgctcccaacatcagttctctggtatttgcttaagcattcttgcaagcggagcacctttcaggaaaataaaaggtttggttattcaacaagaaattttctggaagttccaacatattattattgagaacttcagcactgactacagaactggccaattaagttaatgtagaactaaatacaaggatcagctaattcctccatgaaatagtaatgctagtaatctactgttgtcttgtacaaatatttaaataataacacaatctaacataatcaaattttaaaatggatatactgcattgatcttccaagtacctcctcactcaggtaatgaatattctccctttggtactgaagcagagccatttgctggtcagaaaaacgaccatcataatacctggtgaaaagaaaaataacttgtgaaactctactggcagtatgccaagtacacatatgacatattcggcaacatatcaacacttgtaactcatgtgaaggcacatccttctagatataggttcaatacagatgtttctgataaacatggactaaagaatgcttttccaaactgccagaaaatcaaacgccaagcctgaagtggtagaaactgtgcatagtacatgtttatacgtgtcttcaaacactactccctccattttttaatagatgacgccgttgactttttctcacatgtttgaccattcgtcttattcagaaattttatgcaaatgtataagatataaatcacacttaaagtactatgagtgataaaacaactcataacaaaataaattataattacgtaatttttttgaataagacgaatggtcaaacatgtgagaaaaagtcaacggcgtcatctattaaaaaacggaggtagtattttattgtaaattaagaaggaaaagttcaatgcatttaatgtacacccttatgttgtaccttcgttcttccaaagaactagatggttggagttggagtgcagaatataaggaccgcaaaatatcagggtgcccattcagagagttgtacttgtggatatgccctgtaaaaagaaccgagtgggcattatatcttagaaaaaacaaataatcgggcttgaaactttcatttctaaggaaaagcaacactgttcttagtgggagcaaaaaaaaaaaaagaatgacgagatcgaaactcatgatgacaaggctttgaaccctccagcatgcaaggtttgtcctgcatggctgaggatctgcttgggggaagcataactgctgcaattgtagaagtcaagatgaactatctaacaaggacacaaatgacttgagtacttgactcacataagtataagctcatgaaacatccagcacatatagcttcaaccacaatagcaatcctgcataatagtaaatgaaagaaattatacatgcactgaaaggatgagaagagaataattcatgttcccaaacttgtttgggaatccgcagaccaaacctcatgccaaaagatgccggataaacctcaacttccgttcaagacataacagagaaatttgcagaggttagctgcaattacaaaggtgtaccttagcaataaagaaaccgatagtatgtgtactagaggttgccagactatgattaagagcattgaagcaacgcctgccaaaagaacaaaaagaatatggacaatgggtcatttcaatgccaaaaaaatattttacatatgaacctctcaaaatctcaattccttaacagatccttaaataaataccaaagacaatagtttaatcatgttgaaacaagtgcagttaagtaggacatacttgttataaacattaaaaaaaatgaagaacgcactagtattacagcatcgggcaaatttatttggtgctatacttaccactagcaacggtggcaaatggaagttgagcaaggcgcttcaatttctcactaaaatcgtaatacccctgcatccaaagcagaaatgtgctagttaatatgcaaagtttaaagtaagagtccactaaagaattgtatcaaattttggtgttaacagagtccaattgaagtaaaacaaaaggcagttgtttcatttaaatacctgcaatctcacttttctgacctggtgaacccaatattgttgaaaaatacctatgttatgttccatgcaaaccataagtcatagtaagtgataaaacatgaaccaacaaaataactaaatagagtagcaaacagaaaacagcaacagaaacatgccacatctgatctcaaagagaacctgttagaatcagaatgataacattggagctgcatagcaatggggggatcatgtctggtacaaggtaaaatatccatggggctgacactgccacagcagcataacctgcctagagagagaaataaaatacagctattacaaaatggacaaaggaagcaaaacaaggacttgttgggtaatgacagtaccataaggcaatggcgtttagcgatagaaagagatacatatgttttagctgttgtagataatttatcaaatgaactcatacatttgaaataattttcaggcataatcacaaataaaaacaatgggtaattaagaaatttgcactaaccaacaagatacagtacaaggtgccaccaacaatgcttctaggctctcgatgaccagagagaggagcttcatgtagcaagtcaataaacctacatgaaagaagaattatacatcctgaaggcatcgagacaaatcaacattagaacaatgtcatagaagaatcatgtgaatgctaagtcagctcaactaagtgaccctgtattaatgccttaatggacaccatgtcacccttgcttatactcctcattttatgaattaaattttctactagaagatggattaaaacctggcctctacatccggtttggatgtacacggccaattttatgaattaataccaactggagggataccacaagcaaacatcacctgtgctcttctcttcccttctctcaaagtctcaattccctgcatacgcccaaaatttagtactacatcgcaatgccagagcccaagtgaaccaccaaattttcgactacactgaacgcatcacgacactaacaagagaaggaccctgaatttcgctgcaatcgccacggccttcagatcaagtgacaccagaagcgtgactgaaacgtctactaggaatacacggacctagggatttgggcaacacagactcacagcgcatcctcctcggtggcgggagccgcggcggacgacgcggcgccgccacgctcgtgcgccatcagagccgcgcccgcagccggccggtgcagaggggacctcccgcgggtgacgcctccggagtccgtgccctccaacttctcccggtctccggatccaaatggtagtagaagcttaaggcttaagcgtgcaaagtctcgcgagggataggggattgggcggttgggggcagagaagaagcggcggtgcggatcctgcgtggaggttggtgacaacgggggaagcgagcgcgcggctcggggaggatcgccggggagagcgggcgacggcgggtgatggatctccggcgaccggccacgagagggggaatggcctagacttggagatctaaagatccaacggccataattctcgcaccctgcgttatcccctccgattgacttttaccaaacaaaactcgttttttatagaggaatagaatatcccagcctttccaatttattacaaagttacactcaaaaaagagtgtagttcaataaatcattgagaacaagcatttaaaataaaaaataactcatctaagataagaagaacacattattgaaatctatttgtgaatctccaaccataattgataaaaagttacataattattgtctcaagcctatcgtatacagccttcataaactcgtcatcttcattataactttgtagctaagcccaatacaggagccgatacgttctgtagagaaacaaaactctcgtttgggtcgctaggagtagtatttggtaacgtgattcggaatttcggaccgtctcgttcgtttggttcctgatttttgtataaaaatgccccttcgtttgctagcgctctgacattacgtcaagtaaggagatgcgagttcgtgtgcaaaactgtttccatctttaatccgtgtgagttctgcaatacaaatatacaattacagctccaggaagccaagcaatggtcaaaaatcaaggtacaacttattgtacgcaacaaatgaagttagaaactaagtttccgaaaccctcttcaagtttccccttcctctagcatcatcggtcagaggggaacaaaattgtagaacaaaaacaattaattccacctataatcttcaaatgaagctgatagtggtccttgtcactctcgagcagcctcagctgacagccgcggcagcaggaactggtggcagatcaatgacaccgtggcaccgggcacaaagagtaggatggtcaaggaaagatccaacgtctcgggtataattccagcacctctcacatttttcgccatcggcgcgagtcacaccaatccagatgttgccggtgcgctcactgctaaaagttccagtgtaggatacaccagatgtagtttcggagcttacggaaggaaggatctccacctgcagaaacaaagaaagatggtgtaaaaaaaaaacttgaatgcagaagggcagcctctagttttgaatttacctcagatgtgataaacaggcggtgcagagcatcagcgtcattggttgccgaaaccagctcctttagtttggacactgtgttagcattttccgcgtggagataaacttttgcctctaagctagagcctatcagctttcctgttcgagcactctccaaaattttgttcacctctgatctcaactgttgccaagtaatggaattttttaatcatgaaattaatcttaatacgaaatcataaatgcaagttcgctcatcaccatgaaatcaagaatagccgcaatgtcctataaactataggatcaggtaatttagcagaaatgatgctatttcagatcataagtagtagttactcgtgtatacaagaaatcttgtctgagttgcacgtctccaagttgaaggcagagttttattttttaacgtaagtttgatattcgacctataggaaaaaaactgcaaagctatataacctatgaggttgtcataagtgaacgcttcaaagttatgcagaaacagtgcatacctcgaggataacactcagaaaatcaacatcatcctttggaaccgagagccattcttcattcttaactggccattttagattaaaaacaaactcagcaacagatccatcatccagtgtgtgttgaaacggtaggttctgccatacatcctcagctagatgtggcataatgggggcaatggctctaacaagatagagcagatgcgcactgaggactgtctgacagcttttccttgtaaagctaactcggccactgataagaagataaaaacaaagttgtgaagctggcaagctaaattaataaatgacattgactgagctttcagtgtaacgaaacgtaatcagatggccaatgaacaagatatcaaagccatacccaacatagagtcgatcctttgcaacatccaaatagaaattggagagatcaacaatagcaaatctttggaggatctgaaatagaaacacaagtcaataatctcttgttacaaaagtgtgaagaggacaaacaaatgatgcagcaggcatgccgttatctagagatgatgataatgcagctctttgccaatcatggatagagatttagcaataggatttgcttttaataatgtatgcatatcataccattctgagcatataaatggcatgatataatcattcaatgtgcatgtgatttgagaatccaataaacatatcattcaagatccagaatggagaacagaaaaggacagtaattagaaaatgaacattccactttcaagctaaaagttttcacttttgaccatcaaactcttattcactaaatcataatcatgaagcgcacttcccatttctcagaaagatgaccattgaccaacatacaccaactacgatcacacaatctcaaaaagtatagaagagatcacacacattgtaaaatgaaagtaatgaagcacaacaaactcttaacccacctggtatattttatagaattggtagttctcgtagctatccttcatggaagtcacaacattttccagttggaaaagtgcatacttgtcaattttcggtagatcactgtagcgcacagaattttctggctattgacaggaaagagagaaaaggatgataagaataaagagcaataaatgatcattgaaacgaatgtgcaaacaaaacataagaagggaaaacagatagataattaagagattaaaattatgtgcagcaaaagtattcaactaggctgtataaaatattaaattcactgcaatatgttatctaaacagaaatagcttcagtgctttgcatcgataaaggaaagaataaagccaatagaaagttaagcaaaatgtaaaactagtaaaagatggcattttgatatgggtttgaaatattgaaaacatataaaatggcctctgctgcctggtactgaatcttccttatccaaaacctaaataaattttagttgttgaactgaacatactttccaatcatggagattcgacaataggaatcgcattgtgcctcgtagctttcggtacatgtcagacatttggcgcaaaatttgtggaccaaccaacacatctccagtgtaatcaacactagaaacccatagccgaagaacgtctgctccatagccaggttcttgctacaaaaggttgatgatatttcattaggcaaaactagaagtccagaaagaacggaagcttttctaggaacgtacctttgaatttttaccaccaacaattactttctcaggatcaaccacattaccaagagatttgctcatcttgaaacccttttcgtccagtacaaaaccatgggttataacactagaatatggagcctttcctgttttttaatggaaaaattataaatagaaaacctattgtgtccaccagcagaatataatgttccaaatatatcaagagaaaacacacatgtggtttcagattatgcaactatatcaagcaatattgttctattgcctttgcctacagaaaaattttcaccatttgcacaactagtggttgaaatgtcagacactaaaccgaatatggctcaaaaaacatcttatatatctagaataaataacatcatggatgaaccatgatttgggcaattaatgttgcaaaacaacttgctttttcaaaaaagggattttcattcgagtttctagcccacaattacctgtagtagcaatgctggttaacaatgagctctgaaaccatccacggtgttggtctgaaccttcaaggtatatatccgctggaaaattaaggccatctctttgtgccaaaacagcagcccatgaggagcctaaattaggaaaatatgcagaagtaaaaagtcaaggacacaagaaaagatggcaaaataattaagaaaacactatagcaaagctctatcttttcctagaacattgtgacactatgcaaagctctatcttcgcccagaaaatcatgacaatatgcacgccttgagcccttaatagagtcaataaataaaagttgaggtctgtaaacaaaaactatatggcaaactatacaatgcatgacgactcaataacaagtaattacctccagtctttttcatttgatgttttagagtttaatcttatccctactaaaagtgtctattgctacaccttaaaaatagttaatttcctaagcggcgccacactgtgacatacgtatggccaaaatcaaagcaaacggtacactaccacagtataaaaaagagagaattatagcacatggcttgggcagtttggttcaatttgaaggttaaagcagttaaaactacaaacatctgaaaactgccaaggttcaaagagggagagcagagcaagacaagatggaattctcctaagaacattgattttgggcattgtgaccagcatcaaacattgagctttgttaacaaaaccattaatagaggaagaatgaaaacataatcctaccagagtcaaaccaaacgtccattgtatcagttcccttgcgatactcagatgctttatcacgatatttttcaggaagaagttcctcaattgtcatataccaccaggcatcactccctttctttgacactatacctgagtaacaagcaaactatatttattaacatatgttttgggattctaaaatccaagcagaggaaaataacccagaaattctattatgcacacacaaaataaagagataactgggccaatgaaattaaattcctgggaagcattgtcaagcataaggcttatcctatgctaattcagaaaagtgcaaacataaatggttaacagcttcatgacaaatggtatcacgacgtttggaccaggtggcgcaggagttttttacccaggagcacgggtggcagtctagtctacggattgataaccactaattttatgtttccttcacactcctgtgcttgggatggggttttttatggttcttttttggctgtgtgcattcaatgcagaggccgggggtgggctcagttggattgtaccatcttggtgtaattgactgagtcgtaataaagcttccattatctaaaaggatcacttattggatacaataacttcaggctttttcctagaacagaaattttctaaaacctcattgtggaaatacaaatcagagaacacacttagatgcgacaactttaaaagatggcatctcattctaattcactttttattctttttattagaaacaagaattttatattgcttaaatagctcggatacaaccatgctgcaaacccataatgtgacaagaactagatactaccgacgttagaactacatgcttgtttggcagaaggtgagccacagtaatgttcaagtactcgatggtttcaaccagtaaaaatcacaagcgtagacatacccttgatgtgttcaatagtttcttcagttataagaggttcattcgagtctacatgatagaagaccggaataggaaccccccaagttctctgccgcgaaatacaccagtcagaacggcttgaagtcatggccacaatcctattttcagcctgggaatattaacacaaactcagttattatcaagttacataagatgatgtaccgaaactagcagacagtacaattaggtcattccatatcagcatgaaactataacttacaacttacaagggtctaaaaggatatctatcaatattattacatgaaccagacatgcaaatatgcaattgcttgaccataatatgtgaaatcaagcaaacgtttccaggatccaaagcaacaaaaaaaaaagcaagattagcatagagaatttcatgtaccagtgcagaagagaaatagcactgaacaaaaatgctaaacactatcagatagcagtttgtgttctactgaactttgtcgccactaaagagaacaaaagttcaaactgggaagttcagtgaaacagtaagagtaaaggaaaataaagtatagcagttacaaacctgagaaggaatccaagatactcgcctaattgcatccattgcagcattacggaaaccatccaccgaggcaaaccattgttcagttgctcggaatattgttggttctttagaccgccagtcataggggtacttgtgttctgtgaaccaagagatacaattggaagacaaacttaataaggtttttcgtattcacaagtgaaaccagattgtggaggttattgtcaatctactcactgtaaggctcctctaaaatgagagaacactgttcatccagataattcacaaccgcggcattaccagctcccagaacagataaaccactgaattgtccagcttcagcagtgaagtttccttcatcatccacaggagacacaataggaagcccatatttcaaacctgttatgtagtcttcctgaccatggccaggggcagtatgaacaaggccagtgccagattcagttgttatgtaatctcctccaagaacaacagaacattcattgccattcacaggatgaatatacctgaaaacaccaaatataatgtaaataaacacaaaacaataaataggtcaagcacaatcataatgaagtgagaagtgctaaacaaaatacctgcagtgctccaaggctgacccaggaaatgatttctggattataagctttgtaccccacttggactctagagctgagacaagatcagcagccacgatgataaatggtttctgactcccagggctcaaaatactcccaagctttcgttgatttccaccagatgttgattcactttctagtacagattgcagctcaactactacataagtgagctcagggttcacagcaacagctggttaaagaagaaagggcttcttagacaagttaatatgtagagaataccaaagagttgaagcgaatccatacagtatgcgcagcagacacataagaatagacagggacataatgctatctactacaattccagaatagctgagacaataagacactgtttctgctggtgaaacaaaaacatgaaatgctgtgtagcataccagtatcacctattcgatcttacccatacttgaaatgaagcatcttcttgctatggagggataaatcggcaaagagctttcttttttttattggaagcaagatgtgtgccatgatttacaatcaaactatgttatatcactgtaacgtagatattacttagtatttcttaatcaagttctagccttctaggaattacaggttctaggaactacaaaacatgtgaagttttctgtttcttaatatgctattttccatgtacagacgcatatagcttcaaaattagccacatattttgaaattaattacgttggctctgatgaaatccaattataagagtgacactcactgaatacattaaagcaatcaaggcatcacctcaccagcattagcaggaatcgtccatggagtagtggtccatatggctaggcataaattagggagaaattcctccagcaacccaggcttagacagattggtgatcttgaatgcagcatacatgcttttggaaatatgattttctgaatactggaagaacagaaggaatgcatgtgatgatatgaggaatcaaattcaaaagaaatctaaagaacataaatgaaaagggagaaaaaaaataaaagatcaccaatcatgaattaagtgaaagactacatgtacgaagtaatgtgctttatgtaataagacacataaagcgctcttatggttggttagtaagagaagtgttcttaaacatgaaaggacttcatgaaaaaagctcggtagtttttctgcagcagtgtaggcctaatattaacaggaagaaataagtgacacatctagtggcttttcactgagaagacatactgaagcacaagaaaattattgaaattaaacaggaaacaaatcggaattgtcaattttttattcgaatatttaatagtcacttaaaaattaatgcacaacaaagcctttgacagcaaattaatagcatcaagtagaaagttcaagcatacctccaactcagcttctgctaaagctgtacgtgatgacggactccaatgaacaggttttcgcccgcggtagatatatcctttcataaccatttggccgaaaacttctagctggcatatcaaaatggagaacaagagttgttacggttagccttgattaaaaacatatgataaggatgaaaaagaaaacatcagtatttattctcgcagcataaaatttgcatacacgttatatattttatatcaacgatggtaaatggactaaaaggaactgaaagtaaacagctctattttttttattagagctagcagctataatgtgaccaagatgatatcaatgatctaactaaggtaattccaaacctccaagctttcattcatgtgaaatggataaataagttttgatgcaatggcaaaattactataaacaataggatcagacctgagcagcttcatactctggtgacagagttagataagggttgtcccaatctgcccatacaccaaaccgctgcaggcacaatgtcattggttaatacaattatagaaatatgaaactaaaggctaacatgagacagaattccagatattagatgactgcaagtcagcaatcataccaggaaataccacaaaacatagataagggcaacttgctattagatcatgtcaccactaaagtactttaaaataaagaaatggttaccttgaaagaattcatttgtgtagtaaccgtcgctttagcaaattttgcagccttctgccttaattttataggtgtcagagcattcaatgtttccttgtccagtgactttagaactgcagcaaatagtcaatggttacatttggaaggatattcaataattacttggctggtctaacacatgcaagcattgtgttaaaaccaacccctacctaacttcttgtaaacatagggtgtttccattggatataaagatgaacttgccttttaattcgattggaaggccatggcaatcccatccaggaataaaagaaactttgtgattctgaagcagctgcacacagaagaaaagcaaattttggtgtcagttgatttatgttcccaattttggtttggaccaacataaaaagcatagtcatccagccaaaaaaagttaaagacatttcagcgaagagagttatcaggaaaaaactactagaattagcaaaaagttcattaatcatccaaatctcgtacacaatcaactacactaaagagctctacatgttaagataaagaaatgacagaaattgcactgcattggaaaagacaataaaatctatgcaccaatcatccgtacagtaacattgatctcagaacagagaatatcctatggattgaactgaataagacaacatactatgactgcatcagtaattgccctgaaaaatacatcaatggtttttaaagaaaaatactcagattagattgaagagtaaacgataccttgtaacggtttataatatctttgaggattttattcagtgcatggcccatatgaagatcaccattagcataaggaggaccatcatggag

SEQ ID NO: 54857 - DNA, 726 bp, Oryza sativa
gacgccgaagccgacgacgtaggagcgcccgcgcgggttggcgccgaggaggtagtcgatctgctgcttggcgaactggaggaggcgggcgggctgcacggcctgggcgccgcacatcaccggctggttgatccggcggaggatgtcgctgtaggcgacgaagaggaaggccgtgctggtgacgtactgggagttggcgccgtcgcggaggtggatcatgccgcccggggtgatggacacctggtggaacggggtgtccgggagcacggcgcacacgaagttgtcggcctgggacttgaagctctggaggccgccgctggatgtcatgttgagctccgcgaggagcacctgcgcgcccgggaacttgaggtcccagctgaactcggccacgctcgacgagatcgcctcgtgcccgatgaagtccgcgtacacctgcctcttcgtcgccaggtacagccacgtcgccgcccacagcaactcatcctgatcgatgcagtcacaatcacaatatatataacgtgtcaaattttttacgttgataaattttgcatgcatgcatatgcagagacgtacgttgtagccggagtaggagcagtagaaggggcactcgccgtcgtaggttccctggtgcgtcttggcgaactggaacagctgtgaatttccatttgtcatcaggtagtagctaattagatgcaaattaactatataagagaaattaacagatga

SEQ ID NO: 54858 - DNA, 21366 bp, Oryza sativa
  unsure (1)..(21366): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgagcatgttcctcactctcgaaacataactgtctttcaatatagattaacagtgaagattagcaaagctcataagtaaacaccatattacagcaacagagaacagacaacttgcctgcaaatgctgcatacaacaaactatatctgcttggatgcccttttcttgcatttgagcttcaaagtcatcctgttgtataaaccactaaaagtgtcagctataaactactcatgctagaatgttagtgtatttagttgcaagtatgaaaggagggatggaggttgtacagcagaaggatctaactcgatgaactcagacgtgaaaagtttctttctgctctcccacagctcacgagcatcattgacacctgatgcagaggcatctattgtagaaagtagtatgttcgtcaaattaacaagacagactagacaatgtaaccatggagaggcttaggctagtgtgaattatcctaccaatccctatgtagtgaccaatttgtgcatcgccccacttgtctgtatcaaccccaccatcacaatacaggtcacagacctattgtatttcacaatcaacaaagagaagcatcagttttctgattctaagattcacgctgatctggaacatgctgatctggaacaaaatcgaagatcaggaaagaggggagcagataacagaccgtggcataagggaatgcgaaaatcttgataagggcagtcttagcaaattcatatagccgatgatgcggtgtcactgccatgcactaaccctgcaattacagatagtaggacatgagccaatgatgaaaaaatatttctacagatactgcaatggtggtgttgagcacatactaaaaaataaatcgcaaaatcaaacaaatctggctttactaactcagataataatagcacatgcaaccgctaacactacgcttccctagttccttagaacttagaaagtacaccaaaggtttagggtttaggggggtgaattaggtcaaagtaattcctgctctagtgacataattagcaaaaagcaatcgagttctaagagcttcccgatctagaaactgcaatagcagcagctcatcctcgaaaaaaaaatcaacccattcgacagtgcccaatctatctaccgcgcgcggcgcagcaggcaatgcggggacaccaacctggtgacgcggcgaccggatgaggaggaagaagaagaagcaaccggcacccgcgtgctggacgagaacccagcgacgagccgcggaagggggcgaccgcggcggcgagcgccaaaggcgggcggcgcggagtaggcggggaagcaggggggagtcgggctgcggctgatcgaagcggagggtgggtgcggaggccgagcacgcaacgaagggggaggaggagaaggcacgcgcggatcgggcggcgaggcgaggcggagagcggaggccggaggccggagggaggagaacagcgttgctcacaggcacagcgaaagagagtcaagagtcagagagagagagagagagagagagagagagagggctgtttggggagctggagccttcacccttcagctctcacaagctctgtagatcttcacaagaaactgtaattgtaaaactaaaaaataaactaaaagtcaaaatattttcaccaattagcttatcagcctcagatagcggatctaaatccactcaagaacggtaacatcggatttcgtgaaatccattgataaaccgataaaacttgatccaaaaaatgaagaggtttttgtttttaaccaaatccgaaaagtccacatttttggatttcattgaattataaccctgggcaaacgtagcatgcggaaataggaatacctctgtgtgtggccatacggcttgtgagtagtagggttcagaatgtcgataaatttcgatcggatttctcatcgtctcgagtgtggatttcgtttaggatttgtcaaaattcattgacagacccatcatttggttgataataagcaaaagcgtaacgttacatttgcaaataaaaaataatttgtgaataaaacttttatatacgtgttcttaacgatttaaaagcaaaggccgaaaaacaaactatgatgaaaaagaaatcttaaaatcaaatatttaaggttgaaaatttaaattttagctgataagcataagcgaaaagatgagaggatgaagcgtggcaaaattagtcgacgtctcgttgggctcaaatttcactggtcaatcgagatcgcaaacccactcgttctcgttgggaccagctttcactttgtaaggcccagctcactgcagactgcactcggtttaactaacttctgtaaattgtccctttcttttttaggtctgacatctaccgggcagccacaatgtagcaataggagagggtcttaaatctctaaagtggtcattatacattgtgaaagtaatccatatagtagtctttaagataagctacccataatgtcataagaataaaataacaatactttctcttctctctctcctcttctctctcacatgccatataattgagtgaaactagtaggacccaggctaatgccttctcttgccatatatattgtagcaaacaccataactaataccgggtcccaccttattgcttaagtagacattatacattgagcatgctctaatacgcacattttgacagtaaaaatgatgagagattctaatgggaaacttccgtcccctccagattcctgacatgaccacaaacctcagtaagaaacttcttagctagataatttcagtttagtctcaatccctatatataatacctccatttcaacatcaaaaaataatcaccttaaccagagaaaaagggaaaatcatgagtttacctccaccccaaattcatgcgcaacacatgtggcaattccaataagaacataaacattggttgagaggactaccgtaagtctccacgttaattaactaaaaacaagttatacctgatatgtacatacgacatgtacaacgagaaacaatacaacatacatgatgtttcgtgccgttcttctctggcccttggagtagctaattagtatacgtgcattgtgcatacaggtatagatagatatattttacattgtcaggttagggctcaccttcttttttccccctaacctccttttcttctcccagattgtttacctagaagacgatgttagcacaggttaacatggagcagaccaggctatggctgcgtgtgatggaggccttcatccaggaggaaatgttcaagggcgtccggcaaccttgcctcgcgagagcccttggtgtggtgtcctgttccaatgcagatcatgatctgtgccttctccagctgaccttgtagcacccatcaggagggcaagctcagccttcacaacctggatggcttcgctcacctgaagcccatgcaagtcgatcagacggtcctggccttgttcagatgaaaatgggttcctgcaacgaagcaggggaagctaaaaaaaactagatgcgcctttagagtgcgaaaagatacttgtatgcaagaggagaaaagatgaatacaatgtgcagtccaggtcctggtattttgttagtggtcagtaagttggcaggttgaaaaatacttttatttatgaaaggttaaggtcatgtcaattggttatcagggagttaatccacctttgctgataaatagcttccctagctgtctcatgagctgccttcatttgcaggttgtacaactgtcccttcatgctcagttcctttgctaacgctttgtttcccatcatataagcttgcgtggcctgccagaaaatattccaatcatccaaaataaacattccactagatcaaaggacagtgatcaataaatggaggtagtcaacacaagaaaactcaaagcaagtaaacaaaatgatgccatgaatacattgtgcaagatgaacatgcaatttaagagtgcttacttgttcaaaacatgtattgcgtatgcgggcaaaatcaccagcttccccccttgattctgagcacatgcttgctggacagtagcataaatgcaggctatcaatccataactggagcatggtcggaaatcaaaatgtctggatgagaatattacccatggcatcaccagtctttagactgactggggctgagtgaacattactactggccttaaggaacttgtttcctaaggaagaccttgtatcacagccatactgtttccgcgcaacaatactcaaaagaccattagcatacttgggactttcatttttaaacttcatgtggccagcatcctgcaatgcaagtctttgaatagctgaaacaaaatctccagtcctagacattgttgaagagttgtgtctgtttgtaattccatgggcacctacattgccttcaaacaaacaattaaggtcttctgttccaggtagtacagggaagtttcctgtgccaatgtttggtgtatttggggccagattcagattctgacaggagctagcatcaacttgcatctgcaatcaaaagaaaaggtcggatttgcgtgcaagtactgcattttttttaagagaatgggaaaatcccagcctacatatatatgccacaaaatctccagaacacaacatgcactaaaaggttttaaaaaatgtaagacaaaaaatatgtacagttaaatatagatatgctctagctttaagggtcaactttgtactgttacacagaaaatgtaatgtcccatctataagtaccaagcagaagttttaaaatttttacttgaaaaaagaataactttaaaacaaaacgatctgcctacaggtcaaaagaggctaaaacaataagatagcaacacaaagctctaatactaatgcatagcagtatagcacgaattattcatacatacagtttgtgctttgtactgacagcctaatgcagcagctaatagatgagcaaacggaagttgagtgaacattatactagttttggtcattattctcacttagtgaagatgtccaagttgttagcaccagtcaaagcaaagtaatagaacactacattataatacccaactctgcatcccagcaaagcaattaatacgggacaccacaatgttgcgaatgatgggtgcacaactggctatcaagacaagaatattttacagatttattttccttatattaatatttaattataaggactagattaggagatcacctctaactgagtgagaatttcaacagtaaggtcgaagtcgcaaccattagcacagtacaactcagcaaggctctccacagaaaaaccaggaaactgggatgctaaatactcaagtgggtcatgatcataaaggaggtcaagcttcccattagtataacataggttatctgcatgattttgcttcccactgtttgaacctgaattctcatcataatacaaatcattgtgccccaggtcaagattcttgcctgcttgagacaataacccatgatgctctctcgacaagttgctggctgctgtgccaaagaaagggggtgcattcaatgacaatccagaaaatgacaattctccatgttgctgttcaactttttccatatcactgaagtctggaataatatcatcaggaagctgtctatgccaaaactggtgtgtttcatcatccgagttattagattttgatgattccgacctaccaaggttcgttttaccagagagccccctaaaatctggtttacttacatccgcaactgttctacttccaaaaggcgacctaaaagttgaagggacaaattctgctgcatttggatttagggtggtaactgtacttggtaattttgaccctgcatctccgccttttgtagaaaatccatgtgaactcatcttcttgcagattctgtgcaatgtcaccagtacaaggtaatatatccagatgataatttatccaagccatggaaaacagttccagcagtaagtaaatgctggaacatagtggcaattggcaacagccatttcctattctaggaatactaaaatttaactgaagaaaaaacattccaacagcgaaccaagaatatgcactacacagtgatatagactatttggcagcatgggaagaataaaaaggaaagaagacaaaaataggtcatcacaactagataacaagaatacaggtagacaatgtccagaaattacaaagctacaagcaatccactttcgctaatataactaaccttaaacggtcagagattttcccattctaaaaatgctactactaaaaaaagttgcaaccataaatgtagcaagcagcctgcttccccattctcacagctcataaaccaaacaacgtctctcccaaaagccacgaatttagttagcgttaccaccacggtagcaagtgaaacaaccaaagcatccactctcacaccacccctagaaaacttcgcccaagaatgtactccaattcagtctagtagtattgtttttaacagaagcatataattcttcgcaaattcgcaagtggatggaaaacataaaggaattttgtcaaggtaggtgtgcacaaaggcaaagagtgcacagttattcatgcccacagctctaaagcggaaacagaaaggaggccttccgcacgggaacgacgcacaaccacccacccaccgcacccagcccagccgaacggggcaccgccatggattccaagccagatctaggaggaacacgaggaggagcccctgagcccgcgtggcatgatccaaatgggagcgaaacgaaaccccgccgcacctttccggcggccgatcagctggagcgcagccggaggcggccggcccatatataagatggcgagccctcgacggagagcggcccctccggcggcggcggcgggttgattgctcgaccgcgtagaggagtagagaggagagggagtggagatgaagatggtggggaggattccttggaaggaatggaagagagcagtatcgggggaaggagggcgtggagtggagtgaagtcgtcagcgtctgggcgaggcgaggtggttgcggtggcggactcgcgggagcgccctgtgtacctctacctgctcgccggggtggcgcgtcaggattggtttccggtcgcagtgctgatctggctgacacgcgccctctagtaatagggctgtgtttagttcctgaaaaagttataagtttgggaaaagttgaaagtttacgtgtgtataaaagttttggatgtgatgatgtgatgtgatggaaagttgaaagttagaggtagttgggggtgaactaaacacggcctaggggtgagtttgagaagagaggaaaatacgcaaaacgaggtgagtcatcagcgcatgattaattgactataaattatttataaatttttaaagcaaattttatatagaatttttttttgcaaaacacacgttgtttaatagttcgggaaacatgtgcgcggaaaacgaaacaaactttctcacgatgttatcctgtccaacgcctgattttagggggctgttcattttaaagctaaaatttagcaaatgtaaccatctaaatattgtcaaaagttgactcttaagatttggtaattttagaatcttcttctcataaaaacttataaaggtaatagcttgcacatcatagccttatcaaattcttcctctatccgaaaatgttgttatctagtattttatccgtttcatattacaagtcgtttgattttttcttcattaaagaaaaaaattttctttaggtttgatcacatttatagaaaaatatactaatattttcaatacaaaacaaacatattatcaacatatatttaatattaaatttaataaaactaatttggtgttataaatgttgctaattttttctataaacttagtagtcatacgtaaagaactttgactaagaaaaaaaatcaaacgacttataatatgaaatagagagtactagatgaaacacatgttaatactatgacttctgtctcgattcgtagtattagaatgtgtcacatccagtactggatagtcatattttgtgacgtaaacagtattggacaatgccaaaatttggcactactgaaatttagtaaagtcaatttagacataaaagtgtacaaccacttaggctttgtttgaaattgccgtaacttcttaaatctagtaagtttcacaaaaccttaagtattgaagaatccgtaatataaaacctcaattattatgatttgtttctaaaaaaaccctatcaacaataacaacaacaaaatcaatatttgggctcgttctgctgcattccccatggctggctgcgcgttgtagcctgtacagtgtcttgtgtcaacaacagcgaatgcataggctgtaccctgcagacgaagaaggccattgttggagctgacagtatttcattccttccacagaatcaccaaaattgatattccttctcatgagtaagaagggttgcccgattgagcagatgaacttactgccatgtacgaatcaacacgtgacacaaaacggggagcccagatacaaacaattatcttatcttgcataacaaggatacatgaaggcatgaatcaagaaaccaccgaatatccaaggttttgaggtatcctttctttgttagtcgatagacattgggccaacaatgtgttcttcgattctttttgccgggctgtgttcttcgattccccaagtaacattcatcttagcagccagagcccgcaaggaatttatcgtagggactcaggaccggcagcttacagaaatcagagtgacattgctcgtcgttcgttgatacaaacccagccgttggagaaatttgctgaggtgacccaagcttgtccatgggtgattcaccatcctgcaaagtcccaagaatctgtgagtgtaaactggagaagaaagactttcacctcaaaaaaagaagaaagaccaaagaaaagtcaaatatgttatgaccttgagagaatcgtgtgcaattcaggttcccacaataacaactaacaagctaaaaaggtatgattgtgttatatattgaaagcctagaagcatatttttccttagtttacctttattacaattacctattagatctgctgaaatatcaagcatcgcaaaagtaaaacttatttctttattacatactcctacaacggaagagtgcttggctgcttgcttcacttcatgagatttcaaaatgcaccgatttaccattcaacatagtctaactgccccattccacaaatagtgttctgtaccattttcatctttttaactgtagacatctcaagttgtctgtgatctttctgaaggtcactaacctgtttttggtggacgctcatgcagacagatagcttttgctgctttccgatcaaaagagcttcacatcggtttgctacctccttaaaaggcaaatcaaggtttgttgacactgatagtcttccaacgtgccgagatgtttccacaacctgcggaagttataacctctttttagcatatatcagtacatcttgaaaatgttcagttttaccatcgagtaagattccatattcatagttattgattgaatgattatattaataagggtacctccatatttcattaatcatattttaagcagagtaaagctagcaagcgggaaataagtacatactgattcaagaagctgattcacatcaataaggccattgtccaaaggttgttgcaattgaggttctgctaagctgttagctggttcaactagggtatcatcctcaaaaataaagccgacaggaataacctgcataataattaccacagtaatataagaaaacaagaataaaaggatggcatgtgtttgtaaacaaggttgatcacctccaacgatttttggtgcaacttagcattatatgcaggagattgtgaagtagattcattcgagtgagaacccaggggacaggcatcatctgctgagaactcctcaagcaattgctttcttatagtagacaattcagctgcggtaccaccaatagtgcgaaattagcaatcacagcaataaaaggtatcaagacaaatgttcatcagactcttcttgtgatttacctccgataaatctttcaaactatcgagaataagagaaactgatgcctgttttgactgatcattgatgttgatgtttgagagagatttcaaagcaagatcatcgtcgtcttttgaccgtaaactgtcaagcaagactcaacaacctgcaatttgcagtcttcaactagacgaagaaatggatcaacctggcaaacacattgcttatcagatagtaacacaacatatgacatcttaaaataaaatggataaccacacgcatgtgaaaaaatgataaaatattcacggcatcaatgttttgagaataggcaagagggttgtgcatctttgtataaagatattctaagcatcaaaggctccacttaaaactcagttcaatatttaacattacattctagagattaatttgcaactgacaaaagtagatttttttatggcatcacagtggttagaattgatctggtattgactgcaaaacatcttttagtacacaagaacttaggtgcaaatgtgccatgggtaactgtgtctcattcttttaactgagggagagtatgctaaccattcactcaacaatttcaattattctccaaaagaatttgtattaagaaattacatattgttgtttgcgaatgagtagacatttatctgtatggtttgattatgtatttatgttagtcaaatttatgtaaatttgtttgcgaagacataatctctccaagggctatctattgatggtaaaaatgctcactagatcaccatgcacatcataatgaactatgcaagcataatttcacttactatgcttgtagtcaacaaatctttcactagaggaatgagagatggaatgccaaaagctttcgagaaaaacacaagcatagaagttgccatagtaaagagtgaacgcctgcgtgatggtggcaaaaaacctgaaaaacatgttgatcgaatgcattatgaatatacaacttctgaaggaattacataacagcacattacttctattgcttgtagcatggcatggagaatctatgataagagtcatagagtaagccgaacaatcactacagagaacaaatgaacaaaaaagtaattgttgctttgtgaagtaagatccaatactgtgatgggaataaaatactggtgtgtacctgcttgtaatgaaatgctttgcaatgaaaaagcaagctgaaagctgccaacaagaacttcaagacatgatttctgcaatagggtggcaattaagccaagtaacagagagatgcaataaaaataaatcaaataaaaattgatcagcaaaatttaatatggaaagttacattcagattaaatattcacatcagaaaaaaatatggatgattattacattatattatgtattatattaacatttaattgtgcaagtgctgaaacatggtcattcttgatctataatctggcaaccattcaaaagcttatgaaataagagaaaagatgttattaccatgaattactatttgattgacaagtggcaatgtattataacccaacattccatggagggtactatatcatgtgatcgtttatgtctttatgttgtcatttcctgtgctaagttgattgctcattaagtcgagctttgcaaatggtgtcaatacgtgaatactacataatccctaatatcaaggtctatctatacatagaggaagagggcaatagagacgataatgcaaaatacagatatgaagtagagggaatgggccaatgggttctctcaccttgtcttcagaaaacagtagcatcaagcaataagtatgagaaattgcttcataatttcgtggaacattttcaggtgaaagtgcctgagtccacaaggaggaaagcagaaggatagcctgacgaccactcagcatgagggtgactggatcctgcgtgtaaatgaataaacattcttttttccaccagaaagaggcacagttaataaataaccatgttagctacaagaaatcagagtctagcacttactgtttcctgagttgtcccactcaaattacttatttctgatgaagatgttacaaaactatcttttgcactatacatcctttgaatggtctgtgatttgaatagttttggatcattcccgtttatctggtctgaattctcactgatagggattagattagtgccatccaggcgtgaattttcacgaaatgaaaacacatctcttttcaatttcccaaacagagcagcagaagatgagaaaacagatgtagtcctagacaatgtccttttaataccaatcttgcttgtttgtgaagagcctgaaaatgagcatggagagacagaagaaggaacaagaacaacagagaaaatccgatgtgcccctaaatgtgtctcacaatctggatagaccattgccaaaagcaattgatgaaataacgcctcaggaaatgcctacaaggtgtagtatatattgttgaacaatttgtagagtcataaaagaaaggaataaaaatattgtaaatcaacttactttgctctggtataacagatttggcaatgatgcaattatttgagctgtacgatatgttgcagcaatagtggaccgggcaacaggtgtagtacttgaaatgttctccaggacaacagccaacgcatcaaggataggcccagcatcgcctacctgaagagtatatagatcaattgaaggagcacctacatggatggtgggtgcaaaatgatctgtagagtgcagctatatgcatagctaaaaggaaataaagcaatgcacttatgctggtaaaacatattcacaggaaaactgacctttctagacaactgaacaagacattcatcggtagctttcccatatctgtcattcataaccatgccatccccaggacctacatcactgaccaagagctgcatgtttttactcaaatgcctgaccatatcacttattgcagccattagtgcagtagaagattgagctttggagtgctcggcaaggcgtgttgtgacctcaataatgtccagaatcttatctgtctgcttcaatacattcttgtgttcaagatgcttgactaacatggataacaatatatgtgaattctgtcctgtcagccaataatgtatctatcacttatcagcataagcaactattcaagataatagtgctcatgtagattatttaaataccatagaagtataaaacttattacagcaaataagaggaatgcatctgaaaggaaaaaaaatagaagattcaggaagcactgaataccagatttctctatcacaatttgcatatccaaaaggacacacaatgcaagtcctttagaaggcgaccacagattgttgttatcaaaataacgaaatatagcttccagaactcgtcggactgttgttgcttccctggatattctagcaaggttgtgcagacaaatccctgaccaaaaatttggactttctgattcttcactgtgttgggaaaatgatttaaaagagataagacatagagaagcttaatataacatgaaaataaaaaaattccatgactaaacttatttacgttgtcaggcttaattcaccgcggggagctctaatggctttccatgaaggaacccttgtcaaaatggtaataccggaaggttcatgatcttcagctttgagaacttcactcacccactgagtccttctatcctcaatggcagcatcattatcagaatttgcatatgggctctcgtagttttccagaactgcagagacaacctgtgcaatcaaattatgatgtctgagaatagaggtaggttggcagaatggcaataattctggttacatcactgtggaccttaggtcatgtggtctcagtagagttaacgattaattgacataagtagaagcattgtgttacgaggtctgaaggaagataaactaggaggtaaagaaggcatgtgcaagccataaggtattcggtttcttgctcagataatctattttaatttataatatggaacgattaaaggttcataaattgtttttgttactcaaattggtaacaaattaaaagttctttgaaattaaaaggttgtgctgaactaatcgtatattcgtatgattcttttatcgccaccagcttaatggaaaaaaccacacttacgttgtcgagctctgcagagatatgggaatgctcacccataaaccacacctgcaatccataccagtgggtattaggcatgaaaattctgcggtaaaaatagcaagcgacgaatatgtagcagagcagaaaacgaaagaacattctttttggggttttgcaggaatgttgagagggaatatagataaatccatccctaggcagcatggtgcaaggtccaatgtttgttgaggtgataaaatgagagaaaaattacacatcgggcacctatcgttaccaaagttaccaaagtttcattctggagcgcttcaacaatgttttcactctgggattagatgaaattgcatttcgttgcactctggagttctgactgcctcttcctctccatctctctcccaccaaaactctggccggtgtcctcccatcccaggcagcggcggcgcccatacttgggggtagtgggaaaacggaggttgagctcgagcgaggggactgtgttagcggcgggcgaagctctcaagcaatgggcatggaggtggacggtgagctatttggtcgccgaggagatcgatcttgggggcgacccaggctccggcacttgccccctcttgctctcctccacatcagccagccggccgccatctgctcctactcccttccaaatcgagccgccatcccggcattgggtcagatggagcaacggtcccccgtgctcgagctcatctacgcttgtgtcacctcatacttgagctccatctccgtgctcgagctacatcggcgagcaagtggcggttgcctgacagcgagaaggtgcccttgagcacgacttccgcttccataccaagcaccgcctcccctctgaagctctgactccctcccttggtggcgccggcgatgggaacgaaaggggggagattgccggctgtgtattcttaggaaaactctcgtttttcgtcggttttccgacttttcccagctcaaccttctcagtttcccaagccacctctctctctctctctctctctctctctctctatctatatatatatatatatatatatatatatatatatatatatatatatatatatatatatccacatacacgctttttaaacggctaaacgatatgtttttttaaaaaaaattatataaaaattatgttaatacttaactaatcatacaataatatgtatttcgttttacttgccctgaagatatccttaggttgtcgcggttatcatgtgtggtaacattttcagttttttaaaagatagtatacctcgcggtaatcatgtaattttctaaattataagatggcggtaatcacactcccaacggtttgttaaaccgttatgggttaccaaagtgccgcctccatttctttctcacttatcgggtggaccgctggcccaaactaaaacaaagtgaaaacatgaacttcagactcggtccaaattgccactttggtaacgatatatggtccaacatgtaattcggttgaaatggatggtttagaatggaagtactatttaatggaattctgaattcccttaaaaaacgagccagaatgttagtatgatatacgaatgaaagaaacattttgaaaagattcaggatggtatcagcaaatcatccgtttggttggcaacgtaaaaaaagcgccgtgcagagaacaagataaacatgaacctacagcaacacaaggaaggcataacaggagaggtaccatggatgaaagggcttggaggccagctgcatgaacaatggatatcttctccttctcacccatctcttgggccagttgacatagtttagggatttggctctctaaattgaacatgtatgtgctgtcaacctgtaatgagaagatgtaacagaactcaaaattttctcaaaagagagttttatcggaagatacacgtaaatgtcaagaccatttcaccttgtaaattgatgcctacccgaatgttaaaatacctggttgtttacaaagtaaaaaagtgttcgacacgctattgtccgcaagtcatcctgtctgttctgttccaatagggcttctacgatgtttagcaagctattggcgaaaagaggcctgcaaaacagcggtccatccattatagcaattattcacactaatataaccaaaagaaatgcaacaaatacatcttgtaaactccactgattgccagaggaaagtccacccaaatagatgacttcacccaaaaaaaacactaatacatatatatatataattgagaatataattgccacaccagaaattaagtatttaaagcaaacaaaattatcattgataaaattataatttaactagcatggtggcccgcgcagattgcgcggctagcatcatcatattttctctcatatattaacatatatgttttctcattatattattaaaatatattacaatgacaacataattttaaattgagcaaagtacacggccggtccttaaagttagaacgaggtgtcacttaggtccatgatctaggaaaatcgtcattcgggtccgcggtcttgtttaagtgaatcatttaggtccaaagcgcctttgactggattgattggcttacgtggccgtccacggtggcagcatgtttgcattttagcccccctcccatcttggctcccccttgtctctatctcatttctctatctccacatgttgtcagttgctgaccaccacgcgtgcatgcatgagccactagctgcacccgccgaacaccccggagccgtcgcctgcacccgcgttgtgcgtgtccttggagaaaccgagcacggtctgagcttgttgttgctcctgctgtggcggtggcggcatgcggaactcgccgagatggaaccccacggctgcatactccgccggcatccctagcggccccatctgaggcagaggaacgtagcagccaatgctcctcagcaactccatcgccgagaacacgcacccacgctgcccctgccaccaacgccgttcgccaccgccatgttgcctccggggttgcacatgttgctactctccaagctcgggaacgctgtgaactccggcgactgcagggcgcggccgtggtgatgcgggaacgccaggttgaggtcctgcgcgcccttgtgcatcgacttcaggttcttagccgccagccccacggggaccgagctagacaccgtcgcggaggtggaggccgacgcggccgctgatgacaccatgaggacgacgaacgcttgttctcccttaccgttgccgccgtacgcgcctccctcctcatcgtcgttgtcgtcctcgcggccgccgccacatctacaccgccacccaatcgccgttgcaatcgctaaccctagaaatcacacaggaggagccgaggaggatttgggggagaatggttggatcgtatatgggagagccaagatgcggggggctaaaatgcaaatatgctgtcaccgtggacggccacgtaagccagtcaacctggtcaaaggcgctttggacctaaatgattcacttaaacaagatcacggacccaaatgacgattttcctagattatggacctaagtgacacatcgctccaactttaaggaccggccgtgtactttactcttttaaattttgcaataacttttcaaaactactaatgtgtaataactactctagtctcctcttctaatattccttattttttaattctaaatttcagctatttctaaattgtatttctatatggactctgctttttctttttctcttattaatgtgagaatttctaggccatgagagtgaacgtggaggctcctttttattccgaattttagttggttttaaattccaatatgaactctatactctacttctaatattccttattttttaattccaaatttctattttttttcttaattgtatttctatatggactctatactctacttataatatttcttatttttaattccgaattttggttatttcctaattgtatttctatgtggactctatactctacttctaatattccttatttttaattcagaatttctattattccctaattgtatttctatatggactctatactcctcttctaatattccttattttttaattccgaatttcaactatttctaaagtgtatttctatatggactctagtctcctcttctaatattccttattttttaattccgaatttcagctatttctaaattgtatttctatatggactctgttttctttttctccgattaatacgagaatttctaggctatgagagcgaacgtggaagctcctttttctattcctttaattatataatagattgcagtatgatgaaattgttaagagatggatattacggaaatccaacgcattgcctatggaaccttcagcaatatattcaagggagcacatgtaagtatgtaactatgtttataagcaaaaataacttacagttgctcctgacaagaacatatcacctttcggtaaattgccatgacaactttcactgacccaaaatgctcaactctcaattccttgtagaatttttgctctaaataaactgtaatctgtcaaagtgcaagaacaattttcaatgaagacaaaaggatcaaattcatgaataggggaaagaagtaactccaaaatcttaaattttgataatacatcattggtttttctataaaatacgatttttttacagatttaaagtaggatatatcttttttctagaagaaaattaggatataccttgcttcagattgaacataaaccatcagaataaagctagatatgtgaaaaaaggcatgcccaaatgttctgtatgaaaagtacccactggttttaactaagaaagtcagcatgttgcacaattgattgacttttgggagggatatagatatgaacagaaaatgaggcatgccctgcagcttcctctgatgattaataagcactcgataataattcactttctaaaattattagatgaatcatggcagtgaaataatatataaaagagatgagaaagagaatcacacctttggaacacgcaaaggattcctcgaaatatattcgcacaatttgccgatctttcggtcattgggttcttcatcctaaaagaacaagacaacatttatagccttttccaaaaaaagaaagaaaaagaaaacatttataggtgtgttactctcgcttccccagataggtttatatggggatgtattttaacttttaactgtgcacatatactgatatacaacagtagaacttgccgaacatagattttcttctttttgtaattgcgttattagtaccaatctgtactacaacgagagatactaaaataagcaactactgttggagtatgatacagaaggaacctaaggaaccaacaaatcgatcaggatgaaataagcaaacctcaaactacacaatatgatccataatgtgcaaatgtaggatacagaacaaagcctaatttatccatgaacatctacagcgggtttcacctgtgacttagggaagatttctgagagcaacttcttgtatcgcttgaccggatgccgagacctcgtgcgcaatgacgggcaaaggaagcaaagcctctcgcatgcaggcaatacctcccttgacaccacacccatcgtcatcgggatttcttaggctccaccattactcatccacaaagcgaatacgatgcaccatcgctccaaatccaagccgggttctgaacatcgtaagagcattggccaaacatttttcgcatcagttacatctcacatgcatcggagcgaatcacctgaaaattaaccaaatcaaggcaaacctcccacgcggctaccaaggaaacgatcgaatctaccaccacagcacaatcgctcacaccgaatggtaattccgccgaacacggcagaggcatatcccccgcattctcccaattttagcaaaaggcaaaagcatcacacacacgcactaatactctgctaaggaaattcaaaatgccatcaatttgggccacacgcagcagctcatgaatgatgatgaattaatcgatccctctatcccccgcacccaaaaacaaaaacaagaaaaagccgcccccgatcagcggcgacgcgacatgcagaaaagaaaaggaaaaatctaaaatcaccgcgatcgcaaggaatccgaccatacctgcaggatggcgatcggctagctggctcgcgatccggggcgaccgatcggacgaacgggtggaggggaaagggaagggcgctcctcctcttcctctctctcctcagcgcgtcgtcttatcgcgcgcgcctttgttgcttcgcgctcgcggcggtcgcgtgggttttctatatctgggaatgggggcagggcggggcagcgttttccggggaggagccttttataatggccaaaaggcccgaggcccaacggtccggcccatggcacggcattttggtccggcccaagcacggcatggcctgacggaggtcaggcccgtgccggcccggcctgaataccggccgtgtctgggcccctccaccggcacgttgggccggcccagcacgaccaggccagcacggcacgatgggccggcagccaggcccgatataaaaaaaataggggagtaaaaatagacatattatatgccatggacgaaagaatagggatgtaaaatagacttattttatctatacatatgctagcctaaagaggtgggacgaaaagtagacttatttagctatacatatgtcagcccaaaaaaggagggatgga

SEQ ID NO: 54859 - DNA, 12983 bp, Oryza sativa
aaaaaggagggatggaaattagacttattttagctatacatatgtaacaacccaaagagaagggacggaaaatatacttatttaaaaaaggcccgatgggccacccgtgccttcgggccggcacggcccgatagctggtgggccgtgcctgggcgggaggtgcagcccatgggccggcgcggcccggcacgaagtgccgatcgggccgtgccggcccgttggctggtgggccgtgcctgggctgggccatgacgagcaaaccttttggccatctatattttatacccagtgttctcggatgttgtgcccacgtctacggggggagtccctgcccggtgggccaggctttagatgtctggtccatcatacgggggaagaaaattatacccatctagaaagacttttcatctggagtgtcatgtgtccgcacgaatcttgatgtagtcatcttctatatgagctcaagtgcagagtgccaaactttccctttaggtcctgtataattttcttcccatcagaggggtcctcacttccttccgaaaatgcttacctccagacgccggacacgtggtaaaacgttagaagttctcagcacacatcatatttatctatctatgcatgcaacatctctctgttcaatttttatcccacttatattttaggatggagtagaaaataaaaggtagcaacgatggacaggtaaggcctaagggcgcgagttagctagcgtgtcttcctttcgtcgacggagtcggtgaggccgtgagggtgggcagctgccagccgagcggtgcgccgtcaatgggtggtgcagtggggacaagcgaggtggagctactgggcggtgtgggcactccaccactcggctagaccggtgcaccggtcgaagatagagatggatgtgatgccaatgcgctcaggcagccgccgcagcgattggatgggctaggccaccctcgagttgttttgcacccctgcaaatattcggcttggttggaacctagaacgagataaacatcatctcgcttgtaagaagttcaaataggccaacggagtctatatgggtcaggatgccaggctaggtgtgcatatccggagtacgtcccttcgggtgcgtttgtttctcacgtgtggttgagattttcagccgcacgcgaaaaatgggatttaatttgcacagataaaggacagagtagaccgcttgtatccctacatgcttaggtttgcttaaactccaatttcaaacttgtacctagaggtggtaatgggttagaatttatgggatgttcacaaaccaactcatcccttaaatacttttacctcgaaagtttaaaatttcaaaccacgctttttagattaaccctttgaattttatagattaaaaagttaggcccattacacccctacttgtacctaagttagcacggattgattggtccccaattttacctagtacggtgacatcgagtgggaaagtcattgcaaatttcagaatgtgtcgtatcaagtaccttaatgaagtacaaacttcgtttgacgtcgttatttctaaggtatttttttctcgaaggacatgaagaatccgatcaatcgtaccaacggaccacgatgtgataatctagaaactatcaacatcacaatctacaagaactagatcgaaaagctggttttagaacatgcccttgaatcgaacgatgttctggtgcgccacctaaagcactcttataggccattcatacgaattttgcgtaattctggttagaattatagacagttacagtttatagcacaaaggatatagccctgacttctcttatctaaaagaaagtatacatgcataggcaccatagtccatagctaaagctctccaaaacaattgatgtattagcttgtccgtaattaataacttatcagcaacaaagcaacaattcaataacatctagggatttaattcagctagttgctctacaaacctaaataatcattaaggaatggaaaacgctgaacaagtgaacaatatgttcgttaaagtcggcatagcaagcatcatcgaaagcgttacgcaattagatatgtataagagctcaattctgcgttacaaaaatattgaaaccacaatagaagaacagaaatgagtggtggattcctataagaacccaacatgcttgccgttaattccacatttgattggaagtattaattctataggagtatttaattgttttcggaactttatagaatttaatttggtcatatgaccaaaaactcactggtggagaaatgctttttagtcccggttcgtaaccccctgtagtcccggttttccaaccgggactacgaatccgggacaaaagatcgctatatttagtcccggttcaaataaccgggactaaaaatcaatttttagtcccggttggtgttaccaaccgggactaaagatggagcatcaccaaccgggactaaagatattttttcttttttttttctgtttttaatattgaatattgatttcacaccatcccctcccatatccaaatcatcacatattacagaacatctccaaattctcaaacaaatcttctccaaatacatcacaaactcttaaaaaaaattacatcacagggttctaaaaaattcatcacagattcacatctcacataaaaatacatcacagattcacatctcaaaaaaaaaaagaaaaaaaaatccggccggcggccactgccgcctcccctcctcccctccgcgccggccagccggcgctgcgccggacgctgccgagcggccgcccaccgcagccgccgcctccgcgcggcccccggcgccgccgcgccggccgcccgccgccgccgccgcgcaggccgcctccgcgccgtcccccgcgtcaccgcctccgcgccggccgcttgcacttggtgaaggaaaaaaggaaggagaggaggggagttagagataaggaaagagataagaagttagagttaaaaaagagatagagggaggagtttgttgtgtggacgggaaaagaggatcggtactatagattatatagtgtgttttgatttttattcccggttagtaacaccaaccgggactaaaaacctaaagatcatagggccctaacacagcctgacatggaatcaaccgggactaaagtttccaaccgggactaaagatgatttttagtcccggttggtaacaacaaccgggactaaagatcttcctcttattaaccgggactaaaaatcatttttagtcccggtttttaatggaaccgagactattgtggatttgggtcgaccgaccaaagatgatttctctaccagtgactgaactatttgattggaagtattaattctataggagtatttaattgtttttggaactttatagaatttaatttggtcatatatatagttcagtttttggtcatgaccaaattaaatataaaatatgaagtaatatttagatttatttcagccatacaatgatttactataacggggtgtctggtctcactcgaaaataccaaagagatttcagtgacttttgaatggctcatatcgtgtcaagattcatgcatcatggatattttacctgatctgtttccccttccaccctgcaatgcatgcgagcttgactgctcgtttcctcacgcgacgttgcctctcccacctcatcccccctcccgacctcattggcgctgcgccaccgaatgccgctgatatgtgaccagccgtgcgtgcgcagccgcacggtcggttggtcttataggtatatattcatatgtatatattttgtatacatatgtataaattttgcatgcacgaatgtatgcaaagtatatacgtataaaatctgtatatttatctaaaaatattgtgtgtaaaaattttatgcgtggcatataaattacatgaaaaatatacatacacgtacaaaactttatatgtatactacaaagtttgtatgtatacaaacaaaatttatatgtatacatatgaaaatttgtatatatatatatacactttttttatgcatattccgtacgtatagaaactgattgcgtgatcaatgcacattagcatttttgggcgccaccaagtgctggcaaggtttgccaaattgggctcttcccgctccctcctctaaaccaacaacgccgatgctacctcgtcgcttaccgtgtcatgggaaaccgtccctccagccggtctctctccgctcttccaacccttcctcccgtaactcctactccaaactctaaaccctgccccacactaacacgaaatcgttaacgttgtcgctatcattgatgagttaccccttttctctcccttctcctcctcatccggaacttggttccctggccattggattgaaatccaatggaaatggatgaggtgacggagattgagagaaatctcagtcacatgaaaactagcaattccctctataaatatcaagtttgactaattacttttttaagactcattgtgccatgcttcaattcatagacaaattgcattcataatatcttaaaatttaatccaaataaaatattaaagctaagtcaggggcgtagctaggggtagtccctgtgggctcgggactaccccaaaatctggcccagagacccccacccccccccccaaaaaaaaaatttaggcccaaatagcccagaaacatctagggttggaggattcccctccctcagcgtctcagccaccagccagcgcccagcagcgccagttcgcccgagaccctgagcccgacgccgctagccgccagcctcctcgagacctcgactccgcgccggcgcccggtgccgtcctcagctggccggctccctgctgtccgcgccggcgccgccaccgccgtccgcgccgagtcaccgacgctgcgccatgccgccgtcccctcccctccgtggctcagccctggtaagaaatagctgcctaaatggctagatttgtgaattgtgattagagaattaatgagtctgtgaagtgtgaataactaagaaagtgagaatgcaatttataaattgttagattaatgaatgtgtgctaaatgctaattgctattgtttgtaggatttataatttgttatattagtggctttttaattttttatttatgtgtaagatctatgttgattgttgaactctctatgttgtaatatttgcacattttgaacttgcttgttaagtaagccgcttatggatcttggaagacattatttctatagtattttcactaaatttgtatttgtatatcagttttatggtgcaataaaattttaccatgtgacatgaatgtgtgaactaggactacccaaggaaaaattcctggctacgccactgatagctaagtattcattcactcatatgattaattttattcttatcaatatgttgatgactaaaaattcaattgactgtgtgaatcataggttaaagactctaacaaaaggcaaaattttgaaaaacttttccacctaaaatgatcaagtatctatattacggagagtgcacatgcaaagtttgaaaattttccctccctcgttaggaagtacaaaatacaaacagatgaaagtccatctaatctatctatgaagtgttctcaaagtcattatgtagctagaatagtactattttgcttgtatatataccccttgatgcctttatcataagattcaccaattcacaacacacaccatgcatctcaaacaaatttctatggtccatccggacatctcatttgtctccatggggctgggcaagacactcttggtcgtctttagcttgctacatgccttagtgttagcaacatcagtaggtgttgagcatgcaacagatgatgtatccacctacatcatacatgttgcacatgtgcatgcgacacctccaactcatgcctcgcaatgcatggaccagcacgccattgcacactacacctcctttctccaagggatcctcccttctcacttaagcgagccaacaccacgccttgtctatgcatactcccacgcggccacaggctttgccgcgaagctagcgaagcaccaggctacacacatcgtgcaccatcccagcatccttgccatcttccccgacaagcgcaatgagttgcagaccactctgtctccctccttcctcggcctctcaccgtccaacggcctcgtacaggcatcgaacgatggtggcactggtgcagtgatcgcagtggtagacactggtgtttatcctaagaaccgtaggtcctttaccgttgacccatcactgcctccgccgccgagcaccttccgtggccactgcatctcaaccccttccttcaacgcgactgcctactgcaacaacaagctcgtcggtgcaaagtatttctgtagagggtacgaggctgcattaggccaccccatcgatgagacgcaagagtcaaagtcaccacttgacaccgaaggccatggcacgcacaccgcttctactgccgcaggatctgcggtccctggcgccaacctatttggctatgccaatggcaccgcccaaggcatggctgtgcgtgcgcatattgccatctacaaggtgtgctgggcaaaaggatgttatgattctgacatcctcgcgggcatggatgaggcgattgcagatagagtaaatgtcatatctctttccctgggtggtcggagtgaacaactctacaatgaacccacgtccgttggtgcattcaatgccatccgcagaggcatatttgtctctgctgccgccgggaacgacggccctgacatgtctactgctaataaccttgcaccatggatggtcacggttggtgcgtcaagcataaaccgtcggttcccagcaaacattatcctcggaaatggcgaaacttatgtcggcacctccctctactcaggtcggaacatagctgcttctttgataccactagtatacagtggtgatgctggctctagattgtgtgaacctgggaagctctctcgcaacatagtcattggcaagatagttctttgcgagatcggctatgcccccgcacaagaagctgctgtccaacaagccggtggtgttggtgccatcgttccaagtagaaatgtctatggtcagttcttcctgagttcacccgacttgatcccggcatcaacagtgactttcgctgacgccaatgcaatctattcgtacacgcaatcggcggcgaacccggttgcaagaattgaatttcgcggcaccatgatcagccaatcaccatatgctccgagggtcgcggccttctcgagccgtggacctaaccgctttgtggctgagatactcaagccggacataatcgcccctggcgtcgacatcctcgccgcatggacaggagaaaactcgccaagctccctcagcatcgacacgaggcgtgtcgagttcaacatcatctctggcacgtccatggcgtgccctcacgtgagcggcatcgctgctatgctcaaggtggcacgaccagactggagccctacggcgatcaaatcggccatgatgaccacggcttatgaggtggacaacggcggcaacgccatcatgtcgtcagtgaatgggcgggcggctgggccatttgagctcggttctggtcacgttgaccccaacaacgctctcgaccctggccttgtgtacaacgccaccaccgacgactacatcgccttcctctgcggccttggctacacaccaaaccagatagcgattttcacaagggacagcacgacgacctactgctcacgtcggccgcccatcggggacctgaactacccggcattctccatggtgtttgcgaggtccggtggtcaggtaacgcaacgccgcaccgtgaccaacgtcggggcgaacaccaacgccgtgtacgacgtgaccatcaccgcgccgcctggcactaggctcacggtggcaccaatgaggctcacgttcaacgcgcagcgcaagacgcttgactatgcgatcaccttgtcggcagggtcaagcaactcgccatacaacgcgtggggagatatcgtctggagcgatggccagcacatggtgaggagccccgtcgtggccacctggaaataaatcaccacttgtgacattgtatcgtacgtttatagtaattgaaggccatcatctcagatggtgccatgatgtaaacgtaacatacgtagtactgtatggatgaacccgggaaaaacgcgttgtcatcgttgttcctgctaccgctagcacttgctgcttggctgctactgtataatcagcacgtatgcattaataaataaatctgaagtaaattgtcctcaaatttgtcaatgcatgaagagataaggacgattgtgcaaggttagatgtacgtgagtcatgaaagtacctattggaacaaagtccaacagatatgtctgccaaagaatcaaatatctgccccttcctcaacatggcggttactgtattttatagagggctaagtacatggaagattacaaccatagccctatggctatgggcagcatataggcatttctaggcctactggctgaccggtgggcccctctagaggggtactatagagggatttcttggagggccgccgagcagcccatgccggctcgcaagccgacagtaatcctgggaatcttgggtctggaccatccataataagactgagattaccggcctcgactacagcaagcaatgcgggcaaccagagtttgaccacataggtgggaaaattcaatgctcccattcatcttcctatctctacctctccaaggccacagccccgggtccagatccacttgctcctctaaagacgaggtagacggtcctggcttggttaggggtggcctgaaggctccacatcccttcgggggtggggtggaacccctctgacaaagagaaagtgagcatgataaatgcccgtttgggtgagccgatggacccagagggtccttcagagcccatcccccaatagtacaatggagcatatccaacgtcaatcgatttatttgatgtacggccacgtttaagtttaataatatatgatggtgggacccatgggccaacatcaccgatcaggagaagtgatctttgcccgaatgacaaaaatcacattagtgccttttcaaataggaacagggactaaagaatatctttagccccagttcaaaagtccaatggtactttatgatctttagtcatcatttttagtcccggttcaatagctgttaggccgtgtcaggccccaaacgatctttactcctagttggtatcaccaaccgggactaaagatccagttgatatcaccaaccgagactaaatttctctctcccactttcttatcctctcttgcctcgtctctctcgatctgcccacacgaccttttatttattatctctctcccacgctcgcttgctctctctgtctgctgcctctctctgtcttgctcgctttctcgagaagcggcaatggcagccgggcggcggaagcggcggcggcggcctcgccctcccctccgttagatccagcgagaggagaggccacgcagcggtggagctacggtggctcgacggcgtcggcgcagccgtgcggtaggcggaggattttttttttttagaatttgtgatgtgtttgatctgtgatgtgaatctatgatgttatctgtgatatatttgtgatgtattttttttagaatttatgatgtatttgatctacgatgttatcttatatgtgattgggggatgtagggagcaacttgatttgggaaaatcaatatgcaagaggtaaaaaacaaagaaaataaactcatttagtcccagttggtaacacaaggcgctaccatctttagtcccggttgttgttaccatttttattcttggttatttcaatcaggactaaagatgagcatctttagtactggattgggtgttccggtatgtaacccagaactaaatgaggttgcaaaccgaaattatgagttccccagcatgactccattacacatggatttatgtagtgggtcagtaaacatgcattttctatgtctttggttcgaaccaagaaatttgtttgattttacgtgtcagacagacaacgggctaacgggcttgtttggtaggtgacctgactgacaatctatgcatgtgtaatagaaaagctggtgtttcattgtgcctgaccaggcatgtctatgttttattgtttggttgaaaacctacgcatgagtgaatatatatattatatataaacattacgcttgcttgagtgagatgttgacaagtgttaatagcagtcacatcaatgaagaatcaatggggaaggatcagacacataaacacgcccgactcaggcgtttcagaatattacattcttggtcataattaaatattggactgccgaaaccttcaaccccaaaattaagttgccctttttacggtctgccttttatcatactctacatccttcttaattgatcagtatagctcttgcccttaccttaaacataaggtttccctttgaatatgcaaatttcatcatgaatccctgatcatggcgacgatagcttggttgacaccacacgatagtaatatctacggatcatattgcttgcacaagcacactataacttttgcttaaacttgaatttcaaacttgtactaaaattactacggaatattcatatctagatcggtaataatgaatgtggaaatcgttgcaaatttcaaaatgtaatttctatgcgagtactatcggccacaaaattcatctggccttgttgtttctaaggaggacgaggaaaaacagctcctggctccatttttttcaaagaaagaatccaatcagttgtacccaattgggcagacaatgagataagaacaacataatctacaatagctcgaagattttggtttcagaatatatagggcttggatgatgtgtcagcccaccacctaaaagcagtctacagggaataaaaaacacgaaaatgctatacgtccgaccgacgcgtacaaacagcgtacgactacgtcattggccatccgccgtccgtaacttctgcaacgatcgctaattcaattgggtttacgccgtgtatttcgccgttgagtcgtacgctggtcgtacacgtccgtcggatgtatagcagcgttgaataaaaaattaaacccccttgatgatggccaaaaggcacaatttcgtgcatggttgctgtctatggcatagactggaaaacctttcgattattatccaaaaggaagttgatctgcgtagccaatatatgctaccctgaaacaacagacggcttagatttgttagtaacagagcaactgcaataattgaacaaccctataggctatagctagtagttaattcatgccgtggccttacgaacgtctatacgtacctggacaacaactcatcggggcatggacagcgaccgaacaacatggattaattaaaattccaaataaaaagttaataaaataagcaatttgattacaatacaaatcccaaaagtaacataaagttttcactaaaattcgaaattgaaaaaaatacagtaattgtccatgtaaaatatcagagtacaagcaattaaatatctgaaatttggaatagtaaaattatatgtatattggaagctttcctaaactaattaaactaataataaagatgaagatgagtatttgtaatcttaaaagttagtgttgatagcgagagatgtttcttaattatttggaacgagaactatcatgaatatacaatcccatctttggtggtgaaagaatgtcccaagagatggtgaaaaaaaattccaatattagtctgaaagtgttggaatgagagaaacaaaataccttagatttttatatctttgagctattgtttgtgtttgctttatggacacagaaattaccatgctaattaaccagaatatagatgtaaaccgtttgatcacactggagcagacggtcagagttcaaaattattatcattttcattttttttctttcacaattaaatacgaagtctttctacctttttttcaaacactaaagtataaccactattatatgaaaaactatgcgatgatatatgctagtagactgcacgcaatgtgtatgagccaccccgctagttcattggaaaccttacaaaattggatttgcatgtaagctcaaatccacatttaaaaagggtagaaatcatttaaaaaatgtaaaccaacaacaggtttatataataaattggtatcacttcacggatatggtgaaattatacataatataaattaaaatttaattaaaagggtttatctcattgccaaacattggtatcttatactaacatgtacaatcaaatttatcaaaagaaaacatgtttaagtctaaatatagcataaaactataaatttagcaataaatgtataataaaaacatactttagatgtttattaaggcgacggatcagactgataaaaagaacgaagagattgagttgagagcaaaggagaaaaagaacaaatgagcggaggtagggtagcatcctttgattttaaaatagcttgtcggtgcgtggtggactcgtgtgactggattgactcaaaaccaccaactgaaaaaaataggtctatttttatgagcaaatctactaaggctgtgttcttttcttcaagttcccaatccatctccttcgtttttcgcccgcacacttttcaaactgctaaacggtgcgttttttgcaaaaagtttctatacgaaagttgcttaaaaaaatcaaattaatccatttttttttaaaatagctaatacttaattaatcatgtaataatgcgtgctccgttttacatgccggggatccctcctcccgaacgcagccttaagacaaccttaaccggaggagtcttatgtattttttaaagcagatcttcatttagcctgttcgtaaaaatgatgggttatctgcaagaatggtttt

SEQ ID NO: 54860 - DNA, 1651 bp, Oryza sativa
ttccgtccattccgtgccgttaagtcctataggatgaacaatgtatttaacggcacgaaccctaacagcgatggcatttttgagacaaaatcatttatacgatggcatttcttgaaactcacacttgtcaatggcatttttagaacttagatgcttgtcaatggcatttcatggattatctctaacaatattggtgcatgagaatgtgaaaggtatcaagcctacatgttttttaagcatggaaacgtggatcagtattggtttttgaatacgtatggcatctctcctctttgtttttcctatgcaaaaacttcataacatttaatgcttatatataaatcaccttcagttcctttcccagataagttcatcaacaacaattttatattaattcatgagaaatttgttcctggcttcctgcgaatctatatattcccttctaggaatgtttatatgtcttttcaaatggaacgcgtatccttgcaagatcgagagaaatgggaacgcgcatcgatcgatcagttagttgtgttatgagaattaatcaattaattaaggtctctaaaaaattaattatgaggtcattcccaacccaatgactaggatggtgtccatgcattaaactaggtgaaaccccgcgcattgctgcgggaatttagtatgataacaataaaaaaataacgtgtaagatagctagataacatcagattaagtaaattaatgtggtttatgataattttaatttaaatagtatgtagaatggtggttcaaacgtaaaatataaggtggtatgactttatggaaaaagaaaagtagggagatagtttggaccgtagattaatcatctaaagggtaaaaacaattgatgtgatatgacttaattagagggaaaaagaaaaaagataatttagaccatagattaatcatttaagcactaactaagtgaggatgaactatataaatatataggatatcataaaacatacattacattgaaatattatgtgaattatattggatgataacttaacatgtttgtatttgaaaagctcttaaattataaaaactataaagatatagcatgtttgcatgatgtttaaatgtgatgattgttagtggatgatgatgtgacatcttgttaattagtggatgatgttgtggcatctttgcaagttaagcttaagaagttagtgggggataactttagagtaagataggataagttgttatatagaataaaaaatgatgtgtcaaatgaatataaataagaaaagataagcaaactatgtcttgcatgagacatggtttctacacaacattcaagacatcatgtgagataagtattattaaatttaagtatgaaatagttgtgtttgtattgaaatagtagtatcttagtactagttttttttataatttagagtttatggaaactatgtttagtgtcttaggtttggaatggcacgaggggtttagagaacttcaccaacacggcacctctctctctataagaaccccgcttaatttgcattccatgcaagccatcgtcgtgcaagagcgagccagcagtgcagcatgagaacaagcaagagctcgccgtcgccggcgccggcgcgcggcaacatcgccgtcgatctccggccgttccttg

SEQ ID NO: 54861 - DNA, 2005 bp, Oryza sativa
ccatacttgtggggcaccaagcggctgccgtgcgagacgccggacgcctgctggcgcacgcgcgggtcgccgccgatgctgctgccggagaggatcgacgccctctggccgtacgtgacggcggcgcggcggccaacaacggcgacgatccccggatcgacccttccgccgaggcgatagcgtcgctgccgtgccgccgcgcgctggtgtccgtggccacggaggacgtcctgcgcggccgcggccgccgatacgccgccgcgtggggtgacagtggcagccacagggcggcgacgctcgtggagtccaagggcgtggaccactgcttccacctcttgccggagttcagctccacgccgagaccggcgtgctcatggatcgcgtcgccatgttcatcgccaagggcaagacaccaccaccgaacactcggggctgtttggatggaggctaactttgccataactccatttgccataactgtggcaagccacacagccacaactatggcaaactttggctagtaaatgagagtatgacgcgtgggccaatgtgctaatgaagtgtggcttgactcaactgcggcacgcaaccaaacactagcctagaaaattgtggcacgcctaagatttggtgtggcaaactgaggccaccaaccaaacagccccacgtcaagtgcggtggtgccaagttggagagttccacgcgggccgaggagtacggcccaaactgtggttggggttcgacgtgccgggtttgggatgggcaacatgatcaggcttcctagtaacgcccagaagtatccaggaaactattctaatccctcgaggggatgttttctcgtttgctcaaaaaccatctaaacagttatgaaaaattctggaaaaaattgacaacattcatacaacacatatatacaacttcacaaaatcttaagtccaaactcgactcacacgtcgagatataaaaaagacagattcagtgtatgaatagtagtgtactgtttatatctaaatttgtcttttttatttctcgatgtgtagatcgaatttgaacatgaattttggtggactagtaggtatcattatactctatattgtcaatttttttcagaatttttcacaactatttgcatcgaatttggaagaaaaaggtatacgaggggtatccactcgagggattagaatccactcgttaaggggacatcccatcgttatttgcatgtcatctaaatagttataaaaaaatttgaaaaaaaattgagaacatagattaatatgaaatatatcactacacaaacatgcatgactaaattcaacttctataagttgcaacaaaaacaacaaattaagctgaacataattatcgtacattcgcagcgatatttgttatttttgttacaatttgtagaagttgaatttaaacttacatatttgtggagtgatatatttcatatcaatctatattgctaatttttttaaatttttttatgtctatttaggtggcatgcacgaaacgagagacatcccctcgaggaatgaaattactttcccgtttgttggaagataatagaactatttgtaacgcaagtgtatatacagatactgagaggacaacctattccatttgttgttggcaaaaatatgcatgatctgcatatagtacgtccttcttctccttaaacctttgtcgtaggtttctaaaattgaaaccgatatacttcttccgttttccgttttaggttataagacgttttaaatttagtcaaagtcaaactgttttaagtttgactaagtttgtagaaaaatatagtaacatttttaacccaagaaaaatttattatgaaaatatattcaattattaatttgatgaaactaattagtagtattataaatgggtgatgacagttggagcatcgactataaaccgtcggttcacggcacacgttgtccttggcaatggccgaacctatgttggcacttccctctattctggcaataacacggct

SEQ ID NO: 54862 - DNA, 5115 bp, Oryza sativa
tcctgcagcccggcaatttagccggtggcgttggtaccatcatttcaagtagagatgtctatggtgaattcttgccaaccctttgctgacatccacccaggagtgacggtctcttacactgacgccagagagatctattcctacctgcggtcgacgacgagaccggttgcaagaatcgagttccgtggcaccatgaatccatgatcagccaatcgccatctgctccgagggtcgcttccttctcgagccgtgggccaaaccgcatcgcggctgagatcctcaagccggatatgatagcacccggtgtcgacatcctcgcggcatggtcgggagaaaacccgccaagctccatcagagtcgacgacaggcgcgtcgagtttagcatcatctatggcacgtccatggcgtggcgtcgccgccatgctcaaggtggcacgaccaagctggagcccggcggcgatcaagtcggccctgatgacgacagcctacaacgtggacaacggtggcaacacccatcaagttcatgtccacgggccaaccggccgggccgttcgagctcggctccggccatgtcgaccccaattaaccgcgctctcgaccctggccttgtgtacgacgccaccgccgacgactacatcaccttcctctgcagcctcggctacacgcgcaggcagatctcgctcttcacgaacgacggctcggtgaccgactactcggcccggccgcagaggcgcgtgcgcgacctcaactacccggcattctcgttcgagtttatttcggtggccggctcacgcagcgccgcagcgtgaccaacgtcgggacgaacaccgacgccgtgtacagcgtgaacatcgcctccccacccggcaccgcgatcatgtcgccgatgaggctcgcgttcaccgcgcagcgcaagacactgaactactcgatcaccatgtcggcatcggcggccggcccgaacacgtacaggtggggatcgatcttctggagcgatggccagcacaccgtgaggagccccgtcgccgtcatctggcagtaaattgacgtgcgagtatgcgacatcgtttcctatgtcaaagtacgtaattaaggccatcttttcagatggttgggttgtgtacttgtgtgttgtaaagtgtaaacctaattattgtacttcctgtatcagcaggaatgcattaataaataaagtaggattattgtcaaattattgtacttgtgtgttgtaaacctaattgttgtcaaatttgtttgcttaatttgttcacgtttgccatgcacagacagaatcattctttcgacacgcagaatgcatgcaggattaatgcaggagggttgatgcaaattaaagaagatgtatgaaagtgcaacactattcaaaccccggcgtccgcgcgcacggcgccgacgagcgcggcgccctcgaggacgtccctgatggccttggcgtagcacgcgcgcagccgccgcagcgcccgcctgtacatcgccgccaccacccaccgcagccgcagcctccggagcgcccccataaaccgccgcggcctcctgctgccgtcgccgagccgcaccaccgccatcttcctcctcctcaccctgcagcttccgtgcagaatcgtcacagtccgccgcgtcgtcgcgcggaacgcagcgtctcgccgcggcgccacagcgtggccggccatctgctccggactcctcatgatctccagcttgttgaaacgcttgttaatttgctgcttgtgcttggtcgcctagccgtgtccagctgcagctgcgacgacattgcttagcatttaagcgtgatctccgtatgagttggtctacgagatcgtcgagatagatgtgtcatgctgatagaaggatagaacatgctgatcgttgagtagcagttggtgtagcacgtactgtgcaggtgtgactcgtgaggtcaggtatagttgaagcaccgagcagctgtgcatgaatcatgcgttcatgctccttctagctatctatagttgctgattttaatctgcttaaactttgaatttgccatttccgtcagacacgcggccggccgatcccggtgttgacgctggttggccgagctagccagctagcaaccgaaacctctaatgggcgatcgcctagccaatggggtagccatcgggtgccccctccctccctccacctggttttttttggtaccacattatttttctattttagtaaatttatgcatctaaagtttatacacctcaagtttacacatctaaagttcactttagagaccaaaagtttataagtcaaaagtttatatatccgattcaaatttgaatttgaattcgaatattttttatatatagtatttctatacatctaaagtttatagacctaaagtttataagtcaaaagtttatatacccgcttcaagtttgaatttgaattatatccgattcaaatttgaatttgaattcaaatattttatatatatagtatttctatacatctaaagtttatacacctaaagtttaaagatccaaagtttataagtaaaaagtttacatacccgattcaaatttgaatttgaattcaaatattttctatatatatagtatttctatacatctaaagtttatagacccaaagtttataagtcaaaagtttacatacccaattcaaatttgaatttgaattcaaatattttctatatatatagtatttctatacatctaaagtttatacacctaaagtttatagacccaaagtttataagtcaaaagtttacatacccgattcaaatttgaatttgaattcaaattttttatatatagtatttctatatataaatttttctaattttttatttttttttaaaaaaaaatggtttactatagtaataagagaagaaggggaggagaaagaggggagagagagggggagtagggggacggacgcgagcgatcacccgctcattaggtgtgcccgctagcaaccgcacgtcctgtgaccatggcagcagtggaggcccagctcgaaaattgttgttggcttggctggcggtgtaacgggctgcaggcctgtgctcgttttcagcaactgaaccaggaactgggccgtaaacacgccatgaaggaataagttcacttttactactactctaattcgtgtatctcaaccgccataccagatatcccctaaactacatatgaagccagtgtgcagcgccttctcaccggtgtgccggctggattggcgccgtctcttgggtggctgcccgaaccttcttcgaatgttggctgccaccggccggcagccgccgccggcgcacacgttggtgtgctcttccgatgcctctgtgtattctcttcatgggtagatggatctactcttcgttgccgctgtgttctgcatctgtgccccccggcccccgcctcctccggctgctggtgtcgatggccttatataggcgtaaggggaagccctaacgaacagcgcggaatccatggcgctgccctgactcgatccacgttgagttgttgcgatcttcactgcaatagataaagcctctttgactcatctggtggatggatatatttcacgtgatttctatccattggattgctgcacggttgggcctagcatggatggaggcccagtagtccacgtattcgtatacgtacgccaccaatatacggccgccactagcgagcgcatgcatgcacgatgagcccgtagcctgtatagcatcttggtttgcatggtttgcccatgcatgcatgaactatatatgcacacataattgttttgcttctatttcattgttttgctgctgattgattgaggcttaatcgtgcatatgcttgtccttgtccatattactgaaatatacggacgtaaatacgcgcatgcaggccagagttaattgaacacaggtctgcttcttgttggtttgccaaacatctatagccattcgctgagcttgaacgagtgcatatatacatgccaccaagtgcacgtgcttggttcgcccatatataaatttctgaataactggcttgctttgcttttcaagccaacacagttacccagatactcttgtgtgtacaaaataccgtcaaacaatatcattattacaatatacattggatatatagccgataaacatcggctggtatcggcatcgactaggattactgcatcagcttgtcagccgatcggctctttgaactgttatttacatatcttgtcagttgcaggatcaaactgactggcatatctgcatctcatcaatattttcaacctacactggagctaagcagatctctcagaccgttgtgttcgttgacttagttcgcaccaacacagatccgatactatcagccaagagcgaatttttggtcaacacttctacgttgtataaagttacttttaaatatatttaatattgaacatgtttttaagaaaatgttggtttgaatggatcttaaaaataatatcctatttaaaatatactttatttttagtacatgacacatttttgatatatttcatcattcatcgtatttaaaaaatttaaacatcatttattttgttatgacttgatttgatcagtaaggtttttttttacttttgtacgtttgtaaaaagaatttgaacttttgtatgtttgtaaaaagaatttaaataagataaatgattgaacatatgtaaaaaaaattaacaatgttatatattaatattaaaaaaagaaaagtacgaattaccccccaactatccccgaactatcacgatagttcggggggtaattcgtaatttttcctattaaaaaaagtactttgagttttcaaggaatatatacatggagattagagtagtactagccactagacatctcaattcactatcgtatgctcggcttagtcaaatcactcgcgcagtcacacctactccctccgtcccaaaaaaagacaaaccctggtttctgtgttcaacgtttgaccatccgtcttatttgaaagaattatgaaaaaaattaaaaagataagtcacgcataaaatattaatcatgttttatcatctaacaacaatgaaaatactaactataaaaaaatttcatataagacggac

SEQ ID NO: 54863 - DNA, 4023 bp, Oryza sativa
caatgggaatacaaaattaagtgatgtcagctagcataacttgagtgatagaacaatttaatggaacgctaaggctgtgttcgatggtgggtgttgggaacccatcacccacgcacggaaaacggaacggtccattagcgcgtgattaattaagtattagctatttttttaaaaaatagattaatatgattttttaagcaattttcgtatagaaacattttgtaaaaaaaacaccgtttagcagtttgaaaagcttgcgcgtggaatacgagggagaggggttagaaacccagggcaacgaacagagcctaagatagtttaatggtataattcaacgctatgacttgatttgatcagtaaaggttttttttttacttttgtacgtttgtaaaaagaatttgaactattgtaagtttgtaaatataatttgaataagataaatgattgaacatatataaaaaatttaataatgttatatattaaaaaggaaatgtaggaattaccacccctaaactatcgcgatagttcggaagggtaattcgtacattttcctattaaaaaaaaggtagtttgagttttcaaggaatatatacatggagattacactattactggccactagacatctcaattcactatcgtatgctcggcttagtcaaatcactcgcacaatcacacctactccctatcccatccaaaaaaaagtcaatctaggaggggatgcgacccctcctacatacaacgaatctctggacaaagggctatctagattcattgtactaggaggggatgtcccatcccctcctaggttggcttgtttttggaacgaagggagtaaggttcaaatggtagttagtgcagcagaaagatagcatatatgacagggacggatctaggatttggccaatgggaatacaaaattaagtgatgtcagctagcataacttgagtgatagaacaattcaatggaacactaaggcagcgttcgtttagaggacattgagggggaaagcacctcgttttccacacgcatgcttcccaaactactaaacggtgcgttttttgcaaaaatttctataggaaagttgctttaaaaaatcatattaatccatttttaaaatttaaaataattaatactcaattaatcatgagctaatggctcacctcgttttgcgtatcttctcaatctcctcaatcccctttttctcaaacacaccctaagatagtttaatggtataattcaacgttatgacttgatttgatcagtaaaggttttttttttacttttgtacgtttgtaaaaagaatttgaacttttgtatgtttgtaaatagaatttgaataagataaatgattgaacatatataaataatttaacaatgttatatattaaaaaggaaaaagtaggaattaccactctccaaactatcgcgatagttcggagagtaattcgtacttttttctattaaaaaaaagtagtttgagttttcaaggaatatatacatggagattacactagtactagccactagaacgtctcaattcactatcgtatgcttggcttagtcatggctcagtcaaatcactcgtgcagtcacacctaaggggttcaaacggtagttagtgcggcggaaaatcaacagatagcatatatgccaggaacggatccaggatttggtcaatgggaatacaaattaagtgatgtcagctagcataacgagtgatagaacaattcaatggaacactaagatagtttaatggtataattcaacgctaaaataaatgtagaaatttctattgcaagcttacacaaggtcgatcactgccaatctatctatctatctatctattatatatactaaaagtacattaaacttcctacaaacactcccaatacgtcacgtgacattcctataaacgcttctaaactgctatgtggcactatttaatctaccgttgattttcattcaaatctattatatactaaaagtttattaaacttcctacaaacactcccaaggtgccgcgtgatgttcttataaacgcttctaaaccgccatgtggcactatttaatctcactgtcgattttcattcaaattggtggacccattatttaagaccattagattaaatctatatgtgtaccgttgattttcacttgaattgatggacccattattttgatcattagattacgtgtagtggatattttaatgtattaatgatgtattaagcttattttattggtatattatgtagttcatttatgaatagatacttggcttttaaaccgttataataggttgaaatgacaacaagtaaatttatatgtaaccggaggcaaagtgattttatttattctaggagaaaaccttattacttaaatatattaaagtctacaatctatttcacggtttataaatggtgagatatgacttttttttagcattgttttcataaaactgtcgggcttccttcctagttatacactaaaagtacattaaacttccataaaacactcttgagctaccacatgacgctctaataaattagatgaaatcttaaaaattctgagaaaaaaaatcaagatatctatctattaatttttacttaaattgatgggtacaatattctgaaccgttagattattacacctcttctccgcccctacagtcccgtaggtaagcagccaatgcccaagttcaacaccggttccgattcccagataatcttttatgcatgcatgtcaagttagttacgtgtatatatatatatatatacacctcggtacgtgacaccggaccagacgatttcggcatatctcagtggcacctcgacgctcgacaccacacgtttctcgtagcgattctggcgtcggcacctcatcggcacatcttcagcactccacacagtcagatattggtacctaacatcacaatcaggtactctctctgtttcacaatgtaattcattctagcatttttcatatttatattgatgtctatctagattcattaacatcaatatgaatatgaaaaatgctagaataacttatattataaaacggaggaagtaactgtcattaagactgctgcatggctgctcgggggagaatatatagccccctgcgaagggaggaaccgaggaagtgggcgttccctgctagggaagggcattcactgataacagtgaattactcagctctacaaatgctattgcagtactgaatgcactgcaaataatttgttaatggacgggtagtcgatgttgtcatcaaaactaaaacagttgtagatatcggcggctcagaaaatggaatgagtcattagcacataattaatcgtatattaattactataaacttaaaaaaataggtttatttattttgaaatatacttctatataaaatgttttgtcaaaaaacatgccgttgagcagtttgagaaacgttaaatagctaatggtaaacgacgaatttgttactaccaaatgcccaaacaaacgggccctaaatgaatagtgccaaattaggagatgtaggtttcgctgaacttacaaagacaagttatattcaacaatacagatgcataaaaaaagacaaacaatcaaatatagcatctacaacatgagcaatcagatcagtgtttaccctgtttgaatgctataatgtttaacatacgggacctctatatatagaatatagatgatattcctttttttgggtgattataggtgatatttaatccttcaatttcacacattattccccacaaaacaacaatttaacacccattataatataccgttagatatgtaaaatataattaaatattatttcataagaaaacctaaaattaaagataaaaaattttgcggcaacaaaatttatgaaaattaaaacaatatttttagaacttttaaaaagatgctcttaatttcttatagaacaaatgataacttcaatctttattgtatatggtatatataaaaagaagttttgcactacacatatttcaccaaaaaa

SEQ ID NO: 54864 - DNA, 939 bp, Oryza sativa
tgcagctctgtagttactctgtcacattggcaaatggcaaggactaatgctaaatttctagaactatatttacagtaccgctcaagaagatactacaaaaacaaaaacttaatcactttacaaaaaaaaacgtgcgaatcaactgtcaattaattctgacatgaacctaagtcgttttcgcctgcgtgacagaaacagagctaacagctaccaccctgaaactgaagagcaattctgggccgaacactttgcagcctcctccctgtctcctgaatccaagcgcgtccctcccttttccctcctccattacacctcctcaatagtcaatacccccatctccttggattgcattgccttctccgtccgtcgcgttgctccggtgctcgatcggtctccccgcccggccgccagacgacgcgccacatatgaagccccgctcctcgcgcgacggccataatgccgccgccgccgccgcgctcctcctcgcggcgctggtcctctccggcgacgtcctgccggcggtcgtggccggtggcgccccctcgttcaactacaaggacgcgctcaccaagtccatcatgttcctcgaggcgcagcgctccggcaagctgccgcccaccaaccgcatcaagtggcgcggcgactccggcatggaagacggcaagctcgccaacgtatacgtcgtctcgcctcgcgccctagctcgaacatctcgctagctgcatcttctaattttgtgaaatggatcactcgatcaggtggacctgactggcgggtactacgacgccggcgacaacgtgaagtacgggctgccgctggcgttcacggtgacgacgctggcgtggacggcgatggcgttcgagaaagagctgaaggcggcgagggagctggagaacgtgcacgcggccatcaggtggggcaccgactacttcctcaagg

SEQ ID NO: 54865 - DNA, 14248 bp, Oryza sativa
cgccctcgccatccgtggcccaaacctcatcgccacccagtaattaatcaccattattatacactgattaattactgctaaattaactaaagatattgagtatattactatattactcctcctcccctgtattaaatctcgacgatatatacaaattaatttgttgattaatcggaatcgaaattagagctgatgcatgcatggacacgtgagtgatcgatcgggcacacgatcgatcgatgacacgaacgaacaattaataacgcgagaaagggctcgcgcgagttgttggggtaggtctcggctggtcgttaggttggccagcttatttctcgttgcacgcacgcacgcacgtacgtacgcaggcgcgcgcaaccgtgtgtaagtgcgtgtgtgatggatcgatcaaccgagcggcgcgcacgggcgaatacgaacttttccaagtgatgaagtgatcacgtatacacgtagtacagcagccgagcttttcggtgagcgtgtacgacgtgtttttttcattggaccgaacataaaacatgtcaagtacgtacgtggtacgtttggttaatgcataaatgtatttgtggttcttcaaatcccgtgctcaggtatgaattaattaatctagctagctatatggtgtactatcttgtacgaagaagaacatctctgatgctgtatatctttgtgatgtatactacacgcacaataaattatctagtttggtgctatcattttattgtgtccttctcgttttttcaaaattttaatttattcgtaacattgtgtatgatgtgtgaaaactataataattggttgtagcttttattaaagtaaagacccgaattctcattatctaaaaaaaacattgttgatcaatatcttgatatcccctttattatacatcagctttggagagaaggaaaaaaaatacatgtatttatttgacaattggttttctgaattacaaaaggggtccttgtccagttgtcttgaactataaccttccattttttgagttcatttttatcatttctagcacaaataataaattgtactaaatcaaccccatctgcaaccattagatcagtaaccaacaccaccagataatgcctactttaccaacaccactaacaaaaccattaggggaataggtgtacttgtggtaaatgaggcagtgatgcagcgcaaaggcaggtaccaatttatccttacaaaagttaaaatcacaaaggtgggtgaccttgatgaacattagttagcaatgtaccgcaaagaaaacattaggtagcaatgaagacaatcactctcttaataatctatatgttgtttgcacttaagttgtaatgtaagtaactcttggatttaagcatacgttagattctgctgagatagacatatatttattcgaccgagcttagtcaaactatagatgttggaataaaaatgctcgatttattttagaactaactcattggtggatgattgggattggttgtcgatttgtcgtaacgaatttattggattggatgggattggttcaatttcgcttctatgtccaaaattgcatcgtcttctactttaacggtattagcttggcatgttgttatttggcacaactctctattaaagtcgtgtcctttcggctattgggtaccaatctagagtcatgtctcttttcacttgtttaatatataatctctcaaatggagtgcatatcattgtttttctttacgggttatctaaatgtatgagaaattatttaaagctaaaaaaagttcggggcaaatctttacttatatattactactccatctttctttgcacatttgcaaactcaggcagaaaagggaaataaaaaagggaatcaacctgccctccttttgcagcataaatacccaacccatcactccacaaagaaaaaaaaaagccactctctcgcgatttccctagtctttcggtgtgcgtgcgcgtgtgaaggcgagcaagcgagcgaaagcgaaagaagcagcaagcagcaagaggaggaggcggaggcggcctcctttgcatgtgaggagagagaggaggtgaggtgaggggggccatgtcgatcgcactggagagtgggcccgggctaggaggaggaggagggggcggcggcgggccccggttcggccgcgtcgcccgctgcgcctacgccgcctcgccgccgccggcgtcggtgggggcgcgcagctcgtcgtcggtggggagggacagcgacagccccgcggcggcggccaagtgggagtgggacggcgagaaggtggagggcggcgacggcgaggtgcagagctcgtacaaggggcccttcgacaccatggacgcgctccaggaggccctccccttcaggtatggctggcttcccctccccgcccaattcgtcgttacccccacggatcttgatcggtcccgaggtgttcttgcgtttcgtttgggtgatttgggggtaatgcggggtagaaaccgctgttcttgatcccccggtgcgcgtgttcctctagagagatttcgggggtttcttgattcgtttggaccaatgcagtggaaaatactggttcttgatcggttttagttggggaatgtaggcaagattcttggttcttcgtggacggttagtggtcatggagtaatttgtatggagcggtttggttatctatccttgagtcgatgcttatcttggaatttgggggatttattggtcggactgaagtcaaactgttaaaagaaagaaagaaagaaagaaagagctaatttagggttctaggtgattctttgtgccgccttacatccaacaaatttgtgaacatgggtttcgatcgattcgtgaagctgggatatttgaggtcggaagaatacagcgaatgcactggatgccgggatacttttgcgtatggtttcgtcatgcttgcttattgttggttcatgtttgggttatacccataacccattaggggtcgattatatttttgtaagtagtagtccttaatgttcttgccatgcccttaaaatctttatgctgaatgttctgagcacgaaaggttctgattagacaatttctaatgcgtttgtataggcttcagcaagaatgacttgtgattagtactactttgttggtgtttcacttcattcttactccgaggaatcaaaggatcctagcacttgaatatttcatttgaagtccatgccatcttataatttcagaagggcacattagttgtactaacactgaaagaccaatttccatgattcatagttcctttggtatgtgttgatacttgatattgactatataagcgcagtattatgggatgaaatcacacaaaacgggttttatcagaattacaaaaagttctatggtgtattaatggttgggtttctttgttaatgatcaatacaatagatggtgtaaattgcagatatgtgcatctttgacaaaagcaatgaataatctatcttctaggttggtcgtagtaatgactttgagtttgttcgtttgtgttcttgcaacctgactattgtgtacagggggggtaggcatagctctgagatcagttgatgcatattaccttcaggcagtaatatttttgtcatgaagatatcatgaattgttataatttttgcatagggacattttttttttcttttgagcatgcacaactactgtacaatttcgctactgctatttgaattctttcagtactagtgtaagtctagcacaactacttagtagctgagtgggtttgtagttcatactaccaagtacctattggcccttgtcacttgtagtcgcatagaattgtgcattctagccatatgatggaagcagagattgggtattgtgaacttgaagtcttgaacacaattcaatatggctaacatgattaacacaggaacaggatcagtcagacaccacaatctttttcacatgcttttgttagctatcttgtagcatgtgtaattatttgttgatctgcaacattaaaatattccgcagcctgtctctatcgttgatctggcaaacttgtttgtctgttccttgtgaggagcatgtgtactgctgatgttttccaagtctttgctccagcatcttacaatcttctgttttattgagtaattctgttcttatctattgcaggaaaggggtatgcaagttctacaatggcaagtctggatcttttgcaaagcttcaagattccgtgatcccatctccacctgagaaaagtcttccaaagccagaaaacccatcccctaggaagcggaaaggtcttcttccgttcagtttcaagtggggcaagccacagaacaaagaggtattccctgaagatgatgtgatcatcagccctacaaattgcaggagaatgacattgtcaccagctgcaacaagcagttcggggagcaacagcggcagtgatgatgaacactaccgctctccgaagctgcatacccgtcagccactccgaaggcccagcaatgccgccatgggtgtctttgcttctccacctgcacctcgtccaccgcaggtgttatcagctcatatgagatcacactcgatgcttgatctgcaggatgtgacagagtcgaccgccatggtttctcccagggacaagcgaaggaggaactaggaagggtggatcttgatgtgttgtcggtctggtccaaccgctggtgcccatttagactgcggaatccagtggcgaatgccgtcgtggtggtagggcgcgtgcaatgctttaggggggtggggggtgttttgcgaggtcaaatggactcgtattcatagagcttgctgttctccttatacttgatgtactgggatacatacagagaacctgagaaactgatgtcgttacctgagttggtgggctgcatgcgttgattacaggttgacttgtaaatgctgaactctgcttttgtcgattataattcaatcatgtggcctgctctattacattttgtatacctctctgatctgtggtatctcacccttggaactgtatcagtatgcatattatgtcctgagctgttggtgttcttctgttgctagtacaactgtacaagtagcagcaacctcttccgatgaacttatctgtgcagatccatcacttttttttttagaacatgcagatccatcacatagttttggataaatcattctgctcttatgggtactggtgtgcaaagcgcaaggattttgtttttttggcagaagataatctattgcagtacacacgcagattgtgtgaacgccttggcaaatcctgttggtcggtttcgtactttcatcttctgttttcgtgttcggaagagattgcagtggctgtgcagccgcagcagctccatcaaacgcaacaaaatttctacggctttgtactgtagatacagcccagctgcgccacagccgagcaagctgcaaagcagcacaagcgatttggtggcacatgattgctgctctcgttaatctgacgccttcggtaatcggaacctcccactcacagctgaaatttgttgttttctctatgcgtagatcaaaactgatctttcatatttgtgtaaggacatttaagacctacttcactttgtattatttaatttttataagattttagttaactatttggaccacatggactaaatcttaaagcccacaaatcttgataaggcaaaattgtataaagcaccccaattatcactcgttttaaaatctcctcccttaaaaaattcaattcgttgcaaaggcccacccaaccaaaccccttcacatgaatataaagtcagcccgaccccgctgatgtgtagtcgcaacaggggaacagagcttgaccttagctactctctctgtcccaaacagggacggagccagcattttgaatcactggggtcatggcttttacttgtatttatgtcgtgtttgaaactataattattctcgaagctagatatttttagctcacttttgagctagagctatgagtaagttgggattgttccattttgctaaaaataaatatttaaagtctattctataagaacttctgaggtttttaaggtccaaaattttaaaagttatgactacatataaccgggcataacaaccatgtgttttttcagacatacaagtatgttctgaaagttgtttattattccatctgtctcaaaatacaactacctacgtctttttaagagattaatgttagggtgtgaaattattgtgattggttgggaaaaaaaagtaggtgaaaaaaattatatcgaggaattttgtgattggagatgggatggttcatagaaaatagctatattttaaagcaaatttgaatattagaagtaacatattttgagatagagtgagtaacttaaaaaacacatctagtagttgattagcaaaacttcaggcctaatgcattgatatacatagcacatagctaaaataagtagttggttaatagatcaaatatgtctaattgcagcattagtagcggattgacagtagcataacacagctaacaaattatgcttccaaagaaataaacggtacaattgtttcagccttcctgagctccagcagtttatcaggctggccggggtcattaagcttttgttgctggggtcattagctacaaaataatgaacaattcacttgattgatcgaatgtcatcagggtctaatgaccccaatgatagtactgcagctccgcccctgatcccaaaatataagcatttttagctatgaatctggataactgtacatttagatttatagccaaaagttattatattttaggacggatgtagtaattgcctatactgattcgccgctaccctcagccctcgcgttgttcgagaccgtcttctctctttgatctacacctaggactaggttcaaatggatgcacctgaaaccaaacgtgacccattggtctggtcttttacgggtacaagtcacgggctgactcagctatttacacacgtggagggtttgggtgggtgggtttttgcaacaaattggttttactagaactttaggcgcgcttcgggccgccctaccgtttgttattggtaaaaagtatcacaagtcagaatatgtatgtacttatattggtaaatgttgagtacgaaaggacttcattctagcacaggctgtgacataacttgaattccgatgttacatgatgatttgaaatagaccctgaatactataagataaaaaatacctaataatttcagaaaccacaattatttatcatacccaaaagagcaagaaaaggtataataatgtacttaaaaaacggtttaatcattcatcctcttttaaaagaggttaattcagttccattacggggcatgaatcacaagttgtaatgtgaaggactgtgtttgcaatcacttaagaaaataaatattcttcaatcgcacatggggactctcagaatttgtatgcaccaggtttctggttttcgttgcttgcaaaattaagttgctagcaatcctggaagctgagtagacactttactggtgtgcacgcgcgcacgtttaatgtgacatggagattattacaggcagcacactgtggaaatggcagagttaggtataatggtaaatccctttttccagaattatcagctaaaatccactgctagatgctccctcaatcataccagcttacaaaaaacgtctttcggactaatctctgcttgaatatctggtatttggtacataggcctaagaaaaaaatcagagagaattgtccatgttctgatttgtgattctgacttctgcagttactaaacataatccaaacaaaaaagaaaatattttctatgttctgtaatttgagtcttaattcagattagattgacctgaaatctaaagaggtcatgaatattcagattttgcatttgattctctgagattatatcaaacagctagatgacaccttaaaaaacacaatgaagcagaaccatccaaaccctgtcctgaccacctccttaaaatatgtaatggagcagagcgacccacagtggtttcatgaagtgaacatctaagctttggttgttggaactatatacaaacacaaccaaataaaaagatatgcagtacaaatcagaaatactgtagcattcttgataaaaaaaaagggtagactatcatttgcaagggaataatggtatatgaaaaagcaaagctagcgagggaactggaggcaggaaagggaagatacatgccaagcatacataagtgagtgtagaaaggaactggttgtggcttaactcaccaaaattgaccatgggaaacaaactgcaaatggaccctgggcaaggcaacaacacatggttccaatatcaccagatatggaatcgctaaacagtggtggtgccgcacggccgacggagcttcaagctaaccaacacctacaatattggcaaacttgagcaccttctatggcagcaaccaatcctttttatacagataagacaaaatcaattatcatatttgatattcatatttataattagattgcattctttttctcttttttgaaaaaagattccacttatctagtgaccaacacttcaaagtatcacctagagtagaaggcaaactgaagagaaaaacattgattttaacaatctttcaccttcttgtacatagaaacacaactgtgatgtacattaatcaacgttttcattagccgatgaggacggtaattttaacagagctaggatgatgcaaaataaatggctcagcaaaaaagagtaagttgtgttttctaggcaagaagttttttggatttaaatcaacagcaactatgaaattgtaagtcccttaaatataattgcatgaaagcacataaaccatttcttgcatacttaattaaactcctactttgaaacattgatatggtgctctgcaatagttctttcaatcttgcaactaatgtcaagcaactttgttatggccttcttgttccatgattcaggtggccttgtaatgctagtatatgaccttcccatcgagaaaatacttagttaatgaggaagaatatccaaagtaagaccaatttcagaatatcaattagacatctaaatgaggccatatgataaagtgcgtgcagtaaaagaggatttctttttttatcatattaacaaatgatctgtacaggtgctacagcctctaatcctcccatgaatagtttagcttaattagtttattctactgtgcacccatggtaaatttttagaaaggctaaatatcacgtcaacagtgaacattagaacagtcactgacagttgcaataacatggagtatgtgcatgaggatagctaaggataatggatttaggacaaggttctatgaaccatcacatgatgttcatgtgaacaaatgcacgtaagttcctattatgctgcatcgaaaaaggcaagaagcaacagaagaacttggaaatctggaagaagcaaagaaaataaaggcaaaggcaacagaagaagatcacctgttcaaaaatatgaaatgtcatcccaattgccttgtggaggtagcaacaaatagacactcaacatttagtcatgaaatcaatggcatcttgcttcacagcgtcctatcatttattgagagcaatataaaccagaagtatatattgtactaatataaattgaagagtaccataacaaactttatatgcccacgatcatatctatgactgtacataacaatgctattcaaacctgaagaaaaatcagacattcatgataaggctcatagtatcctctagaatcagatcaagtccaaagatagtcattcagatcaatcgataatttttttgattaatttcaattgtaagtggtcagctcaaagtgtcacagcatttacatcattcaatattaagttctggaggtcttcattccaacacagattgtcacaacacctgaattctgacatttgtgtcacttttaggaatagtggttgaattcttcaagatagaaatcactaaagagttagttcagaaattatgaaaacttatcatgcttaacagagaaagacatatcaatgtatataatcaaagatgattttagtgagattcagtttctttaaaaaaagctaatttagttccatcatatgcaaaactaaatttatatgttgcatctcgtgtagctgaaagcatgaataccaagatagaagcatccgcttatgtgaatgaagataaaggaatttatagaacaaccttcgctaagaataattcccaagaaactaaatgatttctagatttggcaatagaacggtcagttgatcatccaaaatactcctcaaagaactaaatgtggcatccaaaactcttctttcactcaaaagaaaaagataatacatctattgaaatataatgtgagaagtaatcagttaaactaccgtagatgtgggtgtcctaaagagtatgtggccacaaaatctgacatcatgttcacaaatttctaaagattgggtataaaatgatacatcttaaactgcaatgcaactgcttagcatagtataagatgagaaagcatagccacaaggttgctagatagccaaatctacttcacatattaggaagaaacatgccccctatagttttgacatacctgagcaccatatatggtagcaaccaaccctttttacatgaataagacaaaaggagtcatcagatttgatatttataataggatgcacttattactctctaaaaaaaggttccacttatctacatgcataacaatacctttgtagagaataaattatatccgatgaagagctatagaaatacaatgcatatttaagctgaaaggagcatagaggacacatacacattaacaacgtacaacacccactaaacctctttgattacatcaagccactgaattatcagttataatctccctcaatcatacaagcttacaaagaatgtttttcagactaatatctgcttgaatatctggtattcggtgcacaatcccaagccaaaaataaaacacagagaaattttcttgttctgatttgtgattcggacttctgcagtcgatctacacatgcggctgttcttcgttcgcgtcattgtgaagcaatcaagcagtagcatcatattgtccacatcgtcgtcgccgatctggagggcatggccgacccgatctccaccagcaccccaacgtcgttggtaggccgcgccgcccgctggtcgtcggcctcacctggtgcgaggtcgccccgacgctgccggtgccatctccatcaagctccgccggcgtcgtcaaggtcgtcgcggcgtcatcggtgcggcacagggtacgagggaacccgtccctaccggctcctcctctgcggccgccgccgcctggggagctcgtgcccgccgcagccgcctacgcctgcaggccgccggttcaccgtcgatgcatcctccgccatccacgctgccgcccggatctggatgtcatcgtcgttgcggtcaatcccatctcgccgagctccggcctcgccgtcgtcaccatctccacccggccggatgacgccggcacctgcctcgccgtctcctgtgccgctgcggggggactcgcctccaccgccgacgtgtgcgggtcgccgctgcccggattcctcgctgcccctcctgggactccacgatgggcgcccgccggtctccgccgcgttgctcccggcggcgccccgacaccgccgccgcaggggggacggattccgccctcaccgagcacgagctccctccaccgcctcccgccgtccgccgcctcccgccatctgccttgctgcgccggcgccctccgtcggcccgatgcctctggctcctctcataatctcccaaatcaagcgtcggggccagaagatcgatccccacgccatcaatctccatcacagcatcctcggagctagcgcagcaccatccaatcccctgcttgacctcacagagagaggaagagaagggagcaaaggtggggggagcgccaggagcccaggagatggaggaaggcgggggagagcgcgagggatgtcatctgcgatgaggagaagcgggtgagggggagggaagacgatgcagcaccggcggcgccgcaaaggcaggggaagagcaatcgagagaagggtggggtacaatggcggctagggtttcggagaagcgaggggatggaggatggggatgttttcttttgcaagaaaaccctcttactttcttgttttagagcgcgccccctatattcggaatttcttctctttcacatataataataccagtatatagaggaccactacgtaagaatataaaatacagagaagtatgaccaggcagttaggaatgattatcaaagaaagtgagggtttttttgcaaaattgccagctctagcacagggtgacgtggatatcaccggaagcgaacacgccagccaaaaaagccccggagcgctgtggtggctctatttcgcggtcccctttaatctctccgatttaatctctccgatggtggaattttaaaacaagagtgataattgagatggtttataaatttttatctccggatagtgatactatgtgtcaatatataaatagttttcagacacgtgaatacaattacgatgacgatgatatccaatcacaggctctacctactaaaaatctgcttaccaaccagtacgaggcgtatatttcatactccctccgtctcataatataagagatttcgagtttttaattgcaacgtttgaccactcgtcttattcaaattttttttacaaatataaaaaatgaaaagttgtgtttaaagtactgtagataataaagtaagtcataaataaaataaataatatttttaaaaaattttgaataagatgagtggtcaaacgttacaagcaaaaaattaaaatctcttatattatgggacggagggagtatatttgcatggtatcagtgacacatagtactagaacaaaaataattgaatccctcgcacagataggcaaaccctgcagtaagttgtatatattcggctgccctggcctccccactacctccccacagatgacagaatagctcatcaaacctaagtttaattaattgccaacattctcatggtcatcaaaccaatgggcaaaccactcgtagtcatactcttgctatcctcctccctcctcgccgttgcagctgctgcagcatcgccgccgtcatcaacagcagcaggccatgcaggcgagccagacgacgacgttgtgtccacctacatcgtgcacgtcatgcccgcacacgcgccacgccgccttcccacgcaccgcgcgtctcgtcgtctcacccgcggctacgcatcgctcgtccgcgggctcctcccgcggcacatcgccgacccggctccgcgactcctctactcctacgcgcacgccgcgacggggttcgcggcgcgcctcacggcacggcaggccgcgcacctcgaggcgcagccttccatcgcggccgttgtccgcgatacggcctatcagctccacaccacatggtcctccgactttctcaacctctcgccgtcttttgggctacaggcggagtccaacggcgccgtagacgcggtgattggtgtcatagacacgggtatatatccgaaagaccgtgcgtcctttgcacctgacccatctctgcccccaacaccgcctcccaccttccgtggtagttgcgtgtcgtcgtttcgtgattccaatgccagcgcttactgcaacaacaagcttgtgggagcaaagacgttctaccggggatacgaggcacaaaatgggccaatagatgagagggtgcagaccaagtcaccgctagaccaggaatcctaattgacgcgtacgcgccggcccacacggcccaagacatggttagttcttttttccgaattttttcatatatgtataagcttttaacccatatttgaatactttcaactctgacttaaaaactttcaactcagattcgaaaactttcaactcgagattcgaaaactttcaaatcagatttaaaaattttcaaaagttataattaaaaaactttcaactcaaaacattttgaaaaaaaaatacgtgtgctaaagattttaaaaaagtaatcagaaaaaaagaaaaaaaagctaaaagaaaaaataaaaaaaaacgaaaaaaaaatcgcgaataaaaaaaaaggccgatgggccttgtgggctgggggaggggggggcag

SEQ ID NO: 54866 - DNA, 14082 bp, Oryza sativa
tcctgcagccctgtcccgaatgccaacctctttggtttggccaatgggattgccaagggcacggccccaggtgtgcgtatagccatgtacaaggtatgttgggaatattacatacccgaatgcattaccactgacatccttgcggccttagatgagacgattgctgatggcgttgatgtcatctccatctcacttggtaggcccggctaaattttatctctatatttatttaacaaacgtgatgattaggagagacgatatatccgaagatattgagaaattttcacctgataataatgcagccactaggctcaagtaatcactgctagtgtactactcacggtcacatacatgggcaataacacacgacaactcgtctctttggccagttcatgtcgttgtttcttcgcgtcaggggagcaaaaagtcattagctgttcacgttcaaaatactcgaacaagcgagtgccatggatttttcgttggttcgttgtcagttcgaaaggattacaacgagtagaggcgcgcacattcgtgccttcatttttcgttggcttttactgtagcaacagagatagattgacaagcacgtaaaattaattctgatgcgcgagtccatttcaattctaacttagggcgactcgttttcacacgagtaattaacttagggccagatatcctcgtccctgcgagtcaatttcatcgtatcgcgcactgtagattgtaccgaggattgcaaccacagcgaccaatggagggctgcgtagcattttccatctgcaattgacacgcatgaaaaatcccactatcagatcatcaatccgacgggtccagtaataccaacctgcctgtcagctagctatgaatgattattattccaagcacgtgtttatttgcgtcatatcgcatcaaataatattagtgaatgattgaatttggcgatgcggatgggggaatatcaaaaagaaaaaaaaatgctaaatatctgctacctccgtaccataaaaaacgaatctaaaatcggatgtgacatatcctagtactataaatctaaacatatgtatgtccagattcgtattattaagatatgtcacattcaatactatgttggttttttatgggacggagggaatagctgtagaattttcccattaagagtttgtaacatgacgacctataaatctacatgctccctggttaatctacaatgagattgtgaacaatgacatactcccatgtcgtatttctcggtgatctgggaagcaaaggcacgtctcccccacctcatcagcgcggctcgcctgcctcgccaccgccgacaacgctgccccctgcggtggtggccggcggctgcatcgtcccctccttcctcccctttcctccctctctcttcctttccccttcttccttccctatctttctcatttcctctttttctccagatttgaggtgactcatgtggacgtcggtcctgagcttggctctcctccccacgtccgacgccaacggcctcccatcccgggctagcggctgcgttgaagatggtgggggggacggtcagatctggccaccctaggtctagatctggcgtctctctgatgggatctaggtttctctctggtgcgagaggccagatcccctgttgcgatgatggccagcggtgctagtgatggcagtgagggggacagttcgatctggtccctctccaggtctggcacgtcccagggtcgggtgaggccgtctgtttagccatgtatttgtaatataatagattgtaacgtgtactaaccacgaagataacgagttgtgtgcaatgtaccatgtttgattggaacactaatgtggccttctgccatcatcgtgcataggagcggatctaataagacataacatgtgggactgaacaaacttgaaaaactttagcccggtccttttctatggatgtatgacaaaaggaagatagggcttatatggaggctcttatagtcccaacgtcaaaagtaagggctcgagcccctctgtccctatgatagatccgtccctgttgtgcacctcaagcgtcggaatgccatcgatggtgaattctagtcatcctttggagtaaaggatttttacgggaattgactgatttgtatgagaataatacaaaattgatgtgttgcaaagaagccctccacctttgaagacggacgtgattgatggctagatcaaatttcacaatgttttttaatagtataacaaaagcagataatataaggtcaagggaatacctaagcctttagcatcaagtcttggaacaaaaaatatttgaacggttctatttgaggcaccaatttagaatgtataatagaagatattgccatccaaattaaaagaaagtctaaatacacccgtgaattgcaggtaatgtcctgctttttgtcaattctgctttagggcattcccaacccaatgactaggatgatgtccatagcattaaataagttaccacctaggataaaaaataatgtggcaagtgaataaatgaggaaagagaaggaaatcatgtcttgcatgagacatggtttctacacaatatccaagacatcatgtgagataaatagcattaaattgaagtatggaatagtggtgtttgcattggaagagtagtgtctagtactagtttcttgatgatgtggagtttatgaaaaccatgtctagtgttatgggttgggattgcccttagccttactccctcctttccaaaagataagctgcccacaattttagaaaaaataacatttgtaactattaactaatagtaagctaataatatgtatatgtagaaacatgcatatcatatctttagattcatattttaaaatagtttcatataatgttaatattaattatcgataatatattgtgaaagaaattaacgtttaaaatataatataaaaaatacgcatgtcttgtagtttggaacgaaggtgaagggagtacaaacaactctgtggactaagcacattacacacaccaccgtcattacttgtcttactagccagaggccttccaaggccggtaagatgtataaatttgcttggccctcgcctcccactgatctccacacacaagaactcactaaaccgcttaattactaccaacatttgcatcactgcatgatcaccccaatggccaaaccaccagcaacaacaacgctcgtcctatgctgccatctcgccgtggctgccgcagcagcagcgacatggataggacatgacgatcagcaagacgacgacgtgtccacctacatcgtgcacgtcatgcccgcgcacgcgccacgcctcgccacgcaccgcatcgcccgcgaccactacgcccccttcctccgcgagctcctcctccccccgcacgtcgcccgcccgccgccgcgcctcctctactcctacgcgcacgccgcgacggggttcgcggcgcggctgacggcgcggcaggccgcgcacctcgaggcgcacccctgcgtcgccgccgtggtccgcgacgaggcctacgagctccacaccaccctctcctcctcgttcctccgcctctcgccgtcttccgggctacaggcggagtcgaacagtgccaccgatgcggtgatcgctgtcatcaacagtaccatgcgtccttcgtatcagacccgtctttgtccccaacaccgcctcctacctttcgtggcgaatgtgtgtcgactccagagtttgatgctagcatctactgtaacaacaagcttgtgggtgcaaagatgttctacgaggggtacgagcgtgcgagtgggaaaccgatcaacgagacggaggattccaagtcgccactagacacgacgggtcatggcacccacagcgctgccattgcagctggctctcctgtgtcggatgccaacctctttggccttgccaatggcgttgccaagggcacggctcccggtgcacgcatcgccgtctacaaagtgtgctggaaaatggggtgcttcggctccgacgtcgtcgccggcatggacgaggcgatcgccgacggcgtcgacgtcatctccctctcgctggctgtcaaccgcaaaagaacttttgctcaagatcccacggccattagcggcttcaatgctgtccgtaagggcatagttgttgttgcatccgctggtagcggcggtccaaaggaatcaaccgtcaccaacacggcgccatggttgttgacagtcggtgcatcgagcatgaaccgccaattccagacgatcgttgtgctcggcgatggccagacattttctggcacatcgctctatctcggcgatacagatggctccatgaaatcgcttgtctttggtggtttcgccggctcagccgcttgtgaaatcgggaaacttgatgctaccaaagtcgctggcaagattgtcctgtgcgaggcggacaggtcttggatgcggagaaaggagtcgccgttgctcaggctggtggattcggtgtcatcgtgtctagtcgtagtagttaggtgagtatgctaaggccactgcccatctcaacccaggcaccacggtgcctaacgctgccgcattggagatcttgcgatacatggccaggacaccatatccagttggtaagatcctcttctttggcacggtgctcagctcgtcgccgaggatcgcgtccttctccgcccgtggcccgagcctcgccgcgccggagatcctcaagcccgaccttgtcgcccccggcgtcagcatcctcgccgcgtggtccggcctcgtctcgccaaccgaactcgacgtcgacacgaggcgcgtcaagttcaacatcttgtccggtacatccgccgcgtgcccgcacgtgagcggcgtcgctgcgctgcgcaagatggcacggccaagctggatccctgcgatgatcatgtcggccctgacgacgacggcgtacgtccaggacagctccggcaatgccatcgctgacatggccacgggcaagccggccgggccgttcgagctcgggccggccatgtcgacccgaacagcggccttgacccggggctcgtctacgacgccggcgtcgacgactacctcgacgtcctgtgcgcgctcggctactccgacgaggatatcgtcggtatcttcttgagggacggaacgatcaccaactgttcgacgcgggcgagcaccaccgtggcggacctgaaccgcgcgtccatctcggtggcggtcaaggcgtacggcgacgatatcacggtgcgacgcaccgtgcgcaacgtcggcggcagcgtcgacgccgtgtacaccgtcggcggggtgccaccgccgggcacgcagctccgcatcaggccgtcgaagctggtgttcgacgcggagcaccagacgaggacgtacgacgtcgtcatccgcacggtgtcctccggcagcttcgacgagtacacgcacggttccatcgtctggagcgacggcgcgcacaaggtgaggagccccatcgccgtcacctggccgccgtctcagagcgccgccgtcgcggccatttgatcgagcagctgctctaaccctctcgatcaatacgcatgcatgatctggctacgatgtccatctagtttacagctttgctttgcagtgtgtaatgtttttttccgaataagcagcttgctgcttcctcgctagtacaataatcccggtgtggtgtaatcctacacttttgtatcgtgcatgcatgataaataaaatcgagaatatatatcaataaatcaatggagtattcagccgaattatactgttcaagtaactattccaacactttgtttgcttagttacgttattacaactttgcaaaaatcaagcatgaaagcaatttttttttaaaaaaaagcgtacgttctgaaaatgcgggtaccagctcaatgtcttgcaagcataaaagagttaaaagacaataaactgaacccaagaaataaatgcatggtaccatatggtccagcctagaagcaacacagataatggcagcctacccaacatttatttgctagtaatacactatttctcccaccgtttcaaattattgcattctagttttatcttgaatcgatcatttgtatatctgtccatcaattgttaataaattgatagtttaccgcgagaataactttcatattatttatattttgcatgttgttgaattcgacaaatttatattgtcaatgataaaaatgtttgtgtcgtgacccaaggtcatggacaagattagggatagacgggaaaacacccttttcccgcctatcctgagaaatgagcccgaatacaaaataaacacacacttttactgacaagatttttagtattccaatatgtcctgtctgctacaggtttttttgtcagccttatatagttcatagatttacatatgagattacaattgtgcccttcgttgggcccacatgaaattacaatcgtgcccatgccatatgagcaaactctaagggcattttggtacattataggggtcattatagtttttggtgccagctagatggagtggttgagtggttcccaggaatattctcttggcatctttattgtccaagttgccttcttcatgaccaagagtcttttccatcaccatgggtcttctccacgaccgagggtcttttccaccaccatgggttttctccacgaccgagggtcttttccaccaccatgggtcttttccatggcatgtagtcttttccatctcgatcatcctttccgatttacctggtagctgacctgttattaacttaggaaatacccaaaacggataatgagacttagtgagaagaactcactcgaacggtattttccgactcgaacagtgttttccaactcgaatggcattttaccgttttccctattcgaatgaccctttgccactaggatacttatgataaaaactcaatcttacccaatctcttcctctatagtgttttgggccgaatatggagggacggtggtgaccccttgctacaacagtttgatttatggtaaaactagaatgacaagtaatttgaaatgaagggaattacatcttattcagtacacctatctgatgaaatgaagtctaataacttctagcatgggaatccaggtaatttagcataaataaaattattcaccactccaatccagtgagttacacatgtgcatagcgatgaacaggcaaccgatcccttccatgaagccatgggagcactaagcttcatggaaggatttggtctcatgcgtggagatctctgtccaagaaggacctatacaagctgtccccattgccaccaaaccagaagacacccaaatttccaacactactctacatggatgctgctcggccgttcgacggccatgtcacggcgatggggctagtgacgtcgtgcacgccgtcgctccaggtgaccgacccgaaggtgtactcggtgtcgacgatcaccgggttacccgacgcggcgatggtgatgtcgtaggacaggctctggtggctctcgtcgaacaccagcttgcttgggctcaccgtgacatccacaccggacgggctgtcgatcttggcttcgtagacggcattggcgttgctgccgacgttgcgcaccaccctgtggtaggtgactgaatctttgtaggaggataggacgacggcgaaggcggggtagttgaggtccccggtgcgggggaatttcgtcgaacagttggcgacggagccgtctgttgtgaagagggagatgatggagggggagtagccgagcgtgcagaggaaggagacgtagtcttcggtcccggcgtcgtacacgaggccagggtcgagcgcgcggttggggtcgacgtggccggcgccacggacgaacggcgtcgactcggtcccggtagccaggtccttgatgaccgcgctggagttgtccacgttgtacgccgtggtcatgagcgccgacttgatcgccgccgggctccagtccggttgcgcctggcggagcagcgcggcgaggccgctgacgtgcgggcacgacatggacgtgccggagatgatgttgaactccacgcgcctcgggtcgatgtcgaggtcggtgggcgcagactcgccggtccacgccgcgaggatgttgacgccgggggcaatgacgtccggcttgaggatctccggcgcgcggtagttggggccccggctcgagaacgccgcgacgcgcggcgcggacggcgacttcccgatgaccgtgccccggaacacgatggtcgccgtcggcgacggatcgctctggacgtagtacttgatcttgtcgccgaatttctgccccaccattgtcgccgggacgaggtgggagtcggcaaccagctcctcgccgctctccgccgtgttcaccagaatcatgccggcaccgccggccaccttcactgccccgcctttcgccacacgggcgttgctcccacgctcacacagaacgatcttgccggaaaccttcgctggatcgagctcgccgattatgcaaagccgagacccgcagtcgccggcgtacaccaccgggagcagtgtggagttcaggggttcgccggagtacagggacacgccgccgtagacctgaccgttgcctagaaccacatcagccgggaattcgcggtcgatggtagatgcgccgacggtcagtatccatggcgcgatgttcgtcgcggtgtactcgccggggccggagttgccggcggacgcggacaccacgatgcccttgctaacggcgtggaaggagccgatggcgatggagtcgcggaagaagctcggggcgtagccgccggcgccgacggagagggatatgacgtcgacgccgtccgcgacggcctcgtccatggcggcgaggatgtcggagtcgtagcaaccggacttccagcagatcttgtacgcggcgatgtgcgccgcgggggacatgcccaccgcctggccacgcgcgtagtcgaagaacccggcgccggtcaccggcgaccctgcggcggtggaggcggtgtgggtcccgtggccctcggtgtccagtggcgacttggactcctccgtctcatcgatggcgtggccgagagcagcctcgtatcccttgtagaagaactttgcgccgatgagcttgttgttgcagtaggcggaggcgttgaaggaggcggtggagacgcatccgccggagaaggacgcgggcggcgggccgagcccgtcggtgggcgcgaaggagccgcggccgatggggtagatcccggtgtcgagcaccccgacgatgggtgacgacgcgccaccggaggcggcggcgggcaggagcccggaagcctgggtaaggtggaggaacgccggggtatgggtggtgtgcagctggcgcgcctggtcggggtggacggcgagcaccccaggctgcgcctcgacgtgcgccgcctgttcgggggtgaggcgcgccgcgacccccgtcgctgcgtgcgcgtaggagtagagcaaccgtggccgcggtgcgcgcagatggcgcgggaggcgaaggaggcggccgaggaacacggcgccgccgccgccgccgacgcgcgtggccctgagcgccgggtgctcgggcgcgaggtggaggatgtacgtcgactgctctctcgcggccgccgccgccggcgacgcggcggcgaagaggatgaggagcacggcggcgagatggcggagggtagccatggcgcaccgggggagcggattggattggtcgatgactcgacgccaatgcggcctggagaactaaataagtggtgggccctttcaccgggtctggatctggattggccaatggcgatgccggcgtgggctcgtgggattctttacccgttcggtcgtcgggttacttttgcggcatcggattggacacgtcgggcctcacaagtctaagtatctcatttttatcgattttttctccggtttatccgtgactgctgctccagtttaggaccagtttcgtgctcgttttcatcaggatgtactctcactccgtccatagaaactccattttcagtctttgatataacgtttgagtttttgttttatttaaacgttttaaaattagtatttttgttattattagataataaaatataaatagtattttgcgcgtgactaatttttctaattttcttataaatttttaaaataaaatagacggtcaaatgttaaactcacaaacctacaagtggggtttttgtgagtagtactccctatgtctcaaaaagaaaatctaggattggatgtgacacaccgtagtactattaatttctaccccctccgttccataatatataaacttagaaccgaatgggacacttcatagtacaacgaatccaaacatgttgtccagattcgttgtgctatgaattttctcatccggtcttaggtttctatattagagcaagtttaatagtatagtccactactacctccaattcatctatagccgatttaatagctatttcatacaataattgcttactatactattaatgtatgaccccacctgtcatacacactctgcttcttggagtccgtgctgcagctagctacatatctatagcccgctgctcttctctctcattttttatctcattaaaatatgtttatagttggctaatagtatgctattgtacctgctcttatgggacggatggagtattaatttagacagatatactttcagatttatagtattgatatgtgccacatttgatattagtttggttttatatgtccgttacatagaaaattacttaaagtgaatgggacaccatacaatgtatctggacatatgtccattttcatgtccactgcaagcaacggcaacaaattcagtggtgacagcggcgacggatttttctccttgtcactatgccaccttgttgtcaccggcaatctaccgcgatctatcatcaatagtccaggcgtagttgggaagaaacaccggatgtcgagttcaggcaatagcgtttctgctcttcccaagcgacatccgtgctgcacgatcttcacacgcagaagcgttgctgcgccacatgcttcgtcgccgtatatcttctccgcaagcgcaccaagttttagaatttttttattaaaatatttacaaaaatagtttttagttttgaaaatttacaaatttaatcgcctgccgccttttgggatttttaaaaatcgcccttccaaaaggcggcaagggatctaaatgtaaatttttcagcacaacttgttagctctatgattttacaatttaaaattatattatataaagtcagatgaaataaaactttatatcaaaattatagatctcaatgagatctacaactttttagttaacaaatttttcatttaagatgttttagatatccaaatattcgttacaaaatataaaacacatttaaaaaaatctcagatctacatttcaaacgacattggatggagataaactttatataaaagttgtagatcttgatgagatctataactttgtaatttatcactttttcatttaaaatcatttagagtatcgaataagcattattagtttttaagcaattaaaaccggtagaaagggtttgaacacaaataaaaattttgcatttaggtcccttgccgccagggcggcaggtgattagatttgtaaattttcgaaaaaaaattatttttgtaaatattttaataaaaaaatgtataaataaaaaaaatcccaagttttatagcatctggcccatcaagctagcccgccgggaggctgatcgatccactcggcccagtaatggaagtatgaaacgccaacaaattgggtcggaacgggatccccgcttacgtagttacgggccgttattagttgggccggccgggaagggattacagcaacgaactttagcaaaagaaatgcgccttgagactaatacgcacgtaaaacggtacgataaattaactcaggaataatttagtattagttaaaaacttaaaagtgaattaatatagtttttaaagtaacttttgtatataatttttttttaaaaaatactccttttaacaatttgagttgagaaaatcaacaaaccaattcagcttgagtgtcttgattacttgtatcacttggcagtcttgggctgatgcttttttcggtggtccaattaacgattttatacgaattgattgtaccacagtatccccgacgtcaaatcaagaaaacactacacgaattcttgatttttgctccataaaacaatacagcatgtgtttcttaattatttatgtgctccaaatataataaaacctgtgattctctggagacgaatggccaatattataagcacaagtgcgaatcgtagtagcatgcaaattgaaaatcttccatgccggctgaggtaagctctgacgcatactttgcctataatttctttatatcaattattttttccgtgctgatagctctaagatgagtcaggacacgagtacaaagcagatggcagcggaatctcatctctcccatatccatcagtaataagctttgacctctgcgtgcttttttttgctcacgtagccgtgcagttacgccattttggaacaattgaatcgactatctaagtattttgctagtagaacttttgcagaaatttaaggagtatgtaaaattaaatgatataaattatgataagtcgaaaagaaaatagataaagaatatctgcattgtacgacggaggaagtaaataggagcccatgtacaattccaaagtactcactcgtacgatatcatttcctaaatttatcaattgtatctattattatcagtatgtggtgatcatgaatggtcggtaaaatataatcaagtatagctgtttgtcactgtcagtatgtcagtccctcaaacggttataggggtggctaggattgaaccaacataaattggcgcccatgcttttttagcgtatagaattttatcatccacaaacccgtcacaatccgtgaacgaacaaacttgaaaaatgaaatgctaaacatattcatcttcccttttccacacggaagaacagcagcacaataagtgaaacagtgatgcatcattgcatctgtgcatttaaagatatactcctgagtagactgaaaattctctcttcttgacgacagtaaaaacttttttagcttaacctccatgacaggttactgattaactaagcaagggtgtctcgtagtagtactgtactgtgtagcttaatatagcacgtcagcttctcagctctaacctctcaccattttcccaagagatatcgccatcacgatctcccgtaatcacttcttatataaaaagcaagcaagatgctacgagctaaacaatttctttagttagtcttcactaatcacgggcttaaacgcatcttgttacattctcatcggcaagcaaagagcaagagagaagagagaggagatggtggatgtgaagcacacggccggccacgccggcgcgaggagagtcaagctgttccgggtgccgcggcggccggccagggcggcggaggaggcgggggcgccgctggtaccggctggcgagaggaggaagaggaagatggcggtggcgaggctcggcggcggcgccggcgggcggaggcggctgttcggtgcgttccggcggctgcgggtgcggtggctggcggcgctgtaccgccgctcgctgcggcggctgcgcgcgtactacgccaaggcggtccaggacctcctcgagggcgcggcggccatgagcacgctgcgctcgcaggccgccgccgactgctcgttcggcactgcgttcgcgccggtggtcgccgtcggctactgatgagcgcgtgcatgtctgcagcaccgttctggcctgtgcatgaagaacatgaagccatggagcagtagcacccctgtgtatagacgtggttaactgtccatgatgaattccagtgctgatcttttttctctcttcattttatggatctcgagttctcgacaatgatcagtgttcatcctgttcgtaattagctagcatgtagtacaactttccggatctgaaaaaaacaattatattatgttaaagaagagagaagatagtaagagaaaa

SEQ ID NO: 54867 - DNA, 10385 bp, Oryza sativa
cgcttgattgcttcagatcagtctgttcgatgaagtaattagtactttatgtaggctggtcttccgaattttactccttgcacatgtcttacagtagagttcagatcaatctgggcatctgtcccaatttgtcatcgaataattagtctgtcgagattctgttccctcctcacgtctcaactctcaactgccgtctgctggaactaagataagcgctaatcgtagttggcttgcatatataataacgagtactccctccgtttcataatgtaagtcattatagcattttccatgtttatattgatattaataaatctagacatatatatctatatatattcattcgtatcaatatgaatatgaaaaatgctagaataagttacattgtaaaacggatgaagtaacagtctgtcacttcccttttcgtagccagcagtaatacgcaatagtaactcactgaagctattgcaaatagtaggcttaaggatggacacaaggacaaaatttcagtctaagatgattcccatcagagcagacatcctaccgtacgttcaggcgttaataaagtccaactgcgcctcaagatttgcatgtgttttgttgcttttgtttatgttctgatctggtatagtggtatactctctggactgatgctaagtaaaatcccgatcaaatcctactggagcctggaggacaacgaagcgagacagccctgagcccaatatatcacaatcaattcatggcgtgtttacggccccgtgaggccgtgactggctcagttacagaaaagggcctgggccgtcgttacaccgccagcccagccaacaattttcgagctgggcctccactgctgcgttccgttgttttggttggatcatccggccaaccagcgtcaacaccgggatcggccggccgcgtgtctgacggaaatggcaaattcaaagtttaagcagatttaaatcagtaattaggtagctggaaggagcatgaacgcacgattcatgcacagctgctcggtgcttcaactacacctgacctcacgagtcacacctgcacagtacgtgctacaccaactgctactagctgacgcgagttctatacttctatcagcatgacacatctcgacgatctcgtagaccaactcatacggagatcacgcttaaatactactcgtaagtcgtcgcagctgcaggtggacacgcggctaggcgaccaagcacaagcagcaaattaacaagcgtttcaacaagctggagatcacgagtccggagcagatggacggccacgtcgctgtggcgccgcggcgagacgctgcgttccgcgcgacgacgcggcggactctgacgattctgcacggaagctgcagggtgaggaggaggaagatggcggtggtgcggctcggcgacggcagcaggaggccgcggcggtttatgggggcgctccggaggctgcggctgcggtgggtggtggcggcgatgtacaggcgggcgctgcggcggctgcgcgcgtgctacgccaaggccatcagggacgtcctcgagggctccgcgctcgtcggcgccgcgcgcgcggacgccggggtttgagttttgcactttcacacatctcctttagggcttgtttggttgattgggaattaatccccaagggatcctaggattgagtgaatccctcccaattcccatctcactcaaaccctgtggggatgattccctttgcctctcctaatccctctcctaaaacctgtgttcggttttggctgggaattaacccatggagaagtccaatcaagcaagaaactactgaagcggctgaatactccaataaatagcgcattaaatttgacttatgcaaaaatcatacacagaagttgttgatgtcatgaaaaatactgctaacactgaagataacagtgtatgcgtctatttcttcaagcaagaagcacatcacaaacatgtcttgtcagcagacaaatggtaataatactgttaagaaactttgggcttggcccatgaaggcctggcccaaatacacttattgggcctatcatcaaaccttccatatattggaatgcactatataaagagaggagggggctactcatttgtacagttgattggatgattgaatagtgaaagagagtctcacccctaaactttgtgtctccacttttatacgattatgggaccctcttagactacttcgtgtagtaggagggttgcgtaataaatacaattattttcactttccaaatatctcacatagcaaactcaaaacaggctgcactagctaagtctaaatacacaacaaaacccaaacttctcccaggatctcccaaaatgagagtttaagtacttcatgaagctgctaccatcacattttaattacataaaatccaacatcagtgattgctccaaatgacgaactatagccttctgtgactgaaaaggataaccaatagttaataagatggcactactagctccatagtaaacaagtattcacagtaaacaagtatgcaaaagcgcagtggataacaaccaaattttcccttctgtacaacatctatgaaagcattgtagcaaaaactagacaggaaagttgtaggtacagattcaacaagcaagtccaagaagagatgcttatatactaatatcaagcagttgtccttatatcaattataaaaacttcaaaaggaacagacacctcaattgccaattgatcatcagaatttaacagtaacaaaaaagagagggcatggaaccagggagatgataagcaatggtgattgcagtgaatgctgtaaattcattgcagtacacaagaagccctaagctccatctctacttctcatcatacacagatgcatatgtctctgcaacaagtctgtcacttcatgttatgcttttcaacaagacagttattttaaattggacaaggatcaccagttggtactttatatgtaccagtgcattacatctagtgagaggaatattatgcttggaacaacaataaagaaattagtgcagtacaacccaacctgtcttcacactctaagaattggcaaattagtccaaattaaccaattttcggatcaaggtaaagcaataagatgttataggcatcacattttaattactgaagcggttctattatgccaaatgtcaagtttagtagtgaagcttggtgtgaaaaattctataggctcagtaattttaaatgaaaatagatattgaaatgaaagtgactctgcttgtaagatgacaaaaactgctcaaatagaagcatcacatgatgtccttcagcatcaactgctgcatatcaggagatccactagattttcacttcagctagctgtaactgcctagctcccgctttgcagcctcaattacaagcatattatatggtattgaatcttttttcacctatcctaaagccaaattgtgaacttgcaatggcagtaccatatgcagtactacttaaaatgcttgcacccaaataatcaaaattttggaatcctaaactaggataaatagatcatcatgcttaacagagaaaagatgcacaaatggatggacggtttccaggagaagcttaacagcggggcaaatttcctggaggagatgaacagcgtagtgagtttagtgaagaagcagcggatcaacgaccccagcatgatgaactggtcgctgcagctcaaggacgctatcgacgaggtggagtttacaagaacagcaagaacaacaagaatagtcaaagaatcgccttgtgctctcctccgcctcttcttctccgagggcgccacggcggtggcgcagtgggcgagggcgatgggcggcggcggcggcagagtggatgcgccgacgctatgctgcgaccgggagcggtgttcgacgggatggcggcgacgacaggaaagggagaagagaaggaaaccctaaccctagatttggaagaggaggggagaggaggaaaggcagcgtgctcaccggaaagaaggtggcggccggatgagagagccgtgctgtcgccgtcgccgtcgccttcgggtcgcgccgcccgccgcgcgccgcgtcttcgttgcgccgccgcctcctctcgaggtttttttccacgcctcgggagtagatgatttattcccgggccggggcgcagggaaaacaccgggatgggccgggttaaaatccagactgggcttaaccgaaaacatatttttctgtgggccggtatcctttccatgccgggattatccgtggggaataagttcatctgagggcgcacaacgggtttccgtcacacaacgggtcactcaactatcaaaaccggtgtagaataggtccctcgacgattttgagggcggttttggctgacgtggcgcctacgtggctaatttgactcagtattcatctgacgtggcgcttacgtagcaattcgatccgaaaaaataataagacccgtgggacccacatgtcagtctcacacagaaaataataaaaaatggtgggacccacatgggccccacatgtcagtccaactcacccctcttcttcatcctctctcccccatctcccctctcttcatctctctctcctctcctctcctctgtcatcaggcgacggagaggcagcagcgatgcgcccggacaacggtgcctatgcggaggagctcgcctgagcgacgccggcgccgatgcggcggggcgcggctgagtggaggctcggcgcgagcgtggccgtgcggtggtgccggccccggtgagggcacagcgcgggtcgcgccctcgggggtgcggccgggcagcggtgccgatgcggaggagctcgaccgagcgacgacagcgccgatgcggtggggcgcggttggaaagaacaacacggaatcaatcgacaccaaatttttatcgtatttcttttacgctgtttttccttctcttcgttttgctcctcccgatctattgcaggcagctgtcatcgtcatcgtcgtccctccggccggctggtggtgacgctgcgtcggagcagctgctggctgctgctgcgtgtgcatctccgcagcagcgttgccgcatgagttagacgcagcagcaggtgaatttttgtgttgctttcctgggataaattttggtggcaacattttcttcttctttcctcggttctcttcttcttcctatggcgccggtcgccgtggagtggcgctcgcggctgctcgggcggcgcggctcctccggccatgcgccccaccgcatcggcgccgccgtcgctcggccgagctcctccacatcggcaccgttgcccttccgcaccattgaggccgcgacccgcgctgtgcccgcgccggggccggcgccgccgcacggccacgctcgcaccaagccgccgctcagccgcgccccgctgcaccggcgccgccgtcgctcgtcggagctcctccgcataggcaccactgtccgaccgcaccgccaccgtgtgccgctgcctctccgtcgcctgaggagaggagaggagaggagatgggaggtggggagtgaggaggaagaagaggaggggtgagttggactgacatgtggggcccactattttttttattattttctgtgtgagactgatatgtgggtcccacgggttttattattttttgggatcgaattgccacgtaagcaccacgtcagtgccacgtcggatgaagaccgagtcaattagccacgtaggcgtcacgtcagccaaaaccgccctcaaaaccgccgagggacccgttgtgtctggttttctggatgagggacggaaatcggattcgttgacaagttaagggacctcatatgaacttattcctatctgtggggattgggccccgatcccggccgttcccggcccaaccgaacaagcacttaatttgcatcaaaaccctcctgcaatccttgcatgcattctgcgtgtcgaaagaatgattctgtgcatggcaaacgtgaacaaattaagcaaacaaatttgacagcaatttcgcttcagagttcagatgctttatttatgagataatctattctaaatcattaagtttgttcgagtacaacgatttgacattgacattgtctctttctataatatatcggtgactttatcaattgttttataatacgctattgggttaggcattcttttcaaaaatacccaaaatatccttatgaacatactaggttaacaattgatttatctcccaaaatatccttatgtggcctccttacgcaacatggaaatttgtacaggagtttcaagttttttacatttctttttttaaaaaatttataacttatcttttatatggtatataaaagtatttattattattattttttaatataaatcatctttcacatactaaattagatatttttatgctatcactcttgtataagcaaattttctctcgtatgccacgaaaaaatattttttttttaaaaaaataaatataccaaaaaaattaaaatttgtatacaaactttcatgttgtataaggaggccacatacaaaaatcatattttttttgaagcttctaataagataaatcaattgtttattttgtatgtctctaaggatatttttgaaaataaggtccagccctggcatatcgtagaacaattgttaaagtcgccggtatattatagaaaaagacaatgtcaatagcaaatcgttgaactcgaacaaattcagtggtatagaatagattatacagcaactacgcttgtgctatatcaggaggaaacatacgtctcgggttccccccgagtgcacccatactgccatccaatagttcggtttacaacagacaagtatacaacgtacgaaccatctgaaaagagggaggtcttctctatttgtggagaacggaaaacatgggattagggtctgaaaatttctgggagctggtttggatatttgttggatccatttttcgcttgagaaaccccaaaatttgaaattggaaatagtataggggaactctgggtgatgcttaggcttggtccttttttaaaccattccgagacatactagaacgtgggaaggtttaggattgcaagatcaaaccttttatatataggggtttggccggtttaattggaaaaaaaaacaaccaacaacataacatccaattaaccattgaatcgtttgttcagttttacatctattttccctcagcttttaccctagttcatccattatcgtcagtattacgatgtaagccgtccatcttcatcgcgagagttttgaatcttcttatagatttatcgcaaaaatcttccgttcatcttataagatggttggtcacttgtctaatccagcccgctagtcggctttgatttggaaattcattctgattgggagcttttcaagatcaatgtggataccgcaatgttttaggtgaatcacgtggtgatgaaaaaaaaacgtgaatgcgttgtattttgttcagacgacgcatgtagcacgccaattcattgccagtggacggcgacggctactcgacatcaatttccatcatggagactaatcaagcaggtgaccgagaatcactaacaagaagcttagaagttgccattgtaattatggatacggtcataagcatccatataaatagatgataccccgcactttgctacgggatatatgttagatattgatgaaatgatttagattaaaatattatgaaaataattttagaatgatgatttagcatatgtatgtttagttatatgtatgtttagttttagaatgaaacaaattatatgtataattactacttgcatgcttacatgttgagctttacatatttagtgtgcattagctctatagtgaagggatatgcagggatcatccattaatcctctgttttctttgttttattctgcttaattatcatataattccagcctttgttggattttttttaaaaaaaacccttgcgtagtgtttaattgcacggacctaatagttgggagttgggaacaaccgagtcaaaagaacaaaaacaaggaagccatagtttggcttattttaagcataagcgaaactgcatatttaaaaaaaataataatttatgaataaaacttttatatacgtgttcttagcgatctaaaagcaaaagctaaaaaaataaattttgataaaaaaacttcaaaattaattttaaatttaaggttgaaaatttaaattttaactgataagtataagcataagcgaaaaagataagtccgcaaaactataacactgccgattgatcggaatatcttcttaaaattgttgcatggcacgcgaacatgttaagcgacaaataaatttcagaacaattcgaccgcttcaaatctatctatctatctatctatctatctatctatctatctatctatctatctatctatctatctattatatactaaaagtccattaaacttcctacaaacgctctcaagccaccacgtgtcacttctacaatcgctcctagaccgccatgtggcaatatataatctcaccgttgattttcacttaaatcggtggacccgataatttagaccattagattagattagttgtattgacaccctaataaatcagaaaaaatccttaaaaactaaactcccatcgcccaacccttctggctggccccacacgtgcctaagtacgtagcaggtacgtttgcctccatgtgcacaatccaattcctcccccccaatctctatttttttttctaaatccacatcataatttctattctattttttctattattattattattattattattattattattattattattattattattattattatataaaagtctattaaacttcctacaaacactctcatgccgtcacgtggtgctctaaaaacactctcaagctgccacatagcactctaataaaataggtaaaatcttagaaattctgaaaaaaacccctcaacctcgattttcatttaagttggtagagtattagtttacaccgttagaatagatccattataaatagtaatatatccctcctaacttaccatgtaatacttactaaaaaatattggcggaaataagccaagaaggcatacgtgcgtacgagttaaccactataaacgataaaagaagaaatgatatacagaataaaagaaaaaaaacatactgcatatatacgtactacgtactactggaaaaaaaacattgctttttaaactggattttcacttcctaaaaacattgctttttatataaactggattttcacttcctctgtattttttatgacggcgttaaatatttagttaaactaccgaaagaaaacaatgatttaaattagattttctattatacttcctttggattttttttaattttagtgaaggtggtagtataagaaaaatatattacttcataaaacatgcacacccaaaaatagatctagaatataatataaaatatcaaataaacgtatcatttcacactacaattgttgagtatagatagattctatttgcatcaatgggcctacatttatagttaaagatgaaataatgagtaattaaaatattactcaggacatttgtcataaacacatataaaaaatgtattgtttaaaaatatatcacatttttctcgcaaaataaagtcaggattttagccgttaatgacccaatctacgctttgatttgtacatattttttaagtgtacaagtaataaatgtaaggttgacttctaaagtacttattagattggctctccctcatttatcttgagtatgttctccgaaccattaaagtgttggtgttttacaaatactttctatacatacatacatacacacacacaaacacacacacatatatatatatatatagagaagttaatgttcatatctaaacatttaaaaaatattcatactcattcaaattgggtatatactcaatttaaatcttggagcccatactccatgtagcaccagttaatttacctatatatgtatatatatgtatgtatgtatgtatgtatgtatatatgtatgtatgttatatgtatgtgtgtgtgtgtgtatatatatatatatgtatatatatatatgtatatatatgtatatgtatgtatatatatgtatgtatatgtatgtatatgtatgtatgtatatgtatgtatatatatgtatgtatatgtatatatatatgtatatatatatatatgtatatatatatatatgtatatatatatatatatgtatatatatatatatatatatatatacatatatgtgtgtgtgcgtgtgtgtatatatgtacctatacagggatgcgctaaaccgcgcctgggtgtgcaataactaaactactcccctcacagcacccca

SEQ ID NO: 54868 - DNA, 2193 bp, Oryza sativa
tattgatcttcatattatcatcccgcaccttttggcctgtccattccaactgcaacccacatatttctcttgcacacgtagtaaataaattactctctgttaatatctttttattagtaaataaattactcggaatccaattcattacttctttctgtaaatggattactctcgagttgttttcagccgttctcaattggttccttctctcagtaaatgaattactgtcgggttgttctcattcattctcttagtaaataaattactattacaccaatctcaacataacatattgatattgccaaaaaaatctcttagaaaccaagttactattacaccgatgattctcaatgtctcttagtaactaaattactattacatgcacgaatccaacaaacaagacggcgctagtgccacatatcgatgttgagccgacaaagcactatagatccttaggtctcccatcgacagatatccatcacccacgaacatctagagaggcatcccacagccacctggatatagacaaaaacgattacatcatctaagagaagtctttaatttacactcataaatgactctaaatgaaatatgattcgccgaagaagaaataaaatgcttcataaaaaattgagctaccagtttaggttccttcatgcctacttttagccaacagatcattttttattcagactagcatggaggtcacattatgttttcttaacggtagttcctgggcttgcctagtcccgatctgtaatcgatgacattgtgcaaaaaacaaaattaagaatgcagttggctgaaaaatgtagaataggtaattgggatgcttcaggctaaaatatccagatatctctgattaataacatacaagttaaaagctacacaaaacctgccatcttttcagatgaaaaacgatttcaagaataaaaatggaccgaatgttcttaatgaaaagaataatcataaattcagaatgatctagcattcactacaaattgatctacaatggatcgatggaacatgcatgtatgttatacagcgcatcaacgaacacaagcaatcaccacatatctggagcccgcaaataagctgcaattaactgatcaaacatggcagctatgcttcctcaaagaaaaacaagtagctattgcctatagagattgattgagtagatagaacatggagagaaaataaaacaaattaagcatcctgactttcattggaacacatacgaattgaacatccatccatccatcgatcctgaccgccatccccatgcctgctttgcgtggccagggtctccagcgcctgctgccgaccggcacgagtgcagactgcagaatgtgaaggaatcagaatacaggagcaaattagcagaactgcagcagcaaatcggtaaaacaacaaagatgcaaagtaaaaagttcaaaattgcatggactcagctgcttaccctcattatcatcgtgcatcacagatcatgacgccaccgctgtgggagggaggcagcgatgggaggcctgatccgtgccagatccttcgagggaggaatcagggtgtggtcaacgcagccggaagctcctccccgcatcccgccgtcaaccgccccctcctcctcaagagatcctgtcgatgtcgacgccgattcatgggcggggtggggaagggagcaccagatcgagcgaggacctcaactcacctgtcgatgtcgacgccgattcatgggcggggtggggaagggagcacctcacctctccatggctcggcgcaaaggacgtcggcgacccgcgaccatcgccgcctccgaccgatttcacccgtcgttaaccgatttcgcccatcgtccgccgcccgtcgctggaggacacttccaccgcccacgctttcgtccatgagctttgtccacgctaccacgcaggatcatgcgtggaagatagtcgtgcgcagcaggaccagctgcatgcacacgctaggagctggatggttttgttcaaattactgtgtttcagatagggttaatgattctggactgatattcttgatagtgttttgggtatatacgtacctagtatatgtgcgtttaaataggtatatagacaattagaaatgatacttacccaaaatacgagttttaattcaataaaaaaatagttttactgggtatatacctagtatgtgtaaataggg

SEQ ID NO: 54869 - DNA, 2655 bp, Oryza sativa
tttcaccggatatgtgttttttcttcttgccaagaaacggatttggcttttgtctttatcaaatgccatgcacattctcgaacgatgattatgaaggttaacttgtcattcttgcatgtaatcgattgagtgcgatgacaagttaatatatatacttagattccaaattttcatgtacttaattatattccgaaatttcgatgtatattactcgtataacccaatcgtatcattatataccttattaatgtgtaccaatcacattccatgcatagctaaacaccagtgcaaaatgctaaaatgtattggtcaaattttttaaatatataaattctgtaatttgaaagtgcaacgcgctaatttagatacgtgtacataagcctaccgtactactacacattactcctacttggtactgaaaatttcaaataatcggtttccacgtaatatactttgcatgtgtgtatccacgtaaaactacaattttcacaacccgaactgattatatacctactttacacataacccagcggatttgctataattatgtcgatagatttttttcgttgattacagttgattctctggccgttggatctgtgtttaagatccgtgcttccatattgactttttcctcgcaaagagacctgaaagcatatgctattgctagctaatctctaaagtcatgcaaatccaagtgaaacgtcacctaatttcgttctatatgtatgcatccttttctttaacacaaatttacaccccgcttacatcctacttacacatgtaattactatgtaattttgagacttacatctgtaattttaaaacttacattataaatacactaaatttacatatgtaatttagagacttacaatgtaaatacaagctgaccatttttgggtgaaaaatatggcgccataaatctagctacaccctaacccagaattgattatttatacctagaaaacattaataaatactcaccttttttttgcatcttggccggatgtgaaaattgacatacccgaaacccaaaattaatgaccttaaatttgctatttacctttgtcaaaaataatataaaatatcccactttccaattatacggaattgattttccataaattatggatgtaaacaaggacattaattacagcttaattacggtatagttgatacaggatcatgcatgcggcaattttttgaccagccgttgcactttctaaatcaggaatttaatacgggcagacccgttaatcttcagtccgcatcaatctcttgatcaagttctcatccaacggtttatacccatggagcccatacaccatggtgccccaaatggccatcctatatgtatatgtatatgtatatgtgtatatgtatgtgtatatatatatatatatgtgtgtgtgtgtatgtatgtatatgtatgtatatgtgtatatatatgtatatatatatatatatgtatatgtatatgtatatatatatatatatatattcatgtttgtaatatttaatacttaattagtcctgcgttgataacctacgtcgtctttcatgccctgcctaaattcaaccaattagattgaatgtagcctaagtaggagatagattagattatttactataaaatttaaaattaaagaatcaagttaactacattattaaaagattctgcttaagctcaaccaattagatcaaatttagcctaagtaggagataaattagattatttactataaaatttaaaattaaagaatcaagttaacttcattattaaaagattcattactttggatcatatatattctatggactagcttttgttaactaattcatacatttttaagaaaaaagcaaataagttttgttgtctttctcgctatttcttagctattaaactaaagtagaaacaatcaataatattggatttttttagaaacacgacacacgaacaccctactcctttgagtacctctaaaagactgatccaacacgttttgagattgaggatgtcaccacgggcgtctcgctgtcgacgggtatgccacctaccactgaaagaatatttagccgtaaatgcgagcacccgtatcaagtctaggacttgaaccaggtagacaagttacaccacaggaaacctaaccaattgaattgtgctcacttcgcaataacattggataataaaacaaccataatttttaagctacataactggaatacttttatgccttttaaaccggtgaacaatttgttataactgttagatctatcttatataaaagttaagcatgtatttatggtacatgacatttccaaaatattactacgcaattatatttcgtcattatcgtattcatattaggttgcatggagcctttcacccaccctacatgaaatgttcatagatggatcacctctcaaactatatcaatcatattagcttatataaacccatacatttagtggagcttcatgtcccacccaattcatctctaattgaactattataatagatatgtaattaaaaaacaccttactttactttcgttgacatgttttccaaaaaatatatgtttaccttattttcaaatgataaagaagattataaataattgcttatagatattccttaaatatgatataata

SEQ ID NO: 54870 - DNA, 5801 bp, Oryza sativa
cacggttggggtcgacgtggccagacccaagctcgaacgggctggctgcctggcccgtggccatgtccttgatggcattgccatcattgtccacattgtaggccgtcgtcatcatggccgacttgattgccgctgggctccaactcggttgtgccaccttaagcatagcggcgatgccgctcatgtgcaggcacgccatggacgtgccggagatgatgttgaactcgacgcgcctattgtcgatgacattggccatggtaggcgacatttctccggtccatgcagcgaggatgtcgacaccgggggcaatcatgtcgggcttgaggatctctggagcaaagcggttcggtccacgacttgagaaggctgcgacccttggagcagacggtgattggttgatcacagtgcctaagaagtcgattcttgcaaccgggtcggccaccgactgtgtgtacgaatggatcgtttcggtgtccttgaaggtaatcgtcgacgttggcaagatatcagcgaagctctgtaagaaatcaccatattctggagcaattgaaatgatggcaccaacaccaccggcttgttggacagcagcttcttgcactatggggttggtagtattttttgtgccatagcagaggacaatctttccggtgaccatgttgctggaaagcatcccgtattcacacagagcagaaccagcatcaccaccgtacactagaggtagaaatgaaccggctgtgttttggccgaaatacagcgaggtgccgatgtaggttccgcgattatgtccaaggacaacgtgagctgggaaccgacggtcaatgcttgatgcgccaaccgttatcacccatggtgcgaggttattagcagtatacgtgccagggccatcatttccagcggaggtggacacgactatgcctctacggatggcattgaatgcgccaagggaggtgggttcgttgtagagttgtggctttagaccacccaaggaaagggatatgacatctactccatctgcaattgcctcattcattccggcgagaatgtcagaggtagcgcacgatgcatttccatcatctctccagcatactttgtaggatgcaatgtgtgcacgtatagccatgccttgggcggtgccattggcatagccaacaaagttagcgccagggaccgctgaaccagcggcggtagatgcagtgtgcgtgccgtggccttcggtgtcgagaggtgacttggactcttgtgtctcattgatcaggtgacccatcttggcctcgtgccctttatagaaaaactttgcgccgacgagcttgttgttgcagtaggcggtggcattaaacgagcgagtggagacacaatgaccacggaaggtgcgaggtggtggaggaaacgacgagtcagcggtgaaggatttgcggcccttgggataaatgccagtgtccaagatcgcgatcaccgcgcccgtgccgccgccgtttgatgcctgtacgaggccaacggacggtgagagacggaggaaggagggagactgagtggtgtgcagttggagatgctcgtcggggtagatggcgaggacaccagggtggtccgcgatgtgcgcggcctggtgcttcgtcatgcatgccgcgaagcccgtggcggcatgggagtaggcatagacgagcctaggtgctgacctgtcacgcccagaagtttccccctttttccttgctttaaatatttgttaaataaatcgtccgaagaaattatcttaattaacctagagctaattccataattaataaatgcaattaataatcggaaatagcgtggtggaatttttcttgagttccccatgctccaatgcattaacaagatttttagtggaattttcagagccttggaaataattttaaccaattaaaaatcaccaaagtgcaatatttaatcccaggaaaatccttctcctctttttcttttcttttccttcctttttctctagatgggccgtcggcccatctctctcatcgcgctcggcacccctttcctgggccggcccgctcctcctttcccctccccgaagtcctccctccctccctttctctttcgggcgccgacaggtggggcccacctgtcggtcgtcccctacctccggtcgttggagccggagctccacccgcccgcgccgccgccttctccactccacgtcgcgcctccactccgcgcccgcacctcgcgcccacgtcgccgccctctcccccgcatctcccgcgcgcgcgcgcccgcaagtggtgggggatttgaaatcccccaacaccctctctctctcctccacctctccacgtcaccggccaaataggggccatccccggccgtttccgcccctccctcgcccataaaaaccctcactcgagctctctctctcatttcccccattcaccgtcctctcccacgccctctaccgccgtcgcgccgcgctcgccgagctccgccgccaccgcccatctccggccgcgtgccgtcgccactagggccgccgccgtgccaagccgccgccgccgctagctccgccgccgtgtgggccatctctgccaccgcctcgcgtcgccggaaccccaccggaaccccatctgcctatcgagccggagagctatccattcccctccgtctccggccagccactttggtcgtcgcggttgccttcttcatccctaactcctctcctcccctcctctaggtgtcgccgccgctcgtccgcccctcctctcgtcgggtcgtcgtcgccgccttcgttttccgctccggccgccgtgtcgccggtgagtcctccctccccctcctttcctcaccttcccgcgagcgccggccacgccgctgctccggccatgcgccgcctcctttcggccgtcgccgccgcttcccgcaccgccggtcaccgccgtcggtggtcgtgcctcgccgccgcctcgccttggtcggccggtcggccttgaggccgagccgagcccggccagcgcctccctcgcctcccctttgagccaccgcctggtggggcccacctgccaggcgccacctccctccctttggagccgctgacccgtggggcccacgtgccggcgccccccccttcgctgacgtcagccctgggtattattgcgcaataattaattaaggactttttctttattagtaaaaacacagtttatcttctaaaatttataagtaattcatccgagctccgtttaagtccattcaagtctcagtaaatcaagaaaaatgcaaaaaatccattaaaaatagttttgtttcctgtttcagcagtcttatagcatgttttgcttgtgtgctttgtttgtcgcgtaggtttcggccgtttcgtcgatccgcagttcctcgaagacgttgccgaggtctcatcagttcgagagcaaggcaagtcatgcaatacgtttgatcatactgtacccaatttacaaatatcccgcatttctattaaatgttgcattcttttacaatgtaatgtgggatgggtcctattcctcagccacatattggttaccttatgccattgataacttgggtatcaaaatgactagatgttggcttaggaaatgcttagccatgcttagttcaactaggacacaaatggggatcacattattacatagactctgactattggcatagctttagattggtgccaccgcaagggtgtcagttaattaaaatattctgaatggcgggctgtgggtgcatggttttgctggtcgcacccatggcagttaaggaccggttcacgggaaaccctgggagacttatcgtgcttaccacaagcgggagtgggtaactgcttgatctgaagcatagctcgaccctttcctaggcaccggtggcgagggtgggcgtgatggagttgggtcggccgaggtgttcggttgtccagctgccggattcaccgcggcgcaagaggggaccgcccactgccttttgaggggtggggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagtttaggtggttggttgggcctattgcaacgtggtgtagcgttggacagtgattggttaatattgattaattactacagctgttttactgctttcaactactgctttgaaatgcctgctttatgcaaaagaacccctagcttcctttggttatatcctgcatcatacctcctcttccggtatgacttgctgagtacagtgggtagtactcagtcttgctctcttttcccccacaccagagttgaagttcttctccgttggagccgtctcagagaggttggtttcgttgctgccgtcaaggtttgcctgtggagtggagtcgcccgctgctgaagtcaagcttcccggtttagctcgctttaatctttcccgctgcatttgtaatcttttatatttttctaagacgtgggtctgtatgtcaacaattgtcgtttgtgtaccctggctggtcctggacagggatttaatgcacattcagcttagaaattctggtttgagaatttctaggtgtgacatgacccgctatgcatgtgggaaggaagaatcctttgaaggaaggacgtatagtgggcatgagcaaggtgtgccgtgtttgctgcatgggcgtgcacgacgtgcacgatgtaggtggatacttcgtctgattgctccgcgcctacggatgtcgccaccaatgcggcatttagcaagcttaacacaatcaggaagtttttgcccatggtgacaaatgagatggacggattgattgaatagatgcgtgctgtgaatgatggagcgtatatcgaagacatgaagggccggggtatatatacaatgaaaatattcctactctggtcacataatgaccttgaaaagtaaatttcatgcatgcttaggatgcacttgcatcttctcttctctctgtgtagtttgttcttcctaattgaggaagcgagaaaatttcaaactttgcgcgtgcaccctcctccgttcaaagatatggttgcagcattgcctggattactgccacactactagtctactacagccagcttccacaaggtgccaagtcacatttttgagccccactctggtcctccactggaaaataatatgaaccattgatctcatttcatcgatgggttaagatctatttatattaccaccctacttagtgatagtagaaatgtggagatgtattattgtaaaaaaaagtgttgaggggtataatcgtcttagcagtgacttaaatatttttttctttttctttttgctttttcgatgaaatatgagcgatgtcagtggattgaatgatcacagattgataaaaaaaccgtaaataacaaagttacccctaatcattgtattagtaaattactaatttacccttaattctacttagtagtttataatattgcaagtagagagcttccgagcattgctcttcttcctaattagctgcgtgcttccgataagagccattatttgtttttaaatttcacataagatgcataaccctacacatgtacacacatatataccaacaaatatatcttctaacacacgttcaaagatatagtgatcaatgataatcct

SEQ ID NO: 54871 - DNA, 4850 bp, Oryza sativa
ttattgtaacaaccccaatagtattttagttttttaattgatctacctacttcgtggatcagcgtggaagaaattttctactagtatattattttaggagggagggaatagaaagtttcttgtataatggaagtcaccaatattaagcgaaccggcgtgacgaaatcccattattgacactgattaagtgtcgtgtcatggaattaacagtcgcattgacgaagtccctaatctagaatcagaagctaattccggcccccggttctcatgtattagctattcgctgataaaaagtttatcgcgcgctatgaattttgaatattcctcgatcaactgattattctcatgtttgaatgagtgatttctagagccaagaatagtacgattccgtgtgtaatcggaaaaaaaagaaagaggaaattatatttgagctatcgtttattgctaacactggtggagaaactctttgtagtcccggtttgtaaccccctttagtcccggtttccaaaccgggagtatcaatccgggactaaagatcgctatctttagtcccgggtgaaataaccgggagtaaagatcgatctttagtcccggttggtgttaccaaccgggactaaagatagagctgacctttttttttttttgcatgcccctgttgctgcatggtttatatatatatatatatatatatatatatatatatatatatatatataaaccatgcatatatatgtttcaatacatatatatgcatacatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacggtttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttatatgtatttgaatcggagaaatataaatgtagagcatgtgtactcacaggaaatttgaacttccgcctaagtctttctctccatttgccgcggaccaaatgacggaaccgataccaagccctacatggagtttaaagctatgatttgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgtttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagataaaaaaatgtattaggataaatgcgaagtaacatatatatatatatatatatatatatatatatatacatgtatatatatatatatattgcatttcacgttaacgttcgtcctcgttcgttcgctcgttcacgttccctagctcgttcacgttcgttcgatcgttctcgttctcgttcacgttgtcgcggcaacgtacgttgacgggttcgttctcgctctcgttcgttcgatcgttctcgttctcgttcgttaacggcggtgtggcggcatcggggcggcggttggcgcggcggcgtggcgacggcggcggcagcgtggcgttgtggggccgtggcggcggcggcgtggcgtggcggcggtggcgtggcgtggcgtggcggcggcggcgtggcgacggcggcggcggcgtggcgttggcatgcggcggcggcgttgcgcggcgtcgaaggcggtggcgtcgaaggcgacggcgtcgaaggcgacggagagagatcgagatcggagagatcgagatgcatgaagggagatgcggcggctctcaccccagagatgcggcggcagcggaggaggcggaggcggcggcgaggacgacgagctcgagacgacggcgagatacggcggcgtcggcgcggggatttgccctaggcagtggcggcggaggagagaggccgagagagatcgatcggccgaaaacttttaagtgttggtgaagaagacgagggcgcaccgggaatatatatacccctggatctttactcccggttgttctcaacaaccgggagtaaatatcttttcccgctatttcgaaattctttttaaacccggttagggttaagaaccgggactaaagattaagcactgcatatgattttcgcttacatatgtgtttataaaatag

SEQ ID NO: 54872 - DNA, 3490 bp, Oryza sativa
agtggataaatcgtaatagcaaatatatgacttataattaataaaaattccaatatatatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacttgtgtgatttaaaacttttaaaaattgtaagtatcacatataactaacatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattcatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgtcctggcgcgaattagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgaagaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacacagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccaggggggaggttgtagatacacatcgtaacgggccaagtgctatggccgctgctcatctctccaaaaggattcatgccatccgtactcaaaccaaaccgtatatttcgtgcgtcctttccaaattctttaaattttctgtcgatgtttcgccactgcgaaccatcagcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgcacgttgtctcgggcaatttgtttccccccg

SEQ ID NO: 54873 - DNA, 712 bp, Oryza sativa
accgggactaaagatcccggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgtaaagtttagttttagactatccttttacaactcttttcattttgaaaatgtgttgtagtttgaacatttctaactctcttatctatattaatatatgtctagcctcacctctgacaaaaaaaaatgtaatctaattagtacgtgtgcatgttttctttctaaggagggacccgttacgagccatccgatgttgtccgcatatatcagtggtggatgtatcggggccaggcgtgattccattcccaataattgagagtgtattctaatttcttaaggggaagtcccccgtatataatttttcccaattctatataaattgttgtgaaaaaattatgaaaaattcacaatattgaatattgtgatatttatctatccaccaaaaatcaagttcaaatctgacttacacatcaagaaaaaaaagataaattcagataacaatacgttactattcatatgcctaatttgtctttttttatatctcgacg

SEQ ID NO: 54874 - DNA, 1161 bp, Oryza sativa
gacgaaattgaatataacgtgttagttcagttaccctgaattatttgataatcaggagctgaatagatcacttgagatactgacataagttatatatgtttgatgcttctccccatttagtaatactcctagtacatgcttaattctaaacttgtcaccatagatagttgatgccttgtatggccaaattagtggtgttgctagcatacaatatttggacaaacaaccttacaaaatactggagtgaaaagcaatgatattgtccatttcacttgattaaagtggtgtccttgcacacagaattttagataatatggttagttcagttaacctgtatgatttgataatcagattctgcaaagataaactaagaagcatcttataaactatatatacgtttctcagcatcatggtagcaggtgccaggacatttgggtttttggtcatagcaatttaatttctaggtctaaattcaggtatatgaatatttgcatcctaacgacattaaaaacagtgtgcgtgtaaaaaactaaaaattgaacaaaaggtttataacaagtgcgataacatttactcccctgtgctcccccccccccccccccccccccaaaaaaaaaaaaaaaaaaaaaaagctcctagcatcccaatgtggaggtaaatgagttggtcattgggtaggtaaagggtattgaagggataaaatttctcaatttgagaatcgctggtaggtaagaaggtaggaactgatttattttgggacaaagtttgaactctagaagttggtttattttaggatgaagggagtagcattcaaataatgactgtgcatgacgtgatattgcagacagttgttgggacaacagctttctggtctggatgtagaagacttgcaaaatttggaaagtaagctggagatgagcttaaaaaatatccgtctgaggaaggttaaattacaatttgttaacagtccatccacttctaattcttccttgacataatatcaataactactttgactaacattcactttacaggacaatgtcatgatggatcaaattcaagaattaagcaggaaggttgttaccacttagcacattcactcaacattacttatgtacactagtctacttggtccaaatcttattggagtgagataatttg

SEQ ID NO: 54875 - DNA, 71936 bp, Oryza sativa
  unsure (1)..(71936): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgcagaaaaagaacttgagtcaagggagctgactcagaggaatctgaagttggaagctgaactacgttccttagaacccctcaggcaagatgccttacagctacggtccgaggccgggaaactacagtcaataaggcaagagatgactgcaaaggtgcaggggttgttaaaagagcttgagcatcagaattctgagaaccagaaaatacctgtcatgatagctgaacgtgatgctcttcggcaggaactagtccgaatgaggtactgaactattctgcatcatatttcgtgtaaaatgattgcttcttattgcttttcttgatggatcaagtgttagttctaagttgctgcttgaaggagcgcatttaggatcctttcctacagtttcaattctaaagaaaaaaagtggggtacttgagtatcatcttcctcttttcaccaggtggaagatcaaactgattaatatcactgtaggggaacccttgagtacgagaagaaggcaaggcctgatctgacagcacaggtgcaggcaatggagaaggatcttgtttctatggctcaggaatctgagaagctgagggctgagattaagaagagaaatgcacccagtaggtttcttttcttttgctagcttgaaagttatggaaatcaatggcgctgacccacaacaacatactatgtttgattttaggtttcagcggccatggagcttatggaccaccaatggcgactccagggatgggcctgcaaggcgtctatgatgatggctatccttccataggcagccgctatggcactggatcttgggcaccacatgatccccatggttatccacaactgtgactgggcttctgatcgttcttccctgggcagtgctttatcttcgtaatatcgcttgatggttgatactgatcgtgacaaagcttttctcttagtagaacttgtggtgcacagtagatggtcttttgggggtgcacttcaagtgttgttagtttagcatatgtagcaatataccagctatggttgccttggtacctctccaaaaaatgtaatcaatgatgactgtaagagggaattcagtgcaacgaagaagaaaaataggaacttaagctttacaagatgcaagtttgcgtatgaatataacaaggtggaatcagtcagggctggatgttgctcagaagtttgtccctaccaaattgcaatagcaaaaattacttattcatgagcgatatctgcaatgcgcagcatcatgagctgtgtttcctgagcagatgcatattatttgctccaggataattaatttaattttgtaaatgagtatctattcgcaacaagcagtgcaaatttaaatgattctgctattacttgtgtgaagtttatacagtagtcgtacctgaagtttctgtgatgttggtgtgggtgcctaacccgacgaggcgcaaatggcttctctatgcaacgattagtaattctgagcgatatgattctttttcccccaatctccattttttggagtcgaatccaaggtgtgaccttgagagagacatttgtccgtgaaaagcacgagacaagtggcttgaagaagattgaaggcatcctaaaagcaccagacaaaatggaagatcgaagagagacggcagtcaagatcacttgcttgcagttgcagacaacattccatcaattatctttcttttttatcagtttattagatattgcaaacaagtctatcaagcacaggtcagcaaattatcgaatcccttcaactttggagtaaccgagcaaatactgataccaagacaaggatccagctatttggtgggggtgggggtggggggttgtttttttttttgtttgaactatccggctagggttagattcgaaaatgaattcggactttttcccttcggtcacagaaacttatacaaaagtgctaatatacagtgtaaacaaatacggtcctaactcctaacctattaggatagttttggaaacaaagacctaaaagcatctccaacaacctcttcaaatttgaccttagatatccattttgtcagcttgttaaaaatttagatagccaatttatctttcactccatcggcctttctatttaccctatccaatatgatagtaggtctcacatgtcgatctatatatacttcttcctccctctattgtttcctcttcccatcgttttcgtccattcccctacccctacctctcgttgcctcagcccaagtcgccagtgcaacccatccttgctgcctccacccaagctgatttagcaagtgatttggcttggctaatggcaaatctgttggatactggtttttctccaagtttactaaaatttgacttggcaagctagataagtagtttgttggagatgctctaactcattactttaatttttaggcccatctctagctctacttgttcatagtattttttttatacaaagcatggcatctagctataaatgtatgccttatgcacttgttttttttttctcattcctttttacaatctaattataaaatattaaattgaggtttaagatggacaccatcagggttcacgattccaaagaaaaccggttgaattccgtggaaaaccgaggtttcgacatggctcggaagtagaggaaatctggaatttcgatgggttttatcaaaattcaaatttgaattgataaaaaagaaaaaaaacaaataaaatcctataaacagtatgatattcatatagtctatttgagtataaattttccagaaatttggtgtattccatgtatttcttgaactttatagtaggaaagaaaagaataacgatttaaagaaaaggaaaacactttcctcagccgaattccaaggagtaggcccacttagtacttagcccagttaatagaatagaaaggtgatgtggtcccgcacctgatttcgctcagaatttcgccaaagtcaaccggttttcgcgagcatattggtaaactcagtgaatttgtagttaaattttggtttatgaaatttgttcaaaatctacctgttttccaccggatttcatgaaaattgtcataccgccagagcctggaacggaaagtcatctcagaattgtaaaccttggacaccattagtttgtacgtgtttatacgatatcgttatacacatatacagttgctatttttttttaaaaaaaagtagtctactcttttatatagaataacaattgatattttcaggcaatttttcataagtccgtcagacaagtattttaaccgtattcgtttcatgtctatattcgataatatttatcttcgtattgaggatattcatcatttatatgtttccaaatccaaatccaaaacgaaaacgagaaacaaatacggtacgcgtagtcgagttttgtttgtgatgagtttgagttgtgactgggcttctctcccgttaacagtgagagagacctttttggtacacaaaaaatcctcatcatcagagggaccctgcccgaaaaaggtctctccctctttttacacacatatattacgcgacactacccctctcctctttcgtttctttccccttctccgctcctcctccccctcgcgagctcggcggcgggcggcggcggcggcgcgatgaaggtctccatcaaaacgctcaagggctccagcttcgagatcgacgtcgagcccaccagcaaggtacgccgcggcggcctcccccctcccctcctctgatctgtgatgtgatgccctgtgtgtgtgaatctaccccgtcgccgcggcggcggcgggtttgcagatggtgggggtgtttggatggatcgggttggtctagagcgccacgggggttagcagcagcgtggatgcagtggggggcggggatggggctctagggttgcgggatttgggggtgagggggattggggagtggtaatggagggcggattcatcgtctaggggcgtggcttttgtgctggttaggtaggtggggctctgttcgtcgccgctgcgagttgggggagctgctattgagtattgagtgttctggtgtagtatatgatggttggaagcaatattaggttttgttatggctttgtatgtatgcgtgtatctgcttgatgatgtattgattagcgtagtccgcgattcagtaccgtgtctttatcttccatcgcttttattgatattattgcatactggagcttggttgctatgtgttcagcttgttgtgagcggatcgcgggattacggatatatctttatataggtgtgtgtgcacgagtaagctgtatttaatgaccgttggaacaggcaggccatgaatttgtacttatacgcgctggtatcgttgtgttattatggctcgtgtgatgaggactgtttcttccagtaatgttatatatatgactagaccatggaacgataactgtagcgtcattatgcaatatttgtttgaatctaagatttggactagggatagccactctagcaaagctcttaaacctttgatcatagcgcttaggctcttcagcacataacttaatacggtatgttttctcattcgttttctatattgttttgatgatcaaagggaggacaatttctgtttatgcatatagttccaactagtttggaatatatattaacgtgtgataaatgctgcttagttattccacatgagtatgtacacatagtaactattgtaaaaattgcccatcagttaccattaactatggtcaggtggttttactggagtgatgttaacggttagtcggttacgttacaatccatgattggaatcttaatatgtagtactcattactgcactttttcatgactcgcctccccagatacatcaaagcaatgttttcttgccacgtgaacaccatattaaattgattaatacaaatacattctgtttgactatgattgttttatgcaggtcagtgatgttaaaaagctcatcgaggttacgcaaggagataatgtctaccccgctgatcagcaaatgctgatccatcaagggaatgtccttaaaaacgacacaacacttgaagagaacaaagttgttgagaacaacttcattgtgataatgttatctaaggtgcgttaaatttttatcattattatagtagagagcttaatgctatctaaggtgcctcagtatgcaacatatttgtgaaatagcacaaatatgggtcatgcctcgttatgaacgtatgatgcaaatattttcctttcaggattttgtgatttatctatgctataatttttattaaatagaacttggacaattctatttgcagaagggatcatcaagtgctgcttcaagtacagctaaggagcccacaaaacaggtgcggtagaatagccatgtttcattatatcattgaatctgtttctcagtattatttttcccatttttttaattagtgttctatgtggtttcttagaatatcactgatcaataaagtaaatgtgctaagtcttattcaactgatctggaaattttattgactcactcaagaggaaatctgctctgtcctatatatttaaggagaactaccattgacaattcaagatttctacttgttgtatacctgatatgagattgtactatttcttttatacgcttttcctgtaaggtttttggtttaataatatcatctcctggatacatgatgcccatccaagtatatgatttaaggagaactaccattgacaattcaagatttctacatgttgtatacctgatatgagattgtactatttcttttatatgcttatggttgttggcttgtagaattgttattctctttttgtaatttgacactgaactcaaaatttcgcttgttgtacaatcaaattaatatgtatgtcttgcagccctcagttgaccgggcgatacccactgcgcctgcaacccaaccacctgctccaccagcacctgtgtaagtatccacccatattggcctgactgaaatcattgagcacttatgtgctcaaggatccatttttctcagtccttaaattgtctttctttaacaataactgtagttagtaactaatgttctcttggccattatatccatcatggtgatatttaggtccacatcttaatttgcaaattgagttcttttgttgccacctaattgcaacgttttgcttttcccagtagcgagcctgtgactgcaccagttccaactgcaacaactgcttcagctccagcagctgctgtcaccgctgcatcgtgagttgttacatgtttcctttgaatttaagaatctgatcaatcaccctcttttgcttttgttcctttgtttggcattgttttatttggcaagatatgaaaggccactttgacaatactatctgataatttgattttaccagcaccgaagcagataattatggtcaagctgcgtcgaaccttgttgctggaagcaatttagaagggactgttcagtcaattcttgaaatgggtggaggagcttgggaccgtgacactgttatgcgtgctctgcgagctgcatacaacaatccagaacgggctgtggagtatttgtacaccgtaagaatcatttctgcttacctcccatgttttccgtgtcttgttgcttggacttcctgacgtgctattatgtcgtcaaaacttttaaaacaaatagggagtctcaaaatattaaactaatagaaagatgttgttaatctgtgttatttaagtttttgcaatgccttgttgaaaataataaataaacagatcaaaaaacaattttaacgacataggcactttcttgtcatgcatgctttggtatgtgcccttgggcaacaggaaaccacttatttcaaacaatggttgcacccttttctctcctttgaacttatttctgccacttctgctgcttttcgggcacaattttatcatgtgactaatctattgcactttgtgtatttgatatagggggttcctgagcaagctgaggcccctgctgcagttcaagcacttcctgtccctgctgcagttcaagcacttcctgtccctgctgcagttcaaccagttgacccaagccaggctccccaatcagctcaactttcaattccatcatctggacccaatgccaatccattggacctgtttcctcaggttctgcctccacaactcacacaaccacatacacacgcacacaaaaagtactagttctgaattctttcaatttttttttcaggtccttccaaatgcttctgcaaatgctggtggtggaaatcttgatgttctgcgaaacaattcacagttccgtggcttgctttctttggtgcaggctaaccctcaaattctgcaggttactttttcatctttttcttctagttgttgtactctatacgacatatgcactgatgtacaaattctggcatgcagcctttgcttcaagagttggggaaacaaaatccacagattttgcaactgattcaggaaaaccaggctgagttcctgcgcttaatcaacgaacctgcagagggagctgaagggtatgcattgcaagtttgccactagtgatgtcagtatttgtatatttcaacattcgtttttgtgcttgacgcttgataccgtaaaccaggaacttgctagaccagtttgctgcgggaatgcctcaaacagtggctgtcacacctgaggagaacgaagccatacaacgtgtaagcactatatgtgttcttctgcagtaccacaaaaccgagccacttgtttcatgccatcttgttgcttttatccacgttttttgcacctgcaagttgtaacatcacgtcactttgttcttttgtgcagctggaacaaatggggtttgatcgcgatctggtcctggaggtattcttcgcgtgcaacaaggatgagctgttggccgcaaactatctcttggaccacatgaacgagttcgacgacgacgcccctgaaccaccgcaataagatgactgacccgtttttaatgatacatgccagtcacacaagagacattgggttgcaaacagtggtcaccaagactggtgattatccccgttttagaacatccaaatccacccatccatccaggcgtgagaaaaatgtttttgagcttctctcatcatcattcttttttctgctttgggatttttatgatgattagtacatactctagatgacatttacagactacatataaccaaatgtttcaagtcttcagtgtcggttaactgcattgagggagaatgagttgaagttagagaaatccatgtgttcaacttcttatgctcttgtttttttggaggtcgttgtgcacgctcaaaacgtgcttttgacggtatgatgcataccttgacagcacgtgatatgggccgagccctttaccgacccacataatatggcccgcacggatgccacaatccatatagtatgggccgatcttctgttgcatctaatgggccgggtcgcaggttcccaaggggtcggacgcaggggggtttgcttcatctgatgttctgacgcagccacgcagggtggttcgcttttcggatttggagatttcaaattcatacaaattttgctgttacatggagacacgccgttctaacttccaacctgtttaaccgccaccaagctcatgcaatccggcaaaactgtatacaacgatttcacgttcatacacaactgatctcaaaattgtctgatcagacacaaggaaattcgaattttagcaattaattttgaggctgttcaaattgatgtcattttcaaccatactgtttttttttgagaaagttgtcaaaaaaaatgtctacatttagtttattgtcaaatttagtaaatacataataaatcctgccaaaattttggcaatattaccaacttgccaaaatttggtaaggtttattttggttataatctgaacatgcccttttaagtcaaatttaggggtttcttcattgtagactatttttttcaccatggatttttaatggactgctaatagcacatgtatagaagttttacacattatttttggttgcttcattcattttctacatctgtcattcaaacgatcagccgtagaataaaaaaaaggcatgaatttttatatcaaatcaataagttagcagtactattatcatttaaatgcactagcaaacatgactaattaattgagcgtaaactgtttccaatctatgcacaccacgatgaattgattgaattcacatgatactatatcacatggtaacgccggcttcatcgccactcccatcgtcgaacaaggtcctcttccctgcaagatggccaaatcatcatcatcatctactaaccaaagccagaaatgttataacattaaccaagattgactgcacagcaagtcatcacatcagctacaaattaaggcaagagcagcacctatgatgatggttaaacaattaaagatcagcaacctctgcatattacctgtgctaggcgtgtgccacttaggagtgtcgtcctgatctggcactgccaatcctgcgtcgtccttgtcacaaccagctctccctattcttcgtttcttgcaccatgaaaaatcaggccattttgtgacgcgcagaatgcggcctccaatctcggacacgccgtcacagtggagcgcaccattgtagctgctcgcaacatcgtatcttatgtatgctttcctgtgaaatttggaagagcagaggtaaaatggtaatggaagtcaaaaggatagttgaaacaggtagaaaagatatgcatgcaggaacaggtttttctgacttaccctgtgcttgtgccatctagattcacgggagttacaagttttttcatatgatcgttcgcgaaaatttcttcaagtgcgtgcctaatctgaaatgggcaaattgtcgaggggaattccctagggcccatcactccaaaaggcaagccaacgcaagaaggttaaaaggaaagtattcatccgtttcatattataagattttctagcattgttcacattcatatatatgtctagattcattaatatctatataaatgtgggcaatgttagaaagttttataatatgaaacggagggagtagttagcaacagtatagttaccgttccaatctcgagggatgaatcaaagccggtcacacatacagtctgcattaaataattaggcattctctccccacgagtaggtatatctctgaacaattcggaagaatttgtgcaatgttaatgaggcaaaaacaatagcatagcgataaagctgatgaagtcacagttaacagacatatacctgagaacagcaaagtccttgggatcgaaccatgcaagttttaaagggcgtcccatcagatgatatcccataaaatggtagagtgcctgaaaatcaatataaacagtgttgtcatcctcaaacattgcaacatgaatcatgagaaaataaaaactgtgcagtgctacaccaggtatacaacacaaacaacagagataaggctttacactctcagcagcttgttctgtagaaaaatcaacaactgcgagatgcctcgtgctactgaaataaataccaacaatctcaccaatctcctgaaaaatgttcttcctataaaccaacagttggaaatttacaatcaatggtttaattttcagaaagaaaagcagttataatttcaaaagccttacacttgattatattcaacataattggccatgccccagctagcaatcatggtctgctgtggtactttctcttggactttgtcttttgcgggtgctttcggctgtacagaacatcagaccaggattacatgaagtaacaaggattgatttctagaaagaacatttagatttcgtggaggagtctggagtttaagaacatgaattaaaaacatgataatgtccatcaaggaaaaaaacattgagtacttaacttgtattggtttttccccaaaaattttgcaattccatgaaagaacaacttttatggtagttctgactgaacacaagcacattggcagatagcgccaatagcaacatagaaggattagtccttaggaaattttaactggcatcgtaagaccaggtcaataataggaactcaattacatactagtatctactatataaatgggcaccaaaagaaaaaaaaaatccatatatgcggtattaataaaccattagttagtgaaagataaacaattggccatcagcccaacatataccatgatccatgtcattatggccattttctttgaaagattaatcagattgaattggaggtaacagtgattaggtctgattagaactataatgggtgtatatccatcagttgcagatcagctcctctgttgagaaagtagacatggatatgaacaagcctgcctgcctgcctcaatcatcacaaagatacaagtccctagtaaaacgagagccgttcacctatcctcttctccaacgtatgcaacgcaggcgaaaaattaatcacgggaaatcgttgcagagcagacatgggatgagatgaggggaatagatggcattccgatattatatttggataaaatttcaccttcttggggtggcgataagggcaaccgaagatgatgtagcggcggaagtctctcgggggagggcgatgccggagcgggaggcgggggctgctggcctctcctgcgctgcagctgtaacccgcccaatggtggcctgaggactcgctccccgctcgagtcgtcttctcccccgtcgccattgttgacgatcccgattcttgtttatgcgctgagcccttgggaggattagacattagggcttgttcgtttaatcctcgcaaggaaaaaattggaggggattgataagaaaaaaataattttcatatcataatagatataaaataaattctctataaatctccctcaatcatcttgtgagagggattaactgaaaccgtatggtgagacgcctgttagcatatttcaacatgtacgaatactagtcaatagtttcaatctatattttttttttcttttctcattcgcagtgtacgctgcacatgtcatgtctattcatacatgtccacatgtaatttttttttactcatctgcacccttttctccgcctttaaatatttttttctcctaaaataattatctaatctacaatatgattacatcattgtattccttacaattaaatctttacaataagatatcacacgattatattttgataaaaaatcaaacgatgtttcactcattacaaaaatttgtttcaattcactctataaaatgtttcagagaaatacaacatttaaaaatatgggctgcaacactagcaaccacttatatgaaacactgagtcctaaatgagtgaaaaaaaatcatataagagatacaatatatttataaaaacctgatattgttgaaatatttttatatcgcatatgaacactaaactataattattgaaacattataaaatacttgctaaaacattccaagaacaccacgtgcaatatttgcaaattaaatagtaaaacatcatatgaatactagccgaaacatttaaatataataggtgcaacatttgcaaattaaaatagtaaaacatcatatgaatactagctgaaacatttaaatgtaataggtgcaacatttaaaaaattcatgaataaagctaaatatttttttcatcggattatagccatgtttggtcatgttttaaagatttaattgtaacgaatttagtggtgcaatcgaatcatgaattggagaagtaatttaagagaaaaaatagtttaaagtttgctcaaagaaacttaaaccaacctaacttttgttttctagtatggatgcatggcttctgatgtttgcagtgggcttcacctggtcctggtgtgtcttcatgcgttggcggaggctgaggtgggcatccgatttttaactaaaaaatcgaacgtccgatccgtagtcatcccctaattgtcatgcattagaccttgcaaggctcatttggattgaacgatttccccagggagaattgaaggaattcaattcggaatattttctatctggctcatttggtttgaaggaagcttcaaaggatattcgtaggataagaaaaattcatccacattttagagaaattctagcgtagcatgagagggttataagttataacctcacgttttccagtttctttgatctctctctttctctctctaaccaacatataatctcaaatttcatctctctctattaaaccaatatataatctcgaatttcctatgatgcattccaacgtatgatgcacattagaccatgtcttttttatccatattgtactttggactagggttaaactactttattgtgggaataagatgatggggttgtttatattgtagcaaaaaatataccttaccaaattttagcaatgccaaaattttgttaagttggcaatattaccataattttgacgagatttcatatgtattcaccaaagtttcgttaaaaactaaatgtagacatatctttggcaattttcaaaaaaaatgaaaatgacatcaatctaaacaggctcgatatcatccttcccaggaccaaggctccaactcctttgctgccctgagcttgagcatcacgctcatgcttgtcccttgctgcctttggtactatgcccaagctgagctcaacctctatacctcatccatccaccttcggatccacctcttctcccaaatttagtactccctctatcccactatagtggccatcccatgaatgctgacacaaattagctttgggagaaaattacccaaacacccccaaatcattagctgcaggtagtcatttcaagatgcagggaattgtcacacaagcaccaaccacgtccacagaagggataatttaaacatatacaattactccgtaatggtggcatgcacataatttgaatgctcatgcggtaaaattacaaggggcaagtaacctagctagacccactaattcaaaatactccattgatggtgttttgctgccaaggtgtaccctttcatgtcctataaattctgaaggaaccaagcagacaacctttttccattgcattcatcaaactgtgtggtaaaccaactcaatgtccagacatcacaatcgctatagatctagacatttggaaggcctttgcctgaccttagggctgtcaacgagccaagctcgagctcgagctcgagccaagcctataaaatgttcgaacttttagacaggcttggttcgagctcgatcaagctcaagctcgactaccgagcttgatttttaagtacaataatgcatatttcaaggataatattttaaaaaataattattttctagttcatcatattaatagaagaagaaaaaagaataaaataagtatatgacaccaatacaaggcatacaagtaacatatttgatatcctaatttattacataaaaaaatcatatattactagactcgttggaagctcgagctcggcttgacaaagcccacaagctttgggagaggctcgggcttggctcgtttggagcccgagacgagctcgaatcgagcctaggatgagtcgagctctagcagcttgcgagcctcgagcttttttgacagccctacctaacctcaatgaagcaaaagacaatatagaagaaggaagggttgtttcccgggcagcttaccttgctagagttgcttggcatggaaatgaacatgttgtactcccttttgatctgaacttgcaaacttttgatctcaacatggaagctgcatggaagctgcagaagaaggaatggatctaggttatttttacgtcatctattttttctcaatgcatcacatggatctttatcagtgcattaaatgttgtttgcaatacttgatgatgattgcattattcaatctagtttagaaaaaaatatatggtattctatgacatgtgcagcacactctactccctctgcccctcatgatcagcacacacacatgatgttaacaaaacaaaagattggtactacgataatttgacagtttagctcatctacttccattttctcctaaataatgttaaatatttaagatttttgattcatcaacacaaccacatcgacaaagcaagatttgtgcataatttgattagcaattcagcctacaaattttcaagttatcataaaagagagaagtacaaggtaattcaatgatcactttgttgcacccccatccatgaagtttcccatctgcatgaactgccattgtatgccttcaccacctgattcatcacagaaaaaaggaccagataaatgacatattcctcctcaaaaggttgtgtaaaatagaattatgacagatagctacattaaaaaatcatagaaagggcaactaatctttcacaatgcataaaagaaaatcaacatatagacatgaagccacaacataacattgttgattacgctacatcaatacaagcatagggtagtactggaatcaatactaaaaaaagagtgtaaacttcagttgcatagttgtatgcctaagtcatggataatatatggaatagataatattgttctaacgtacagtatgagtcatgacattgcatatcctaaacatatacaatgtgctttgtggctaggtaaagggtactgactagcaagttgtttttttcagacaatgatcaccaactcaaggagcacacccttcatgttaatgcaaacgcaaatgagaaacaaggtattgaactaggtaaagttcatgactttttaattagttaagaatatgttcatgtccttgatttcggttgtgaataaatcagcataatctgattagccacattaacttaccaagtaaataattttgtagatgacgacgatgttttgcaacatgagctacaagccttggagtatgacattcaagagtatggtgtgtacgccgatgctatcaatgttgtgttcaatgtagacgagttgctcgactcagatgaagaagaaaatgatgcaaatgcaaatgagccaatcaagtccagaaaattgacaaacccacaaaggcaaggcatttatgaattgttgcttgcaaaaagtatggatggaaaagtagaaacgggcagcacacatgtagttgttgaagtgtccaatatgagcatacgtacagtccaacgtatttggaagagagcacaactttgcagtgcacagggagtacaagttaatgttgactgaaggaagcattataattgtgggcgcaagaaggttgaaatagacttgttagttgtagcagcaattccattatagcaaagaagcactatacggtcacctgctgaagcgctaggtgtgtcaaaaagcacatttcatagattgttcaaagaagggcatctacgacgtcactctaactcattgaagccttatttgaaggaagccaatagaaaagaaaggttgtggtggtgtgttggtatgttagaccattgtacattgccaaacaaccccaagtttactgaaatggaaaacattatccacataggccttgtttagatcccaaaaaatttaggacaaaaacgtcacatcaaatgtttggacacatgcatagggcattacatgggaaaaaaaaaccaattgcacagtttgcatgtaaaatgcgagacgaatcttttgagcctaattacgccatgatttgacaatgtgatgctacagtcaacatttgctaatgatggattaattaggcttaataaattcgtctcgcagtttacaggtagaatctgtaatttgttttgttattactctacgtttaatacttcaaatgtgcatccatatacttcaaaaattttacacccaaagaactaaacacacccatagatgaaaaatggttcaacgccaccaaaaaggacaagacttactacctacatcctcttgaggaggagctgtataggattgtccaaaacaagaatgcaattgagaaagtaatgttcttgtcggtggttgtgagacctaggtataatgatgaaggtaactgcacttttgatggaatgataggcatttggccttttgttagaaaggtaacacatccttcttacatgtattgtttgcttatatttatttttgtttttctgatgtactaatagaaacccgcccaaaggagtagccgtaacaaagaaagggggacacttgtaacaaagacttaaggttggtagagacactatgagatcatccatgatctctaaagttctcccagctattagaccatgttggccccaagaagatgcaagaataacaatatttatttatcgggataatgctagaatggatgtcccaatcgatgatgaacaatttggttttgcagtagctctaatgggtcttgatattcgcttcgtgaatcaaccaccaaattctcctgatatgaattgtctagaccttggcttctttgcctcacttcagtccttaacatctactagggtctctagcaacatggaggagctagtagagaatgttcacaaggaatataatgactacaatccaaccactcttaatagagtgttcgtggcactacaaagctgctacatcgtggtaatgaaagctagtagagggaataagtacaagatccctcacatgaacaaagagagtctagaggcacttggcattcttcctaaagcgcttttttgtgatcatccgctctatgagagagccatacagcttatagtttactaattgtgtacttgtgtcatctatgtacatgtgcatctatgtaattgtggaaactaaatatataagttgtttgcttgtattaatgctttatcccatgttatattaacaagttgattgttcatatgcgcaatcacaaaaaaaaagaatgagtactgatatcgaataaagatacatatggcatttcattaagatgttttcataaccatagttccaaaagatgccaccaaaaaagaaacacaccacatatagcatcataggatgaactatgcaccccaatcattatgacttcatattttagactagtaacaagcatagtagaaaaaaacggaccagtgggtgacctggtcgacctctcggtttgacggtccgctggtccaaccgtgaaccgaacggtcgaaccgcagtttaatacatatatgtacaacgtatgtaattgctcaatcataagtgcttggatggctcggtggttaccgccacttgcttctatcatggagacctgagattgaaccctcataggagtatgtttcctctgatttttaccaaccaaaacgctgttggcaggctaattgggccacattaaggcccatctcaatattggtgtggtcttgttcggtcggaccgatggcggtttaatggccggttcatagaaaaactacccggttcaaccggttcaaagcgagtcacgtgcatgcccggtccggtttaatgttttgaatcgaacgacgaagatctctggttccggttttttccggttgaaccgccggtccggttttttccaatatgataacaagttgtagatatatggcacattattcatgtcacacggtactagatgggcccacttcttttttttatgagtactttcgctgttggggacttgggcatcaacctttctgggacaacttctacaacgtaaaacgaccactaaagtgggacggaaggagtagcacacacttgacttagggaggaaaggaggaagaaaatgcttttgatgaccgacatatcaccaactagtccagtccaaaatgcaatcttcggtaacaaagcatatgatccagcttctctccatgtgggctagagcaattagcagctaagcgctggtacaaatcgtacgtatagtgattttcaaagtgaaaatacgtacaactacctattccaatatgcaacataggtaacaaacactagcccaaggtgcaattcactctttcagaaatcctgatgtccaaataagctctcaagatcttttttttcttattataataaaaattaaaaagattaggtgtcccgttccaaataaaataactccgcaacgcataaacgtatcggttcggctcattttgggtcttttgtttcaaaccactcgaagttggaacaatattttcgagcccaccgaaaggcaatcgacgacatcgcaattcaacaacgcacaagggcagacaaacaacatcgaggaggtggacgacaactttaaatattgctcaataaaacactatctggagacaacacacacgagagtcatatccagaggaaaacaatcagcccagacggaccactagcaccaaatgcaaagcaatgggaagaactaattcgaccgctaccaccctagtaaaaaccagagaagagagaggaaggggggacaggaagaaaaacattctagtagaacaggagaagaatccatccatcatggtgacagcagcatgaggcatctaaatcgatggtctccaataacatgcggagccatcgatcgatcgatcttcccattttactggccctcgcaggcgtcgcccttggaggcttctttcacctcatcaccaccgtcctcctgccacagatagtttcacaaggtaaaattagcaagttgctcattaggtcgatggattttgcagaagggagcttatgatgtgttgagaggtaccgtgaggtcagaggtccagagggtcaagttgtccctcaggagctgcatgatcaaagtgctgtccttgtaagactcctccccgagggtatccaactcggagatggcttcgtcaaacgcctgtagcaaacggttcatcagtcacatttatttagagttgatatagcgacaaacgtccagatggcaaaaaagtcagggttcatacaacaagcacagacacatcaaggaccagcgattcaacaatgcataaaacaaaatagtttgttcagatttgacaaacctatatttatcatgcttacttttttgttggctttggccccattaaaataattaccacactatgagctatcactaggcaaatactaccacgtgcacaaatacaaatttaatcaacaataagcaggggaagaatatccaagttaaagcaggaaactatagagtttaatgaccagcaagttaacttcaaagtataaattcaaattaatatcatacaacatatcctaaagcacagaaacctcatactaatgacacaatcatgattatattgaagagaagagcaaatgaccaccaacctgcttagcaaggttgcaagccttgtctggagagtttagaatctcgtagtagaacacagagaagttaagtgccagtccaagccttatgggatgggtgggagcaagatccgccagagcaatatcctacatagaaaaacgtgggacagacaatttcagaaagcattgcctgaatcgactaagcagtcaatgaaatgcatttattaccagatggagacatgtactaattagttgctagagtaataaaatgagaagtgaatcagtggtatagcatatatgttatctcagaattaaaataaatcaacctacctgagcagccttgtaagccaccattgtgctctcagcagcttcctttctctcggcaccagtcttaaattccgcaaggtacctgcaaattataaactaaccaaattagaatagtcaatataaactaaggattcagttgtttttatgataagtgctgcatcattcccaacctgtggtaatcacccttcatcttgaggtaaaacaccttagattctgcagcagtagatgagggcacaaggtgtgagtcaagcaacttcaggataccatcgcaaatcttgctcagctcagcttcaatcttgccacggtactccttgatcagagtaacatgttcctcattgccacgaccctcctccttctgttcaatggatgagacaatacgccaggaggcacggcgggcaccaatcacattcttgtaagcaacagacaagaggttgcgctcctcaacagtgagctcttccacatctacagtctttgcaaccttctccatgtactcaaccatctcctcatacctttcagcctgctcggccagcttggccatgtagacattctcctcccgagacattttgaccaattaagggattactgtagccagataaaaaggtactgataagcattcaccaacattaataatctgaaagccatggggtctctccagaaggtataattgtacaaaacagatcatgttcccattcatatcaaggatgttcatttgttgagaaatgaataattaaacaattgtgaataatactactgaatcctacaaattccatcaaatatttaatactaactctttttaaaggctgtaacaaatgaataagccaatatcatgtccaaattcaaaatatttcataatctcaactaagttgtatttgtaatcactaaaaattgttcaatacagaaagaactaacagaaactcaattacagccttataatgagggatatatctaaacattgcagatcaataaatcataaacatggctaggctagatctaaacgtcgcatcaatccacccacgagacaaacactgattttccacaaaccaagaccacctacctcccaatccagataaaaaaattatcaccccaataccgagcaggcgtgcacctttcaccgctacatatatatagatccccacactattaacagattaaacctagatctaatccgtggatcaaacgcagctaataaccgataccatcaacatacttccacaataaataaataaataaataaataaataaataaataaataaataaatctgtctaacttttccaaatccccaacagacgtttgctcaactcagagatgataatccaaaaaaagcaaaaaacaaaaatccccacttctaaacgagacgaagctcgccaaaccgagcggatctactcccctcgcgtgcacgggatcgcagatctcacgaatccaatcccatccaaatcacccatcaccaccgagcacaccagatctagcccaaaaccacatcccacagtccagaacccaccaccccaaaaaaatcgccaaaaaaaaaaacatcgccgcacgccttcccgtgagatcgagcacgcctagaaatgcaaccgcgagaggaagaggaagagaaaaaattccggcaaccctaaccttcggtggcggcggcggcgaggcgggtcgggttcgagtggtctcgtggatgcgaatgctttttgttcggcggagaggaggggttgggaagacgggtgcttttatagcagggaggcttggcacgggagccaatggtgtggcgccacgtgtgcggcgagccaggctggacagcggatgacatgtgggggacgggtcgcgcctgggcccacgtgtcagtggggggtatagttggcgggtctggttggcctcggtgcgcgcggtcggtgggggatatacccttcctcctcctagctcgtgagatacgcgttttttcgtatgatgacatgtgggccctggagttggtggggccgacgtgtctgtgtgatgacctgataatgtgctgaaaaagaatgttttttttttagttttattttaggggctgatataagtggaagcgcaccatgggtgatgcaaattgcaaaatgacctgtgatctcaactcaaaaggggaaaaaataagcaactctggcaaaaaaacattataatgttcatggaatgggagttataaattaacaaattaacagttataaaatctattataataaataataattttataatgtttcctaagctgtattgcacggcatatagtaatggcttttgctgacttcagaattctgaccccccccccccccttcatctgttgtttcaaggtctagagaagaaaaggtcagagaaaagctgtttaccaaataccttttcttatttcctaaaaggattcttttgatgttgaactgcttagtggtctaaaagtcttcctacaaggaaaaatttgtcaccgagaacaagtggagattttgcatctatatatattttttataattctaagtcttaaatgtattgtattagctatctaaaacctgggacggacctagagcaaggaaataatgtacagttgtacttccaaaatttttgacaaacaatatgtgatttaataggtagaagtataatagtacatgtatataccattaggtgggtcaataagagcattgttaagcccaaattcatcctttccagaattttatagtttgcctcgtaccaaccaccccagctagaaaaccaaaatgaacttgtgaacctaaaaaatcataaatgtggcttggtgaattatgggcattgtctagctggcatgcgtttaaactagacaggacaaatatggacagtttgattttctgacagaaaaaaacagaggcctctcgtctttctgacgatccttaaaaaaagttacaatgaaaaatagaaacaggagacgtgcctaaacaaattatttcacccgtacatgttcttgtcaaagaaaacactaaaatccctcatatccaagttgcagccattgcccattgctgtcaatcttctctttcaaactccttacgtgtccctgtccagagacaggcacagcacagtcagctcgaaaatatcaggttagtttccatcttaatggcagaaaaggatgccatttccaccgaagcaaatctggaaagcaatgtgtatgatgcaaatccagaattgacacgtaattgacagcatccatacggcaagatctcagataagcatcgagactcatgtcatatgcagcattgaaatcaaatggaaaataattcttgcatgaggctacagggcacacacacaaagacaatggctggtggcaacagactaactaccctgaattaacatgcacagaagaatcaactctcttaaccggtcaactagcaagaggatacatatgctgttggcacaagaacagaaatcttctcggactactgaatttatttcaaataattgcttgtactacagcttaaacttatcagttctggcttaaacttagcagtagtaacatacagctgaatcattggggaaaggaagccagccaagaaacaggaccagctgacctccatatcagaagaatcacaagcattttagcgcagccataaatgtggagatctgttcagaagtcagatgatactgcaaaccccgctgagctgcagacagtacagaagatgtgggaggccataaacatcaataacgcttccagcatttacatgagaaaaaacaaaaggctctaatgacaacgttcaagcagagaaacaggatacacagctattcctcatttccagtgatccttttctttagagcatcaaagccattggccagttcttcccggttttcctgccagaaacaatacaggctgtaagggaaacaaacatttgagtacaactaaaacatgaagtagatctgggtcatactcagacaaataaaaaaggcacagccacgtatttatctacgtgcgacagtaagttgcaccaaatcatatttgacattcaaatggtaagtagtaggagtataacttttctctaggataaaaacaaacggaattgacttgggatggagctgtgatagacatggcaaagctaggtatgtcaggcatggacaattgtcaattggaccgacgtgatctgtactactgaccccatcaataccaagttgtgcatcctccacggttcaaccaacagccttttaggtttgcacagctaagttaaatggacaagactcaagaaactcgtgctgaatagctcaaaagcagcttcactgacagcccacatgattcaagattaccttgaagagcaggtagcggtacacaaaccatcccgagtagccaagcccaactagctccagtatgttcggaagctacatgaaggaagagtagttagataaacaagtgacaccatgactaggacagcattttgcagcagctacaagtaaatgggggaatagcaatataagctgggcatataccactggaactgaatcgacagctttgacaacaatcgaggatagccagacagcgatgattgctccgcctccgtaaaagagaacagaggacttgttctcaatagcatcccactgtgttgtggtcatagcaatcataagattactgactcagtgaaatacattgtgttctcccaagtgaacataccttctctttgagctcagaaaggatctcatcgtcctcatcagaactactctcttctgaagatcgcatggcttgtacctggagtagagcgatcttcggggaatctgctaaaatttgatttcttagtgtacttgtacactttctcagccacatagtttggagggtggccatcaaacagatgccgcaatattgctaaacaactttgccaaacaagtcacaatcattgtatagatcttctacccttgtatactaagtgaaacgtatgccttctttttctctccttgagaaacaggcttctcaatctttttattgaaaaggccaagttttttaaagaactaaaagaaaacacatgattctttaaattgtatttatattttgtccctacagattcagccgatgagatacttttagaacgtggtttggtagcttgagtttttgaattgtccacaacataaacaacacagatacactgactgtaaatagaaagagctaattacaatcaccacttgttcatcagtctgaaaatatgatgtggtggctctcaatgaaagtaatataagcattttgatatgcacttgatagtgcagtggcaagggatcccatatacagggtttcaactttcaaccctgaggtcccatgttcaatcctcaacacgcttacaatttcttcttaaaaaatgtttggagagacaactctccctccaaatcttttttttttttgtaatacaagcattttgtcaagcattgacaattctctcttgtcagaaatacttaaacaggtagcagtgatttcataccctgaacataggaaatcaatgataaatcacactagcccaaaactaggacgttcttggatgagagcacttctttgaaaatttatagagcagaaaagaaatatgtggtaaccaaaactattaagtaatttttcgccgggtaaaaactattaagtaattgggttgggtgcactcaggtcagtgagaggttttctcatatgttgttgcttaacttgtacattaattcttgatctctacagtgaagcgcaaaggattacatgtgcaaagtgatttttgcagtattttactgtaaagagtactggtggttagcagcaaatacacttccaacattagagctatcatcagtatatatgctttgcccttagtgttcggcaacatgtcaacataatactagacattcaggttaccctgaagtcttctgtgaacaacttgccctcccactttgtagagtaatactcagcttaacaaggatcagaagcaagaacttcaatgtgggtggttactcacttactctacaccaatcacaaccaaatgctgcattctactagccagccaaggcgattctaatatcgagtcccaaaatggagctcaaccgttgttgatccagttttatgcttgcactccagtatccaattttttctaatcccctttcctaagaacgatttgacctcgtgtgtgtcgatctgggatccaaagcatatggcgagaagtggttaccttcgcagcgaagggagggcgtcgtcttcacgcggggagtgagccggcggcggcgcataggagctcgggggacagcaatcggacggcaaagagacgccggcggcgccgcggcggcgaccatcccggccatctcggcaaccgccactacctaccctaccttcagtggatgcaggcgtcagcgtcacggatcgagcaaacgctgcgagagggttgagaagcgcgctgctggaagctgcgggaaggaagaacgcataccgcacggaggtggggtggcggcgacggcgtcgccggcgaggtcgctccggcgagaatggctctcgctggcacgcgcggtgtgaacaaagcaaactcgataagcgccgtccgatcggagtttggcggcccagatcgaccaagggcaagaggtggtaggtgtagggtagggactagggagtagggaggatttgtggctgaccgttgcgcccccaatttccaatccaaatttctcaacccctcagggtcaaaaatttaagattattttttgtttgaatttcgtcatccagatcccgtagctctaaaatctaaaccgaccagtttctgttgaatgtagttcaattgggctgtgtctagtttcacgccaaaattgaaagtttaaaaaaaaagttacaagtttatatttgtagaaaagtttagatgtgatagaaaagttagaagtttaaagaaaaagttaggaactaaacaaggccttggtcaaatttcacaaggtcacgtgaaattcatcatctcattctaacttgcatctcgaccaaaaaaaaaaaacgagattgcaagccttgctcctaaaaacattgattaaataatattaagacagtttagatgtacagtgcatacaactttcaaaccttaataattaactttgcgggaggataaaaaataatatttaaaaataagtttgggaggaaagaagaaaggaacagattacgtcacaaaagttgtcatttctcaacttttgtttttccttccctagggtaatgaattcacttggaaatcattcatagcgagaagatgagatggccatgcttatttatctcagcagaaagaaaaatcccgattcttttattcctccttgtttattcatcactcagctcatacatctcagagatcattttaacattagccttgtcttattgcacgaaaagtactcggtagtattatctgtaccagctccgggatttggctttaaaaaaccaagaggcgatcgattactcgtctgcctccgtccatgtcgcgatggccagcgtgtgcctcccgccgcaggcgacgtacctcgcctgccattgcccgccggagtcgccgccgctggttcccggcggcggcaggtcgatggggacttccatcgggtggcccgtcgtgaccttcctgccgtagcccagacggccatggtcacctctaccgtactgcgagaacagaaggggaatacaatgtaaacacattataagtgattccctggagatcaaattttgttctttttagataacaaatcagaatggattccctgtttaagcaaaacctgtggttgttcagggattacaggcttacagccaggcatggttaaagaggaatgctgtttttaaaagttttactgagattcaagtatccaaaaacacctatcagtacttctctggtgaaaaaaataatctctctaaaatatgcaagtgatctgtattaatggagaaatgtggtgtcctcgtcgccagcatttcatagactagaactttgggtatgttctcaagggtgagcagaaaaaaatgttgcatagctgctcggcaacattgactatcaaactgcaaaaggttgtttcatgatacgatactccaaagcacagaggcataattgagtgattatggacttgcgagtgcttatagcagttctaatcagccattattttggttcactcaaatttgtttgaaatttgaaatatttgtctattttcatttgcataatttacaggtggtattacactcaaatggggtcaagatgacaggaatatgcactcttggtacaaagtaactagtagctggagagaaaaacacttacagaaaacattcgtccatcacgagttagcgcaactgaatgggttcctccacatgatacctgcacgcaagaaaatgagtactggtgctcaacttggacaaaaaaaaatccattacctcaggcacagcataggagaattacctgaataatatcctctccagcaagaagctcaaccttttggggaaccatgtgactacttttatcatctccaaatccaagcctcccatgctctcctctcccccaagcatacacctatagaggtccagaaagtgaacagctattaatcccttgtgcacaaagcaatgtttatttgccatccttctggtggcttggcagaaataagctcaaacatgatgtttcagttaaagccaaaggaaggaaatacctctccctctttagttaatgcagttgaatgccaacctccagcagcaatgtcaacctgcaaacaaatgtacaaatgagcaatatgtatgaaactataaacaagaaggtaagatacaaaggcatgatccagaaaattgtgcagacgaatatttatttatcagcatacagtggtagcctataatcagcacaaagttatatgtatagctagaatcaaacatactagtgtaaatggttaggagtggaggtactgaacaccatggcttgtgagatgaaccgagcacaactgaagtgactgtaagcaaacatagtttaacgcaggatccaaaagactaggttctgttttgggctttgttagtaatgtcttgagaagacaaccaccctgttataaactttatttcacaagttatcagaattagaagaaaccaaatcagtgtggctcaccaatgaaaggtcagataatccttcaacacggattggttgcgatcttggttgagtatctccagtgcccagttgaccatactcattgttaccccatgcccacaaaattccatcttctgttagagccaaattatggaatgcacctacagcaatcacctttacattctcaaggccttgcacccgcactggtgtagatatttgcttgctgaaaaaggactaatggtcaccagcacatatagggagaaaaacaaatttcagcataaagcaataaggcactatacatatcgcctggaggccatggttgtccccatgtccaaacatggccatcttgtgtcaagacgaccgagtgtgtccctccagcagcaacctacaattaacgggaacgattagaaaacccatgctaagaaataaaaggtggaagtgcatgacaaaatattatcattatggaaaagtggagtgcacgacaaaatgttatagcattattctgttacgataaaaatccatttcgggagtgcatgacaaaacattatagcattattctgttacgataaaaatccattttgggagtgcatgacaaaacattatagcattattctgttacaataacaaaccattttgggagtgcatgacaaaacgttacagcattattatgtgacaataaccattcattttggatataatacgttatcacagttgcaaaacatatatcctggcgacccttcaagcgatttacgacctaagaaatgtgttccacaacctaacacttgttgggcaagtagcagatgccaaggtgatagtgcacaatttgttggattcccattatccggttatcccctacaaccatgctgcatcaacaaagacgtgataaaattccagcattctcatggggacaaattgtaggacaagtcaggaatcgattccactcacttgccggactttcagcttgggggcacacccctgcgggatcggaatgtccctcctgagagccctggttccatcttccttcctctcagcctcctccccacactgcccatactcgttgccccctgcaacaacccatccacacgctcacattgcatcaaatccaaccaaatcgggtcacagaattgacagaaaaccaagcaaggcgagccgagctccccgtccccgtaccccaagcgtatgctctccccttgtcgtccaccgcgaggcaatgccatccgccgatcgccgcctggtaattagcaggacacacactcgcattcgttagtgctcactactactgcaggtagctcaaatcgcgattggaagaggaatgatctgcggtgacctgcacgatgctgacgccggcgagggcatcgacgggggccggggagctctccgtcttggtctccggcgggtgcccgagcgtgccgcgctggttccacccccacgtgaagagctgcagcagagcagtacacgatcgaatcagatcagaaacccagcgaaggcctcgatcgagagatggagggagagagagggagagagcgtacgcggccatcggcgcagatggcgagggagttgcggctgccggcgacgacggcggagacggcgagcgcgtcgagcgcggcgactccccgcgcccagtcctcctcctcgtagccgcccatgcccagctgcccgtcctcccccgaacccctacacacaaaacacagagagagagagagaaggcgccatcagcgccgccgccggccgcgggagcgaagcagcaggtcggagcactccactcaccatgcgaggacggccgtggggagggaggaagccggtgggggcgccatgggtgggagaggagaggaggccgccgagcaggggcgcgcggaggcggaggaggtgcgggttttcgtgcgccgcgcacggcggaagaaacagtgtgtgcttccctcgtgtccgagcccgagcaccgagagcgagagagggaggagggggctatctttcggggcgcgtgtccgccgtggcgtgggttttctccctttctctctctgtgcgccgcggtcggcggtagggtttttggggtttgggtggcccaccaaacgtgaggtggattccatttccatccacacccccttggtgactctgactcacccccggccaaatcagtccatttgagcgaggataataatgctcctattgtttcaatcagtcgctgctaaaatttgaattttcaaactcaaatttaaagttgattttcattcaaatttattttttagcattggtatttaaatcgctaaaaacacacacacataagtcttgcatataaattattattgctttcctaatacgtattggctaaacgacgggggtctaagctaactataaacttatatgaaaaaaaagataaagaaaaataagaagtattggttataatgcaagagctagttaaaaacgagattttgagggacatatgtccctctaaatattttttttaaaaaaatatgagtgttctagggattaaacacggaaactcgaagttgaaatcacacacccctgccactgcactaccaagtatatctcaatgcaagagttagttatatacatgtttgttcaagatatttacattaaatttatagtgggagaaaaggagtggagaaaaaaatatagtcaattgttaacatattatacatgttagttgcaatataggctaaggttgtgttcttcccctaccttttccagtgtacctttctcgttttccacgcttcctaaattactaaacggtgtgtattttgaaaaaaaaatatagaaaagttgcctttaaaaaattatattaatctctttttcaagtttattttaactaatacttaataaatcaagcactagctgccgctccattttgcttgttgcgagtgaggttcccgaattcagtctaatagtcaatatttagctttactattaaacttgttgttagagagaggattagtgggggacacggatgcttgctataggtataaagcgtgtgtgtttttttagggaagcatgtgtttatattaggaagtgtattattgcggtgccgtgattaatggttggatgttttatgatgtatgggtggaaattaagtcgagaaaaaaaatggtgtttgctgcgtaatgattaaggccatgtttgtttcattctaagattattataatctagattactgagccaaatgaatgtaagctgaattataatatgccgatatataataagttgtgagctgtttgtttctctggattataagctgtttgttaaatgttagccacccaataattttaaaaaaacacctttagcgtggattactggattatagtaatctggcttatagattgtaataatctatcataatatgctatatgtttgtttcagcttattcctaataatccaaattataataatcataagctgaatcaaacagggcctaaactcatgtgccacgatggtaaaagacggtatggttgggtttagttcgcaatttttttcccaaaaatatcacatcgaatctttggacacatgcatggaacattaaatgtagataaaaacaaaaaactaattgcacagtttgcatggaaatcgcgagatgaatcttttgagtctaattagtccatgattagccataagtgctacagtaatccatatgtgctaatgacggcttaattaggctcaaaagattcgtctcgcggtttccaggcgagttatgaaattagttttttcattcgtgtccgaaaactccttgcgacatccaatcaaacgttcgatgtgatacccaaaattttttttttcgcgaactaaacggcctatgttggttttatgttggtatcgaagtgattgtatgagaatgtccccttttatatggtcatccatccttttcttaacacggtcaccaatgctgacattttatacatagaaaagggtatattgttttaaggagaaaatgagaaatgagactaaaccttggatgaggaactagggtttcgatcttccaataggtattgataaagtcgattatggatactcaacgatgatctaaaggctctgatcaggacgatcgaatccctcctaatcactaaaccactcttcgattggttatcaaccgagccgaaatattactgacctcctcgataagactatctcttacaagcaaatcgagaatacaagcaagtgagtggaagaagcaatctgaaaaatttatgaatataagacgaatctcacaagttggatttcacaaaccgaagcagcgtgaaactgcaatgccataataatataagcaaatctaaccataattcggagacaactactaaataaataagttatatagtcgaccaagaagccctggacgagtctctaatggactccaacacgatacacaacatgttaagacggtgacgtgacactcgtatagattctatatgctctcttgtttcgacgattcatgttgacttagaaggaattttgatgtgagacaaggctcattcgaaagttggtctcattatctttccatacataatggaatccgaatgagatctgggtgacgattttagtgcgggttgctcttggattctgaggtgggcttgaacttgatatgaattaggcctctatttttcaagtctcttttcaagtgcttcttgtttctcctttgtacgtaccgaaagagtgatgttctcatcaatcttaataggaaaaaactggacgaaaatcataactagaacaaactcacaactaacctaaactattgtgccacggaaatagaaatagtcaggttcactaagcaaatgatgttcatcaccaaatttgcaaaattagcgagctaggagatcaaactatagtcatcgattagtagataccaacggtgatacaagctctcctaattcatgtcgttgtgttatctatctccaatcaattttcatggaaataaaatggataagaatcataccattgcaaaattcctacgctctacgcaaatctcgtgtcatataggtactccttccattccaaaataaattatcctaatatgaaatgcgatgatttctaatataacgaatgtatccagattcatcgtaataggataccacatctcgtattcgatcatcgatggcagcagcatcatgtcatatgctacgaaatatattttggttgcattcgttgatggaagagaaatgccactaaaaggggagagagaaaaaaaaggaaagcacgaattttgcacagctaaatgggccagcccgaaaccgtttatactgggccgcaacgtctagagtgcggcccacgaaaaggatggccacactggctcgcctcaaggaagcccggccgcggagagcatcgcgtcccaccccccaccgccgcggcggcgatggccgccgccgccgccgccaccgcgcgctcctcggtggcgccgcacgcatcgcccacccttcgccgctcgggctcatcaggtaccttgccccccccccctctcccacctcatcacgacatcaccctcatcactgtttcatagttatatgatttggggatccccacagatccggctgcctgtttggcggcgagatttttctagctccaagagagaatgccagccacgaatcgtgcgtgatccgcccgccgccttctgtgccgtgcggttgcataaactagtatactgatgatgatgatgatgatgatgatgatgatgatgatgatgcggcactttcgggcttagtggggtgttgcgatgcaaaaaaaggcagttctgtcggcttggcaactttgcgtggcgagattagtaaatcaagggcatgtttttttttgtttcgatcatctagcctttttaggtagtggagaagctatgtctcggtgtttatggaatttcctaaaaccgatgctacagctttgcagcatgctggatggtgggcgttgtgatgcaaaaacgattccgttggcttggaaattggaatagtgaaattaactgagtaactgatgagcaaggcatgtctgtttctgatcataagctttttagatagagaaaaatacaggttgggatttttgagatgaagatcttcttggaccgatgttagcgcttcggaacatgctgttaagacgagctctgaagaaattagagtccattgatgagtcctatttagtgtgagttacctttcgtaacttccctcttttaaacactgaggtgatgcctgtggtcaggctcttattttgagctgttttctgggcaattagaaagcccaagcattgatgataagattgatacatgaggctatttgatattaaatgccatctgagcacttgagcagtagctgaacaagatgtgattttgtcgagggaatatgtagtgaatccaactgaccattagaccagaactctgaagtacttttgggtacttaaaatttaagaaaaataaacaaaagctggaaatcatctggtagtaatactcctgaagcatgttctgcatttttccgagctttgtcatagctgctaagagttatatcctctcgataacttatcttgcatgaggcacaaaatgtgcttgaaatgattcgcgtatccatcgttctttccctttcatagctttagtcatatcagatttggtattgcaacaattaaaccttctcaaggattggatgatgatggagagtgtggtcgatgaccaagataaggagcaaagaaaacaagccaggtctggagagaaaaaatgtagggtagagaaatgttgtaatttatatattagacctgaatttttcacctgtcgacatttttcatgttcattcaagctactgtcatagtttgtttggattctgcatcaacaaatatctctacagctttttgatgcatccataaatatcgccagtctcctcttaagtgatgctttcactttgatatggccacataggatagctctatatgagaaatattggggatttaaaacttttaatatacagaagtgattagttcatgctaatccttctatttcagttcaatcgtggactgttgtcagtagagaaaataaccaggattgccccttctgtttacgacttcacagcattctaaataggttcaggcgacagacaggtgcaatagacagcgacaactaaacagaagcctaccagtcttctcttatccttacgaccttacaagtcatggccggtaattatgatttatggaggtgattattcatgattactcataagggaatagaaaaataaaatcacatgggtcatagcatttatctggtggaaaattgactgcattcttgttagtacaagtagagacttgaccaactattcatcatgtattttggctgtttcagtggatcgctgcacttcctgagagttcttttaaagatattaccgtctctctcaacgcttaccggaattgcagattcgatctatttgcttcgactgcaaaagcaggtatgtgaaccttatccccaagatatagaagttagcaatggcataagttcctctctctttgttatcaaaaacatgtcattcttttggagtacatgcatatcaagatattgaaacctaaatcatttatcaggctagagctgcggctgggtgcatcccatccactcatttttcagtggccatgctagcctgctagggatcacattgggaagggaaacaatcaaataatccgcggtggtctcagctcagctgcatgtgtggaggacaagcaaatcgccaataacacaccacatggggcaacatcgcgcagacatggcatggaccctgcttgccatctacccctcaccgtttcaatgcaccagagttacagcggcagcaaggaggcccccccattgcaattgaaatggccacatgtggagactgccatatgtttccatcagagatgatctctcagttacagtaagacacatccaatttcgacttgttaccctgatgaaggaacaagaagaagagaaagaagtgagtgtggcagacagagacagcagcaacccgggcagacagctccacgcacatttcacacaaaagtccacactccaaacagctccgtgtgcagcagcagcaagcagcaggccagcagcttccttggtcagatttttccatctcgtccaattccatcgcgttcagtttactgaactttcgactgctacttcggttcaggctttgtttcgacgccctatcggacctttgactgacgtgcttgcttgttaggtcgttcagaacactgcaactactgtatcgtcacgtcgggttttcgcttcgcttgcacctcagctaagaatgatcatagcttcatctgtagttacctaaattaccgaactgtaaatttcatgagattgcaggttcttcgacagtaaaattatcaaatttgtacggttggaaggattttcagttaattaacttataatgttacgcacgaaattttcactgagcattgacggtgctggctcacatgctatctgacaaggtggtcctgctatcaatttgctataaagttacaactaatgtcatgtcgtcatgtgttagcattgttattcttttcgcattttgcttgtatgttcatcctcgattggtgctcaaagccaatcaagcagttcaaagttacaataagggctcctctgaatgcaaggataggagaaacataggattgacagaaatataagtgtaaaataaaaggctacaaatcacaaaaaaggaaaaacaaagatagcgcttggttagatggcatgaaaatgcaggattttgaggagagatcaaaatgaaactacccatgaggttggacctcaatattaaatttcctcaaaacctgcgtggattgaatcatttcatatatatttcataattctatattgtccagcctttgtttctaaggatcatttagaaaaaaaaatatagaacaaaaatcctacaaaatttctatgttcatagttcaaatgaaaggggtttacgggtattttctcaagggtactaggcaaggactaggtattttctctactaagctttttttctcatgtctatttgagatctcctattatatgtgttcaataagggattttttttttactcttagccatcctccctaacaacgtgttctcaaatgccatccttccaaacaactttaattatttaccatccgggcccactaggctattgctattttgccacttttgattggtagctcagcaaaccgggtgacaaaagacttcctagccccttatctcctttttcataccttcttccttggcagtccttcccctttcctcatgtcagcgagttggcctaattctagcaaggtcctgcaagctggcgatggaggtgagctcggagacatagtcggtcgggcttcgcggacccaccgggatagggaggatgttgttgttgctggtggttcaccacccaccccgtcccaacaagctccttgtcgatggaggcgacgataaccgacgagcttagatacacggctggtagggcttcacggtgccgccgggatggggaggtggatgttgctgtcagtccactaatgagctctctctatctctctctctctctctctctctctcgctcgtccgagcatgacaatgaaggaggcgtggatgtcgggaagtctctagcaatccaaacctccatccgtcgcctctaaggtcttccacccagtcatccatcgccgctgtctctgtcgatggttgccacccgtaggatccaacatggtggccggccttgcatcccagctccacaaaggggaatggtggcgacgacgatatgacgggggaggagtggagggagaagaacgggtacagttcgtaggcgggaagctcgccggtgtgtaagaccttgccggagccaaggcagctcgcgaaccaaaggaagtgagttggaagaaagataggagagatgagataatgggtgaggtcttttgttacccagtttgctaagttagcaattaaaagtgacaaaatagcaatagtctagtgggcccagatggcaaataatcaaggttatttggaaagatggtatttgagaatactccattgggaaggatggcaaagagtcagaagccctgtttaacgagcacaatatcgactattagtagcaaatacttcctccgtatcattttaagtgtagctgtggttgccgtgtccaatgtatgagtgctcgtcttatttgaaaattttatgaaaaattaaaaacaaataatttgcgcataaagtattgatcatgttttattatctaataacaataagaatactaatcataaaaaataaaataagatggacagtcaaacattatatacgaaaatccataactgcacttaaaatgggacggaggaagtagtgaggtcgtcagtttccaattacgtgcaaaccataaatatggtgtgcagtggcaactgagccagttcatatctgttcatggttctttctattaggagggaagaggtacatatacacatttttttttagcacgcccatttttctaacctaccatagagttgtaaacctcatctcatctagaacatcacaaaaaattttaaagcattgctctagaggtacaaaatgaagctacttcttcacattcccaatcctcacaatcaaccgtaatcattctccatttaactttttcatctacttttccttctcaatcaatcataatatttctccaatcgtttttacttgctttcttaatactcattcctacttaaaaatgcttaaataggatgaaggtactcctagcctcctagatattgtaaacttaaataggatagaggtattcctagcctcctactagtagatattgtaccttgttaacttcgttcgacactcgtttaattgctaaacaatgcttactgaaaacattaaaactccacacatcagtttactaagaaacgtcgccaccaagctcgatcaatgacggcgaccggacaggctgaaaaattgaaaatacggttaactggtaccgatacatccatgtgcatgtggtctcattctttgctctagcaacccaaaaagaattcatggataaggatttgtattcatatttttgtgatccaaaaactgatacggataaataactgtgataagaaaaagcttaaaatttattcaaatgtttaaatcctagataatatggataagccaaaaagttaaatagggtaggcatgtcttcaaatacttctaccagtacataggagtagcaggagtaggagtaggagtacattctagactgcgaggaatacaaaacgtcacgtgtggttaatccctcctaaccatgtcaacgcgaggagagccgggtcagcccaaccaaccaacccaacccaccaccgccttcaccctcacccacaccacccacacgccccccgccgctacgcaaccttacgcctatggcagctggggcccacgtatccgcgggaccaccatgtcagtgaccgggggtcatgggtactccagcttcgtgcggcagcgcgcacgaaggcgtggggtgtggtggtgggcccggctcctggtaggtgagctggatccagcgcggcggggcgggggcggaggcggcatcgggatcggcgatgattacacagatgaatgcgacgctattggatttgctagtttcgaaatgtttgattttttcttatttaaaaaatttaggtaattattaattattttcatatcatttgatttattgttaaatatatttttatgtaggcatacaattttacatatttcataaaagtttttgaataagacgaacggttaaacatgtgctaaaaagtcaacggtgtcgaacatttcgaaacggagggagaacgttttttttttgagagagattttgggcgcggggcatatgtggtattgctcgtggcaagaacagaggggggtttgggttccgagggataggggggcacagagcttgtgagcgcaggggatgggggatgagaaatgggagtatcgtgcacgagcactactactgccgccgcggccgttgtgatgatccgatgacgtcgtcggccactgttcatgtatttcctctatctatatattttaaatatattttaatgtatgatgccgttgactttttatccaacgtgtaaccattcgtcttattaaaaaattgatgtaactatcatttattttattgtgacttaattcatcatcagatattttttaagcatgacataaatattcccatatttacacaaaaattttgaataaaatgaatggtcaaacgttgataaaaagttaacagcgtcatacattaaaatacagagggagtacttagtacctccgccctaaaataaggctgtgtttagataaaagggttgtaaaattttatagtgttgtatcggatatttggaaatatatttaaagtattaaacgtaatctgataataaaacaaattatataatccacctgtaaaccgtgagatgaatttattaagcctaattaattcatcattagcaaatatttactgtagcactacattatcaaatcatgacgcaactaggcttaaaaaattcatctcggaatttacacacaatctgtgtaacatatatatatatatatatatatacacccctccctcctgtcgcccctctctccctcctccctcccccagcgccccctccctccgattccccctccttttttctctccctccttcttctctcttttttagaaaaattaaaaataaattggtgaattcaagacttgaaccaatgatctcatggtttatgacaagcacttctaaccaaatcaccatatgatgatttgtgaacaaatcagttatgtacctataacaatcataccttgttactatgattcggcagtaacattatcccagaaatatagtaacatcatatgttactggaaaaatgtataggttgttactgcacttttggcagtaacaatatgacgaaatttatagtaaacagagaacatgcatagtaacagtggccctatagtagtaatgtttttttagatctagagtattttaaatctcaatatttagagagtactaacatacacgttatgtcttatttttctaacccatttgcatcatggcattcgtcaaaaaaagtgcttaacgaaactagaaccatcataactattttttaacattgttacagcgaaaagcagaggtgttactgcatattggccatcatgttactacgctgtttcagtgagatgaggactaaaaaaaggtaaatctcaatctttagagagcaatatctctcacatcatatcttgtattttcaatccgtttgcaccatgaagttcataaaaaaacgcttaacgaaacaagatccatcatagctactttttgacgttgttactgcgataatgtggtcttgttactgcacgatgaccatcctattactgcacgattcctgcaagacgagagcagcaaagtggtgggcgggggagggagtggtgggcgggtttgaccggtgggaggacgctttgaccgacgtgggaggggggctttgggccctaggaagggtggggggaggtgggtttgacccatgggaggggggtgtagaatagattttatatatatatatatatatatataatacttcgtgcatgtatccaaacattcgatgggatatggtgtaaaattttgctaggggatctaaacaggccttaaagcaacttactccctccattaaaaaacaacttataagtagatgatgatttgacaccacctaaaataatgaatccaagtttattatcctaggttgatttttcttaatgcagagattaaaaggtagtacctcatccacccgaaaatgtaaacattttttaggttggcacgggtattaactaaggaagtatgtgagaatgattgaagggaatatgtgattagttaaaaagaaaaagtaggtaaaggataatggttgtgattggttgagagtaggagatagatgaagaaatagcttcattttgggacaaagtactatgctagaaataactacatattaggatgaagatagtactacgaatttgaacctcttattccctccgtactcgtaaaggaaatcgttcgatatggtctccaaaatataactttgactacttgtttctataaaaatatttattaaaaagtaatatatgtatacttttatgaaaatatttttcaagacaaatctattcatataattacatcttcaaactcaacaacttgatagttattcataatttatattcccaaagtttgacttaaacattgtcctaaacgacttccttcctgtacgagtacggagggagtactgttaaactcattgttagcaccgtacctctaatactccttgttaacagttctatgcatgtgttacacattcaggtgttaaaaacaacaacagtcctaagacacataccatggacgattcttttgagatcaagctagtaaagctttcgcctgcagattaacgtggaacaagggtaaatatatgaggcaaataatatgactggcatccatgcaaacgcttccttatcattaaaaaaacaattaattggctctaaaaaagttactacaagcttcaaaaagaaatagtataaaataaaacatagtactccagagatgttttatctaaaagaaagatctttgcattatcagagatgttttatctaaaacaacatcagatatgtcgctgtggctcgatggttatacagagaaattcgttgactaaattagcagttctttttctaagtctgacggcgcttaagcggatagaattgatagttccttcgttaccaactgatgtactttgacacatttgatttcactattcgtattttttctacctcctccatttaaaaattactttacacgtcttaaaatactgtaatctatatcttatgtccggttttataatattaaaacggaggtattttagataactccctctatttcaatttcgtatattattttattcgttgcaaggctaatttgttttggaggaataaatttgtattttgtcatataagattaatgatgaaaaatagtactccctcatttttcaaattataattcgtttgactttcttcctagttaaacttctttaagttttatttttttatagaaaaatatagtagtattttcaacacaaaactaatttgagatttaatgaaactaatttgatattttagatgttgctaatttttttataaactttcaaatttaacaaagtttaattaggaaaaaagttaaacaacttataatataatatgaaacggaggaactactagccaagtttgcatggttgaatcaacattttgattattttacagggcatcttgaactgctaacaacgatacgaaaactttaaacatacactattatttttagttgcattttttatttttccatgccttattagccgtagctcaaatgacatgtgtgtcgacgtttaatgtctcgactacggtatttgcatggcatgggaatcgttggtactagggtatacgtgagactgaggtaaaagagatggagacaatgatttttatacaggttcgggcccctgaattgtcaggtaataaccctacatcctgttggccgaagccgatattgctcttattcatgataatcacaccagtataatatttggggtagcctatctaactgttgtcgacttggcggtctgaagttctgactcgtagtcgacaacagggtagccttcctcctcgaatccgtgcccggcgagatcagagatagcgctttcgtctctcctgacagtatccggagacaccgtagggtactagccgtgcttatccctgaagtcgatatccggtggcgtgtcttggcgtatgtaggcttctatattgtggcttctatgtcgattgtgttgggtgttgatcctgtcccctctcttcctaggggggcttgtatttatacccataggtgtccccttgtccaagtagaactagggaaaccaatatagatacaatccgagtagtcattgtcgtttccatgtagaactctggttgtctttccttatccggaactcctcctatatccgaacgttgcttccgtataggacatggtacgtagtgggtcctaccgagatttagtcaactactattaggtatgtggtatccataaccctgacagtagcctccgacttcaatgcaaatgaacgagttcatattctcaaccgcagaccttggaggaactgttatcgagcgcacatgaccattctcggtgagtgtagagataacattagacttcctttatcagcctcgtgtgggtacctaaagggttagtctgagtcaatctccgacgtcaaccaagaaagaacagagcatgcgactaagtctcccgtcttgctgtaatcgagaatttggattgaagtcaagaaattttatctcggtgggtacaccatctcttcatttcgtattccttgttgagatacatcaaccgttctcgagtgatcgagaaagcgcagaatctgcgacggagctttgtcgacatttgtcgtactcgccttagtcgatcttggtgtagaaccatagagacatggagccttcgtcaatgtcgaatagaattttcctgaaatcaatactctgaaaagaatattagatagaaatagccctcgagcgaacgctcaaagggtaacatgttataatataacagactagtgaattgaatgtacagaccagtgttttgtatatgagcgtcttctctcttaccgactccgaccagtcagtttgtagagtcatacactctccctagcccccagccttgtcgtcggagaatcgttctcggatgatgaggctcttggacctttgacctgcctcggttgaacaagcactgatcctagcccccagccgtgaagttgaaaaatccaatttccgattacacggcttggttaatacgcacggcgagaactcttacacgaccagatcttacatggtcttttgtctttaaaggatccgataaggccttatcggctctgggcgtccccagccgaagttcccttaggttcctcggaggccttgtcaagacggcgtaaagggacattaggataggtttcaacgctaggtgtcttctgtggtaagggatctctgggtaaaacacttggcaatattgtgtacatgatatcaactttgttgaagtagaggtaatgggagaatcgctacacctctggtcaagaaccaggtagtagtcgtaactcaaccactagaagtaaatgtacgagagatcgctacgattgactggttgagaaccagtgagtaggtgtctctcgatcatttgaagtcgtggaagtttgcggtgcgggagattgctatgtactggttcgagaaccagcgagcgagtagaatcatctctcgaacaccaatggaagttgcggtgcgggagattgctacgtactggttcgagaaccagcgaacgagtagaattatctctcgaacatcgatggaagttgcggtgcgagagattgctacatactggttcgagaaccagcgagcaagtagaattatctctcgaacaccaatggaagttgcggtgcgagagagtgctacgtactggttcgaggaccagcgaacgagtagaattatctctcgaataccaatggaagttgcggtgcgagagattgctacgtattggttcgagaaccagcaagcgagtagaattatctctcgaacaccaatggaggtgctagagttggtttattgcatgtgcgtctcatatggctagcatgactcacgcacccaacttgtagcatatccggatgtccgttcgcaatcatgtcgggtgatcaagccgacgatgttcgcgaggaattatccgttaacaaccttttctcaagtagtccagcgattgctgtgttaacaaccaaatttggtaatatcagcatcggaagtgaagatgggatcgaagtggagtcggagataaggattgttgtgggaacatagtaaggatcggctggagtccagatcggctacgactataatcggctaagtctgaatcagactgggttaggtgatacagccgattccgacgatacgacttgtatccgatattgggtttgagttgacgtgcttcaagatgattgtcatatatggatggagtcctgagaaggcaattgtatctattaattaggatgttttgtgtaatttccttagagatatgtttagggcaaaagtctgccgcaaagacttatggtatcttagagtttgttagagataatagtcgtgtctggtatggacatatcttgtaattctcgggtataaatagaccccaagccctatgtaaattttaacacacacgttcaatacaatttcggcgcatcgccacctttttgctttagttttatttcgacgagttcttgctttcgggttgagctgcatcggtttcgatcttcaacaagaggtaaaacttgttatgatggattgtgttctcgggattagtgcttccatctttacgacactctagtcttgtatatgtaattcgtcaagttatcatatatcttacataatcttcgacaatatcgtcatctaacctacaatcggctaacatatgtcgacagaaggcagccgactaggttaaatagcgacgttgacctagattatataagatatctagcactttatgaaacatccagcggcttgattgtctagatattgttcttctttcttcttttcatacttaatgctgcatcagttaggtttgatctattaagtcatgcttagaatttcaatctctagcctgccttctggttgccgattagggtagtatcggagtttcagccgatcttatctgatttaactacttttatcttatatgctcgattgatatgttagatcttccctttatattaagatcttgctgcgtttaagtatattaagctcctgtttaatgtattctacttgctttaatatcttaatatagagtggtatcggagtattagccgatacatgctagatctatctgatcggctatgctatgaacatatataatcctattattaatatatatttccatctaagtgatttatactatctcggcaaggtgaccgatctatcccaaccacttgatttaagtatatatcgatataaggattacatatgattaatatctacagccgatcgagtagatttagttctgatttgtttactaatacttgccgatcgatgtacatatgacatcggcataagataaatggtatgtcatcggcatctagccgatcggctatcatttatagatttaaccacgaattctttgtctctatttcttgttgattacaggatcaaatcaactggcacgctcatacatccgaaggcgagctttggacctgcacaggagttaagcagatctcctaggcctcgtgttttctgtcaacaggccggcgctatgagatagttcgtcggtcttcgttggtgggttgggcgcgacgattctgcatttgtcgagatcgttctcgataatatggtgtacttgaccacagcctactcgagtgctcaattgttcctgaaaaatattttctagaagacaagacatatatcagataatatcgagtatgtactcaaaaactacatggatcttctagcattatcaggatatgacgagcagatataaatatcaggcattatgtaaaccgtaagcaagcatgatttatacgaaagaaaatagagcgagcccccagcattaaactgtagtcgatttaacattggggacactcgcgcaataggtattgtataaaaaacatgtaataggtaaacataataaattatagatctgacaatattgtatgatctgagtaggtacgataaattgtatataaaatattgcgtacctgtgaagatacatgccggatgtatctacggaattagtagatcaattaaaaattaatcttactaaataccttgtttagccttggtagccgatcttaactgtactctgaacgcacaataattagcatatatcggtggcctgcatgggccccacggtatgcatgctaatatttttgtagatggcgatgcgatcggtcggctggttggttctaatacggcaaattgtctggcttcgacatcctttgctgcggtggggttagtcgaaccatggtgaagcaccacgactgacaaccctaaaatcgacgtgatccgcggtggtgacgtcttgaagcttggtcgatctcgagagatcgaattgttgatgacgatggttccgatattgtcggaagacatactccggtcgtgttagatctccacagccgaagtcgtcgagtagcttgttgtcggagaatccatctcttaaacccatctcgtcgaaaccttgaagcaccaaaatgcccctacgtggcgcgttactgtcgacgtttgatgtctcgactacggtatttgcatggcatggggatcgttggtactagggtatacgcgagactgaggtaaaagagatggagacagggatttttatacaggttcgggcccctgaattatcaggtaataaccctacattctgttggccgaagccggtattgctcttattcatgataatcacatcagtataatatttggggtagcctatctaactgtcgtcgacttggcggtctgaagttctgactcgtagtcgacaacagggtagccttcctcctcgaatccgtgcccggcgaaatcagagatagcgcttttgtctctcctaacagtatccggagacaccgtagggtactagccatgcttatccctgaagtcgatatccggcggcgtgtcttggcgtatgtagacttctatgttgtggcttctatgtcgattgtgttgggtgttgatcctatcccctctcctcctagggggcttgtatttatacccataggtgtccccttgtccaagtagaactagtgaaactaatatggatacaatccgagtagtcattgtcatttccatgtagaactctggttgtctatccttatccggaactcctcctatatccgaaggttgcttccgtataggacatggtatgtagtgggtcctgtcgagatttaatcaactactattaggtatgtggtatccataaccctgacaatgtgtaatactcaagtgtgtctactgaggaagcggaacatatcggattttctttcagcagtggaatacattctgatagtactctctccagtcataaggtttttgacatttagtcatttacaatagcttttactcaaacttttacaatcaataacttcgtatagttttaaactaactagaaaaaatatccatacgttgcaacgggtaaaaacgtattttcactgatatattaagagctaagcaataaattgaaatattaggatcgctatatacattataattgaaaaagttaatgagaatcctaacattgggatcactaacattgggatcactatagattataattaaaaaagttaatgaaaatatttcctgggtttagggtcaatagccttcctttatttttagccctaggcaagtccgctacctcattctgtttgtttggcctgcttcccttcgacccaaccataagtggagtcgaagcgcagctcaaagtctactaccatattcggccagtacgctacctccctccgtttggcctgtttcccttcgacccagccacaagtggagccgtaaactcaactcgcacagtctactactatctttggccagtccgttacttccctccgtttggcctacttcccttcgacccagccacaagtggagccgtaagcgcagctcgcacagtctactaccattgtcaatctcccgaagatagtcccgtggccgtacggttgccggagcaaatctctccccatcaaatctggtcgaatctttcccgatcacattttggttgagggtttttaattcactcgatcttctctttccgttttttccaaaatcagtgtaaaactctcccccatcaaatctgaccgattctttctcgatcaaccaaaattagttcagggtttttgatccactcgatctcctctttccgttttttttccaaaattagagtgtaaaacttggcataaaaacgtccggggaagatcaccgtcatcatcggcaattgttaaatggagattaaatccgatgaattaagaccgaatcgaaagggaaaataatggagaaaatgatggcggaggagtggggaatcgatttttgcaatcaaattggaggagaaatgtacaatcgatatggcggcggcgcagcacggcgctagggttcaaactcgggaggcgtgcggtgaacagatcgtgttaaaaaaccagatgaaaaaaaaccaaaaacacacgggagaaaaaaccggcgtccgaaaaaccaagcgccgggaggcgccaatagattaaaaaacggacgaaaaaaccaagcgcatgtgaaaaaaactccttcgcgtgcaaaaaaaaaaaagggaaaaaatgcctgtgccaaataaccaaatggacttttttttttccaaacggacttattaaaaaaaggttttttttcgatcagatgttttttctttatattttaccgagacagaagctctttttatcgcttttgaatcggactttttttttacctcattgagttcgacttttttttcctcttttaacagacaattgaaatttaagtagtatagataacataaaattaaaaaatcaactcaaacacgaatgacgtatcaaagtaccggcaaaaaaacatctttaatttttataatagtagagatataaatcgtacgcatgtatcttttgtcttgaaaagtataattattattatgtcattaacttactgaatttatataatacaaaattaaccaaagtttcaaaacatggatatattataatatgtggaatacatttttttctattttacgtaaataaaagaaaataaaaataatatgtgccctattttccgttcatcatcttttccccttgttccctccgttttctacggaagtgaaacgtggcgccatatcctgcggtgccttctccgctgttgcgtgtggaacggctcggacgggatccccattcctacacgaatggcgttatcgtcattacgataaaaacggaggggtgatcgggaaaccctctgggcctctccacgtcgtcgccgttacttcgaggcggtttcccttttttgtcagcgtccaaaaaatgagaagcccgcgctcttcgccttttgcagtaacgccccccgtcttatacaagattttcactatgaaccgtgagaaaagtcaaaaccccagtcccccgttcggagaaaagactcaatgaatccgttacttttttaaaaaatacgacaagtgtcagtcatttgtgtatcagactttttgtgaaataaaattatgccgcaccatgttttctatgtgtttattagttacttaaaaaaatgctcgtgtgttgcaactggtgaaatttattttaatcttattattattatatggtttaattaaaatgaaatttaccgtcggagtttgcttggatatatatatttttagaaaatcatgagctacagttaggagcccgatcgtttcaagttagtatgcgagtttttttaaacagatttcttatatgattccttctgtattatcaaaagtgaacaatattaaaaaccaattcaaatgcgaatatgtatttccaaaagcaaacgaacttaaaaaccgactcatacatggatgacgtaccaaaataccggtaaaaatatattcaatttttataataatagagatagagataggttgctcttaatgaattttactgattcggtaagtgttttttacataaaacatggttataaatttaatagactttaacttttttttttttgaaaagagactttttaacatttagtttactttagattcttttattgggtctctttctcttttaactctagtaactccttcagtatagaggacatggtagcgtctagaattgttcatagattgggccaaaaaatgcttaatttgtatagtataaacaaattagcccaaaccattcttttcactttcgttgttttgggctcaacaaaacccgtttaacatgtcttgttattcacaacatcccatgacgcggttgcattccctcaacgtcatgcctcaatgagtcccaacgttattatcccatagcaactatttccccgcgcttgacgagacctcaacgtttgcggcatcgcgctcgatgagtccaatcgatgattctattcctgcgctgatgagggctatacctctaagagtgatgtccctatacattcaggctgtgtttagatccaaagtttggatccaaacttcagtccttttctatcacatcaacctgtcatacacataacttttcagtcacatcatctctaatttcaaccaaaatccaaactttgcgcttaactaaacacaaactttacgcttaactaaacacagcctcaacaacctgcatgcctatgttcacgtggctcgatctgatggaacttcccacacatatagtgatccccgaatgcatgacgactattcctatcccctgccatggccttttgctacttctatgctctattcctttctcgtgtacaaatgaaggagcatgtacatgatttaactgatgcggtatatatacatgacagaactggttattcatgaggcggaagtattatgtgttatggttaggttcagttgagggtggttcttgcattaaagcaataaatggacacaacatgttagatacaaatctgatgaccgttcaaaattctacagactcgtagatataaacatgtcacctataccgtgtaaatggttcctaaaaatttatcttatccgtttcataatataagactttctagcattacccacaatcatctatcatctataatgttacgtcatagatgaatatggataatactaaaaagtcatatattatagaacggagggagtacttgttttcatccatatcgacaacatattctggtagcttccattccatgttatcgaaattttccgggcaaaacatattcccctatttttagcctccaagaacaaaatggtcacaacttgtaaataaacaaaagagcaagccccactccgcaaaacacacctctcctctccttccctcatattttaaccattccacccctcacaaatctcactatttacttacctttactccgccgaataaaaccaaccaacccaccctcctcctccctcgcccgcctcttattttttcttttctctcccccaaatctgatcccctcccacacgcaacacgcgaggccgcgtctagggttagggttcccctccccttcggccatggacgagctcgcggcggcgtcggcggcggcgaggaggaggtgggtgcagtgggaggaggtcgtggtgtcgaacgaccgggggaggcgcctcgtgcactactacctccggggagcggccgcgggcggcggaggagggggagaggtgagggagcttgcggtggtggggcgggagcggagcccgcggcacatgtcgtacgtggtgcaggggcggttcctgcggtcgctggcggcggcgggggtgggggtgggggtgggggtgggggcggcggtgggggcggtggtggcagtgccgtcgccgtcacggtcgccgctgccggcttccgcggagggcggggcgccgaggaaatggaggtcgaggcgggaggtcgtggactggctgtcctccctcgtttccggtaagatttgtgtggttttttttttttacgcctgggcggtcgattcgggtggtgttgtgcaggattttgtgttgttttgtgtgcgtttgcggctgttttgttctttcgcgtgttgtggtttgttttttctgtgttatatggtggctgatttgggaatcgtttttctgaatgttacggggtcctattccagactgcgcgcagatgcggtttgggcatatgtttttccctgtttctgtttggttcaatttgttcagggaatagcgtttttttggatttctataccaaaagaggctgtggtttctgattttctgacgattcgacccgaattcgcaaatagcgttttggatttctctaccaaaagcggtttgtggtttctgattttccgacgattcgacatgaacttgcaagattgtttggcctttagataggcggattgatttgttcccgtgaatcttttgtataacccatgcgtgttaatggagcggatctgatttctaccgtattaggtctatcagggcaggaattcaactttgcatccttttgttctctctgttgcgaggagttcatttctggattcgttgggttcaatctgctgcggcgcccttctcacctgattcgtgaggaggtagacagcttgttcgtatctcgtggttataggagaagagtacaaacgtttgcgataacccatccgcttatggtcgattgttgtatattagaaacttgttgctttgaacccggatttagctattgttcctttctattggaggggtttgattctgtttctatttggagggggaaatatgttctatttagagggcaaagattgacaatttttttcctccaaaggcaccttttttacgatataaccctcttatgacctgcctatgatttgattcggttagacatatcttatgtcagtattggaacacttatgctagttctagagttctttttttgtcaaaataactaatttatatgagttgccttgcggtttattctagaaagctaacaggattttatcataataagatgtataattcagtcttatattggtaacctgtaaatctcatgccttctccttttccataggattatggagaatacatgtgtgacccagtggaagccgctgcaggtttccctttttgggtcgattgtgtaagcatgcgttcggaaatatagagaaaatgaagcggcagcgtgagttgaaaggcaatcaggtgccattttgttcttcccttcttgtggcctcccacgagacacccatggaattaatccgtgtaaattgaatgcttccgtaatctgcccaacaatggtcaggaaatcctccaattagttctgtcgatgagcttttgtaggaactcttacggtgtgctgacgcatcaacttgtcaatgcttctgtttaaatatgaaacggccttacaaattagaagtcacctccaactctgtttgcttccaactgctcttggttttaaccttggtggtgtgcggctgtgcgtttcatcttcgatttttttttgtgttgttttcttcttgtgttgcctttattttttctgaatcacaagtgtgctactatgttttaaaccaatgttttgatgatactcctgttgcactgtcttgtatggtaaatttcttatgtctagtgcttcttttgcaggatgtaattacggatcttcttcaatgtctaataggttcaatgaaaatccatatgatgacattgagttcactgatgttgctgcttcaaaggtatagagctatttcaagataacttgcccttcatccttctagtatgtccaggatatatttctgaatttccccccattgctaattcattccatttttgtgtgcttaggatgtttcacatacatcatcagtaaggaataactcaaaagagttcacatggttaggtcctgcatggctttgcgaaaagcgatggaagcactacagatctttctgccgtaaggggattactatttcggtatgttacccactgatcattttcctgtattttgtgttgtcaccatgtgtaccactgagattttatcaaagaaatgaggacaacatgctgagatgaagtattgcagaacaataaactatgtagggttctaaatgaaactgcattatgaaaacctggaggagttttaggggaaaaagctatgacattctgttattgccctcctgtttggttttatacgttgtatttattagtactactgcacagtgatatgggagtatttcaaactattcaaaatagaagtttaaatgctaatacttgttattactctgaacctttgaaagggaaaccttggttgacacatgtttatgctatctttgtaggtgcataattttgtctacatcctgagtgaggaaaagaagaggctcatcgcccaagtggaggatctgtatgaagatactaattcaaccaacgttgtcatggtacgatggttcgacaaagttgatgaggttggtgtcgaattgccacctgatgttggtgacagagagattttcttttcccctggtctgcaagatctcagtgttgaatgcattgatggattggctgcagtcctgagtgctcaacacttcgagaagttccagagtagtccaaaacatagctattggcagccttatatttgtcgccgacagattgatgaagatggcgtcaaaccttttgatgtaacccaattgcaaggttattggagtcaagaagtgcttaggacaatgttcaatgcagcttcttctcttaaggtacgtttcaaggtcactaaaggtgcttctagttcagatggggcacaaaagaggaagcgtgatgcattcagtgaaaccgatccacagcagtgtgttccttccgctgcattcggttctgatagtctcaagaatgatttggaacataaaactcaaaagcagctatatcctggtagccgtgctgaagtcctatcacaggacagcggtataaggggctgctggtttagatgctttgtattaaagaggcgcggagacaaaatcaaggtgcgatatgaagatcttcaggatgctgatgagacaggaaatctggaggtgagcttagtgtaattctatataatctttttttccccactaaattggatctcagatcttacttgttacttaacctttgtttgcaggagtgggttttgctaacaaggattgctaaacctgatcagttgggtatacgcatccctgaaagaccaatggtgcggccatatcatgtacatagcaaggatccatgctctttcgatgctggttccattgttgatgcatggtggaatagtgggtggtgggaggggattgtattgcagcagggaaatgacagacgccttcaagtttattttcctggtaattacattcttaattaccatcaacatttcaatttgcctctgcatgacattttaataatgtagtttggagctactgaacttacatttgctttgttatttatcacaggagaaaagcagattgctgatttttgtgaagatgatttgaggcattcacgtgagtgggctggtggcaaatggaattccttgggggaaagaaaagatatcacacacctgttgccccccacttcagttcatgaagagggaggtttgcttagcaaacctgtttcacaagaaggcaatccctcttcaaaattagaatctgacaagaggtgtgatgacaaatcattgggcaccaagatttcacatgatcagaagcatcagaagcgtgttctggctgatctcacaaatgctctgaaattcgataacctgaaatggaggccaagaaagcggagcagaagatctggttccaaaaggcagtcagacactagcagtggcagtggcagcagcagccagggcgacatggaggagtccagcccctgcggaagttttgcagtgcttaattcagcgcccgatgaagaagtatgcaagagcagtggagaacctcttttcatgagggtttccaacctggtgatgtccagatgaagtcactccacgactgacatgttttagccttttctttccggatttcaacagccttggcgagatgtgagtttgatgcatccccaggttatttagtcacaactcacaactggtatcctgatcatcttgagagctctgaatgcttattcgctcggatgtccaggatgcaagcatggaggagcacactgttgtatttatgactgatctagatgagttttaccattttgtctcactttagggtcttgtagggtgttttaaccgtcttgttgtttagttggtgttacaaagatagctggctcattccacctcggcagtttccagagtcccttttttgtctttgtttcagcagtccaatatccaatttaatttgttcatcagctgttatagatgttcttatagtatactctctgaaatgataatatttacatcgtcatacgagttttttgttcttctgcctatgtggtgttatttgtgtgaatttattggtctataattgaaattgagtgtattgtcttcaatttctgctgcgtttttgagcctttgaatactagatgtggcggtaattgttggaagtcatgttggttggtgattatgtttgttgtcatgtttaaagtgtaccgatcttaccattttccaaccagctgtaccgacttcaccgggtcaaaattggcgccttagcgagctactgcttacattgcacttccgaaattctagttccattcgtgccttttctgtctgttttttcagacaactttgctctatggttttgccaggtccatggaacgcacaaactttttctagacgacattacgaagatagtagtatttgggacctgattccatccccgcgagggcatctcggcgaaggcaaaatgtccataggaaaaggttttatcatcacaaggaagaaaaggccaacgagaagcagctaaggaaaggaccaccattcgtgcaagccagccactgaatcccagccagcgtcgttgtgaggaccagaatccgattcgattccgacctccagcagcgtccaccatgacaccaacaccccccttccctcaaagcggccagaaaaatacaacggcgagccaccggcatcagcttagccccagctgccggccaccaccaccatttccccttttgcagattcttctaccgttctctcttctccggcgagccggaagccgacgaccggtcgtcgcgcgccgccgccaagtggacagacggtgttcatgagtggcaaggtgattatggtgaattggaagtgcagagggggaatggtgtggtgttttgttgtggagtaactgaagctgtgttcagttttctctgcagttctactgcatgaccgtcaggatgagcatcgactgcaatgggtgctaccagaggatcaggagggcactcctccagatgcaaggtgaaaaaccggaaaatccaccagagattaccaccataaatattccttttggtctttgatgatttgataatgctcagtacagaacgatagcaggggaacaaaaaaatgggcatcaggaacagcatattaagcagcaaaaaacatctatcaagattctcttgttgattgtatttatttactaaaacaagcagaactgcttacctacacattcaacattggttacctgattggctacaattgatgtcctttcgcatcaacaattttccgtgcaaaaaatgtggatttcatctcacatttttaccccctgtgtatgtatgtatgtatgcaagaagatctggatagccacctgatcgaccggaagcagcagcgggtgagcgtctgcggcgccttcgtgccgcaggacgtcgccatcaagctccgcaagaagaccaaccgccgcgtcgagatactggagatcaaggagatcgacgccggcgacggccaccggctgtgaagtcgccggcgtcgcacgagatgggacggcggcggcggccgtaggaaaattctttgtaaataaatcctgtatattatagcgtatatcatttgttttaatcagagccgataaacttattcagctaacccttttaacacaaagcgagaatggtacgattgcgaatcatgaggaaagtagagaatggccagctgcatgcctgcatcagtatctaagctttgagatgaagcattcatcctcccaaagcatccaggtgaggaaggcaagctctgcaagcgtaggaacatggccaattctgcttggagtgcagcttcaggaagggcctaagtagccccaaccatatgcacagaggtggtccaaagatatgcactctcccataccctaacaacataacagaaactgaactagctctacagattcggtaccgacgatgatctcgtcgcaattgcgatcacatgactgacgatactgcgaaaatgacacaaaacaatagcagaaagcgattgcgaaatcgcctcgagaactatcatatcgccataacacggtctttcactacaacagattggtaacatcgagtaccagacagattgattgctggtgagtgagataaatgtgcaaagaagagctttgcatggtggtgtagatcatcaagaacttgagtagcttctacctccatccaatccaccaacaattgtcagaattgctggtcagtcagggtttccttggagtgccattaaagtccgcagaggtggatggagaggagagaaactaaacctgctgatggcttacggccaagacagcaaatgtggccgcacaacacccccaccatttttatgagcttgaacaaccgtcctggctcctccttttgtcacacccagtgagggttctgcaagtgcttcttctccttttggctgagattgagcaaacatgggcatggcgatgaggtgcgtcttggtcctcttctccgtctcccccgtgctgctcctgttcaacttcgagatgctggaggttgctctccatctagcgagccgcgaaaaggagctcgacaccgctgcggtaaccccttctgccagtttgagcttcctctcgaggtttaggataatgctggggatgaaccatcatcggtcgcggggccgaaggcataagagatattcagaagctccagctccagctccagcaccagtcccagcccatcaagcaagatcagaagctcctgcccctcttgttcatgtgcctcgaaaaggaatgccgtcgactcatcgcagccacattgccccagctagaagcccggtgcacaaagtgaaagatggtggtcacaccaagatcccgagatccgccattgttgctctgggtgtggttggattatgcctagttgttcttggagttgtcatagcagcattctcagtcagaagatcaaggaagttcaagaaggtgtgtacaaaggcattcaaaccatttcgtcatggatcaagagatcaaaggtcacctgctgctaccaggaaggtcagttcccaccctagcccagatccacttacactaagttccatagtacagtaccaacagaaccttccaaaccttaaacaatcatctgaatcaaagagtctatccattcagagcactattccgatgggtacagaactaatagtaagtgatcatgctgtgataaacaactcacaatctgatgaggttgaatctttccattccataccttgctctgatttatcagctggctccattacagagttacctcagcaaatttgtgatagaagagctattatgaaccgatctgagtatttcctacaaacacatgattcaccatctgattcatcatatcaatccctttcaccagattgtacatctcgtttgtctccaaaggatcaaactttcactgcttccagtcacctcagtttgcgtagcaaaacttgtccagaaaaatcagatggtgaaaatgctgaaataaactgtcatgatggattggaaataacttgcatttctgggtccatggaacatcaagaagcccctatcgaagagcgggccagaatcaatttcaggaacccaccatcacaacacatcttccctccctcctatcgtacagatacctcacaatccaaaatcaacatagcatttactatgactaactcaaaggttgaatcaagttctaaggaatcatcaaggattgagacctccagttcaatgggtataccaaaaccggcaccgcctcctccaccgcaaaagaaccctcctccaaatctgaaagggcaatgctatggccagcctccaccaccacctccattgccacttcagatacaggttggtaaagatgggtctcccctaccaaggttgaaaccattgcactgggacaaagtaagggctgctccaaaccgctctatggtgtggaatgatataagatcaagttcatttgagttcgagtaaggctatcccccctcataattgtgttcatcacatttcctattcttattatgttttacaataaagctatgctatgcagatttgatgagcagatgatcaagtctttgttcgcatacaaccttcaagggtcaatgaaagatgaggaggctatgaacaaaaccgcatctaccaccaaacacgtcattgagcaccataggcttcaaaatactactatcttgttgaagacattaaatgcaaacaccagtcaagtttgcaattctgtaatacaaggtaggtttcatgatgttttaagtaattataagttatgattatcaagttaacaataataacaatcaacttatcctcatgtctcggctgactcaggtaatggattatctgtgcaacaacttgaagcgcttgtcaagatgaaaccgaccaaagaagaggaggaaaagttactaaattatgatggcgatattaacatgctagatccagcagaaaactttgtgaaggtgctactaacaataccaatggcattcccaaggatggaggtcatgctctacaaggaaaattttgatgacgaggtagctcacatcaaaatgtcctttgcaatgatcgaagtaagtggagtcattttgcatgacttgtttaggacatattctgttgtgcttatatatattgttttatttaatagggagcttgcactgaattgaagtcaagcaaactattcttaagattacttgaagcagtactcaagacaggaaacaggatgaatgtcggaacattaagaggaggtgcaagtgctttcaaactggatgcgcttctgaaattggcagatatacgtgggacagatgggaagacaaccctactgcactttgttgtaaaagagatggctcgttcaaaaggattaaaggctttagaaaagctcaatgaaacacccagctcttgtcatgacacaccaactgaacgagaggagtattcatcaatgggtacagaatttgtctctgagctaagtaatgaactaggcaacgtcaagaaggtagcaagcatagatctggataccttgcgaaactcaatatcaaatctatcctgtgggctggctcaactgagaaatcttgttgagaaggacctagccagtgatgacaagaacaataacttcttgcaatgcatgaaatccttcctaaatcatgcagagaatactatgcaggggctcaaagctgatgaagctcaagtcctactcaatgtcagggaactaacggagtactatcatggagaggtcagcaaggatgagtccaatctgctccaaatattcatcatcgtgaaagattttcttggtttgctggataaggtgtgccgagaaatgaggggcacaaagcataaccaaactctcaatttagtccttccactcaagtgaataggtatagattaaccaactggccactaacaaattgattgttttgcatgtgaatgtttgtataacgatgttagcattaagtgtttgacaagttgactgcttgtgtatgagagtgtttctttgggagtgttagaatggagatcagttagcattaattataaacagattgtttatgtggagtggtattggcatcacggattcaaaatggatttgtgtggcatgatttttcaggcagcttttcattttggttagaatattagtgaaataatgcagaaaatgttgctcttggtaccatatatgcaaatacaattatagtaaaataatgcagaaaatgtttgcaaatattacaaatcaccaatatgacaaaccaattccaaagccagtatgcaaacacaatttgagatggctcagatacacctagatttacatactagcttaatttgtgatctttagagttatttccaagattgtaccaatgctaccaagagtgttaatggaggttaggaaccttatgcaataaagtagttttctccacaaattcaggaatacatttggcttttagcatcatatagaacagaatctgaaggaacaacaactcatgaggggcgaaaaatataccgaattacgaaaaattataattaccaaactattctacagttatagcttattgctttccataacttaatagtatcatctctccaacagtacccaacattcagaaggaaaaatagtacaaacaaccgaaaagtaatacccgatgagtgattaaagatacaaaaatggtattcgacaatagacctccataggaatcaaactaatgattagcgaagatagttgaaacttccaaggaaatcttacaaagttaagctctcaggatcctcaataatctttgcaaaagtttgcaggaatgctgccagatcagcaccgtatacaattctgtgatcagcagtgacattaacctaaaaaaatgtagatccaccttagttgtttctatatacagaaatgtcattcaaataaatcgcagataagcattaacagttcaagacgtaagatatatctgtggtgcttcaaccctacttcctaccaatgaattgatattttttatgagaacaatgctcttaatatcaggtgggtaaataaaaagactggatggatcatgtatacatataaaggaatgatcatatcatatatgaaaatcatgatgtcaaccacctaccacacccaaccaccccaaattatacacatggggtaattcgtttatcactaagcagagctcctgcctttgccactggctatcagtaatacatggggtctgggagtaaatgataatgagaactcagcattaaaaccaaaactcatgctaaattagtagcttaagagagatggttcatccacttggtagacaaatatttcggttcaatgtgtgaatttgtgaatgatcttatatgactaagcaaacagacacaaaacatactagagacgtgcttctatgctcctcggaaaaaaatactgcacgaaaattaaagcacatcaatggttcggattaaaagatgattactagggtaaaccgtcattaacgagggccaatttcgtccaggaagtaaaatcccacatcagaccaggccaatcgcaccatcgatctgggaggttgacacggcaacagggctgggtggtgaagatcggccgggcatgtgcgaggaatgggagggcgacgagctgtgcggggcgttgtttggtgcccgccgtcggcgttgagacggattatatataggacgacgagagaggaccagttctcgatcgaagggcaacgccgcagtggggaggctgcaggggcggcagaccagatggagcatggccggttcatgccacgcgcatccactacggccgccgttcatgatcatgattacgcaaactcccggccaaataaaagcttcttttgattcagtgttctcctgttctttgtactggcgaaaccttgatagaaatcccaactgttctcctgttttttgattcaatgtttttcgtccttgatagaggcggctgggtatggatatggaattttacttcctggacgaaattgcccctcgctaatgaggtttaccctgttaatcactttttaatccagaccattgatgcgctttaatttgtgtgcagctttttttattgaggagcacagaagcacttcccaacatactaatataacaatcactaatttccagtattggctgaaaaattgcatgtgtgaagggcaactaaccagcattttgctcttgacactaaagaaaccatctttatcagccaccactgtaggttttgaggctccgacagccattatgcctccctgtattcatacacactcaaatacttaggccatataccagtaaaggaaccacatcaatatttagcatcaagcagattaggagaaagagaacctcacctggccaggtggaagaattgcatcaaatctatcaacaccaaacatacccaagtttgacagtgtaaatgtccctgcagaccaccaattcttcaggtaagtacaattttcacatgtttttcaacaacgatctacaagactgaaacatcaggttccataccagagctgtactcatttggttggagctgttttgcacgagctttcttgactagttccttccatttttgtgagagcaaatatatatccaactgcatcatgccattgctcaagctattcagtgaactcatatgattcaattcctaaatgaaacgacattaaacacacagatatcctgtaccttatcagcatcctccagaacaggtgtaatgagcccaccatcgattgcgacagccaccgcgatgttgatgttggtgttgtaagtgaagctcttcccatccctgcagctagcattcaccaccgggtgctgcgcaagtgccatagctgcggccttcgccagcagaactgtcatggtcaccccctttgacttgacctaaccaaaccaaatcaaccccaacaatcaacaaaatgaccaaaatgtaataaaccatcacaggaggttaagcactgccacccccaaagtctccaaaggtatagcaccttctcatatagctcatcgagcttatcggtcacaattgggtatcccacacggaatgcgggcaccgcgaggctctccaccatgttcttgctcactgcagcctgcatgccagtgaatggaaccaccgtggcaccgggcaccggaggaagctccgcggcctgtggcacggcgccaattgccggagcagacagcggcacgggagcagcagaagcagcaggcacaaccttcggcttcggctcgatgccggcggcagcctcaacatcggccggcgtaattcgcccgaacggcccagtgccagccaccttagctaggtccaccctatgctgcttggccagcttcttagcttgcggggtggcaatgcccttcgtgccggctgccaccggcgccggagccgccggagcggccgcgggtggaggaggcggcggtggcggcgcggcggcatcggagggtggaggcgcctgctgcgggtgggccttggagagctcctgggccttggcgagggcggcctggaggtcgtcctcggactcggcgagcagcgcgatgggggcgccgacgggggcggactcaccggcggggacgaggacggcggcgacgatgccgtcgtggaacgtctcgacgtccatgtcggccttgtcggactcgacgaccaccacggcgtcccccttggcgacgcggtccccctcggcggccgaccacgacacgatcttcccttccgtcatggtggagctcagcgccggcatgaagatctcccggatcttggcccgcaccaccaccatcctcgcccgccgcctcgccaccggcgccgccgcggcgccccgccccacgaggaggcgcgccggcacggtggaggccgcggccgagagcgagacgggcgctggagtcgtcgccattggagaggtggaggtggaggaggaggaggtggaggcggcggaggcgaggtgggggaggtcgggtgtataaggagaaggtcggcgagggcggagaaagcgaggcggatgagagctttggaaactccgacgaatgctgaaatgggctggggagggccgggccgagcctgacgtcaaccccctcacctggcctctatcagggccgggctcaactttctgttttggatcgggctcgttttagtatattgggccggcccattaacccgcagacgcaagccatctgtcgcgacttgggaaaagtctatatcacctccctcgtctattactccgctctccatctctcctcgcaggcagcagggaataagttcaccagaggtccctcaacttaacagcgagattttctgagggccctaaactacaaaactagaaatcttcatccctaaactcatataaaccgtgcactcaaggtcctatagcagtatgtatgggtggtttcgacgtggcatcctagtcagcaaaaataaataaaaaaagtaggtggggcccacatgtcagtttcgttaccgcacgtagccgcgtgctgatgtcgtcgccgccgctcccacctcgagccgacgcctctgctgctcccgccgccgccccttttccccgccgtcgcagcggcggccgccattcccaatgttgccactcctgccacgtatcgccacagccaccgctgctcccgccgcacgccaacgccgacaccgccgctcctgccgtcacccatgttccccgtcgtcgccgaggccaccgctgctaaccaccacatgttgccacgtccgccgttcccctccccctgggaggcctccgcggccgccacgaccgccgctgctcccaccgcatgccgatgtcgtcgccgccgctcccacttttgcccattctccccactgatacagaggcaaaatgaccagaaaaagggtaggagtacagtacagtacagaggcaacaaccacgttggattagaactccgacgctcgcccgctgtcgccgccgcgctcgatagttgacgccgccgtccgcctgctccggccgcacgttgacatcgccgctccgcctgctccggccacgtgccgcccgcgcccggagccggtgctcacccgccgccacggctgcgctcgcccgctgacgccgccgctccgccttttccggctgcgcgccgcccgcgcccggagccggtgcagttccggatgaggagaggtgggcgccggccgccgctcccgccgtcgcggcctcacgggcggtcgcgccggccacctctctccccttctctggcgccggccgcctcttctcccctctcccgcttcttcccagcgcgccgcagtgcccgctccgccgtcggccgccatctgcctgcctgcgcgtgacggcgtgagaactgagaagttgagaagagaagagaaaaaagagatgtgggacccacatcaatttatctcactgacatgtgagtccccacatatttattttactatttttgctgactaggatgccacgtcatcaaaaccagtcatctatactgcctcgggatccaaattagatggttttgtatagtttaggagtgaagatttctggttctgtggtaaggggacatcaaaaaatctcgttgttaagttaagggacctccggtgaacttattcccaggcagcagtggaggcgagacagaccagaccgctgaagaacagtcatatctcactgacaatctgacatgtgggtcaatttacacttgtttttaaaggtcaagaggtgtaagtgattcgatcaagaataagatagaggaggcaaattagacttactccgcggaggcgtcacgaattttttgtcatttttagatttttttttaatatttacagaaataatctatcggtcaaaaaaattgcaaaaatagaccctgccgccccagtggtgggcggcaagctgatgtggcagacggcgggtcgaccgtgccgtctgccgctgtcggccaaaattgcaattaccgccttgccgcccatacagagagcggcaaggggctaattgcaatttttgccgcccataatgatgcagcaacgggggttcccgatctttcgatgagaggaggataaacttcgatttggggaaggatacgacgttggcggtccgactataactaccacaggggtgctgcgccttagcaaccggtacaccgactccacgttgttgctgttcttgccgtgccaagaacaaccttgaacctgcaagcaatcgaagaacaagcaagaacaagttgacaaggaaacagctcacggcacttgtcaaatgatgaaacttaaacaaaccaaaatggggttctgaatacaagtatccgggtggtctagccgacacacgcgagtacaaggaagtagctgcagctaaacttacatcaaaacaaaacccaaagtgcaaaatggtggctgctaggagtttatataggtggaggaatgaccaggagaggaggtgggagcaaaccctaggttttgtggacccctaatgggctgtaatgatacaaggcccaagcccaagtttctgatgtaaagaactattttcgtcattctgagcagcctgggtcaaagttgatggtgaggccatgcatagctgatagtagacgacgagatctttccaacaagtactcatttgccccgtttgacctccggagtgaagagcattgacttcatcaaatcagcgctgctagtgctgcttgcgatttggttcctctcccatattcctaacaacaagtagatcacaacaaccatttagtagcacctaattctgagaagaacttgtatgattagctaggaatgactttacctgataattaagttcacgagctcgagctctagtcattggtccttgctgtgcaataggcgtggttgtatcgttggaagggatgtcctcatcagataaagaggttgcgctcgtactttttgcatctgg

SEQ ID NO: 54876 - DNA, 29368 bp, Oryza sativa
cccagatgcaaaaagtacggccaaacgatttttctatgttatgttaatattaaataaagaagtatttattggtaaaacttgttaatattgttataaaaatgtattgaagttggttgtttcgcaatttcatatgttaagtaaggtagtattttgtaaattattcgacgtattagtactcggataattaatataggcctatcgcagtctcggtcgtagaaacattatatggacttaaacaacgagaattatgtaacatgaagaaatagtagtacaatttgaacatgatacaactattttcattgcggttacatagatgatattagattcgaactaggagggaggtaatgcaatagttgaacacaacgacgatgtagtaatgggacaaggaagcatgacagtagaaatttcaatatgccaagttgtccgacaatagctaacccctacgtgaggatccctctcctctctcaaaacgcgttttagtaactctgtattgctctggtagttcaagctacacaacacggctaggtggagttagaacccttatggtgtctatccattctctgtattgacatctccttggtggttcctgggaggaaagaatagatgtaaagcgaacaaagttagtaaatgttgtgagaaaataaggattcatgtaatcaaaatattcttaccatgaaatcgccatcaagaatatttggacaaacgttgtaggctttatggaacgaagaacctgacaatgatcaccacacctgcatcttggacgggtttcccatggagggagtgccgtagttagcacccgccagtcgctctgttgttcacgacattgtcattcataagccgcttttctctgtaagtattgctcagtactttcggatacgaaataccagcgaccttcttgtaaacaagtggttaggtcgagaacgggattttctgtatcgacccacttgatgtatgcgcaagccgtagtgcgggtctgccgaatagagtagtgttacgaagaataaagcgattgcccatacggaatgaataagcatatgcagataataaaatacctcacgatcatagttagggcacctacaaaagcgccttcctcgaatattaggattcctcaaagccattagttggcatcgatcaccgcataggcagagaggacgctggcaccaaggtggtagtaggtatacacaaggatcgctacgccagttcggatcctcaacaccccggcgtctagccattgacgaaagccggtaggatttgtaatgaagcaagtgggaagagagtactgaatgtgactgagttctgaaagattgtgaggcctcactcgttaaggcgacttatataggtgcaaaaaatcgagtgatatccctgacatgtgaacgtggcggggcatggtgggtacgcctgattggcgccgaaagttacatgcctgatcggcgccgaaagttacattggtcgtatgcggcaaatggcgggcaaatactcgtatcgcatgcgaataaaggaggatgcatcggtgcgacagaaagtagtcgtgcatgcgccgaaaggtatcgtgcacatataacaataacatagtcattacacaagcatacagtactagaaagtgaagcaaataaacaaagagaagactgctctactggccctgccccacgccgcgaccacgcttagtcctccgggcctgtgctcgcacgtggtcctgggagtaggtgaaacgatccggtggcatagcacaggtagcacgagtgtctggcggcggagtggcctgcgcctggtcctgcgtctgcttcggcggtgcgcctcccagctgtaaggggccgatgacgtcctctgttgagcctgaagcgaagtcgaagtcagtgatgtcgaagagcaaggtggaaggcaccaagcggtccgacgaggtcccagcatggtccagtggtggaccctgactcgacgtgccggctgcctgtgacgaagtcccggtgtactgcagaactgcgctgagtgcaaggtcgatgcagctgcctgagacgctgaccctgcagcctgggagaagtgggcggcctgcatcatagcgaactgggcgaaacctacacatcgacaacgggacccttgtaagctaagacataaaatgcatgtaaattgattgtcgaagtaatgttgtttttttaagtacctgtggggggcacaacagaaggcctagccgaggaaggcggggtgctgaacggtgcacgaaaccctgaagcgatcggcaagtgaaacggctcacatatatgtgcgaggcatgtacagaaaaatccttaaaaatacagctgcggagggggagtcggcctaggaacgtgcgcagctggacggggaccagtcggtacaggtggccgctgtacagctgcgtctgcccgagcaacgttgtctgcacgacaggtgagcactcagagaatcgagcgcatcgactccaccatccgcgtgtacgtcatcaggtgctcctctacgggtaccggaatccccgcgcctaaacgttggatcatcgttgaaccgtcaacgacgacccggttgatgtcgtcgacctggatggttaatttgttcgtacatattcgtaaaatttgacgaagagaaagacatgaaaacataaaggaatggtgcgatgcagggtactcacagcacgagcgaagtcctggtcacggtgcctggtgtagaggtctctagtgctcgcaacgtggggctgctgctccaagggagcgaaggtgaccctagtacgggtgcatggttggtacccgcgtaggtaggcctggtacgcctcctcagtgtgtggctctctctcgtggtccacgacctcctcggttgcgaacaaccagtcctcaataaaagtcgtcaacttggcgggccagtcgccagctgactgctgacccttgcgcgagtacctgcaaattaatgtgtcatattagtgtgaatcgacagatgttgcaaattattgtggacaggtagattttaatgcaacaactcaaagcgcagtgaaagatcttaccggtgaacagcagctgggacggtcgtcggaaacagtactggaaagggctgacggaagccgaactgctgcatcacgcggaaaggggcgtgaggctcaacgcagatgtcgaagaccatcagaaccgtagtcatccagtatgcctggtccctagtgcagagtgtggacagacccaacggcgcacgagcctgggtagccgcggcactgtagggctcccacacgacgtcagtcggcagaaggcggtcaaactccataacaaactcaagatacgaccgcctaacctggacgtgagcccatcggcgctgcaatacgagacgatcgatgtgatgtacaatgaacttagcaattaacttaacaatacgagaagatcgatgtgacgtacctgacgacggcaccacagagtacccatcatatggtagtcgacctctggtcgctccgcgtacagtgactcctcgtacgcgtgctggtccacctcagggcggccgatcgcaatcctctcagctgcccagatagaaagaaagagagggcacccaccaaaggtcgcgctgggatccgtcttcgtgcaaacctcacaaaggccacggtacagagccgccaacaacgcggaaccccagctccactgaggcacctcgcctaccacggcgtcggcgatgctcctggcgtagtgcacgagtcccttgtcgaccgcgtgcccgtgaccgccacagaacatcacccagccaaaaagccagagcaagtatgcctccaaacagcggctgtaggagtactcgtcggcctccgcctgtagctgctcgacctgcaagcgttcgataaaatgttaggcaccttaactgtggactaaatatgtagtacgcttgtcatttcggtacgaaaacactcatggtgaactgaagcagccacctcttcgtaggtccggtgttgcggtggtgtgccaacggctcgagagggagatgcggtgcacgctgtactagtgcgaaacgtgttgtcagatcgtcctgccagtccacacccgtggtcactggcccaacagcgtctcccgcgagcggtagccccaacaagtacgatacgtcctgtagggtaggggctacctcaccgcacggcaagtgaaaagtgtgcgtctctggcctccatcggtcgaccaaagctgctaggagggaccggtccacagtccatcgtctggccgggtccgcgtcgccggcggtagcctccaccagccgacacatcggtaggaggccggcctcacgcagcctgcaataacaaattaatatgtcattataaaaattattacatcacaactaatttatagtaatacactgttcgtacctctcgacaaaggagtcgtgaaccgtaagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaagtagtaatgtaaaacaaaagataacttgtaaaattatgaaatcgtaataaaatcatgagaataattatgtacaacaagagtacaggctatttaaatatagcaaacgttactaagggtacataacgatgacgtgcaatttaacatatatgtagagttcgataatataacataacataacataacattatgtatcgaagtccgacattacatcagcatacctaaagacactaggtgccttagtctgacgttacatcacgagacctaaagacatgacatgccgaagtctgacattacatgacgaaacataaacacatcgataagttcgaaacaaattacaagcaaagccacatgccaacatagaacataagaactacaccacgtagccagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttgtaggtgtgcccacgttcatcgcatttgctgcaacgcttcaccctgccagcctccgactcgtccatatcgttgcggatgcgacgagtcttcctccttccagccttgtctcggagcttcgatgggtcaggaatattgagtacttcatcgttagtctctgtgaactccccagctatgccgaacccataaatctcgccgctccatgtatgatatattgcttgcttactgaactactgtgacacatatactgcatctggtatgccacactccgctgcggcagcaatgatatgggtgcatggcctgtggagcagcttctgctttgcacaagagcaatgacatgtgctgtcggctttgagaatacactcctgcttcactctcttgcggtagatacccctgcatgccttatcttgacatagtatctcaaacctgtgctgttgggtaccttgcactagagctcgatgtttcatggcctttttacgcaactcctctagctttttttgcatgaaagttccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcctatttctcttttggttcatgcagaatccactgagaaaatttccgaatctccaatctagttcttctaaccaatgttggactatccgttgggagaggtccaagagcttgaggagggtcagcatcggcagtcgatggagccgctgcacgctgatcactgcatttggctgtcaactcatctaatctcttccaaagctcattgatttttttctcctggttttgattgcatagcctcttaaacatgttcatgagctccttgttcttgaattgcttgaagaaattagctcccatatgatgcatgcaccacctactctgtacatcttccactcaccagggtatcctcattccatactcccaaactgtaactcttctatcgctcgcagaatgccagcgtgcctatcatgtatcaggcacacatttggcctcataccaacaacttttgttttaaccaatttcagaaaccagtaccagctatcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcctagggtttctttcctcgataataccaagcaggcgtggcaaattgtcatactaggcttcgtaagttccaaatctcatctctattattttctgtttggccctccaggccttggcatagctaatagtatacttgtatgtctcttcgatgtgtcggattattgaccttggtttatatgtgagattatcgatgacatgcgcatacatctcagatgcaacaaatgcacatgtaatgttcctgtggtatttctgaacaccaggtagaaaacatgtatgcttggtaacgactgacactgtccaataatccttccatttccccttatatgcgtgcactctccaaggacaaccatctttttccttaacacaccgaacttcatattgcgaccgattggacttggcaacccaaaactctctatgaagtgacactgcaaaatgttttaccgcctccttcatatcttctgctctactataaatcgctccttgaataacctcattttctttgtactcccatctcacactatccttttcagagacgaccagcccagaaaaatcctcactagcccattctgctggattaatatccgtctcatcatctgacgaatcaccttcctctacacgctcgttgtcagaatcctccctctccatttcatccacaatggcaccacagtctccccctcgtcggccactctacctggttgaatgcccactggagctactacgcccctgtcctctcgtgcgttgacctcctccacagaagtctcatttacttcagcacttggtccctcgccatcatccatgttcatctgcacacctggatccttcgggtgaacaaacagaaccatagctagaggccacccgcgttgcaatgcatttttcacataccatctccacactcgagagttttgaactggtattagttcccaataaaaacccttagttgcccaacttactataacattgattgttatgtcacttgtctgtggatcaactctcaagcccctcattaaccatccttttatagaaggtacactcctctcagccggtctatcaattccccttttctgatacaataaaatctgacagatctaccccagttgacccgtaacggatgtttcctgggccatggtaaacttggaatatttgtttgttcgacatatctgtcaacgaaataactagattatattactctttcatgcaataaacatctacaacgtaatatcttcttgtgtatgccaatgcaacggtaaagtattgattccaaactagcagatctacgtagttaccgatatctgcaatacgcacttctagattagtacaactaaaaccctaaaaatataatgcatttattcaaacaaagttttaaaaaatacacactatttaactcaatagtcacatataggatctatgaatattacctgaaatcggcgtctgaatccggtagggcttcgccccttcttctcttctcctcccctttcttcttttttttcactggatttgagaggggaggaatgagggctgggagctgggcggcaggccttttataggcagcgaggcctgccgcccggccagagggcggcaaggggccgcctgcaaaatgccggccccgactggttttttttgcattcaggccccttgccgccccaacagagggcggcaagggctttcctgcaaaaaaaccctccctccgtcaccgcccgtcccttccccgtttgccacgtcagcttgccgctccaaaggtgggcggcagggtctatttttgcaatttttttggccgatagattacttctgtaaatattttttaaaaaaaatctaaaaatgaaaaaaattcggggcgtcactccaagtcgcttcttttatttgggccgggcagtttctgggctagacccattttactgttttggcccggcccatttagccgccgctactttccagcttccaaggaggccacaccacgcaccgcagctgcagctcatccccacgaccaaatctcgccgtctccgcctcgccgccgccgccgccgccgccaccgccaagagggggggaagcaacccgcagccgccgcgcggcgagatgaacaccgacatcaccgcgtcggtgaagccggagtacccggtggtggaccggaacccgcccttcaccaaggtcgtcggcaatttctccgcgctcgactacctccgcctctccaccatctccgccgtctccgtcaccgtcggctacctctccggtacgtcctccccccacccctctctacgttccacccctgggaggaggaggcctcaattccgcgcgtcctttgcagggatcaagccggggatccgcgggccatcgatggtgacgggagggctcatcggggtcatgggagggttcatgtacgcctaccagaactccgccggccgcctcatgggcttcttccccaacgactccgaggtcgcccgctacaagtacaagctgtagtgagaaactttatcgattcgctgcgttctctctctctctctctgctgctgcaagcgtttacatcttttttttctttttcctgatgatctcgttttagcgtcacttgttgatgtgcgagatgtgtggccttggctgaataaatgttgtacgctgcacgcttgtgaggaattcgtgctacaatttagctccctttgccatggtttagtggcaatttggttgccgatctggtaaaaatttatggaactgaatgtgaccccctgcctgtgaaatttggggattttgttcttaagtgactctggaagtcgtttcaggaactcaggatttgggaggttgatttctttacatgtagtggtagtcttgtggtactggccagatgcggggcaaagtctgcctgccaaatagttcgtagatagttgttgtgagaggggaattataacttgcatcttggagaatcgtaaggaagtaagatgttacgatgagggagcacagtgatagttcttgctaacctaagaatacataaattgctatgccacatttagctaagcggtctctagtggttttgctcttagtttattctctcagatgttatatacactgaaaatattatttgaggcaaggaacactcagcggtgaacagtactgcctcaaattttgccgcaaaaggactaatattagtttttatatatgtaaatctgaaggcatgatacgataattatttgattctgagtaccatgatggcatggttgaactagtttaagacgccatattagactagcaatgccatgctgcatagttgtcttattcattctcttatgtaggttagcaagatatatgagataacatatcagtaatcaggacgcataacttgattcagttgtttgtttttcatactcatctcatcccaatgcttttgataccaaatcacgtgcagtgtttagttcagagaatcggatattggctcctcctatgtctcaaactgcttggctgcctactagaaatgagttgataattgtagcatttaaaaaaaaaatcgaccgctgtcctagctttggtgatattcagtcgtggatttagaattttttttagcctaagcaagcctaatgatagataagaagtacacataaacccatataactacatagaccatttatcataggcataagcaaaaaattacagttgttgagttctaatttacaaggaaaaccgatgtacaaaattatattgatgaaatgatggccgtgtattatcttaaatagaaattatatagggcttgtattatcttaaaaaggaaaaaaaaagatgatgaatgctggacagttaggtcaccttgccttcatattgcagacatatgatgatgtaagtatttgctttgctaatttacgttgctgatccactgatctgacattctgatctccattagaactagttgattaaacatgtcaaattacttgttgttccaaggtttgtcctaagtcaaacatttgtatctttgaccaacaatttctagaaattcatatagttcaacatcataaaattaatgtttttaagatgcaccatgagaaatgtttttataatatacaattcacatgttgttaaactacacgaatttctagaaactgatgatcaaagataaaagtgcttgatttaggacaaagctagaactacaagtaatttgaaatggagggagtacctattattagtacttaactgcacgcggctcaacgcctgaacctatgatgataactaagtactgctcactgcgctgcatgtggcaaagtgacgctaattaagtattactggtcacttgatgcatgcggcggagcccgggcacctgtggcggcctgtccagggtagtcaattcctggctccgcaactggtgatattcctgagctgatgacttgttcagccaccctgcattgtacaagaacatgcagtccagagatgttgattggagagtgtgagttactttttgcttccccatgcttgatcacattaagtagttctttaggaaaagaggacaaacctatgtatggtgccagcttccatcaaaatgttttgttttagaaatgatgtgtgtgttgtaatgttattcttgcttatcatccatatctaaatcgttatgttcttgaaaaatggaaatcagaaacatagtttccaatctgaatcttttgggaaggttctagggactacatattctggttactttaagttggtataatttaataatatagctctttggcgtcctagaaagtatcataatttcatatttagtatggtaaatgaaaaatattggtggaatgaacaaagaattggtcaaacagaggacctcacactgattgtttttggatttgcatgttgcttgacaaatagaagtataatttacccagaatgcctccatctatcttggaagatttggtaaagtacggtgtcacttctatctatgctgaatgcctgtatgtgtgcaacctgagtatatagttgtatgctgtatgcctgtatatgcgcaacctctatgttgttgcagtagaacgtttgagaagtttatctgaaaccaattgttttccttttgctacataattacatgagcttgtgactccgttcttagttaaatgttgcaccattgttagtaattaatctgcaggtaaaaatatgaccaggaagtcttctgaataacaggtgttatgagactaggacgatgacattgaactctggaatttactgcagtaaaccaacgcgtctattagtggatcatcggattcgttccctgtccctcccacagcagtagaggcgtgagatgacatagaacatccgcgctcatccctttgccctcaagaacattgcagaagtagacagtgaacacagatatagggtggggctctctctttattatagatttcatttggagtacaagccagccaatcttagatgtctcgccctgcccttatatatataggggtcttaggaaggaggagatagatcttacctctactccgtttggattagtccaaaaaaaaaagatcttatctccccgggagataatattccgtaacatttgcatctaccaaagttagctgcatagtttttctgtatttgctgatttgcattttgcagtaatttcctcttggcacaaggttttggcttctacattagctttttaattagaggttagctatgcgtttatttcacaagtcagtgcggggggcataatttcaaaacttattgttcagtgtttgagaaatcagcttaatatcaaacaaattgtgttataaaaaattctgcatatgaaatagagccctgttttttttacaaacattaacctctctaagctgcgtaggattgctgaaatccttattatcaacctggtcagggaagaacgcaacgacccacgaaattcgtgggctagtttaggttcacttctggccccgcagagatctttgcggcccataaatattaatggaccgaaagttccggttggaccaaaatacagatggtccaccatgaagacgggctagattaggtccatatatataggtgggccgagaataccgtatgggccaccagttgacctagctagtggacataaaaggatggtttgtaaatttgacttcccgttcaagttcagggctacaatttgggagttttttttcatttttattttttaatattcacagaaatattataccggtgaaaatatttacaaaaatagaaatattaaggtgacgtggcatatggtgccatgtgtgtattttgcgctgaggtcatatgcaattttcgccgcatgcaaaattcgcatgcccgctcagcagcctccaatacctggtcacacaagtcaccctgccaccctccccgagagcggcagggtttatttctgtaaatattttcaccggtataatttttctataaatattaaaaaataaaaatttaaaaatgaaaaaaatctacaatttggcgcatgatatccccgtggattgggctaaaagtagtaaggccgaggaaaaagctaataactggataaataaacaagatgggtaccacgcgcgttgctgcgggagaattgtgtgataatataatatatatatgagttctaaaattttctttcttacctactatacaattttttttcatgttttatatatttttatacctttatcaattatccaaaagttataaatgattgggttgtatggtgtgccttttaggagaaagagatgcaatttgcaagaaccgcatcaatttgcgtcaaaggtcctagatacataactgcccaagatattatcttaccgccttgatgaatcatccaaatactaaaataaattgaggtgatgtgaaaagaagcaatttacacccttgatgaataatccaaaggctaaaaataattaaggtgatgtggtttcatgagagaagagagaattagcattaactatacttagtggggataaactttatagatatataggataattccacttcgattttcttaactagcagccgaatctgactcatttacaatagcagatctctcaacccccaattattaaaaccagtgcaatttgattccctcgactgttttggaatttggaggatagtttcgttgacgtggcggtgttaacatggtattcatccaacatgacattgacatagcgcttatgtgacattagaattaaaaaaatatgagacccatttgtcatgtaaaaaaaagttatgggacccactaacatgtggggcccgcataatcatcttctccttccttcttcctcctccctctctcttccttctctctccttctcacatagctggggctgagcggcggcggcggcaagagatggagcggcagcggcgggtggaaaaggagctaggtggcaaaatcaaacagtgcggcgacgaggaatggttgcgtgccctgagcacaattccgaagggagacggcgcgcggtggaaggcatcggtcatcgaggaagatgggaagcgtgctccacaccgcctctcctcgtcgccgctgctccacgctgccgctcctcttccctgctccccatcgtcggtggaaggtgtcggcggaaaccggtccacaccgctgctcctcgccccctctgctccgtggagccatcctcgtcccagttccgcgctgccgctcctcgtcgttggtggaaggcgtcaacggaggcgccgcgagttaggatgagatggaaggaaacctctgctagaacggccacgtcgtcaacgcgtggaccgagcgcctgatctactcctaactcattccaacaccatagtttggtatgccactactactttgctctctagtgccgccatggcgccattgccaagaatgccaccttactacgtgcttgtgaccagggtttcccttatcgtttggaggggggttatcgcacccctgctataaggcggttactgtggtaaccgctgaaaaccgtgttaatttcggcggcaaacatttgaattaaaaaaaattgatggtttcgcggtttggttgcggttatcacacggtttgacacggtaaccacgatatttgcgcggtaaccgtgagttgtgtagccgaatagaataatgctaaaaaaattgaaaaaccacctaaaagtagaaattagggataattagaagaatatataggatacttgtaaacctaacttttggatgtaaaatacagaaaacgggcatgactttttctatattatggagatattttctcctctattgagccggttgcatggtacaacttaaggcccaatacctttttttattttttttcattttctaaactattattcattttgccctcaaatatgattttattttactctttttcaaaaaaaatcttcaccatctacctttttttttaaaaaaaaacaagaactacattcatgctttttttttggaaatgttgaatttggtcaaaattccataaaaccctattgacggtaaccatcatcgtacccctgcggtaagcacggttatcgtgctaacagcacagttttcgacggtaagggaaaccttgacgacaacctacggccccccaccccccacagccttggctctactcaactcttcatcatggatggcgcttgcatgatccatgaccttcttgcttccatcaatgtcaacgaactaggtcgggcagggagggggggggggttagcggaggctaggggccggaggcggttgctacccgtggcctgtcgacaggaggttcccaagctgtcactgtagacgtacaccatcatcacctccacgtggttgcaactcttcgccctgctggcactggcgagctataaaagttattgcggaggatgattcatgggagaagaaggggagcccgccgcggattaccggagctccttgtcgctgacctcacactgccactgcctcctcccgttgacgggcttaccggccaccaccccagcggtgaactcctggggaagagtaggagatgagaggaagagaagaaatgaagggagggaaagtagaggaggccatttacatgtgaccctcatatggtttttctattttattcttactgactaggatatcatgccggcaaaaccacatacccatagtgttataggagtatgacctaatttgacccggttttaagatttccggtattgacgttacataaagtttgagggacgtgaactagacttatttcttatgtgaatgggctatatcgtttcgtttgtaagccttccggcccatcttctgaccagtcggcacaaaaatgggctggaagcctctttcaaagacgttccctgtcttcgtcggcgacggcggcggacgacgccggcggcgagtaggcttccagcaaataccgcggcctaaaccctagcccactccggcgatgaccaggtctcgccccaccccacccgctcgatgggggcgcccgctggatagaggagcagcggccgaccagccgccagtggcgaagctgtcgccgccaccgattcgcgcgccgcggcactgttcccacctagagaatcgcgctgttcgacctcgtcaaccacgacggcgctgccccggcctcccggtacaccctctccgtggctttcggtgacgagggattaaggtattcgttttcgtagttcttatctgttctacttttttgatagtttgatgcacatttggggttaggatgctgcccaccgcgagtgctgattcaaagctaacttactgaatttaaaatgctttgccgacaccggacggcgcagctgagcaactgcggcgccggttttgagagactgggaatactaaattggagtaaatatcccactacgtgagctgaatgcatagggacgatgggagacttgttgtttattatgtgctaaatcgccgacttaatgacagttcattagctgttggccacattagctttaaaactaggaggcttagctatgattttttgttcacttgttaattttttcaagttatgcgcctttttgtgcatcatataatttagagtaattgaaaagaaatgtggtctggttcgttccttcaattcatcccaagaaaaggtctcgcaaagataaatcgtaatgcgtgtatcttttgcagttgggagtgttctgtccaaaagatttctaatcatcataactagcccaactaatttcccaaatcgcgaaaaatctttcagcacttcataaccatcaactacttgatacaaatgtgcaataatatatgtcctctaaagttaagtcctattgttaacatatgtcgaaaagctttccttctttgcttaaagaaaggtgaaggcatggaatgttttgggagtatcaaacactctctcacatcaccaataatgcaccattaaaaattcgtaccatcaactgttgcccctgtattaggacacccttagacatttgcatcaggaacctgacgtgggtgcagaaaattatattaattgtttagcctgctgttgttgctgtctcagttcaaaatgctaattatcagcaatttgtctacctatatttctactaacaacttgtcaaaagttaaaagtaaagcattactcacaacaattgcattggatcatgcattcaactatggtatcaagttgatgaaggacaaaattatatatgattcaactttctggagctgagtctgacagattgaaaagccataggaaacggctgccagttcgcctgtttgtttgtccagtgattccattttggtgatgtttcatataacccaatcaagcaacattcacgaaaaccacatatgttttgatcttgggaacttgttgaagcaatgatctggttatctgaatctatgtaaagcaaatgcactgagataatgatgcacaccagtagactgatatcctcttacttcttttttccttgacagtataacaatgtacaattgttttctttcagaaaaagatgggagcatgcttttaggttcctgtgatctgctttcttcataaattcagtttatggttcatgttgaagacatcctgatgatgtaaatgagatattagttcactggtgggagggacatcatcgcaagtatttaattgggttttgaaggctgatagaatggaactaagatctggagctcatgcaatgctacaactgtggtaatagatgctctttctggattaatgtaattactatggtgaattggcagatgcacattaatcttgtgagtttatattctactgctgattcagatttattcgcttgtcatttggattgcttggttttctgtgattcgatcttgcaactattaccatccattctgtcaggtgcatgatttgaataactctcctgctagattgaaattaaatttaagagtacgaaatttgccgtttcaacttttgatcggcatggcaagctctcatgcattaggaagggacaacctaataaaaaaaatcaatgtagtgcctcatcagcagcattaatgaagtatgcacattagctgtagctgcaccattggactttgacgagtcaaattgtcatttgtgaactactgtaatcactgttttccttttctaatgaagctgattgagatccaaatgctcgtgatgaaaagcacagcatgggatggtgcgccctgtttaagggcagcatgatgagcagaatccaataggtgaaaagattcggcaccatggtgtccctcgcacgcagcttcagcgaagctgcagccagcccaaatagcaagagtaaacaaatgcagccaagtacacagtataggtacatgtcttatgcatgtgaatttgttattatcaatttaccatgttccaacacctgttactactattaaccatgactggtgattgttggctttataatgatatttatatgacctcaccctgtccagttagaaatatgtctgatttagtcagccccaataagccacagccaaacaatatagtttggtattacccagtatcacagtataagtctatcctcctggcacacgatacaagtccatcgacaaaaccaagaggttatttaaccacttgatttttcttcaggtttttgcacgcacaagatcatacctaacgtacaggtacaaaaatatttttataagagccatctatctgtctgtcagtacctgtttctgctaattattagttcttgcttattttttttctctgtacacaaagccagtgcaaattaaaaagattgtactaattttaaactgggcagcatccaagcagagtgaagctactccacgcaagtgggagtttttcctgtcagcaaactcaaacacattggaattaataattgcatcctattgttccctgttcccttccttgtttttccccccgctgcctcctctcctcatatctgcccattcggttataaaagtagacctggtctcgtcccctctttgcaccaacacagcattcttcctgctccagttctagtcttctagggttagaagtgatgagaggtcaagataagctgtgggtaaacaagctcaatcactatggtgtgggtgtagagatctgatctatatatccaggtaattaattaaactaattacgttaagtttactttcgagccatctgtgatcttggcatgactgctggtttgcagctatggctttcaaaagcttgctgtgtcaatctcctagatctaatggttggcacagcaagtatataacacatattttggtttgttcacctagatctgctttcctttactgttccatgtcaatattgatccttgtggaacatagaatataaggggcagcacagatcttgttaaattacatagtgtgcttgatctgtggtaccagtttgattttttctgatacatgggaatctcatactaaatgccaacgttacttttcctttccaaaaatcttgctggttcaggtattatttacatatcaggtgcacttaacatgcatgtacgcttgatctaccaaagatgtcttcagcaagtttattaccatctatcataaaaaataagtatattacaagatgcaacaaagcaaaggtgccactatactgcatatggaaccttaagtgaagtcacctcactgggggttttagagttggagatgcctccattgtgtgtgatgcatattttccacttcggatggctaataaagtaataataacatagcaaaactatatttgttattgacaatacttgacacttgattgtgctaacatttactagttcttcttgtaggttttgtaaccaggggcaataagctagaggcagcaactgcataacttgcgagaaacttgtaagatttctttacaacctatggaaaagataggtttacttgtcttaattttttgctgttcttgttaactaggaaaccagaagaattattaacaagagagaatttataacaaacaaatttgatgccaattctatccttgactctttttttttctattttttttatctcttgagtcatctagtcatttcactgtttgaaagttgggaacatctgcatcacctaagatatgatcctacctatccctgtggaatgtgttatctgtgtgttcagtttacaggctgtgttactaaaataatgcatgtatttgtgagtagtagtgttctgatgtgatgaccttcaagctagacctccacatttgcgagaactttcaccatcaagacaaaaaaacatgatgaaacaacctatccaatacatataaagcgccataggatgaactcactcataccaaactggcactctcatggtatggtatgacatgtggaaatgggtatacgcatgagatctcccggaactgaattcactttgatataataacaccttggcatgtaatagcattagtaaatgacgtccaaggaatattagagtaatcatagcgttaatactgtaaaaggaacatattacttgtactagtccttgattgacattcagggtctgtttagttcccacaccacaccctgtcacatcgaacgtttgaacacctgcatgaagtattaaatataggctaaaaaaataactaattgcacagattgcgactaattttgagatgaatcttttaagcctaagtgctccatgatttgacaatgcgggattaattaggcttaataaattcgtctcgcggtttactaacggattttgtaattagtttttttattagtgcccaaacaccccatgcgacaccctatataatatccgatatgacacgctaaaactttacacctctagatctaaacaccccctcaatacgtactgaaacagctaccggaatccagaagtaaaactttttcacctgagtatcacataagctcagccatttcgctatggtactctaaggtctaaacatggcaaatagtctaagtctgtaacaattattatagatatcagtacaaacaacttaatggtgaggagacagttatatcatgattttcatgctgattattattcctatatatgatgtgcttccttcaggttggatgatgatcttgccaatgattttgccgcaagttatgcagttgctgcctcaagcttactgcctttgtttgctaaaccatgaaaccagcacaacaataagagactccaattgcaagagaccttccaggaaatctttagtaggcatcatatgttcaatacaaatatacctgaggttgttagagcaaattatctgctcatgtacgattacactatctctattatcagaaaatcacaagaacttttgttgctgggttttgcattagtacaagtatctggctcctgatttttcttgacgtttatcattttccattctgagctatacgagcaataggctccggattgtagtgatctcctgtgcaagttttacctcttcggcaaaaaataattgtcggcctacggggcaaactattctgtcccctctaactaataatgtctttgaacattttgatcatataccctcccattttatcaaaaattgaggatttattcttctgtcactgacatgtagggtttatctgagggcattgacatgcggaccatgagggtaaatcctcaattttaatctaatgggagggcatatgatcaagatccacattaaggaccagctatttaaaatacggaaattaaattcttaaaaaaatagtaagtagatctgtatacttgtaacatttcaatttattaggttactgcaacaaaattgatggagaaaatactccaaagagtcgtgtgtgaattatgaccagatatttgtacctttcaatacggtggaactttcctgcttaatgacagtagaaatcacaatgtaaatgaactagtcacttgattataaagcctcatttagaggatcacaacccttacatgggtttctttggaattcagatagaataggctcttccatagggattttggatttaaattttgtgaggtcatatgtcatgttttcatttctttgtttttgtaatcttatatttctagactttgtttcctacaaatgccttgtaaagttttcacgagttgttcattcctctggattttaaaggatgtgacgctattatattttttctttaagccacaaacaactaaatttcaactcatttcaagtgacaagctaatgccaacgcccaacgcatcattcgttggccattttcttgtgcatttgcctatacacagtttgttcttaatctagccttattcagatttatgtgaatggaagtcctctacgttatagtgttcatggctgtgtggttaacacttaacagtctataggattgtttaattcatggtaaaacctggttcgatggaaaaatagccaaattattttcccggtccttgaaagaggtaccgagagtgttgtgctgaatggatgaataactgtatagtttgtgataataattcgaatgtacaaacgaactaagggtgcgttcgttggattgggtgagaaagccccatcgtattccgcgcgcacgcttcccaaactattaaacggtgtattttttataaaaattttctataagaaagttgctttaaaaaaattatattaatctatttttaaaatttaaaatagctaatacttcaattaatcatgcgctaatggctcacctcgttttgcgtatcttcccaatcttctcaaactccttctcctcaaactcaccctaactatatattataaagttgaaatataaatttgaaatgtttttttaagaaatttatatatataaagtttttatgaaaattatgaaccatgggcagtttgaccaaaccatcgtcaacccgacaaataagccttcctagatttttattgagaatctcactatcgcattagccactgataaatctataaaggaaagggaaaaaaaagactttgttagagcatccattgcttgaactcctctctctcaaatatggagtagttacttaggactattttttagtaactatagtaatatgagtgagttgtaacttgggtcaatttttattaccaaagtttaggaaaatatataatataaaccatatatgtagtgtaaatctgaaaactaccatgggatcgagaaatagacgtatgatatttgtccatgtcacctggagtaaaatttttactcttataattaaccagattactgagagtaaaaaaaatatcaggcttctacttctcaatcttacagtagttttacactagatatgtaatttgcaccatatattttctcccaaagttttattttggatcatcatttacattttttttaccttttttaggttgaatgctacaaggcatttgccccgtactgtttttttttccctttagcctaggttttttttttttcaatttggaacactccgatcactctcctttagcacaccaacgacatcaagcacatcgccaccacgcatcagcgaactctcctacgaccaagccatactttcctggagaagacgatatggatggttaaggaatagagtcagggtagtaaaataaatatagagttggccaaaagttactttaacagtgaaagatgccccaaaaatgcaattcactctagtaatattttgacaactacaacaaaaagtgtctttgaataattatccaatccaaaaaatgtgttttgagctaaactaggcacgaacttaaaatatcaacaagtccgaatcaaccatataatcttagaagaaaaagaggtccaaaccttaacccacttgtcaaggaggaaatcaactgctgccacatgagcttagttgtaagtatgaagtagccaaactagatgccgacttcaacttttcactagtcaaattatactggcatttatttatatactccaaaaaaggttcaaagaatcaaagtagagcaaattatctatctatatgtctggtcagtgctgaatgttcaaaccagtatcaacttgttaaatttaataatctaaacgagcagagagtgcaaagaatataagatatttttaaaaaactatgaaaattatgaaagaaagccatggtataaactatcggtggctaaaagcatgtgaactttggcggcgagctgcatctgtgctggcacaaactgttttattctgcactagtaacgtagtttttaacacccatctgattaaaaatcgacaaaatgagtagctacctactttgtttaaaggtgtgtaattgaatattagcacataatttagatgggggaatatgtcttgggatgtgtgaagagaggcagtgtcttaacattgccaatatgttattagcaataatgcatcattaagaattggctacattagaagattccggtagtaaagcgtatccagcagacacacatccgcatgtagagtatcagacaccatacctcacgtggctgctgaggaaaaggctaattattggcctaaatgccgcgattggggtgcgtttacactagcataattttattacctcgacggttagtaagatcttattacctcgacggttattgaattggaaagaagtccatttcacccttggcttttccttgtcgactgacgatggcaacacatcaaattatccgtctaccagagcatcctaaaatttaactcataaaattcttggattgggaccatcccaaaagaaattgggcccaaaaatcactttctactacaagagtgcccataaatttggttttcaataactttaaaatatgccacatcatctcaagtagatcctgcttcaaccgtttatgtctttccatttttccggtaagagggagattggcgctgggaattgccaaccaatcacgcactagcggctcagctatgctgtgcagtagggtgatctttcgcgtgcctagcagctacggcagcccacggcgagggcgtcggcaagtctgcaaggcacatcgaggaggcaggtagggccactccagggttcatccatctcgtcataacgcgtgacaagggaagaaaaggcgtgagcggcaaaaacctcccgtgatttcatcaattgggagtgcgtggaggtgtccaaaattggttcagattgattctagttttaggtgtaggtaaatagtgggaccatctttgggcatctcttggagagatggttttagactggattcctaaaatttatcttttagactagattcctaaaagagtatctccattttttaggcgtgtcacatcaggtattatatagggtgtcgcatggggtgttcggcattaataaaataataattacagaatccgttagtaaaccgcgagacgaatttattcagcctaattaatccgtaattagcaaatgtttactgtaacgccacattgtcgaatcatggagcaattaggcttaaaagatttgtcttgcaaagtagtcgcaatatgtgcaattagttattttttagcctatatttaatacttcatgcatgtgttcaaacgttagatgtgacagggtgaaaaatttttgggtgggatctaaacagggccttaaacacaatcctaagtccccaaacaattctgaggggttaaagctaaaaacaagttatagcaaacacctacaatgagagcaaaattaaaaagtcctccgtcggtatccctgcaccaccggtccttctctagctagctatttctacaccatccaccctccccaccctctcaaacctctaccacaccttgcaaactccaataccactgtttgtgcagaccttagcggatgaagagtgcaacaatgccatcttcggctgcctcccgagctaagcacctccaccattctctctgtcctccttcatgtcccttgcaccgattaggctgtgttgcgccgtaggccctagtttaaggcagggttgaaatagaatagaacaaaatagttctaataaatgagagtagtgctgaagtttgaggcattattccttaggaaattggataacccctatttagtttttaggagctctaaactatgggctattgctagggatgttctaatatggttggaaatctttataagggttggaagtgttccaaatactttttcctcatggcatgcttttgggtcgcaatctcttgttacgaaccttcggcactcggtgctcgagctattgcttagctgcagtaagcaaacacaactgctctttactttgtagatacatgtgcttgcctgtagcgatgacgtggcgagaattacagacaccagtgaggaagaacaacgactatgtttgcttgaggggttgaagttgacctaatagtttaaactcaatatcgatccaaagtgtaacagaatacaaagatttatgatattgagtgaaaatattgagcttgatctaatgtacttttaaactttgagcaaagtgatagtgggcatgttcgacttagattgctctagtagcagtggttgctgtaaaacacgtatgctgctatcgtgcagctgtaatcaagtggtaccgaacaatagtctaatgtaaagttttactccataatataataatgtatttattgataccgtcatttttttctatttagactaaattgtactcacgatacaccaacttaacatgtggatgcaaatttagttattttgagcatctttttatatacatttagtttgtaagtgtttattttgtcaatgtacttgtacaaatatgtaaaagtatatatttttttcaatctaatcactaaaagtcaattaaattttactatgtaaaaaatgtatatctcagataagatttgagaaggtttttaaaaaaatcctgaccgctggtgtaaattgaatgaggaacgcaattcttatatgttaaatccaagattttaaagtaatattcgcacgattgctatatgatatcatattggcatcgtaagaaaaactcatctagcacccgtggactaaaatagcacatattgagctaagttattgtatcaaaatactagtttgataagttcttatactagaacgcatccacattaccaggttgtttcccttcgacgttcaattctcaagttcttaactaaattgttgcatcattttttaaagagtaaattatatgttgggttcttacctaagtttcaccatgaaccaggtgtcagcacacattttcatttaggactagtcattattaccaaaactttcaatttgaactagaggaccacctgccatcaagacaagttgtctcgaggaggaggaggagaggagaggagattgagataacttggaagtgatttattaacgtgaatataatttactcttttattccagtgatcgaggctatgctttcataacttatcttctcattttttacgtgcatgctttccaaactactgaacgacgtgtttttgcaaaagttttttaatacgaaagttgctttaaaaatcatattaactcatttttttaataatttaaactaatattatattagttatacggtaacgagtgtttcgtcgtatgtgctggacatcccgaacacagcctatgagagttgctagcttgctatacgctctctggtctatgctgctctgcctgtcttgctcgtcctctgccgcggagacacttgctccctctgttctgattttgacatcttgcttgtaatattttaccactcgtcttattttaaataaatatataaatataaaaaacgaaaagttatgcttaaagtacttttaataataaagtaagtaaaaaataattctaaatttttttaataagacgagtggtcaaacagtaaaatgtcaaaatccctaataacttatactttctctgttttatattataagcctttatagcattacccacgttcatatatatatgttaatgaatctaaacatatatgcgtacctagattcattaatatatatatatacatatacatatatatatacatatatatatacatatacatatatatatatatatacatatatatatatatatgtatatatatacatatgtatatatatatatatatatatatgtatatgtatatatatatgtatatatatatgtatatgtatatgtgagaatgtgaaggatgctgggaagttttataacctgaaacggaggtagtattagtgacggagggagcataatagataaactcgttgtcgtcgtcccgtgcggtgcggcccccgctacccgccgcgcgatgccccctcttctccgcccgcctgatctagggttttactggagccgccgcgcgcagcgaccagccgaccacggacgaggacgaggggatcaggtgagcccgccgccactctctcccccacccctccgaacccgttcaattcagctccccgcggatgtgatcttggttaggggctagggttgggtcggttaacgaagatcggttccgcgtctcatcgtggcgtgtgtcttcgcgtgtgtgtgttgggttggggggagtccgcgcatgcgttgtgtgggtttttttttttcaatgctggatgcgattgaaattgagcagaatgcccagtttactcattcagaccgaatgagcttcatttactcattcatctagtgttggtgttggaagttttgaagacctgagtatgcggtggctatataatgtttttgttgcagatcagttagctttgctggttggacaaatcgagtcctagatatcttggatttttcttttttccatagcagaaggttgtgggtaaaggtggtgcaagacaacatggaatataaaaggccattgtattcatgctggctgaataaatactagtttctcgcacacattatccaatggactctgttttttcattgtgcataggcgaagggggttatgttgtttaaataaagcattagggcaccattatatttccatatgcacggactatttctcattatatattctataattgacactgaaccagtagggtctgaaaaggtcatataagcttagctgtgagtagctcagatattcttttcctatttattttggctgaacaaatttaacaattttagctaatattcgtttcaatatatcttagatgcaaaaaaaagatatgccttgatgcaaaatttagtcgcttttgcttgcatcgtgtagatttattgctattgtgcccctatgctctggcctccaggcttactcacgacaggtgatggaactaccaacatctgtagctttccacccatgcagtcttgtgccaggctggttgcatgctttagctgttttgcatgtgtcgtctgtcctatttttgttttcttgatgtcagttgaccaatggaaaatcttatgagtataggattaaacaatggtctaaaagtcggtgctaggtactgggtagccactgtaatttggtgcttccctgccttgggggctctatattgctatgtaatgttatattgtcttctttcatgtcatatgcttcccaactgcttgaaactccatagtcaagtttgttctaggctgtaggcaccgcctagttgacatctaggtgctaggtgccagccttgctgaccctctagcgcctagcggcttcttgaaccaatagtattaaagtgaataagtgttttagcatttgttttggaagatatagctttactacggggtatgaataccattatcccaaagagttgatggcatttttcaaatttttttagatgattgatccgtaattt

SEQ ID NO: 54877 - DNA, 1215 bp, Oryza sativa
attttatgttagaataaatgtataaaatctaataagtttatgatattacaatagtacttttcgaggcaaatttatgtatataatttcttttatttttaaactaagcatttaagaaaccaatgatggttggaattttcaaagtttgatcaaatcttggtctaaacaacaaatattttgaccagaggtagtattaacgttaaaaaattaatatgaagtagcttcatggtacttggaaacagaatatagaatgtaagttctatatgttttctatagggactatctatatttatggcaccatatgaaaaaaatagttaaatgttttagcatgtactatttacaccgtaaattccatatcttggtccatatatttacactgtaaattacaacttacactgtaacttaaaacttacacagtaattttctctaatacttacatatatacaataactagaaagtactagtgcaaacttacattaaaaggtgatggatccaaaacaagtagcaaaagggcaccaatttcaatcatccagatgcatggtgaacctaagctgcatgtgaacctaatcatattggcatgaacgtccagatgcatggtgccataggctcaaggcaaaaacgagcggtagaactacgactgaaaacagaccaaaacagaaatatagcaaaatcgttttctatatatttattctccatatgtaagatcattgggggtgccaagttacccactatcccaattccgcatccttggtcacgtgggtggctcatttgtgaacttctaatgtatcactggatattattctgctgtttagcattttagatcatcggcaatttccttatattccaagcagcttcattgcatttcaaaagtaaccacatgcatctaccaagttcaaatcaatacaagatcaagtgcctatgtttggcgcgatacaaataagtgctgtgcactctctgccctgcattattttgaaccacaagaactacatagtcttcagaacagcagaatacatgacataaactctgttctggttgaatgggttcccagcaacttgaacaaaaaactgaactaaactgataaattgttcatgcagaaaatattgcatgggtaatgctttgaagtttagcttcgaggttttatagtgacaccaaagaaaatatgccattagtcacttaatcttagcgtttgccatcctcacttgggctgaagtctgctgc

SEQ ID NO: 54878 - DNA, 6326 bp, Oryza sativa
gttgacaagttctcgaaaaccggtcggtttaggcaaaattccgatcgaaatcatcgaaatttcgatctgtaatactgtaatttggaccaactactaactgggcctagtacatgcaatctggcccatgtaagtgttttcctttttttaattctttattcttttctttcctgatgtaagtttaagtaaatacacacaatacatcatttttttttgaatatttatatcccaataggttctatgaatatcatagtatttataggattttatttgtttttttctttttttatcaattcaaatttgaatttggatcaaagtcctcgaaatcttagacggtttctactttcgagcctcgtcggaatgtcgaaattttgtgaaatccgattttatttcgttggaatcgtaaaccctggtgatagtaacaatcttaggttgagatcaacatatccaatccaacaattgtaacctacttggtacatatgctccataacagtaactgcaatgagttaagaaaaaaaggtcactggaacgtgttggttctctaccctaccaattcaatggtagtgccaaaatctaggtaaattttgacactaccaattatttggtagggtagaattcatataatgtgtttggtttggtaccatttgctaccaatatgcttgttatagtgaagaaagttctagaatgctaccaaattagctatgggtattgccaatactttggctctaatccaaaccaatcaaactactatttgaactgccaaacaattggtagggcacattttggcatcgatccaaaatggcccattttggattgaagccaaaacatgaccttaccaatctattggtatcttgaagatattgtatggttggattaaagccaaatcattggtaatgcccattaacaatttggcactaatctagaactttcttctctatatcatcaatatttggctttatattggtagcaattcaaatatgtaccatgcatctctaccctaccaaagaattggtagtgccaaaacatgccaaaaatttggcactagcaaagatttggtagggtaaagaaccaaacagcttttgtttcagtcagaaagttaagtggggcaaaaagattgcccaaaatattatgaaatacctctcgatatacctttgatttcacaatatgttgtattaatttatgttttacaggcatacaacagatccaactttcaatgacatgtttattgtttagtttagctacaataattgttgggtagttgtagagcagcacatggtacttatgccacaagcccgcaaataaaataattcgcatttgctcatcctaattcatgctagcatctctattgcagaacaattttgatactattttttttttaaaattagccttgaaaatgccacttcccctaaggaatgacaaatgcatttttttttacaaatgcaaaaacttgcaggtagacacatatttggcaggtgaattcgtgtcatatggacatatctttcattggaagatatgtccatatgttggagctatttcaccagttctttcattggaataatgttagcatttaatcagtgatataggagatgattcaccttcaacaagctctcatttatcatcatgacgagtcagaagaatccgattgtcaagttacgccttctaccatatactccccaccaaaaacagctaccactggtaaataaattgctttctgttctaattggtgcctgaatttctgtatgctagatctgattgtttgttgctttcctggtattgtgtagtttttagttatgatgtacataatcctaagttaatccagaaattaatttttgagttctttctggagtttattcagtagtttataggttgtgaccaccagtgtccttttatggctgaatacaactcaaagaatcttcatgttggagttggattcactttggcagttcatacagtggatgctgatagatgcgctcgattattcctgtcgatagcatcctagtattgtgtctttatatagctatatctagcattttcatgtaaaagtctatctgttctgtggatgggtgctcttattggttgcagcaatcaggataatcagctaaaataatgatatattgcagccttgtcagcctttattatatactgggttccctaaatggtcatctagtcattagtgccaaagtgcatgtagtcttctctgatcgttatttataactttatatgccaatggatgttacagacaacgtagtgtatgtcaatctatctggcgttttatttatcagaatactagaagagaatttgcaccagtggttcaagtaaatccctgaacattgaaactagatagtttgggctttttggcccctaatcttgtttgattgatacaaacaagtcaacgggtcacaagtgcttttgactgacagactacatccgtttctctcctttcatcttcactctttcccatcgaattctcctcttatctttcttcattcttccccatctttgaccaaattagccgcatcctatgcctggtggaatattctgacacacaatagcagtgtggcttgtttcagcagaaaatatttgacaggcgttgattgcaaagctgtcacagctgcacccatctgatcagatataggtaaactgagatgtggttctcagccagtgggaatgatgtacaaccacgttgtcattcaggggaactaaaaaccatctactcctgtttttagcaactcacatacagtacagatacctagaatcaacagatatccctactttaaccactttaaacaagtctgaggacatatattcctagtatcaatgttcatacactgaaccagtaatgcaaggttcaggacatacaatgcaatttactcttgttttcttttatagttcatttgtcctcattttggtccctgatttaagttggacattcttatctcactagacggttgggtaagtaatgttaggggtcaaaatatagtggagttatgctatccaatcttgaaagcaatgtagagctttgatctgttactatccagtactacagtgaacagctagacttggagctagtgatttactcccttattggatacggatattgaagtagatatgggctggatgcctatactatgtaaattcacccattgacggttcattggctcagtcagatagagaacatgcctgcttaactgaattagtgaaagcaacgccaaataactaagtggcaactcttatcagcaaaactaatttgtgattatgatctgtggcttgtttatttcaaccatttcttttatatgaattgcgtgtaactcagaatttcatgtgaatactgagtaactagcacatctattttgatttgggcccaatttttcaactggcaagaaagaattggagtacaagatcaaagggtgggagtaactcttagtcttaggcatcgggattgggcaggatttgttgtgcacctaattttctttcatttctcgtacttgaacttgtttgtgcatataagtatgtgatcatccaactatttctaagaggaaattagccacaagcaacaaataggaagtttttatattcatacctttgcctcagaacttgcgttcatggtttgatggggatcttctttcgtctcattgtatctctcaattatggatttcatgctggttgaaaaaaaaaatcaagatcccattagaacacatgtcaacacatgccacagtagtgttgaatgctatcatatagctcctgcaagcttattttgtagtacatgggcatcagtatgtaagatgacaaatgcaaacttttaatgaaggcctagttctttgacaagtaatccacgtggatagataactgtaaggtcaacacaaagaattaagtgtggagtgttttgagttaattggttcttactgcttaatttcctgttatcttaaaacttcctgttatcttaaaactagacactgttctcctaatttgtcatccttttcctatttagtttgttgttttctacgaatcttgagctatttgtatggagaaaaagcagtgacaatggtaaaagatggttttgaaggcactacaagacatgcctcaagttataaccgtgctgttacgaggatccaagcatccaaaacacttggaagattaagcttcaggcgttgtcaacataatgcataattagttgcatacttcagtggatgattgaacgggatgtttggatatgcaaatatttctatgcatccggactgaatactttctgaacacaaagcaagccaacctgccatggccatgacacgatggttctatccatattttcctatttgtcatgtacggctgggctgggcctagcaccaaaactattcgttgttgtttattattattaggtaattaggttattcgtagatcatggttgtttattttattatgaacattttgataacattttttttaaaaaattaaagcctttatttttccgatcatgtggaggacgcacactgatatatacgtatatcacacgttatataagaaacgtgcttgaacacacgggcaagagatagatactatataggagtagcgatgaatccataacttcactaaattaaacgtgcacccatatgtgagtaatcatgagcatcaagatttaaattctatcagagttgctcgcccaccccctttcaagaaaaatccattaattaatcttgttacataggagtatcgttgtgaatagcatggcaaacaatacagttgtctcctgatatgtcctagctccttgtatagattcgttggataatgtgtcccggataatgtgtcccatccagtttcaaattgctatattttgagacaaaaggagtaactttttttcccctttggatttactttgaaacctatttttaagtttcagaaaacaacgtatctatagatgatacataatatcttactatatgtagtttaataagccaggatgaacaatgtagaattaatcatattcttttgtacgataacataatagacttcgacaattgttgagggacataaagtaaagatcttgataaagctgttgtcctagctacatgtatctctctaccaccaggttgattcattgagtagctagtgagggaggaagaaaaaaaaaacaagcgttctttcatttcattctcattcaccaagagatggaaattttgaatattgtacgaatccttatacattgtagttaacgacaagtccattatcgcactaaattcaatttgaaagtactgagaatagtgataaatctttgatcatatttctattaaaaacacacgtatattacacatgtgtaatattattggacatcagaatttaaatcctatcatacaaagacatgcacctagctatgactcaatcttatctatgatagtttccattgattttgaggaaattttagcacgttctgtttgaggattctcctcattcaagggttggaatggtctattgatcgcgcagaaccatccaaaaattacttaaatcaaaccagtaaagtcgatttcagagtaagaatctaagtggtccaatcaccgtacagatctctccaaagcaaacgcatcatgtaccaagttggtacgaggtatctctgctacttgcacatcatcactgccctaaactaaagtcaaccaaagcgttctaacttccaagacatgcttaaccccgtaattagcagatctaattaggagcttagatcctaattaagctaactaatgtgggagtgaagcaaagaaaaaaaacaaatacctggagctggcaaagtcatagagacggctggtgctggagaagacgaggaggccgacctcggcatcgcagaggatggagagctccctcgccttcttgaacagcccgctccgccgcttcgagaatgtcacctgtcggctcgtcgcgttgtcgatcctctttatctctatcttccctctccccatcttccccttcgatctcctcctccttttccctcttacagatctacgcagaaataacaattagcagcagcaacaacctcggctatctttcaagccaagctctctatctatctctaatcttgtgctaatctccttagagtgctctttacaggtagctctatttctctaatcaaggctggttagctagctaggtagctagccctgatgcactacaacttcttccttaagaaagtattccaagagaggacataaaataaaaaaaatatatagttaaacaagtacagggcgcgtttggaggctgcacgatgcaggcagggtcttccaggatcaatcaattaatcccttttttagctttcgtctacctcgtcctcatttgttaatgtgccatgataa

SEQ ID NO: 54879 - DNA, 1299 bp, Oryza sativa
tcgggcttacccatggcgcgaggctaccactctaccagcgagacctggaacgtggatatgcaagcatgataacttatttgaggatgaggcggcgcagaagggcgatcgtgcgaggcggctagggtttagtgtcggttggcaaaatccatgccgtctgtttttatctacgatcgcacaggagtggaagggccagcacagcgggacacgtggacatccagatcgagcctagcggtagaacggatggtcgacggttgcagggattaatgtgtaattaattgaaagagtaaggacttctttgcaaaaacatcgctgaaattctcagcaatctcacgcggtctagagaggttaatataatatatatggttatcatatatatacatataccgttaaattgttttagaattttcatgaaattttagcctgattaattcagttttactgatttaagtatgggtagttaaaaaagataatgaatatagatatcaacttgttggtattttactttgaattaagaattaaatagaattagttgcttggatcatcaataggtagccactgttgcacttgagtccggctaaccatggactcacgagtcagtggcggatgtatcctttggggtttgttagggctagagctccacctccacagtgacagcaacccctccccccctcccccctcgggcggctcaaatcctggcccattcactactataaaaaaacgtttttccatgcagccaaaacacgttttcgtaggtggccaaaccttccgactgtatctaaaggcctgtcaaaatcctcaatttttactggcggaccaaagcactgctcgcaggcagcagtttcaatcttcccaggcgttgcttgcgaaaatactcttggcgccaaaaaaatttcccgccagccccgccccctccctagggtttcaaatcacaaattctcttaaatctcatccaggaaacaaaatccaatcataaacatccatacatcaacacaagagcattggattcaaatccatagcatcaacttgcaaattaacatcaatcaacatgtaaactaaaaaaaacaacgtcgtcgttaccggcaaactcctccgtgcctcctccgctaccgcacgcaacggcagatccggccggagggaggggacagccgcgccgccgccgctgctgccctccccctctggcgggatctaggagggagaggaaaatgggggagggggggccctccaagcgttgccgttgcatgcggtgaccgccgtcaccgccctccccactccggccggatcaaggagggagggaggtgt

SEQ ID NO: 54880 - DNA, 2140 bp, Oryza sativa
agatgagggagggagtaatatgggagtacgtaagtgtgggcgatttttataagttattatttttttaggcggacgtcttaaggtcatgcctgcaaaaataacaataatctcgtcctatgaaaaatccaacaaataagaacaacatgtcaagacacgttttagatcctagtgaaactgtttatttgtgattataattggaattataatgctaaactctatatttaatttgatctgcaggtcattgatgcatttttatgtgtttatgccatcgtatttgattaacaagtaccgacagttgattccttagtttattttttcttttctatatacaaaatttaaattatatttgcatgagaccgacaaatgtatattttttaaatgtttttattgcattgtgggttggacataggatattaggagcacctcctctattttcatcctagattcaccactgttacaagtcacgtacagagaaactggttgatgaacgggagataggtcgactgaaaacagaggcactattctcaatcaatgttgtaaaaaagtcagaatatgggttacatgctcaaactattgcacaactaactattattcaaagtagttctataccaaaataccatagtgcatagacaaatcattggtttgtctggaaacctatcgctgaaagcacaaacgtaaagcatgtatatgcctagtagcttacttgggttgtgacctataggcccacatatcaagtagaaaatattttcggctcgatcattaaacgtcttaattgggtcattaactgctaatcaactttgaattaattggccattttggtttttatgcaccaaaacatgttccaaactgcagtcggatgaaaaagagatgagaagtcgaaaaaatgaaacggaccacgtacgacaaaaacgatatcaatgtttataataggtaaatgatatggggatggagtgatatggcgagggagcgatctgattaaaaaaattaacggaaagttagattagattttttattttctattttcagggtcggtatatcagaggacaactaaaacactacgaaatttttaattaggtaaagatttgctttcacattatttcattctctcgggctcatttcttgtccaggctaccaaaaaaataataaaccctctcatatgcctgatgaggtaaaattttccatagattcttttacacacattcatgttatttttttttctcatgctcatcactcagggcaccaatgcaaccaaatgcccctacgaatgtggacttttacggtacaatatactgctaatatatacagcaagtatacaggatctatcggtgtagattgatttgattttttagttaatcagattgcagtataaaatttgaaagggtaattttatcttttctttgttattctatcatcaaatcgtactatcatcacgtgtttcgtcatcaaatgatgctcaggatgctcctgccctagtgcacgataagatccaggactagatactctcaattagagtcaatctgaacaaaaagattactgaagtgtattttttattttctatcaaatttctaacttgctcgataccagatgatggagcataaaaatacaacttagcctgaaatgttggtttcggaaagatggaataccggaatgatcgaaatgctgtatttcctcaaaacaccagcgctcactgaaagaagtgcaaaatggacgtttaagaactgttttccttgctaggtctctggctctcaccgctcctcatgctgactgttccaatgtcaacttgcatgacagctttgcgctacgcctcaatctcaatgtcaacttaatttacagctttgtgctaatatatcaatgcctccaacaatgcttcaataatgtcaacttgacaggtttgtgctgatcaacgcctcaatatatattaatgtcaacagttgcaataattataaactcgatgaacaggaataattgttgtactattgtttcagtaggtaaatcaaatggagttagactaatttggctgtgttctgcttttgcaacttcctcgatcgtttactatgagcacactttctaaattattaaacgatgtatttaaaaaaatgttttgtataattttttttaaaaatcaaataagggctgcagg

SEQ ID NO: 54881 - DNA, 1033 bp, Oryza sativa
  unsure (1)..(1033): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnntagttgtggcatacatgaatttaacacgtggctccaaattgtggcgttttccattttggttcttttggggtcttctggtacttcagtgcttctacaagattctggtgcgccatatagcatccaagtccttgtggaatggtcgtagttcagaacttcttcaggagtacatgggtgccaatggtaacaagagcaactttaatcctgaaatatgcaacccagagactatggaaggatacaagtacttggtttatggagagttacagaaaagccgaaagagtgcacacattctaaaagttgaagacttgaagtccctagttaccttggacaagatttggcgatgtgatagtgccttgctgctaacctccatcaacatgcaggggaacaacatgaaggacatggccctggcatttgcattatctcggttgctccggtgtaggctggaaggagcaacgttgcatgaagctactgtttccatgacccgaaagctaatcagcaagatgatcctctcagatagtgctgacaaggtactgttcggtatcctggagctggatgtcaggttcctccgggattccctccactccagttatcctatggtcttctgcagagggcttctttcgctcttcttcactcttctgctgtctttggtgaagtttttcatggctacatggctttttgtagatgtcaatatggtgcatgtcccaaaatcagtacgagacaggccctcgggcccgttttagttattcgctgcactcatttggttacgattcaggtatcactgcagcagccatgtacatagtaatgattgatgagatttttaggatgctcgggtacttcctatcaaggtgggcaaaactaatagccatgtgcaactttgtgaatttcagaaacagatggctgaaatatgtcattgcgaatacacctgccagatatggggaaagaactata

SEQ ID NO: 54882 - DNA, 9073 bp, Oryza sativa
aatcgttgcacatccaggtttgacaaaaaaaaacaaacatgattcagagccaacagtaatccattatctatgaaacaacagaacatggggaccacaaaaaaaagcatgttgcacgctgcaaattgcatgatcacttctatagtaaactgcaaattgcaaacaaaaagtctttaaaaaaatgaataaataaactaaaccaaatgtcagcttccacaaattgaaaacaaattaaggttgtgtttcagaagagaggaaggacaagattgaaaagatacgtatgagttaagccattagcattagcatatgattaacgagtattaattattttaaacttaaaaatagattaatataatttttaaagcaacttccctattgtcacatcacaatctggcaccgccgtacaacggcacctgataggagcgtgttgtaggaaaaacgacgcgaaccgctttctacgaaaccgcgatctcagtaccagtcccaggacatagtgctggtacccacagtgacaaatatgaatcattgcaatccttaaaataaatagaggacttatttaccttaacttagattgcagctcagaacagccagagaatgcaaccgacgacacgaacgaggaaacaccaacaacagcagcagcagcagcggaaccaatgaactaacacccaacaccacaggcgacggctgggaaccaggacgaaaccctaatcttcacttcacttcacgacggaggaactatatatatttatatagagcaaggatgagtactttcgtacttagcaagtcacgagaatttaggtgtttaatgcaagcttagaagagaggcaaggttgttttgcaaatcctttatttgaaatccattttgaaaccactaagtgatttatttctttttaagtttgggtcgaaaagagacttgcgtctcaactcgacttaagagatgcttttcaacaactcaattggtaatgtaccgacctcccgggtcagatcattacttctcggctcccagagccatttcacttgattaatcggctcccagagccttttcattttctcggactcccaaagtccagctgcccagcagcacaacaatctgcttccactcgggaagcctagtctatgatgcccgtagacatcccgaatcacatagattcgttccttgaccactcaagtcatccatctgccacataggctgattctggtaacgattcccaaaccacaacaacttttcacaaagcattggcaaacaaatctacgctacaggaaacacctcacatccgcccatgaccgtgggcacggctgttcgaacagttagttaacctctgcagagggggtacactttacccacacgacattactaacccggatcacccagcccgtgagatcaaccacatcgggagaccttaaggctttcatgacaaggcatttcgaaagccgacacaggtttaccatacgccgacaagaggggtcccagaccaacaacaggttatgtcccagaccatactgtgccaggaagcccaggggtcctacccgacaccaccctggagaatccacttctctcggcatcaaggctcccctgattagctacttacttagccagggtgtcccatttcacccatgtggtcgcacttgttatatgctcggatgaattccccacaggaatcggtccttatatgcgaatacgggacagtgccacacaggcacaacccccgcatcgcgagttttcataatttattttattttcaaacacgccgacaccacatgtcgagttttcaaggcttcttaaacccatttcccaagttttcgacaatcaacggtgtatgtgggatatttggtatacgcgctcagagagcacggataccgaagtaccacaagggtggagcgacaaggaaattagggtatattagcctataggaagtagtgcgactactgggtaggtccatcggtttggcacgcaaaccaaggccaagcatgttatgagtgtgttgctaattgttgtcgaaacgacaaccgcatacgtcaaaagacatggtcacccaacagtggttggaaaagaagtaaagtgtattaatttgagaatttttcttcggatccccctattacatggccctatgagactatttatagcccccattacagattcttactactagggttttggttatacagtggaatttacatggttgcccttataaagggacatttacatgggtacatagtgtaattgaggttcatgggcccctgatgggccgtcgggcgatcatcggcccaatagcccctaggcttgatgggccggaaaagcttcttcggtcctcgctggggcgaacttgctatggcgaagtcgtctcccttcggcatatattcttcgccctgcatccttcgcccaagaggcctctggcttggcaaagcacccgcgcaatccctcgcctctcgccgtccctgttccatagtcttcgccatggggggacttcgccctgactaactttgacgtctcgggcttgaatccccactcttcgcatggtttcggtaggtttggtcgaagggcctcatgccataccgccaacaagcccctcatgggcaagggtgagattggagcttcggccgagaccatgcaaaccatgtggtatggtatgtggcgccccctttcgaccgatgctcctgccgaaacctacattgttcctgcaaatagagtttgttgtctgtgcggctggtatcgttttgccgctcttcgcctcctgcggacggtggtatattatttttatttttcccgggccgaaaggaacagtaatgggccctccctttgtggctttttactgtgcaacttggtcgatgggaatttactgtttcacctaccctcgcgacacgtggcgctttattactggtgggtaggcgaaacgtcacctgggtgggctatatattctctccccgttcccttttcaccgctagacccgtcactttcaccgctcacgcgctcttcctccgtttttgctttcacggcaccccttggccctttagacccttctctcgccccctttgttcgccactgcacacacccttcgtcactgcatatatccttcgtcatggctccccgcaagcctaacccctctttggcgaaagggccctaccccggtcggattgacgacgacaccaccgcctatttagggatttcactcatagacgacagcgagttggcgaagttggtcagctctggggcattagtcgaggggtaggctttcgccccggggaaagctgttgtaccgaagcccgtcgacaaccggacggtggtgttcgccgtgttttttgaggcggggctccggtttccgtgcaacgagttgttgccaaagatccttcgccttttccatgtggagctcccatagttgagcccgccggcgctggttcggatcgctatctttgactaggcgtgccggacttccgggtttgagcctagcgccgaactcttcggtgccatatttttcgccaccgtgaattcgaagacggtgattaccccggctagaacgaagaaaacagtgtttgggagtgtgaactttaatgttcgccccgagcggtccgatctctggccggtgaacgccgccatgtcgaagtgggaccaccattgatggcgaggtggttttaccacaccatccccttcgaggctggttctgactcagcgaaggccctccggtgccggcgcagggcgattgcgccgaaccgaaaacccaagatcgccgtggacgccgctatggaggcacgattcgctctgctgcgtaaggattgctcccgccttagctgtcgcgacttggtggaggaattttgtatgcttcgcatctttcccctctcccagtcgtggcaagtcgcagttgatcaaggcgaagaggttgatggtttgccgaagttggttctccctgagggaacgaacggtaagactgctctttcgctatgcactcttgcgctttgttattttgctttgttcgacgcttaatgtggctacaccctttatttttgcagtgttgaccctcgaccaggttgacgctgaagctcgtaggatgatcggcgacgtgtcggtcgtcgagtatagccagctgctaacacgacaaccagctggccaggcgaaccgagtttacaacggcgaattgcctccccgggcgaacccccacaaagccgacgacgatgcagggccttcgcgaaagcgaacacacggacaagtgaagcttgcccctaggaaacgaagggttcctacttcctccgattccgacgccgacgacgaggacgacgtcgaagagcgtgacggcgaggacgaaggagaggaagaagaggaggcggaggtcgcagccgaaaaggccgcggacgaggcggtcgaaaaccacgtcgacacccctggctatactcctactccaagtccaggtcacaacaagaccggggtggagtcgaacagctccccccttcgtcgaaaggatttggagggggcgaaagcgctagttgcattttcggcaggcaatgcggcgaagggaggtccgatcaaaaagatctccaaaaagaaaggactcgtcgacgtcgctcacgttttcagcgatgacgagtcctctaacgagactccgacttcgcccgctggccgcagcctggatctttcgaccgcccccattctttcactcggcgctgatggggcaggtggtagcgccgccgcctgggcttcggcctccgcagaacggatcgtgacagctgcggcgatggtcttcggtagccctcagcgtcagccggttgtttcgccgctagtcaaggcgaaggggaagggtgcggccgtcgaaacttctgcctcggaatattcccttgcggcgccccacttcgcccctggcgatttcgagacccgggcggaccttattccctttgtcgagggagtaagcaatcttgtcttacctgccagcaccccaagcctattcaccgaattgaatgagttcgattaggggtgttttgctattaaaagcttagcagttcgggtatgctttttctctcttcttgattttcctcttctttttacatgtctcataattaacatttgctctcttcgcctgctcctatcttgcacctagattcttgcggctcactgttcgacagagcgaaccgtgcgggcccgtcttgacggatttaagaaccgtcttcgggccaaggatgacgaaataggccgcaagaacttggagatggaagccctcgccaacaccctgaaagaggcaaaagccgaaaacaagcagctccaatccgagttggagaaaggaaaagaggcgagggccgaggttgatcgcctcaaggccgagcgggagaaagaaaaggctcattccgccatgctgaccgattattataacctcactgagccgaagatggaggctcttcgcctggaggtcagcaaggctaaagcgagcgctgtggaagagtcgcagcggttttcgcgggagatggcaaaaaccaccgaatccgcgagaacggcgtgccaaactctccgcctcgccattactgacatgggtgcaaaggtgagcggggtccctgccgaagatgcctcggccttcgacttctccgagtggacccagcaggctggtggttcgatttcgaactgcgccactgtgtacagcgattgttgtgcgtgcatatcggcgacctttactatgggccttctacaacagtttggctgcgagcacgtcgccgagttccccaactatgcgaagggggactaggagatcagtgtgcagaacatttcgcgcgcgcttcgtgcgtggcgaaaacagttctggcagaaggacgccggtccgctgacaaggcgcaccttttggagcaactggcgaaggcagaggcggcagaccagtgcgaagaagaggacgcggcagccgaagggggtggaggcgatgcccaggatcacccagaggtgtgaggccatccgcccttttcttagattttcctagtttcccttcttcttttgtgtttgccgatagtggcgaacgatgtatattcggcaagccaccgctaaccccccttattgtagccgaaaaagggccccttggatatttggaatatatgactcacttttagccacctttttgtggttgaagtctttggcgcattatgattacgcccatttcacattgtgcagtactttctcttttttttttctttcgcctattcttactatgcaaatcgtcttttgccctttttgcattgtctatcagggtgttcgccgaaagttgtgcattcagcctccttccgggagttggcgaagccaaaacgagaaatttgtggcactgaaggatttgtcgaaggtacgatgcccatttcggcctgtttatcacaaaatggtgataaacggccgcagctataaggtttttaaggttgccgggtggctgcgggcgcaccccgggcgaaccttagaagactacgagcttgttcattcaagacgtttcgaggatatggctcgcttttggcgaaaccatcggaagactgatcggcaggaggtgatctcccagcgtcgttacagtctagtctgtgtttcgcccccttctcctcttagggttgtgtatgatattagtagcgatgacgaacctagttcgcctgatcattccttagagagagagtgatcgcaggggcgaagatgtaatttatctgtaagctgagttgtaacgccattgctcttttcttatcacttgtaccattgtgatgggtttgtattcttcgatacatttttattcaaaatcaataaaggtgcgttttattttcttttcgctatttttgcattgtcacttcgcgtgcttttcgttgggtcagaacgtgtcggcccctttgcatatattagcgaaataggttttgacttttcagctttcggcttccatttttgatcatttttgtaagcacgagtgctttccttttgatcgagtgtaacggtgttcggctagttgttctccgaaacaagctgttgcggtttcaaagtttggcgagcgatgcttcggccgattcgtttcgccccctggcctttttcgctgatcaggcgtttgccttggggtttttccacaaattatcaatcatacaaacaaacaaaaagaaggcggaggacacagagattttatactggttcgggcctccgtggtggataatagccctacatccagttttttttgtcttttttcatttttcctcttttttttttcttttcttgacggaaggcttacatagtgccgaagggcttacattgtgctgaagggcttacataatgatatatacatttttacaagttggcgatttgggtgccacccgttctagacatagaaatgcttgaaagagacagtgttccaggaatggtcgaactcttcgccttccagtgtcgccagtcgaaaggaccccatccgggacttgtgcttgatgaggtacggtccttcccacttcgattcaagcttgccaacggctaccgggttcgccttcttccttaggacaagatgaccaggcaacagctccatcggtcgaacttttttgttgtaagttgccgaagtgcctgtggcgtacttgcgtatgtgctcgagtgcttcgactcttaccccctccaagagttcgagcgacacctcgcgcccctcttcgtccccagagaacatcacccttggtgagttagcccctagctctgtcggggtcattgcctcatcgccataaataagcatgaacgggctgaacttggttggtcttgtgggggtcgttcgaagggcccagagaacagatagcatctcctctggccatttgcccttcgctgccccctcaagcctttttttagtgcttctaggatcttaccgtttgtgtgttcagccgccccatttgactgtgggtgcgcgaccgatgcgaacctgatttccatgttaagcccttcgcacatttctctgaacttgtcagagtcgaattgcttgccattgtcagtgatgaactcttttggcaccccaaaacggcaaacaatgtttttccatacaaacttctgtactgctgccgaagtgatcgctccgaggggttcggcctcaatccattgagagaagtactcgacggccacaattgcgaacttgtacccgtttcacgccaccgggaacagcccaatgatgtccagtccccatctggcgaagggccagattggtgcgatgggctgcaactcatactggggcgatgtttggcttcggccatggcgctggcagctttcgcacttcttgacttgctcaacacagactttcaacacagtgggccagtaaactccttgtctaaacactttggaagcaactgttcttgcggcttggtgtgcgccacatagcccctggtgtatctccctggccatttcctcgccttcggcaaaagagatgcagcgaagcaagggttgaagtaccccggagcgatagagctggcctgagaccatcttatattttgtggctctgagttgcaggcgctttgcttctgcttcgtcttccggaagccagccagtttcaaggtgttttacgaacggggttcgccagtcgtatggatcttcgcccagtttctcctagtcgattgccatgacctccaagctctccacaggcacgcttggtgcaaacaggacttcaaaaaaggtgccaggcgaatgcggtccaccacaagcagcagattttgccaaggtgtgcttcctcgttctggcctctaggtaaatgttcgaccgttatgccggtgaaacacttttccatagaccgaacgacctccaaatacctcttcattccttcttcttttgcctcaaaggacttgtcgacatggcccgccaccagcttagagtcggttcggattagcaagcgccgaacccctaatgctttcgcctttcttaggcccagaagaatggcttcgtattctgctgcgttgttggtcgtgtcgaactgcagccctgcggcataccgaatcggcacaccacttggcgaaatgagcactgccgcaatgcccgcccccttgtgcgaccacgaaccgtcagagtacatcacccagggctgtttgacgggctcgggctcgggggcgagtgccggtgtccattcggccacgaagtcagctagcacttgggact

SEQ ID NO: 54883 - DNA, 24122 bp, Oryza sativa
  unsure (1)..(24122): unsure at all n locations
tacttcacgtacgctcaacggaggcttcatttgctgaatggcatcaattttctcgggattcgcctcgatgcctctttcagaaactaggaaacccaacaacttgccggcgcgaacaccgaaaacgcacttctcaggattcagtttcgtacccgccgcgcgcaagttgtcgaaggtctcctgcaagtcggacgcgtggtcgaaagccttgcggctttttacgacgacatcgtcgacataagcctccacatttcgccccaactgcttgtaaaggaccttgtacaccagcctcgcgaaggttgctccggcattcctcaggccaaaaggcatcctgaggtgacaaaaggtgccaaatggtgtgatgaaggctgtcttggggatgtctgccgggttcatgtggatctggtgatagccggaatatgcatccaggaagctcatgagttcgcagctagctgtcaaatccacaagctggtcgatccgtggcaagaggaaatcgtccttcggacatgctttgtttaggtctgtgaagtcgacacacatgcgccattttccgtttgacttccgcacaagcactggattcgccagccactcaggatggtcgatctcttgaatgactccagccttgagcaatttttggacttcggcttttgctgcctgttggcgatcagcagacatcttgcgtagcttctgtttccttggcttagcatctggcttgactgccaggtgatgcatgatgagatctgtcgaaacacctcccacttcatcagagccccaggcaaagatatcaatgttcttcttgagtgcctctaggatgttctcagcttcttctttgcccatgtcgccccccaacgatacgagctttgcggggtcggcatcatcaatctatatcttgattatcttgctgtgaggggcgggctttggcacatgcttcgcccggtcatgcggttcggcctcaacattgtgcactgctctgttgattatggccagatctccttttgaagcagccaaaggctgaagccccctgaccacgatcactcctgccgggccgggcatcttgagcttgagataattgtgatgagaaatggcttcgaacttgttcaacgttgcacggccgaagatggcattttagttgtatgggatgtcgacaatgtcaaacaatacttgctctgcgcgtctgttttcccccgtgccgaaggctaccatcaactgtgcttggccgagaacttgaactgcttctccgccgaatcctcggagcgatgctggtgctggggtaaaggcttgggtagtcaaccccatcttggcatatgcttcggcaaagatgacatcggccgaacttcctccgttgaccaggactcgccggacctcgaaaccagctatatcggctgagatcactagaggatcttgatgcgggaacattaatccttcggcatcttctggcccaaaagagatttgctggttcagatactgcggagcccctgccgaagcgatattgtggaccgttcgcaggtgcatcctcttctgtcgcttcgacagttgtatcagtgggtcggcccttgtaatcacttggatcactctgcgctgcgcatcatggcgttgttcggccgggggtgcttgttcttgagctacttcacgagttgcttcgaccgctgctccctgttgcgtccttggatcttgcgcgttgctacgttgccgaatgtttcggcattgcttcgtggtgtgtgaagagcgtccatggaaggcgcagtagaggtcttttcagacctttttgcggacaggttgttgatggttgcttgcttgctgggcgtcaaactccttgcgaagggcttgcactccttcgacagccatcacagccttgcccgcatggttggttctgaacttcctccaggtcatgggggcttgaccttgccttggcagttgtccttagatcgccggctggggctggcgaaccacgagaggaggtggttcggcaacttgaacttgttgttgggcttgagcagcggcgacggaggccttatcgtactcggcttgtattgcttgccgtcgcttgcaatcctccttgccccttgcgaacccgtcaatgatgtgaagtaggtgctcaagcgtttgcggctccttgttggcaatttttcttgtgagttcgccctcgagtagaccagctgaagcggcgtttatgatagacgcatcggttatgtcttgaacttggcaccgggcttgcgagaagcgacgcatgtactcccttatcgactcccccggcctctggcgaatgctgagtagatgctgctgcgtcttcggcttctcataggtgcctcgaaagttaaggacaaagacatcgcgcaattgctcccatcagtaaatactattggttggcaaattgaaataccaagagcgggcgatgccgtctagggcgagatgtattacctttgccttggtattttcgtcgccatgagccgcttcgatcgcggattcataaatggagaggaattcctttgggtcagtttcgcctaagtagcgtggacgggtgagaacttgaactggggtgggattggatgggtcttgattcccccactgagcggtagccccttttcgccccctgccctgttcacggcaccttgctgcgggtacggtgtggcgaagggcaaaatcacgacttgcgcgtgtggttgggccatggcattcggctgcccggccccgattggtgatgtttgctgagccgccatggatgggtcgaaagttggttgtgaccatgtcatggtgacctggtttggtgcttgctttgctccgaagcctggcgttggtgtttgcagccgaacggttggcgcctgagcaacattgatggagtcgaactgcagtccttgactccacggcgaagcccccagacctggctgattcgaaggcaaccaactaggtgcaccatgacttgtattcccctccgggtgagccgaaggggcagtacttgaaatgttgtggggttggctgagctgttgaaggaaagcttggagctgcgcctgcagagccgaagccccttctgccattgtatgtggcacttggccaggcggttgaggatgtacttgggcagcaaccggttgagcttgcagttgcacgtgaggggccggatgcgctgctgcggtcgatggctgcccggcgaagtacattggcgcttgtgcggcttgtggcggaaggggctgggtcggcacttgtggatagacttggggtgggacatagcctgccgaatactggaggattggtgccgaagtgaccttggaccgccttgccgcctcgtacgcttgctgctgttcctgcatttggcgaagcatgtcttggagtcgtctcatgttctgtcgcatggcttccatgtcggcttcggtttgtgtctcggggtcaaggttgacttgggcttgcgcagcggcgagcgcagttggggccactgccggctacgatggggcggcttggggcaccagcaattggcttgtcgaaaggatctccgtcctggtctggagtgccctcgccaccgcagccaccttcgccatgtcagccgcgttcggcacctgcacagaggcagtaggggccgaaggcggtagtgatggcgcaggtgcggaagcagatggcgctcctccatcttcggcgacaggcgccgaaggctctgctccctcttcggcggccatatccgtcccggcgtcgctttcctttcgcctcgtaaccttctccttcacaaccttcttcggtggcattcgctctcagtggtttcgctcggaggtccccacggtcggcgccagctgttgtcgaaacgacaaccgcatacgtcaaagacgtggtcacccaacagtggttggaaaagaagtaaaatgtattaatttgagaatttttcttcggatccccctattacatggccctatgagactatttatagcccccattacagattcttactactatggttttggttatacaggggaatttacatggttgcccttagaaagggacatttacatgggtacatagtgtaattgaggttcatgggcccctgatggccgttgggcaatcgtcggcccaatagcccctaggcttgatgggccggaaaagcttcttcggtcctcgcgggggagaacttgctatggcgaagtcgtctcccttcggcatatattcttcgccctgcatccttcgcccaagaggcctttggcttggcaaagcacccacgtgatccctcacctctcgccgtccctgttccatagtcttcgccatggggggacttcgccctgactaactttgacgtctcgggcttgaatccccactcttcgcatggtttcagcaggtttggtcgaagggcctcatgccataccgccaacactaataatgcgagttgcaaacaaattaataatgattttctaattataggagcaattggttaaagggtgacttgccttgctcaagatcttcacgaagcttcacgaatcttcgagaaatcccacgatcgacaaaaatccggtaaccgcaactatacgcaaacaatcaaaacctaaacaaaagaccaagagaagatcctatttagactaaataatagtgacattagatagatctcaaatttacggaattattggaagtggaacggaggttaatcggagttacggatcgagagatatgatttttggaagtttaattggattttctggacatggggatatatttgtggaataaggaaaattgatttatggaagggaaaaaaggatttattaaatttatggaagagaatatttgtggattattggaaaagatattctcgagaatattttgactcattgacaagtggggcaaacaagaaggtgagagcgtaaattgagagggagcagatatggactttagctcatgagggatggacactgggcttggagggagggactagaagtggacttttcttgtttccttaagccgagaagggaggccggccaatgggccaagcccacgagcgcggagagagagaaggggacggctgactgggcaggggttgactcggtctggtggggtcggcagatgaggtggcgtccacgtggatgccacgcaagcgcaagggaaagaggaggccggagaccgcatcggacggccggcggcgcgcggagcgtcccggcgaacggcggcgagacggagcgaggcgcggacacctgtggcgagaggaggagatggggaatcggttcaccggcacggattagagagaggaggcacgacggcggccggcggcggcagcgaagctcgccggatgtccgacgtggatgcgcgagggaagggccaagagcgcgcggggccaggcttagccgaaacgattcggcattgcgacgcacacgcgacggcacggagaccgatggttgccggacttgggctcgcggtggcgctccgcggcggcggaaggggcgacgcggcgaaaagggggagagaggaggggagcggccaaggcgatgtcccggggaggctgctagggacgcggggagggtgatggcgatgggattcgtagggagaaggaccgacggcggcgggagactgcacacggcggcggcgagaggggaggcacggcgccggagcggaaggggaggtcggcggccgagggaaaggtttggggaggtcgagggggtcccgaggaaggcgatggcgagccggtttgaagagagggagaccgacggcagcacgcggccatgcgcggcggcggcgagtcgggcgacatggcgccggagttggagggcaggccagcggtcggggcgacggtttggggtggctcaaggggactcaaggagggtggtggcgcgaggaatcgatgagcggggagccgacagcgacgcacgactgtctgcggcggcggcgggaagggcgggaagggagcaaaagaggaggccggcggcggaattggcggtttggggtggttcattggagctcgaggtgggtggcggcgaggggattcggcgcgggaccgaccggcggtagcgcacgactgctcacggcggccgcggaagtagagcatcggcaagggcccgatttggaggacgaacgcacaaactaccatgtcccagtgctgtttaggagtcgctagaggatgtagatgagaggatttggaccgggagctcaccgacgagcgggaacggcgtcggcagacggatggcgtcgcggcgaggcagtcgcgacggcggggcggcacgacaccgagagggcgcggccggggaacaagaggggagaggtggcgcccggagctcctcgtcacgcgcccacgcacgcaccggttcctccgatgctcggcggcggacggcgacggcgagatcgggtcgagcggcaacaaggcggcgacggtggttcggcggcaatggcgcggtgggtgcgaggcgagtgaaaacgagagaggaaggggtttggggcggcttgggttttatagtggaggaatgtctgtttgtggagggaggaaaccgacctcgtgcgctgtcaaggatgcaagggcggcaagctggcggtcgacgcgtgcggccaaggaggcggcaggtgatgacgccggcggtgtcgggcaaaggtggaaaaaggagaggagaaaggggctctgttctttgccgttttttttaggagagacgaaggagggggagggcacgagagagacgctgcctccgtgatttggatggttgcggcgtggggttgcagggccaggcagcgcaggcgctgacggcggcgggcgaccgggcggtcggctttgaccggtcgcgggcgcccaaagcaatggcggtggcgggaggatttgcaagacggcggcggaaatcggttggcgagagaggcaagccgagagagagagagagctcggctcggcgatggttcatgcgcacgcgcgtgcgccgcacgtgcggagcgagggaggggaaggcggagagagagaacggcccgagagagagaacgggccgagagagagatgggccaaaggaggacatcggtccatccaaaagcagaggaaggcacaatagactttttcagaggggttgaattgttgaggtttagggtttagattcgaattcaaatttgatattcgaactcgagggtttagggaggaatcaagggagactcgaggagaagtcaaggaagagattcaaaatgagattttgatatttttgggaacggggacaagtatttggcgatgagttcaaaggaggaggttgaatttcggaaatatatttcggaaggttgaaatggaagatggattccgaggaggcgatttttgatggcgatgagagggatcaaggacggatttaaattgagatcttggcacgacttagacttacactcaaagaacgaaaattttcgagaatagggttttgccgaattagtttttaacgtcatacgaaaagcggagcgttacacctatagaatttgttggttgaaaacagtttgatagttcggaaaacgtgcgcgcgtgaaaaacgagataaatctttagcctttcctaagtggccgaaccgtgcctaaggtcctgtttagattacactccaaaactttacaccctgtcatatcaaacatttgaacacctgcataaagtattaaatatagtctaaaaaataactaattgcacagattacgactaatttatgagacgaatcttttaagcctaattgctccatgatttgacaatgtagtgctaagtaaacatgtgttaatgatagattaattatgcttaataaatttgtctcgcggtttacttacggattctgtaattagttttttattagtgctcgaacactccatgcgataccctatataatatccgatgtgacaagagccaaaattttatacccctgaatctaaacaccccctaaatatcttgttcctccacaactttcccctgcaagacaagttcaaggtggttgaggaacaagacgttttgtacagttttcaatcaaattggcagcagttcgctagctgttatggaatcggtggtggaataggagaagatgagaaagaggaaggggaacgactttgcctctcttaagccttgaagtgctcgatagttccttatgtagcgagcatgcatgcgtcaaatagacacatgatgaaaacggtatggaaacgaatggaaactacctctatcgattccattttcatttttcggggggaattaattggaaccagaaaccttggatgttgagacggaatcaaatattgtcgaaaccgaaaacatagagaatactaactgacacggatactgtaacgaaaatttattgaaatacaacccccccccccccctcacctcaaactgagcttcaaactttatcaagtccaattacaatctcaagtctcaacattcaacggtacatcacaaaacacaattaattagaatgctaacgtgaattgggttgggctattattagggtatatggacatggtatggaccttttctcctatttgggagagtttctagctgctatagcttcttcaagaagttccagctcctaaacagtttaaattctcctagattctaaaaatttggagttataaaatctagaaaataaactagaagccggatttctcagctttatgggtatgatccgactagtcaactcaagtcggaatatgactctgcttcttttttcttatttggagctctttctttatttattcagaacttttgccatatgtataaggcttgattcaatattggacttggtatatagtgggtcgcgttgtacacaagtatagggtatcccatatttagaacactaacctatacaataactgaacatctaattttattatagcactttttaggattagtctatatatattgttttagtgtattcaaactaaatatttttgaaatgattgatagtcaaagttgtaatagtttgatcccaacaacatcaagaattgtgaaattggaaggagtataaaaaataacgaaatgaggaatctgggggtagaattaaatttatccacttgatggattgatggatgcttcttagataatgagcttgatgccaactgtctgaaacatgtgttaagcttctctatttaatttgatggtcaagctggtggcttcaaaggtacaacctctaactctatttatatgtcacggtgtttcttattgtatacctcctccgttccttaatacaagggattttatcattttgcttgtactgtttgatcactcgtcttatttaaaaattttgtgcaactgtagaaaacgaaaagttgtgcttaaagtactttggataataaaataagtcacaaataaaataaataataattctaattttttttgaataagatgaatagttaaacagtgtaagtaaaatgtcaaaatccctcgtattaagggacggagggagtatgttcaagtgattggctaagtctgtcaaagctacggtgtttcttgttgtatatatatagattcatatgtcaacttacaatgtgttccgcttcgagtcgagctaatttctggccagagtacgcaagtgcgcggggtctcgagcagagatcaaagtggtgccatctggaggtcgatcatcgctgtaagcttgctcggtctcgatcggcttaacttcgtattgaggtacgtatacgctctgatcagcctttatactcttatatatgtctatcgacatggattgctggtgcctcatctggagatgtaaaagatcttcgagtttatctcttatgaaacagctgagattaatcaaagtcttcagacttcagagaaccattaggccataaatttatcttctgcttgctctcgctcgatcgagaaatgtactatcctgccaagctctttcagaataccaagataaatcacatccccagttctctcacatcttaaatgttgacgttcgttcgttgactcctttatggaaggtgcatgtcatcagcgatttcttcttcaaggcgttctgtcgtcggctatttttttttaacgaatcacacaagacggtgcgatgttttattaaaattataagattacaaccaggaaggtcgtaaccagaaaaaaaaaagtataccaccatcacccacacatcaacagcgccaacacacagaaccaagagaaggttagcactagaccggccaccgctaagcgtgaccagctgccactatgctaacaaagaaccacggccgagatcgcccaaaacccaacccttacaatcaacacaaagccccgctctatccaagtcttcaggagttatggagagagggtgagagagaagaatggaacacctctcccccttaggccttccgacgtggccaacttgtagagactagtacgccgcttacaagaggatgaaatctagagggagcttgcaccaattggttgtggggtttcggctaggggatgcctagacgacgtctccaaggagagaagcgacggagaacactaccgccgccgccgtccgtcaaggtcttaaagagaaccgagactgggctttcgttcggcatccacacatgagggatgagacggcacgacaacgccctcaggaggggaatgacgctttgagcgtcatcattgccggcccggccgaggctaggctaggttttcacccgccactcatcacctacaagtccacggctggcgcccagatgctccaccaccgtccaacctctgccaacatgtgggtccactgcaccagcgcccaccgcatctaccggcagctcctcctcctcacaccgtgcccggctccgtcgccgccggccgcgcctcgtcgcgtcgtgcctcaccgcgccaagctagtctcgtccatcgccggctgcgcctcatcgcgccaagctaggctcccattgccgaccgcgtctcctcgcgccaagcccgcctccaagcgccgagccggcctccgctgccaccgaccacggctctacgcgtcaagctagcccccgagcactcctcctgccgctgccgcgcaaatacagtcatctgccatgcctccccggctgtcgccgttcgtgcctcctctcgcagtcgccgtcgcccatttccaggcgttgataccgtgtccgcacccaccatgctgccattgcaacatcctccattgttgccgacgacgcgtccaccgccgccgccaccactactggagctgccccagccgctgccaccacccctgcagctgccaccaccacagcagctaccgccgtcgccgccgccgccgccgccgtcgccttccaccgtaggcagccacgcccgcggcttgccgtcgcaggtcaccatcgccggtcatcgttcggccagatctggcctgccacggtcgccacatcgccgtggtcgctagctgccgccatcaccagacgtcactgccgccatcaccagacgtcactgccgccgtcgccaccaccagcggacggccaccactagaagccgccgccgcctcaccacgctgccccaccgccggccgcctccccaccagatctagccgcggcggcccagatctgggcggtcttcacaccgtcccgtgctgccccccactgccggcgcgacgagagaatgaagccccgccgccgccatccttgcggccgctcgggcggcggcgcggcggaggaggaaggagggggggcgacgcggggttgccgcctcccgtgtcgcccgtgagggaggacgacgcggaagaagttgtgtaacacagtatattttgaagtttctcgtcggttatttggtttcatggtaggcaactagcctctagccattaattggttactcctagtactgcctgcctgttaattctcttcttgcctgtagaagagtctattgtcgcaaggcaacatgccaacatgagacctgaaaaggaataagtcaattgttggcagggttatggataacacatatccaaaagtaatcgactaaactcggcagaacccaccatatattaagtcttatatggaatcatgccttgtatatatagaaggagttccggataaggaagaacaaatagagttcaagctggaaacgataaggactacccatattgtatcatatttatctccctagttttacttggacaaggggacatatatgggtataaatacaataccccagaaggagagacaacacaaaaccaagacaagcctgaacaaaccaatacacaccgctagacatcgacatcggagattagcctagacatacccaatctagtgccatcggaggccgtcaagagggatttagtgttatctctgatctggccgagtatgtattcgaggaggaagactaccctgtcgtcaactacgtgttggtgtttatgtcgccaagttgacgacgactagataggctatcccaattattgtacttgtgagattctgatgaataaaagcaacaccggcttcgaccaacaggagtaaggctattacctgattctgatgaatgaggggcccaaacctatataaaaatcattatctctgtctctttaaccttaatctcacatataccctgataccaacgatccccacaccatgcaaataccgtagtcgtgatctaaaacatcgacaatttggactccctcaactataactccaatatgattcatatccttaaaccgtaataccggatatcttgacccctcaactatgaaaatcggtgcaattttattccctcaacagttttgtagagcggttccgctgacgtggcgctttgacttggtctaacccgctaagtcacactatgggactcgcacgtcaatgtcacacattctttattctcttcattccctttcccctcctcactttcctctctggcggaagcaacagggcatggcggtgatgacgggaggctgttgtcgcgtcgccaccgtcgggcaggaggaagcatgagcgaggatggcatggctgtcagaagggaggttgtcatcgcgccaccgtccctcccatcactgtctccgcctcccctccgctacccccttccgctcgccaccgtcgaggaggaggcatgagcaaggatggcggtggcgatgcgaggggatgccattgtcgcgtcaccatccctcccgccaccgcctccacccccctcccttttccagttgttgcctccgctgcccccttccgcttgttgccatccagaaggagggagtgcgagcaaggatggtggcaacggtgaggaggttgttgtcacgccgccgtccctcctgctacagcctcccctccactgctaccatcctcaaccccgcatggggaaagccgccgcgcctgctttgccaacggcgtgccgttgtcgccccccccccccccccccagcggccgccccgttctatctcatcccacgccattgtccctcccaccactgcctctgccttccctcagctactgccctcaaccccgcgtgatgaaagcctctgcacctgctccgccaccggtgcattgtcgtggccctggcggccaccccgctccgtctcatctcgtgccacctccccgtgctgcccgttctctcctgccattgcatccgcctcccctccgctatcgccgcatggctgattccactacttaattaaaggagtcacaatggacttattccacctgaaaatgcaaggctcactacacattattggcccatcacaagttatcgatccctagcacaaatactggtatcgttgctgggtcatcaagactttcctcttctgtggaacatgtcgcatcgtgcgataggcccgggcgccacgccgccagagccttgccgacctacgtgccaacgtacctttgtggtttgtgccatcctcacccgacgggctgcacctaacggtgtaagataggccaaataaggttattcatttatttggcctataaatgaattcgtgaattaacccatatatgctattcggtgagaaataaaatagaacaatattaaccggcaatatgtacggaccgccatactagttataaactgaaattcaacaaaactgagatacaaagtagataagccttcatcatatacgaatgcatgggttatggactactagtatctaaattaacatccaggttgatatatacaagtattgcctgtggccgcgtgcaggaacccggaagaacgtaataacacaactctgaatatggtggaccctcgtgccgtcatttcatcctggttcgttacgttgcgcgaggacgtgtacgtcttgattcgcatcgaatcactggtgtcgtttgttacggtggcgttcattctgatgtttaccatggacatctaccgtgcccggtctcgcggctctggcaccatgtccactttggacaaggtcgatcgtatctctgaccgcatagtgctgtatctgttgggcaccatgcaagctgcgcctttcagcaatgagctcttccctgtctggtcaattgtgctggtgagtcttcatgctagcatcggctatctctccaggtacggtatacctgaccgggtacgacatatcactgagctgggaaatgtgatcaagtttctgggagtagcgttcttgaatcgcacccgaggctccatgtttgtgaggcccctctggtcgatttggtgtgttctgctactgcggtccatgtaccggttcatcgcacagagccttgcgctgttatccctgtggcatggccgcagttaagagctccttccagagtacatgcgtaacaactttgggaggggaggattggcatccggtgtccacaacgcggaaacgatggacggatacaaatacttggtccatggcgagtccaagcagaagatcaaattactgaggcctcgatatgctctctatctcaatgtcaccgatgaaaacttgctggtcacactggacaagatttggcgatctgacgggccggtgctacagtccgccaacagcgttcacggagacgactgcaaggatctgtgcctggccttttccatgtcgaggtttctccggtgcaggctcgaagacgtgaggctggacgcagacagcctctccatgtcgcggaatctgatagtgacaagaatattgcatgtcgaccagaaccctgcgagggtgttcaggataatggagctggagatttcgttcctcaaggactacttctacaccctctatcctatcgtcttctggcaaggccttgcttctctctccttgagtgttcttcagtctctcgcggccttgggactcgccctctggctcgcctcgggcgtcaatagggtcaagaaagatcttccggaccccgtcaatgtcgtgcacggccataatgtggaggtgacaatcacatgggtgttcatgtccttcatgatgttcaaagagatctgggagatgatcacttacttgctatcagactggacaaggcttctccttgtgtgcgagtatacgcggtccagatgcaggtggataagaaacgccacgatggagaagctgttaagttcctttctaacgttaagttcctttttaagtcgtaagatcttttctgacccttggcatggatacatcgaccagtacgacttcttgcagtcatttgattacagcccgtcgctctggaacctgatgtaccgtgctactctaggcgtcatcaaagagagggtaaaagggcaaaagcctggcaccgccatcaagatcccagaatgtgtaaaacctgcaattcttcaggcattgcgctcaatggatctcgctggcttgggcggccgcgagcttccccgagacgtcccatcgttgagcgccgcgagattgcttgaggatttccgatgggcgttgcttgacctgtacacgtgctcccaggtcattctggtttggcacatcgcgacctccatgtgcgagatcaagctcgcccgagacaggggcattgacctgagcaaaccagggctcctgcgctccgccttcacgtacctgaaaatttttctctgcggctgctgctgcactcctcagccgtacctcgttgctgaaaatattctcggtgatgatcaactccggactagctacattgttgcaaacagcttgtcacgatactgcgcgcacttggtggtttttcagcctgacctgttgcctgacagcttggcgcttctgatattatgaatgaccgcgactccttgctgacaaagtatgacaagctcaatgggttgttctcacccgaagctgctgaactgaaaaaactgaacgggaccatcgtagagaaaggcgcggtactgggaaggcaattgcttgaaacaattccagacgatcagcagcggtggcaaatcctggcgggtgtatgggctgatttgctcgtgcacattgcgcccagctggaacgctgaggcacacaagatttgcctcgagtacggaggggagctcatcaccttcatctggggattgctctggtactgcggcatcgagaagagcagcctgtggcgagatcaggacgatgcgcctggagatgccaacgtccagcctcagcctcagcctgcagcagaagaacctcagggtggccacaatgtcgaagatgatgcgatggtggaagatgcccaaaacggaattgaagctcgtgaagcaggcgtgcagaatcaaccagcggagcaggtgctgcagcaagctgctgaagcagatgtggagattgcagatgaagcacgagaagacgagcctgagcctggcaacgacatccacgctcagtctgctgctgacatggagattacagatgaagctcaagaaggggagtctgagcctggcagcaatgtccaaacttctgctgctggtgtggagattatagatgaagctcaagaagaggagtctgagcctggcaacaacgtccacactcccttcagtgctgacgtggagatcgcagatcaggctcaagaagaggagtctgagtctagtaacaaggcccagtccgctgctggcgtgcagattgcagatgaagctcaccaataggagcctgagtctggtaacacaacaggatcaggtagaacatcagaaatacctgttaaaagacgctggagatatgtcctgggattgagatgcagtgatccggaagggaaacagtgtccggacctcgcagctgatgagctgatgtgtgaacacacatcaagccgatgaagagcagtgcctctcatagtcaaggttgagtacttgagtgaaactgtgaaagccttgtctgcaaaagcaagaaaaaactagaagattattcaactcatgcagtgtgatatcttccgtctcccgaatgcgtgcagcaacgtactttacaaatatataactttctttgtacattgtgcttatgttcaattttgtttgcagagtatttatgttcaaggaaaaaaaaagagagtttttgtgttcagtttatctttcgacagcgtttatgttctgtcgacagtaatactgcagccatgaatgtttcacaattctcctcaggttttcgttcaagaattttgtttggatgtctatggttgccacattcttggttgcacaaatcatttgggtgtcaaatgccttattgccacatgcttgtggttcccaaactgtgtatggattctgcaagcatttctggaaagagagacaaactacaaacccaactatcctacaggctgcactaaattgcagataagcgcagataaaaatcaaactatgaatcataatactagccagcatcattttgagatcacatccaaaacttttctctccaatatgcggagataccatggcagtacagtaatcagtactcagtaggtacattgtttcagtagatcaggagccgcacctggatggctcgccggcccagaaggaatctgcgccggccactcgcgacacggcggagtgcacactgcgcctctgctccatccgccaaaccagagcgagccaggctgcccgacggaaggtggccggagaagccgcttctgggaggaaaccctccagggcagaccagagcaacggcatctccagcgagaatgacccccggaactggatcggaatcccttctccattctccctctgccaccaccacggcgacgcctcctcctgtaatcagcatgatagatgcattttttggtccattagaatgttctttacaggattggctacttggcatatacttgcagaacagactttacaagcatttaaaagtgaatattggtataatattctcctaaatcaaacacatcaattcttttcatctcccatagcaacgtgcagggtactaccagtctaaccacatgattagtggctctgatcagtataactagtagtaacaaaaaagtaggtcatgatctatatacaattgcacccatgcatgatactccacttaccctctccttggaaaaagtaactttaataatttgaccactaatgtaccctacacagtggaattgatttttgtttctccctttctctgtcagaacaattcagttgaaactgtattttataatgttgggtacatggttttcagatttgtgctgccttattgggatcctgaactagccgcagcttgtgcagcatgggactgaaggtgaacaaattctagatatcctccattctgcctaaaaattcataatgaatacatagtctaaaaacgaaacagatcaacagcaaacattgggagcataagaagacccttttaacgtgaactaccttctgacatgatcacttacgtgggagcccgtggttattgaaacccgcatgtcattatgtcagtgaccatgccacttgacataatgtcagaggagatgcatcaccatcatctcctttgcagtatttttctcatttgatttaccgatgatgacaaatgcctttttgctagctaacagtgcaaagtgttcgattggtgcacacataggctaccctttaattccttccaagatagtatgatcttattcttacctcaacctaacgaataaaggcaaaataatttcttcctcttgttttttttttaacctttcttctctcctttcttccaactattttgctgcttagctagctagctataaaaagcagtggttcctccttccactaacttgtgaaaagcattgtctgctgccttacatttgcatagatatgttggctgcaagttttctttttatgtgtgtatgagcatcatgtgcgtcatccatgaccattgatgagcattcaacactatgcattgcatgtggagccactaaaacatactcccaccatttcgttaatccaaacaatcttttgtcaaaatgacccattggatttgtcatcattaccttaaccactaaaaccataccattttttctagaaggatagacttgactaaggatagcacgtgagataaactacttaaaaggtgtcatttgtttacttaaaagatcatgattaatcgtagcaactcacccagtacagtagtagttagcctttacaattgtctgaaagtgatggatgtaaaagatcggttacaaactcagtgatcgactgatccaccattgtctggtaatcttttctggaatgacaccaaaaaacattgaaaatcccaggtgctttgagatgttggcactgaaaagccatcccactaacggaccaacctgaataaataatgtgatgtagagtcttaggctgctgccaaaacaaaaggaacagagaaaatagaactagtggcgaaagagaagaaaaatgacaccttgcccccagttggcctttataatcttcaccagctgcaagccttggaagattcatccatagtgtactcacagcagccaataagcagtagcttcatccagccgaaatcgtcgaagatcggcagtttgaaccttggtgagccatggttcttggaagaggccgttcccaacatcggcaacaagccataaggtgtggcgatcttggaggtctgttagtcagcctgaatatactattgtttcttttgcctgatcattctatctctgttcataattggtgagattcagggcgaacaatgccatcaaggagaaccagaaactcagggaagaactcaggagaacggaaaccatagtatcaatttataccaaacatcgctggtggatggaggagcaagcttccaggtcttatgagatgattaggttcaccgagtacaggccttcacagattcatcgtgtagtcaatgaccgagatgcaatttttcttggaattggtagttatgggtctgttcttcagtgcaaaattggtgagaagactgttgctgtaaagattcccaataacagagacagccgcaaacctctgccaagcatgcgagagtttaatcaagaggcaagtataaagatatattctgcaatatatcttttatatttctactaatctaagttcatttatagtagctccatgcaaaataaaaggttcatttcatagtaattgctgacaaaagtttaacatgggggattacagttgtctctttgatccctcaatccattgaattcagatcagtgcaattgctattgtgagtttttgactgcgcaatagcaattgcagacaatcttagccattcattttgctacccaactgctgaaaatgaccacaaaagtaatttctccacagtttccggctacagtattttactctgattcaaatgttagctgcaacctcacctatttttcctgccttactttctccctgattgcatgcctactaattgaaatacagttcagaaattccatgggtataaatgcaagaaagtttatgcctacctgaattgttcatatattaattttcccgcaagttagagctaccgtacaatattcttctcattttctcggatagaagagctctgaaaatgcaggttgccatcctcaaaaagatccggcatcaaaatcttgtcaccctcataggagcatgtccagagagacagatactcatctacgagttcttgcctaatggctccctgaaagatcacctcactgaaagtggacaaaggaggaggttcacatggaaaagacgagtgagagctgcctccagcatatgctccgctctcatcttcctccacaacaccgagccctacccaatcgtccatggtaatctcaaaacgagcaacatcctcttcagcaaagacaatgtatgcaagcttagcaactttaccatgtcccatctgctgcaatacacttccaaacctgtctcgttttggggtggtgttaagggatttgcaagaatgttgattggttctgacacccacaagactcagttagatgtgtccgctctgggcattatacttttgcaacttgttacagcacaagaaccaaaggatttgagaaagaatgtgctcagcaaactaggagatattatacgattccaaggaaagagcatggagcagcaacatgaggtcctaaaaagcattgtggatcctgacctgaagaaatgccagttagatgacgccgcagagatgctgttcctgggattgaaatgcagtgatccaaatgagaaacatcgtccagacctcgcagctgatgtgtggccactcatcgaggaaatgaagagcagtgcctctcatcgtcagggttgagtgaagctgaggaagctctatctcttgaagcaagaagaataaactacaagattactcaacttgtgtggtgtgaaatctcccctctcctgaaatttgtgtggcaagcaaagtgctccacggatatgaaactttctttgtgtattgtgtttatgttgagttttgcaaagttgagtttatgttcagttcacaatagtcaagcctgaattcaataatttagtctgagatgtttgtggtttccacattcttgaggaaacaaattatttgggtgccaaacgctctggctgccattgtggctacccctacccatcatggcctgtccatttttgcaagcatttctgcagtgcaagatgcagagccgggatgtttattattccattatctaaaaaaaaccatttctggcaacgtatacaaattaactacaaacccaatactcgcttanctncaggccattgtttagttcacaaaacaaaattttttcacccatcacatcgaatgtttggacacatgtatagagtattaaatgtggacaaaataaaaaaaccaattacacaatttgcgtgtaaattgcaagacaaatcttttaagcctaattgcgccatgatttgacaatgtggtgctacagtaaacatttgctaatgacgggttaattaggcttaataaattcgtctcgcagtttcctggtgaaatctgtaatttgttttgttatagactacgtttaataattcaaatgtctatccgtatatccgatgtgacaactaaacccaaaatttttccccaactaaacaaggcctcaaagaggacaaatccaaactgcatgattttcgtactatcctagagtaaattacagatagccgcaaatcaaaataacaattaattgtactagcctacatgatttaccccccttttcttttcgtctcatcgagagaagccagatccaaacaagcgtcaatagcatggcagtgaattaattaatggaggaaaattagtagggttttgggtacacctgggaatgtggccttccgatccttccgctagtccactgctaggttgcccccgccgacgaggagatggccggagaccagagttggccggagacggggagggaaagccttctgggagggaaagtcggaaaccccggtggcatgatagcgccggccggagcaacggaagctccaggagagtgatgcccgggagtagaacggaatcactcctctccaccgtctcctccgcatcgccgcccgtcggtcgccgccgccgccgcggcggccgcctcaccggcagaggcacattgctgcgagcccagcgatgaaggcggcggcagaaggcccacgttgccgggccaactcaggcccatatattgattggatgggcccacgcatattcgtcggctgcactctcataggccttaattacggcccgtgattggaagaccataaatttcctaaggaaaaagtacacccgaggtccctcaacttgtcatcgaattacaaaatcatctcccaaccgcaaaaccagatatatgacatcctcaacttataaaaccattcgctttacgtccttcggccccacatgtcatgatgccacgtcagcatcttctctcgctttcccctcctctccctttctcatctctctctctctcactttctcctcttagggagcacggccggccggcaggggaggagcgcgacgggcgcgcgacggccagcgagggaggagcgcggctgagaggagggttggcgcgatgggtggcggtcggcgacgcggagcacgacgacgacttggggccgccgctcgcttgctcctgggggctggaagagtagcacgcagccacgcactcagagtggaagcggtgggtgtccggcgacgtcccgaggcgggcgaggacggcggtggcttgcctcccgctcctctccccgccgatctccctcgccggcccgcgggtgcgcgcggagaggaagaagggcagcggccggccggcagaatagccggtgaacccatccttccctccatttctttgttagcttccgccatgtctagttgcattttattgatcaagaggtgattttggcccattctgtttctgcgagctcacagcctcacacccgctcaaattcttcacaatctgtaagtgtgtgtgtgtgtgtaaattcttgcaaattagaagctgaattgctgctaatagcctgcatcgactcgtaaatttatgtttttttgttggaacagatgggctgtggctagtggccgcagtacagctatgggggatgccatcctgctgcagaccaaccacattcgacgttaacaaggtgccaaccatgcggggacctagtgcaccggcggcgcggcgcactgaggacgacgaggggcggcggcggcacgcggcgcgcggtgaaggccggccgtgcgtcggcggggtgcggcgcacggcgtgacggcagccgacggcggggcgcggtggcggctaggcggcggccgcgacgcggacacgcggcggcggcgcggctaggacacgggctcgtggtggctggcgtgcggcgggccggcggctcacggcgccacgccatgcggggcggcgtgggggcggtcaagcgggcatggcgcggtgctgcgagcacgccgcggacggcgaatgcggtgcagcgggctagcacggcgcggtgcggcgacgccggtggccgggtgggtgcgggatacggctgagcggcggctcggcgcgggatgcggccgagcggccatggctgctcgctgctccgcccttttccttttttttttctttcttcattttcttttcgggccgcagga

SEQ ID NO: 54884 - DNA, 26145 bp, Oryza sativa
  unsure (1)..(26145): unsure at all n locations
cctgcagcccctgaaatgaataggaaaaagtacaccgaaggtcccttaacttgtcatcgagttatgaaatcgttgtccaaccacaaaaccagatatataatatccctcaacttaaataaccgttcactctcttcatgtcagcgtggctatgtcatcacctctctctttccctcctctctctctctctctctcacttttctcctctttccccgccgcgccgtgcctccctcccggtgctcgctctcctcctcctcctccccttccgcgtcctcgccgctgccgcggggtcccacttctccccctgcggtctcccgcctcgcgggccgcctccgcctctccccgtccatggccgccgtcacgctcctcgcgctcggcaacggcgcgctcgacgtcacgggcgaacgatgcaggagggacggcgaacggcgcggcgatgagcgcgacagccccgacgacgaacgcggagatgaacgggcatcgacggccggcgacagacgacaaggcggcgacactggagaagggaggaggccggcggggcgacgaaggagaggagaaggtccggcggctggctcgcggccgctcgctcgcccgccaccgccgctctgctccaccgaccgcgcgcttgcctgccgccgacccgccgtcggcgcttcgctccgccggccgctcacccgctgcacgtgcgtgcccgctgccgcttcacttcactctgcgcctgacactcaccgacgccccgacccctccgtcctcggcgagctcgtgtacagcatccccggcgccaagaacgtcctcgagatgcccctcctcgcagctcaggcacgtacatgaactctcatgcgattatccatttaatcattgtgtttgttgctcataattgttagctaaataatgtaatcttgtgcagtttctgttgttgcgttgcatacagttggctgtgttagaatctggcagcagccggtcagtagtggatctagatcaatcgggcttctttctgttatgcatgtaacaaactctgtaattgaggagaataaatagaaaaccagaaaagcagcaaaggtattacgctgcgccaaaaactctgctcgttttctctgttcttcagttaaactgttcacgttcgacaaaaggttcagagattgtgagagtgagagtgagagttcgtgagttttgattcagtgtttctgtgttcctaacaataatcatctacgagttcttgttaatggcgatggtttaggtgactcaagtgcgatgggttcgtgctcggtctcgccatcaaccactgcatgttcaacggcgtcggcgtcatgcagttcgtcaactcggggtgtgccgctctccgtcccgccggcgctcgaccgcgccctgctccgcgcgcgcgaccccccgcaggtcgcgttcctgcaccacgagttcacgcagatcgacgacggtgatgacggcggctcgccggcgcagaacggcgccgagccgttcctgcacaggtcgttccggttcacgtccgagtcaatcgcccacgtcaaggcgctcgtctcggtcgactgcggcggcggcgggcgcgcgcccacggcgttcgaggcgctggggatggggcatgcgtggcggagcaagctcctcttcgccgtggacgggcggccgcagttcacgtcgcctcctccggcaaggagacgccgggcccagccccgcgctcgcgggcgctgccctccggccggcctgcccagaggagaaaagtgagagagagcgagagattggaggaagggagaggaaagagggaggaaagagaggtgatgatatggcttactgacatgtggggcccacgtgggtcccacgctgactcagccgccacgttggataaaaccagggtcaaaaccatcaaatgacctaaaataaacggttttgtaagttgagggatgtcatatatcggaggacgatttcgtaactcgatgacaagttgagggaccttgggtgtactttttccaaatgaatactccctccatattttaatgtatgttaccgttgattttttgacaaacgtttgacctttcgtcttattcaaaaaatttatataattataatttattttattgtgacttgatttatcatcaaatgttctttaggcatgatataagtatttttatatttgcataaaaaatttgaataagacgagtgatcaaacgttggttataaagtcaaggcgtcatacattaagatacggagggagtatattgtttccgtaaaatggcacttcatggttattgataggaacaatcagctatctgaaaacagtggtatcatatcttactataaagttatcccccactaacttcttaagcttgatatgaagatgcctcatcatcattcactaacaagataccacaccatcatccactaattaacaagatgtcacatcatcatgcactaacactcatcacatttaaacatcatgcaaacatgctatatctttatagtttttataatttaagagcttttcaaatacaaacatgttaaattatcatccaacataattcatataatgtttcaatgtatatctttattatgttttatgatatcttatatatttatatagttcatcctcacttagttagtgcttaaatgattaatctatggtctaaattatctttttctttttttcctctaattaagttatatcacattaattgtttttagtctttagatgattaatctacggtccaaactatctccctacttttttttccctccgtaaagtcataccagcttactttttacgtttgaatcaccattctacatactatttaaatttaaattatcataaatcacattaatttacttaatctgatgttatctagttatcttatacgttatttttttattattattatcatactaaatttccgcagcaatgtgcggggtttcacctagtttaataataaatataagtatatactacggcagctggccaacgtatgatgaccctacgctaatgatgcagcaatctgccacaagctgtttcaagtgctcaatggaaactcgaccatcaagctgcaaagtgcaaaattgctgcttcgttcctctttccatagcttacggatcggaccgtttctcaaaccatgcatgtgctaaataagagagagatataaatgcatgcacttaattaggacttcccaaacataaagatcacatatatatagacatcaattctaatgtttaatcaagtctatggagaaatactaccaaatgagccaaaacttcccatatataaattatttttttagtaaagtccatcaccgtccctaaacttgtaccgttgttttatctcagtccctacactcgcaaatcgaccgttcatcctcaaaattattcaactgtgtcatcacggtccttaaacttgcagatcactcgtttagatcctccaatatatatatatgtatatatatatatgtatatatgtatatatatatatatgtatatatatatatatatatgtatatatatatatacacacacataccagctatgctgccgtgtacgtacataaccagccggctgctgaaattactatacaaccaagacgacgtggacgccgcggtgttcaaggctctcctgtacttcatgtacacgggcacgatgcccggggggccccgccgcgcaagacgacgacggggcgccggcggcggtcatggcgcagcagctgatcgcggcggccgatagattccacctcgacaggttggagacgatgaggttgaggcttctctgcgaggagttgtggactagctactaccggtgtctggcgacattaatctgcagcgtagccagcgactacgtctttgtaacgtcctgccttcccccaggccgggcccgcttacatctgatagctttcataggtcatagattgtcctcacagaccaacacatatcttttctgcacactttgtcctcactcgtgtgcactcgggaagaatttcccggtcggtcacccatcccaaattgcttcaggccaagcaacccatcccaaattgcttcaggccaagcatgcttaaccctggagttctttggagattggcttccggaaaaaaaattgcaacttgttgatataagtattctattaatcctattaagccctaggccgggatgttacaccctcccccttaagagagatcgacgcccccgtcgatcaaccctaggccaggaacgtcctctcttggccacgtccatgtgtccagtgccagcgcatgtgccatgctgtgtaaccactcccggtctacaccagccatgcgcaccatgcctgcgcaactgcgacacacgcgcccgtgaaaccgcgagagtcggctctgataccattttgtaacgtcctgccttcccccaggccgggcccgcttacatctgatagctttcataggtcatagactgccctcacagaccaacacatatcttttctgcacactttgtcctcactcgtgtgcacccgggaagaatttcccggtcggtcacccatcccaaattgcttcaggccaagcatgcttaaccctggagttctttggagattggcttccggaaaagaagttgcaacttgttgatataagtattctattaatcctattaagccctaggccgggatgttacagtcttccatggtttaaggacatgttttcaaagttttgtggtggtgccttttaatttaggcttttcgagtaacgggtgcagcttaattatgtaaagttatactaatatgtatgacgtcgttgattttttttaccaatatttaactattcgtcttatttaaatttttttttgcagatataagaatattttaacgtaggtgccacgtcagtcaaaaccgccatccaaatcgtcttgggacttattttgcatcgtttttgatagttgagggaccagttatatctggttttcgggttgaaggatgaaaatcagattggttgacgagttaaggggacctcagataagcttattccaagcaaaaaaaaaagctaagaggagagggcccacgcgcgatggataaaaccctctcacgtattggcgtatgtattttgttcgtgcgaaaaaaaaaaaagaagttcaaaactaatcgcgcgcagtgatcgtacaagcgatcgatcgctcattatatatccttttcgcgcatatatacatggcaccgtagaaaaggaaaggaaaacccaacacggaaaattaaggaaaacccacctcgcacgcgggtattccacaccgagtccgagttaattacgttctgccccgagcggcaacagtatttatatcgactgcaacacacgtcgtcgtatcacacgtaaacccggccgctgaaatacaaaccccaaaccaattcgagtgagttctccgacatgatgacccgtcgccaggatgcctactaccgctacccaaccacgtcgaccatcgtcgcgtcggcgccaatgcccaccggccaccacgtcctcaggatcgacggctactccctcaccaaggccaagttcgccgccggcgaagaatgcgacgagtcgtgcagcttcgtcgtcggcggccacgcctggcgcatcaggtactaccccaacggcgccgtcgtctccggctccggtggcttcgtatccctcatgctctcccttgatcatcagcccggcgccgcattgccggccgccgtcgtcaaggcgcggttcgcgttcagcttgctcgacatggacggcgagccggtgccgtcgcgcacctacgcgagcgacggcgtggtcagcttcagcgctaattcgtcgagcacgttcggggcggagaggttcatcggccacggcgagctcgaggcgtcggggcacctcaccggcgaccgcctcgccttccggtgcgatgtcaccgtcgtgaagcgcgacgggcctccgacgatgtcgaccctctgcccggtggagcacgacatgttcagatgcctgctcgacaccggggacgacgcggacgtcgcgttcagggccgccggcggcgagacgatcgccgcgcataggcgggtgctcgagcgacgggcaccggagctggccaagctctgtcgtcgtcgcggcggcgcctcctgcttcatgggactcgtcgggaggcacatcgacgtcggcgacatggacgccgctgcgttcaaggctctgcttcacttcgtgtacaccgacacgctgccggagacgatggccccgcgagaggtgccggccatggcgccgcagctgatcgcggcagcgcgtaaatacggcttggactgggagaggttgaggctcctctgtgaggacaaggcgtggggatggcgcgtcgacgacacgagcatggacacgacggcggcggctgctccggctaccggcgatgatccgaagcgtagccagcgacgtcttccatggtttataaggaaatgtttttaaagtttggagatgcgtagttctagcacagacagatactccctctatctagaaaataagtgctaccatgagtttctgtgcacaactttaatcgtccatcttatttaattttttagaaaaaaaaatctaaaaacataaatcatgcataaagttctattcatattttataatctaatataaaaaaatacttactaaaaaaaaatactagtatacggaaacttatgattgtacttattttgaaacagagggagtatatgaaatactagtagaaaaatgtacctctacttacttacatagtcataaaataaatagtttatatcttctaaacaaaataaaagttcacttcagttttcagttcagactcaccttaagctctaaatgtaacgaaacggaaccaataaaattaagggactgtctactcctcgacagaaaacccctcctaatatcttgcaaatttttgttcattggattgatttgagattcgtgcaaaccccaccaaaccctaaccaccttttcctttttcctccctgccgccgcacaacgctcaagcgctcctcccctcctctcagcaccgcgcgcctccttcactgccgccgccgcctcactgttccgtcacccggcctcgccggctggccgaaaagtgtcaacgacgccggcgaggccccgccggctggcccccttcccctcccctcctttgcctcaagccggcggcggtgcgctgtatgtcgtcttccccgtcgccggcggcggggcgccatcaccggctacctcctcctaccactctttcagctttgcccccgtcgcctcaaccggcccgccgcccgctcccgaccccgcggcttcggcgccgccgccgccgcctcgccacctgcccgatccgccgcccaccgccggactgccgcctcccacggccatccctctaaagccgacgaactcccctctcttccccctcccacccccaccccaccccgggatcctaattcgtcggccctctgccggagtttgggttcgccggcgccggagaagaagaggtggtcgccggagttggagaagaaaagcacgaatcgtgaagcacatccaatgatccaaaatttgcaagatttgagattgtgttttctgtggacataaatttagcatttccgtaaaattaatattgttttttattgtttttacattcaatatctctaattctattgtatgcatgttacatgtaaggttaatcaaaacgagaagatgataataaatatttttttatctttaattaaagggggtaatgctttatattttagaatggtgggagctaaggctacactttactgctataagatcggcgtcttctctccacacgttctatccataagtgtcgtggcgacgtatactcagcttctcttcctcgctcgaaagggtgtcgccatgcgcgcgttcgagagcttcaccggtcgtcacgacgaccgccgcctcgccttcatcaaggacggcgtcgagctgcgagccgggctgccaccagggccggctgggacagtaaggacggtgcgactgtactgagcctccaaaaattaggagcctcgaaaatatgtatactatgatatcaggcctgataggcttagaaaaaagacagaagaccaatcgacgatcgaacatatcgtgacggcttgattgtattttaaacttatttagtgtgaaattcgttaatgacaatgagtttttaaatattatcttgtaattttatggtaaatgtagaccttcattttttttccacaccgaaccactaaagagtcagtgccggccctggccaccgccgccacccgtcggcgaccctgagtccggcggcctgcgccgccgcttgctctccttgctggacgggacggacgtcaccttcagggtcggcggcgaggcgttcgccgcgcatagctccgtggtcgccgcgtggtcgccggtgctcagcccccctcccccccccaccccccttgcggtcgccgccaccgccgccgccgtcttcgacgctgcttcacccgaggacgacgaaggtgcatccacgtcgacggcgtggacgccgtggcgttcgaggctctcctgtacttcatgtacacgggcacgccgccgccgccaccggagacgatgccggccggccccgccgcgcaagacgacgacggggtgccggcggcggcgatggcgcagcagctgatcgtggcggccgatagattctgcctcgacaggttggagacgatgaggttgaggcttctctgcgaggagttgttgaccactggtgacaatcttctagtgtagccagcgacgacgtcttccatggttcaagaacatgtttttaaagtttggaggtggtgccttttaatttaggcttttcgagtaaacgggtgcagcttaattatgtaaatttgtaaatgtatatatggaaaagtatttttagaacttggtacgattacacctagccacctactagctaggttatacatgtgttatcatggtcctctgccatgacaagctgtggctgtgacgcgtcgagctgtggcggatctaaaaaattgattcgttggtgtcataattaatatgtactccttccgtcaaaaaaagccaaccttaatatggatgagacattacgtagaacaacgaatctggacatgaagcatttccagattcattgtcttaggtaatgtcccatccatactaaggttgttttttagacggagagagtatatcggtgtcataatatgttaattatactagttactggtgatgacacaatccgccgcacgtaggcagcgacatcttcaatggttaaggggatgtttctgaagtttttggaggtggtttttttagggattttggtcacacataaatactcagtcagtttcattgtcgttttaccttttttttttctaatcaaacttattttattgtggtatatttttctataaacttcatcagacataaggaaatttggcagaaaaagaaaatcaaaccgacttataatataagcgggtgcactattaattaattataacatgttttatctcaactttcatgttttcaaacacgtgaagtgggtttacaaagtggtcaaagctgcagatcgatatcatcatcaggattgctttgtttgccttgccgacgggtgtgtctgtcatttgtgccttttgctacttcgcctcgttcccatcgccggcgccgcgccgccggtcgccggcacggcacaggcggcggtgctggcccgcgatgaaggtggcaatgggcccatcctggtgacgcaatttaggcccatatgttgactagtcaacgggcagtctccccttcatatgctgatgggccgattcgtgggctttaatagaccttacggccccgtaagtgaacaaaataaaatgtttctacctgaaaaataaattgtttctgtaaaattctcctgttctaaatggcgcttcatagttttttttataggaagaaacagctacttgccagtactaaaaataacaacagtaaaatcctaactatactggccatccaagggtaatgatgcaatctctgaccaatgctgtaagcctataactgtaactctgtgcgttctcagttcaatggaagcatcaaactcactcacatgaagccgcaaagtataaaattaagctacctacaattaattgatgaaaggatgtgtataatgaatctaatccccgtagcatgctcttaggaaacaataggcaaacaaacgataaaaaacaatagatcaatcacataagacacgagattttaacgtggaaaaccctcccaaaacaggagagaaaaaaccacgggcgctaaccagcaaaatatcttcactatatatggggtgaggttacatcgctgcacggcgacgggcctccgctctactacggcagaaactggactttattaagtgcaaatgaatttggatcacaactcaacacatgctgcatgattactgaacaaagcctacaaaacaaagtgcaaaaacgcctggataaagtcagaaactagcccctgcatgacactattattccagtcactctacctacagcaagtacagctacagctagtcgagtgtaaaaagaaagtcatcgtcttcgtcgatggctttggtcaggtaaagaagaactgatgatgcagaagcagtggcaaactggcaatggacaaaggaaagcagcccagctttgcttgccggctaatgctgtccgtgtccggctcacttcacttcagtgtgcagcggcagaattgcctaccaaataggctttttttctcacgtctgcaaaaatcttcatttgtccttacctttgggcctagataatgaccggctcctcctcctcctcctgctgctgcaagtctgcaaccggagctgggaaaaatcgagatccaatgctgtaccacccactgtgcagaatctactgttctccatgcaattccacagtaatgcaaagctcatgtgatttcagaaatgaaattcgaaatgcaagattttcaggtaaaccatctagcatttctgtacttggaattccattcagaagtctttgcacttgctgaaaagcacattgtatttttctttgaaaacaatgaaagcacatttcaataaatccttggaaacaaaattattattactactacagatttcagatatatcagggagattctggagtagtttggtcaaagatacaatcttttgttttactacctcacaaaataggactgcacagagaaatgatgaatgatgcaaatagggatggtcctacactcctaccaagcaacagtaaaatatgtcagcatgggttaataatacaggcagagatccaggagaccagaggcatgattcagaaaggctaaaaacaagaaacaaaaaaaatgtgacatgcaaaagatgatcagtagtactagtggctgtttatctccattgcctctgggtgatgcagctgtaatcacacaccaaatggtgaaacagaagcttcctccagtaattcaaaatgtattggtccaagggatgaatatgaccaacagtcaatggttggctgatcatgctcatactcatactagcagaccagctgctgttgcggagtaaaaatttatcctttctgacaaaagcctggactgctgtatatttatgctttgataggttattagagttaagtgcagagagtgtcatggagtgtgaaaagaagcaatcagttttattttacgaatgatacattaggtagtagctaattccaacactagtacatagacggatagaccgtgtttagttcccaactttttcttcgaacttccaacttttccatcacatcaaaactttcctacacacataaatttctaactttttcgtcatatcgtttcaatttcaatcaaacttccaattttagcgtaaactaaacacacctatagaacattcaaggactgcaactactaaatggacaacactaggtttgatttgtagactatgttttattgatgttggagcaattgtgcaaatatgtagggtgtgtttagttcacgccaaaattggaagtttggttgaaattagaacgatgtgacgaaaaagttggaagtttatgtgtgtagaaaagttttgatgtgatgaaaaagttgaaagtttgaaaaaaagtttggaactaaactcggccatactctcatccaggttggaagaattttgtgttttcttccaatgatacagaaatgttttaatgaatcctttcaatattatctaaaaaaaaatgaatcctttcaatgaatcctggtagaaagtttcactatccacataagtgcagatcccagagggtcagtgtcacagactgaaaaaagcaatgaattcaacatgctaaaaggtgctgcccaaccctaagcaacaaccaacagttaaataggcgtgaagcagagctaggagtgaccaaagactaaaagagtcatcaaactactcctacttggctacaccgaacattcaaatagtaaatgaaataactcaagtttagttttgaacatttccaatattgagtaatcagcactcaatttaccatcattcagagaggacaaggctcctgtttgtagggcttttacaaaggtaacatcaagttcacccttttaaaaagatcctagagaaggacctacttgctgtatatatttagtgtaacaaagtgctgtaatgactgtcattaagtaggattcagaccagggacccctcctaatcataggcttagagccatagacataaggtggtgcacacaaaatcttgacctctgcacttcatagctcatgccgcccagacagtgacagtcctcagttcattgaacttcacataagctcaccaagtaaccaaaacacataagctcagcttcagctcagtctcctccatggagcccaagtcttcttcttcctcacactatctgcagccatctgcaacattgccatcaacaagaagagtaagcaacaaacacatctccaatcccttcttctacttgatttcttgattcaagaagaccagacaaatcaacaacaaatcagtttcttgattgaaaatttcatcgtttgatccatcgatttgcagaactcattccaaggagtgggagctgaagctggaggaggaggaggaggcatgaacccattcgggcccacattcagtgacccactctgcagcctcaacctcaaggagacctcagagttcgtgaggtcatccttccccatggctaccatggcgaggagcaacagcagcaacggcgccaccggcaatggcggccatggctaccaccgcgagacctccacggcctcttcatcctcttcctcctcggcctcagctcagaggaggcgagccgagcagcagcagcagcaggtgccagctactccagggcggccattgctgttcttcaattcctcgagccctgcacatcaccagctcgtctccgcgaggaggtcggtgccttccaagtgggaggatgcggagaagtgggtgaggcaggcgtcgtccgaccaccatggcggccatcaccaccaccatggcaagggctccaagcttcaggaggagaagagggcgtcggcggtgaggaggtcggtggatgctgacgtcactgctcttgctctctacactgctcctgctgcagaagtgttcctcaaaggtgagatgctgaaatatttttttcagttaatttttgtacttctttgagtttttctttgtgttcataggcagatgaaatttcagtgaggtcactgtcagaatgaatttctgaactttcttgtagagttgttctgagcagtaatttctgaactttcttgtagagtaattctgtgcagtaatttcttaactttcttgatgtgtaatttctctgcactttattggtttcttaagctctcattttgtttcgtattttgttctgaatttgccaaatgttttgtatcttgatgtgattcatacgattccttcacatgtcacatatgcatccaaagtttcagttgtttgttctgaatttgccaaaaattcagtaccataattgttcatcaagaactagaactgcaaatctcacaagttttttacgtttcagacaagttcactgacaatgtggagccctccaaggagagcttcgtgttccggagctcctactgcgagccaacaaagaacacggcggcgcaggcggtggccgccggcaacggcatcgaccaccggcgtgacatcggcacggagatgactccgctgggcagctccaccacctcgaggtgccacacgccgatcaagagcacctcgccggcgaggcacaacacgccggcgagccggtcgggccccctggtgccgtacgccggcggtggcggcggcgccggccaggacatctcggacctcgccgactgccacttcgccaagctggacctcggcgcgcagttcgacgccatgctcatcaactggagctccaaggaggaggaggaggaggaggtgtccaagagcttgaggcacttcgaggccagcgtcgccgccgtcggcgagaagcgcggcggcgccggcgactgccggtgggaggacgatgacagggccaagagctgcataaggtttgcacaagaaattttagcataaattatggcaaagattagagatgaatttctcatatgatgaaaattttcttgtgttttgtctgattattaggtatcagagggaagaggcaaagattcaagcttggatcaacctggagagtgccaaggctgaagcacagtccagaaagctagaggtaaaagctaaataatttcatcttttttcatattgcaaagttcaattatggcatcagaaatagctattttgcttctggtccaagattacactttaagaacaatgtagatgcaatgataaaagtagccaaaacccaaaaggtgtagtagtgaattcagaagggtatatgtgtgatcattttgagccctgtgcatattgcaaagtaaaattattgcatcagaattcagaaacagaaacatttttttttcttccagtccaaaattacacttttagatcattgtagatgcaatgatatgagttgacaatatttgccaaaaggtgtagtggtgacttcacttcactagttcactagggtagatgtgtgatcattttgagccctgtgatcttttccttgtggattcacaggaagaaattgcctgtctcaatcttctgtacaacaaaagaatctgaacctctggaccctaccggtttgaccgtgatggcatactgagaatctgaaaacagttgaacaaaccgaattaagtacttcaaatcctgcagcagagtatcagttatagctggttgatgatgctgccaaatatgacatattggcatctagttctgtcaagttcaaacattgcattgtgaattgtgatttgttaattgacaatggtcaggtggtcactgtggctgtacacgctaaaaccatttttcagatacaatttgtctgaacccaagtttattgatcgataacttggtattttccaagtatcgataaataccagaattataaattacagacgaagattgggatcatggctatgtcattcccatgtttctttgcctttgcagtcttgaacatggttaaatccactgcaaattcttgtttgtttctcgtgtgtcgctttgcttatctaagttgcttagaaatggtggaaagtatgattgttcattgctttctatgccatcccctaccctttcaaccagttaccatgattctttaagattttgttcctgacttactatcattccaaaagccatgtgaagttcttcgatccgagagcgccacacgataacatttctacccataatcaaagatcaagacatgtgctttcagtgatattgtcatgatctgtgatactacaatactagtaccaatgcatatgcactatattctagtgaacacattgaattcaaagtttgaaactttttccctccatgctgcattctcccaggtcatggcaagaccagctgcatggtccttcagaataatcctctgaacctgacagaatttctgtcacaattttttttttcaggtgaagattcagaagatgagatcaaacctggaggagaagctgatgaggaggatgacgaccgtgcaccggcgcgccgaggagtggagagcgacggcgcaggcgcagcacctccagcagctgaagcgcgccgccgagcaagtccggcgggccaaggccaccagccaccatcaccaccaccaccacctcgccggcagcaacgcctcctgcggctgcttcccctgcaatggcagcaacaacatcatcagtggcaacctcctgaactactattagatatgatcagctagccgccatggaagaaggatcaagaatgccaatttgttcgggagatcaacgggttcttgttgattgtagtggatgtttgggacgtgtgaagatggagatgtgggagataatggtgtcatgtgtatcaaaaaactctgatttttcaaggtgatatataccagattgctgaatgccaaatgtcatgaatggtttgtgcaaatattcagaatgagcatcatcaatatgaagaacaaattgaacagctgaaccaagaatttattagcaaatcctgaattttcagctaagcgattcatctaatactttcatgcaaactcaagccacattccgaatgcgcggaattttttccccatgtcctgaggaactcgaactatttcatgtaaacttgcagtgatctataaacttgcagtaaaatttttgtactagttcaaaatgtcacagtgataaatcttgctggtacttcaaaatgtcagagtactacaatctgaactccatgcctccttgtcttgctctgtctctcaagtccatggttgctgctggttcactaaacagcacaacatgtagcctcattcggacagttcttcccatcaggattcaggaatttctcacaatcttgctcctacccacaacaggtgaattaattaggccattaaggagtactaatactaaattactgtcagctagaacaagaggctcgttgcctcgacattcgtgcctgcctgccatgccatgcctacaaaaacaaaaacagaatcaaaccccagcttaggttcagtcctgctgctaaaatcaagattggctaagctatcttaggttcactaaccccagcttaggttcactaaccaacacatcgcttttgctgctggagtggagtagcttgctttgtctgcttgtctgaacaaactaatctcatactctgacgacgttgctgccaaaacacccaaagaagaacacatcagcatcgccgcaaagtaaccaagttaaattaacccgactaggccatattaatctatcactaatcctcgatcagtaggctgccgacggagaggaggacaggtccacatggggaggcgagccattgctttgaccggagggtcacaactgaactcacacgggtgagatgagccaagcagcagcatcgcatgctctagctaaagctaagctagatgatgtgtgggggccttggaggttgtccgttttggaggagccagagacggcattgttggctatggtgaatgcagtggcacggcaacctaggatgccattgccattgccatggccatggcctcgcgtgcgccatgaagaagatgtagacagtaggctgcactgtagccttctctctcaccttgtcgtcgagccctgtgtcccctgaatgcagagagagaaagagggtgagagtgtgtctcaaagtgtgtgtgcaatagtgtgagagagcaggataaaagcgagatgggagaagataaagccctagaaatgtgaacgaaagcaaagaagaaaaatactccactctactgatttgtaggtaaaactaataatttattagtgacatcaaacagtttagaaatgaaggtatgaaaagagactacgataaaaaaaaagaaaaccaaaatcaatcctcaagggtaacttcaaaatgcgggatttgaaaaacacagaaatagaaaaaaaaaggataggatgtcattcctcgtcgaatcttgtaataagtgaatccatgattttatttttaaaaaatattttctataggaatttcaaaggattttgggaatgccattccttcgttccaaatgaccatataagactatttttcaatgaaataaaatgatttattcggattgtaggaaaaacaaagggaaaatgaagaatttagatccctaaggattcgatgactgtagcaccgtttggttcacatgaatttatcttagggaaaatcaaaaggaaattttcctttcatgtgaattctacttagaaataaagaaaaacttccatacactccaacctcctactgagaagcaaagataaaattccatccactccaaaatgttcctacgtttttactttgccatgtccgagcacatattttacaatccaatctaaagaattctagttttttcactcctctattttacaaatgcattgtgatttttctattcctacgtttttacaatattgtgttccgaagaagccctaaaattcttttatttttccttttgtttcagagcagaggttgaaaagccaacaagccagaatgttgctgatagcagaggcatggctgcactgaacgagaagagagaggctctgcttttgttgtaggaggtgacatgaggagaagggaaggtacaggtactaggacggccatgcgtcggatgttacatgacatgcatggctctgtaaaactgtagaagagagatcggtgagaactgaagacgacgacgtgcaggtgacaagctagggaagaagaatcgtggataggcgtcgcatgggtttttgctgctgctcaccaggaaacacgagattcttcagtgcagaaaaggatgtcgattttaccggttcatttgagtaattttttagctacttcatccgtttcatattataagactttctagcattgcttatttatatatatatatatatatatatatatatatatatatatatatatatatatatatatatatatatatatatatatatatgttaatgaatctagacatataatgcgtttagattcattaatatttatatgaatgtagtcaatgctagaaagtcttataatataaaacggaggaagtaaattacaacctcgtattgctgatatctcctccagtcctcgtagcaaaagaaaacaaggcagctaaattagctaagaagaggtactctgacacggctcttttcgaacgcaggaattttgacaagattttcgcgaaatttggttcaattcctgaaaaagaacattttgaaattcctccttgggagacctatacagagttttctgggccatacaaattacctgctaacttcagcaaaagcagagaatttcctaccgatcgtcctgngataatctctcacagtggcacagttcgttcatcttttcagggagatgtacatggcccatggcttacatgaccaccattgctgcatcggaggaacatgaatgtatcgatctctgctgctgctgctaaatgtctgaagaaagcatagcactgcaaaaggaggcgcggtacatgggtacattacatatgctgnctgcnnagcanatttgcacttgactcatcagctggatcaatcggcttgaacggcctgcttgtcctctgcatccccatcccatctggatctcactgacaacaatctcatgtcacaaagagccctcttttctccagtactcactcccggccatcctctgccattgcacaccacaccatagacatccaaggccacatgcatgtttctccttgcgttttccattgcccaatcttgtccatgtccggatgctttcatttttctcctggtgaacgctgatgagttcttcatcctcttcttctatgaacattccatgaacagatcagattccgaaacagatgaaccgagaagacaacacatatcagcatcagtgatgactgttgctgcagttgaaagctataacattctgctgtttggaaatgaaggtgtggtttatttgttgcaactagtcaatggaagtagcacagatcgaattaggtacataaataattacaattgagagccatgagtttagctgctaaaattgtggtggtcagaactcagaagtcaattttcaagtcatttgagggtaacttcttttgccactattctagacacacttctgcaggcatttatttacaatgcagaacgtgacaacattataatgcttccttagtgaaatccttagaaatgagatagtacaggcaggacagttggaagagttgttgtcaaaacaaggaaccaatgtacttctctgcttttcgtagctccaaaggatctgccattcaatcaaattgacatcaaaatggcccgatcctccgcttattgtgctgcctgcctgcccccgtagtaaaaaaaacagaccaagactgtcatacaaataacatgcacatattcttgggtgtccagtttttctttctttccagatcttgctgtaaatcctcaggactccagttatttaatctcagttcttcaatccattgatttttcactagttctaggcttctagcaattcccttgttgaaatgcatccaattctgaaaacatatatagaccatttcttaccaatgcaggtgtgttgttcagtcatcgtccttaatattgttgtcttcagacggaaaactatcaagcaaatcacttcctttgtagttcgtagaaccaggacgagggttgaacgggtactgactgtttgcgatacacaaggatgctgatgatgttctgttactaccagcaccccagatggcgaactttgtattttcaagaagaccctcagaagcaatccttgcatctcggaagggttcaatgcatttttccttggcaaacttaacacaagcttctcttgctgcttcaagacaagcggccatctcacgctcttcacatctctctctttcttgatagtcagttggtgctcctcccaataaacctttccaccagggtggcttgcatttgcgtgatgcagtaattgaacacccagaccgtgccccagcctgtggaatgaaacacagatccttactcattcatcatttttgttttaaaggtaaattctctactagaatagactttactaagtacactacacaacaatggtggatgagaagatatatgcaagcaagacatattgattcagcctgttggaaatcagttattatactaaatgaaatgcataaaacagaccatggcaccctagaagatgaagaaaaatattaaaggcagctttagttttttgatgatttactaacacacatgaattgtttcttgcatataacagttcttgatcaacacagtattgtttgtcaataagcaacacctgaacacaatatttgacaacctctgctcacataagtactgtccaatccttctgagaggataaattcctaacaggaggtgagctcacaaagaggaatcaatagttccaacacaatgcttttaaaatgataactctgcgcattgtaataggaacaagctgaaaggtatgattcatgttctttataataagatacacagaagacagcataacacactacaggatacatgcatatgtcaaatcaccgttgaaatctagttccatcacacataattattacttctagaacctaacactaacagtatttcagtagagaaaactgcaaaattgtaaatgcacttcaagaatatattgtgaaagcattatcaatcatgacaactaaagctaagcagtcatgagctggttgtttgctctctttaatgtatgcagctgttatacttcctgactgccagagctttagccagtcagctcggccagctgcaagagtagcaacagtcgtcttcttttaagggtaaaagatgcaaaaagaacatagtgaactgctgtatcaatagcataatgcgccacaagaaggattatcttgtcttgcatatggaatcaataaagtttgttcaaaaaaagaaattcaattgtgtaaagcatgttcaatcctagcaaatgttgtagcagcacatacatgggaggctgtcttcccttaaacaagggagacttattagccaaaataatagtgttcctcccttctatcagagtaaaactcccagttgatgcacacaggatcattacaacttactggttgagtgtccatgttgctccaaaaaactaaaaagattatattgtcatatacatcctgatgtatgaatgacacgctatagcattgtactgtgcaaaagtaacacagcctgtggaatgtacaatgttgtggagcattgtcaaccccaaccactaatctccagtagccaggagctggtttgctctgtttgatgtatgcagctgctaaacttattgcctagcataactagcgcaaggcaactcggccagctgcaaaatgaatcacaatctcaggggaaataattctaactgcagagttgcactggacttattaaattgcctttatcatcaacacaaaaaaaccatacactaggcaatggaacaatacctgatgtacccaaatccatcagtaaactattaagtaaaaatctttcgatgctctagaaccaattaactacttgcattagccaatggaacaatatttaatacacccaaatccatcagcaaattatttgcattgctcatagccgcacctgtaaactaaccgagaactcacattttccacataacgaattctactccgaaatagtaaaatcctacaatgttgccaataggtcacggaggagaagggggattcacctcgcattgcgacaggaggctggcctcggcggcctcccacgcggcgcgccagctcgcggcgtcgcggaaggcgaggacgggtggctcgccggatgcggcagacgacgggacgggcgcacggaggagcgggagcggcgggtcgaagcggaccacggtggccgccggggagtagtcctccgactggtcgacgctcccgccgggcaacggaacgtccatcgcgccaccggcgtgggggcaacgtggtcgccggcggcaaccgcggcggcggcggcgagggaagtggccttcgtcgatgcaattagttagggtttgccatataaacgagtaggattcgtttatatgcttgctggatcaagtctgtctacgtggcggccgagaggcgagagctacaaggtgcagacagaattcaactcaccattgcatgtctctaatatgaattctaatctgaaggtgaactcatcttatgacaaataatgtctcctccacgacgacatatttctcatacttacaagaattatggttaactgtgggatcacgagaactatacagacagctagttctatcaaaaagctctgtcgtgttgtgagctacccgaactcgtacgacaaaatgtctcgtaattcgtcattaattaaaatcaaccgatgccaatattcataagattttctagaaaataggtcgtaaatcaatgatgttttacatgttcgtcatatggtttttgtcacataatatcatatttgttgcagaatgttagcgaacccctatcgatagacatagatctagctaccaacctttgctcgaacacaagactagatgatgaacggggccaagaacacagggtgtttggtgctgcgatgaagcggcagcttttctgttcttttctcattgcaaatataaaaggaaagacaaagacatgcaaagcaccatgatcctccactatgcgcaccacgatcggttcacggcgtgtgccatcccacacgcccccgatcgtggtgcacgactcgactatgacgcgctcggttcgcactctatgcaatagaagcgccgggcccaacttgcaaccgataacatgggagataattaacacacagcaacacacagtaacacatacatgaatccccgcaccaaaaaaaaaaaacatagatgaatccttacacaagattattattattaagtatcttcaatatgatcctcattaggcctagcctttcatcatttcaatcttgggcaatacttcagtcgccaagtccgggcgctgtttcctgtcattactgctgcatttcaggcctaggtatatcatttgtacaacgtgtcctgcgtacttgtcttccaagttcagtttgctgtccacgatttccagtgtcctgagcaacttttgcctgggtgtattctgtgtttccaaatttacacctgccgaactataggataaatatgtttctaaaaacactgcactttgccctgttactagctgcaacaaaatgatacccaaagcaaacacatctgactgaggggtcaattgttttgaactctcgaactccggatcaatatacttccaagtgccctttggttcttttgttccatggagaggtgttgctgtgtgttgagtatactctaaatggcgggaaattccaaagtcgcagagcttgcattcattttcagcgttgaaaaggatgttgctgggattaagatcaccgtgggcaattggattaggttttgtttcgtggaggaacagaagagcagagcatatgctggcagccactttaactctttcttcccatgagaaagattctctgtgttcttctgagagacgatcttgaagggtaccattaggtaaatactcaaacgagtgcgagtttctcagtgcaggctcctataagggtgaccaggtttggatgtcggattctcctgaggatctcaatctgcgttgtagtgtcatatatgagaaagaataagaatgcaagaaaacctttatattttgggcaaaattgctgtttgtaaaaaaacattttgtatgaaaaaggtgcatcaatggagaaacaattaagaaaacatagcaagtacgatacgaactagttgagctagtatctatctatatattatattattaaaacagttctgaaatgaggcatcacgttcgctgtggggctagaaattcccacattagtcgaagaaaaagagaaaatattttgatcgttagattgtagctgtttagatttttcaatggtgcagattaacacatgaaaaatatcgaagtccaactagaaaacgactaaaattgggaccggcctattctatatacagtgatggcaagttaattaaacctttatgattaggattaagagtcggacatatttgcatggaggtcctgtaatcaaatccagagtacaaatctaatcagtgtaggacacgttaactcaaggtagaaataaaaaaaatcaaataaccaatacagttggaataaaacaatgtaagaatatcatgtatgcatgagcaaagggaccaggaacattaggcgtccaagtaggaatacattttaaaaataactaaaattcagaataaacaataattaatattgaaagaagagtccatataggcacccaatacgatattaattaaaatttagaataaaaataaaataaaacccaaaattagaaaaataaaggacataagagtttaagtaggaatacaaattaaaaataattgaaattcggaattaaaaataagcaatattaaatgaagagtacatataagaacctaatacgagattaattagaattcagaataaatataaaataaaaataacataagtttaattaaaatttgaaataaaaatcaaattaaattctgaaaatataaaaataattataggagttcaagtataaatataatttataaataatataatatcggaataaaaaatatagaattttcaataaacaccatccatctagaaaacgcaacaataacgaatgacaataaagagggaagaagcaacaaagtcgtaaaggagtaaagtgacagcagttgatgggacattcaaaaactataaacaaaacccaaatagaatcccaatggcgatcaaaaggagggacgacggacatgccgttaagcagtacgatcacggtggttggcgggatttctagaaagtaaaaaaataaacctcaatgatattaaagagggaagacaacaagggtaaaaataataaacaaaaccacaaattaatagaatcccaatgacgattaaaaggagagatgacggataacctgttaagcagcacaaacatgatggttagcaggaaagtaaaaaaataaaccataatgagaatcacgttcgaattttaaaatatcaatgacaattaaaagggaagacatcggatgggccgtttaggagtataatggctacttgcttatggcttggtgggacttctacaaagttaaaagtgaacaccgacgatcattatatcgatttttaaaatccaaatgccgataaagagagaaggagacagacgtgcataagtggagtagagtggcggcgtttgatgggacttctaaaa

SEQ ID NO: 54885 - DNA, 1395 bp, Oryza sativa
aaagtcaattacctctgtataagtcatattcttgagtggcacggcttcggcccacttagtgaaataatccgttgcgactagcacgaaatccaaagcctaacctcggaacggccatggtttgatgataggattcaatacaacggcaagtgccgattgaacagtgccgaaccattgacaagcttcgcatcccctataatatttgaaataatcatcaatcattttcggccaataaaatcccgctctcctaagtaatcaattcatcttatgggctgattgataagttccacaaatcccttcacacacttctcccatagcaaccttggattgatcattatctaagcactttaacaacacccaacttatatttcgacgatacaactcccatcaagcaaagtatatttgaatacttgccgccgaattttttgatcaaccctaagactaggatctttcaaatattctatcaaagggattctctagttttcttctgactcttgggcacaaatgaaccgatgcccttttttgttgcacacttcgtgcatacaactaagctttgcgtgcacattttgtcgtccatcaactagcaaatgtcattaaagagttatatgaagaaaattgttcatgtactgcctcagtcccataatagacttacttctgattacgaatccagacatgacgtgattcatatccaaaagttgatttttttttatagaacggagggagcatttgcaaatagttggacacctacatgtaataaaatctaaacctcatatgtaatatgtagtatgtatcatattatataccatctacatgtatgcataagatatgttcacttttaagctgagaacatgtattgtccattttagatgatggcaaattttgctacaggatactgctattgtgtggttttagcccaaggacaccgcccgagctcacttttgggggaaaacactctataaacgtggtaatttgccgatggacatcgcgccaattagaataataatttccggttgaagagaagagagaaatcgcgtgaaatttcaaaaatgcctttgggcccacatgtcagcattgctatctctcctctctcacatgtcacaccttgggagatgaaggaaaggtgcccctgttcatgtcgtcgtggccctgttcgtcctcattcccgatgggcacccgaagctcctcgtgcaagcaatgtcgtcgcagtcgatctcaggccaaagcgtgcatgacgatggactaacgcggcggtaggaggtcccagggctcggcgcggtacaagtcaacatcgcggatggcggcagaggtgaagctggtgtcgagcaccatggagacattccgccgcgggagtggccgcagttggcgactttgacgctgcttttctcctccccatccttt

SEQ ID NO: 54886 - DNA, 11047 bp, Oryza sativa
  unsure (1)..(11047): unsure at all n locations
atgacgagggcggcgtcgccgaagctgtgccggtcagatttggagcgtgccgcacgcccccgttccctgtcgtcgtcgtccgcgtcgcctgggactggagcgtggaggagaaggaggtgtttcgaagcggtggcatgcgttgcggcgctagaaggaggggattaagagagaagagagatggagagctgacatgtgggctcaagggcatttttgacatttcacgcgatttctctcttctcttccaccggaaattattattctaatcggcacggtgtctattggcaaattaccacgtttatgaagtgttttccccaaaagtgattcagatggtgtcctagagctaaaaccataaaatagcagtgtagcaaaatttaccgatgatgatcgtgtcgttgcgtttttgtccacatatgtcatttttccatacgagtaatcacactaataaatcagttgcatgtttcatgcaaaaaattatatatgttatgtttcagccaataaataattccgttgacaaatataatttaaaaacttcagaattttcccttttaagattgaaatctattcaaatttgacattgtgaggcacttcaatcatttaacatttgctatgcctactacagctatctggccacttttagagcatatgtccaatttacgtgattgataaaacgtgtcgctgaacatctaataacaagactccagaccaagtacaactcacaattatttatttcaaatattagagttaataaattaagtaaaatattgaattaagactccaacatgagtacaaatagctgtagtggttctgaaaatcatataaatatctttattttgaaatttgtaattactaaatcaatgagatattcagactccaaaccaagtacaattcaacattattaaatataaattttggaattaattagtaaatcatgaataaattgtagcccatcaccactcaccgaatacaacactatattattttagtttagaatgagtaaatcatgaaaagagctatacgggaggcttattaattccgaattattaaattaaattcttgcatatactcgggggtataaatataaaccccatagaattgcaatagaggacgaacaatccaatacaacttcggcacatcgccacccttttacttttcttgtttcggtgagttctatccacaagaggtaatctgtctcgatggcttgtgctattagggctattatatcgctttagatattttagtccttgtatcatgaccattgatatcatatgtcttagttaatctagctttactatctcgatttagctctatcagttgtctctcgctttagggtttctgccggtatcggctaaatcgtcttgctagattagattagctaaggcatctaccatcttgaaaggtgtttaattccttaattgtttagactctaagcttcttttcatactttgagctgcatcatccctagtcgtgtatatttgtcatccatatagacagatcaccttataggaatatatcaagtctaggttatatcggctgggctatcaatttgacaattgatccctacttgatatattactatagattgatttgcatatataggtttgtactagagtattagctggtacgctatctttatctatcttttctgctctaaatacggtttcattggctattttcgtaatattgtcttgaacttctttattaaacttgattagcaatgttacagccgatgaggcatgtttagggttttatattctttgatctatctagtctatagccaatttggtctacatcggctgagaccaccattaatatgctatcggcctatcggccgatcggctatcggctgactaatcatgctttattgtttccttgctggttgcaggatcaaaccagctggtacgcccttagcacactcgaggcaaacctttgacctgcactggagttaagcagtttccccaggttgtcgtgttttccgtcaacacaaccccaactgcatagtatcatcgcagttcagaaaaaatggctcttggtctattgacctccatctagtgttatcagaacaagcacaggcataattacaattgcttatgccactgctatcaactcaacagatccagaacgattcgccagatgaacgaaccttacttctaagctcaatgggaatcacgactgccgactggagcatatgttataattaacctgataacgcatcatggtatgctctggccaccggcaccattcatctggttgaaagcaatccctaatacctgtaggatcttcttatggctagcatttcgtgatagactcaacaccaatggcagctgggttaaaaagcgtgggcttccgacccacattgtagcatttgcccaaccatcgaaacgacaaatcatattattttgcgttgcaagctagctgagcgagtatggaagaagttaaacttctatgaacaagctatccgcagtaaagacatcctgcaatttgtgcagcatacgatgacagtggggcctgctaacctaaaatcaggttgcccggggagggggggggggtgttcctgttccgcgctacgaacagaggcggcacgcactttagcagggctaatagtgcttagccccttttttcgctaacggtgcttagcatcctttttatatggtttctttttttttgggataaaaatttgctgtgtctgtttcttctctttgtttagttgactgcaacaaactttcaactcatatttatccaggatttggaaacttttcaactaagatttaaaaactttcaagtctagatttgaactaagatctaaaaattttcaagtcaagatttgaatactttcaacttaaatttaaaaattccaactcagattttaaaactttcaaatcttgaattgaaatttttcaagtcagatttgaaaaattcaagtcaagatttgaaaactttcagcacgaatttaaaaactttcaactaaatatttaaaaaatttcaaatcatatttaaaaactttcatctcatattcaaaaacattcaactcaaatttgaaaactttcatctcaaaacttaaaatctttcatctcaaatcttaaaaacattcaactatttaagttaagatttgaaaactttcaaatcatatttaaaactttcatctcatattaaaaaatgtttaactcgaatttgaaaactttcatctcaaaacttaaaaactttcaactcaagtcttaaaaactttcaactcaaattcaaaactttcagcaaaaattaaagataaaagattcaatttctaaaataaaaaaataaacggaaaaaatggcaagaaatgttcacggcctccctgcgacgaaaaaaataagcgagaaaaaagaaaaaaaaaagaaagagatggctacacgagggtgtgagcctcacgtgggccagaaatgcgcacgacttgcgctaatcagatcatactatatcagatcatcgattgtctagaactttgggaacaccgaatcaaccaccgtcaccaagctgcaattcaagactagggttgtgttcttatcactgttttccaaacccatcctcctcgtttttcgagcgcacaattttcaaactactaaatagtgtattttttacaaaaagtttctatacgaaaattatttaaaaaaatcatattgatccaattttgaaaaaacaaatagctaatacttaattaatcacgcgctaatagactgctctgttttccataccagaggggagtgttcccaaccaggaggagcgaacacatcctaggtgattgcgataatatcctcatcttccttcttatttcaccttttgaattttctctgcatatttttcttactatatttatttttttttgttctcttcttcctttttcttccttttttatccttttatccttatttctatccccttttcctgtttcttgacattgttccattttgactcaccattaatacaatggttataaggtagagcctctctaccttttcggtaaaaaaaaaaccatgtaatcactactcagaaatccccgcaaaaaaatcactactcagaaataagcacggccctccctctccttttgtgcaacagcaatcctttcctccttttccaggtgccctctcccccctctctcgcatgtgttgctttgtttatacggtttgattctatcatctgttcatttcaattcttttatctcgttacctttaattgctgtcctgtttgggggcatgtgtgtcatgtgatggttcaatttggttggacgacaagggttaagtttaacggtaacctatagaaaataattcaactactaggttggtccatcaatcatgttcatagagtgaggctgcttacaaaaagatgtacaccaatcatgcaatttgtaatcaacacatattataaactagggacaatatgattgaagagtggcttgccttagttcatgatcttcaaatcttcgagagaatccgcatccattgaacccccaaaacatccactacgcacttgaaaagagagaaccattcaaaaccctataaagtagataataactattataaactaattgtgccgttggacagatctcaattttagaaaaattatggaaattgaacggagtcgaacagagttacgatttgcaagatatgaaattttaaagattaaataaatttttgagcaaaggaaaaagagtttctttcatggggaaaaaatattccgaaggaatattcctttgtgggcccactcacagtggcaccggggggtcggcgcacggtagaccgtgaggtgaggtggtggaccggctcacggtccatggtcagtgcgtgtggggcccaagggtcagtgacaaggagcatgtctgcatgtggaccgggtgcgcaaatggttaaggaatcgtggtcccacatgtaagtgactcaagagttaaaagggagtttagttagagattaagtacaaccgggcccacatgtcattgagacagtagaagcggattaagatggcgatgattactgtgtaggattaattaaggaatcattaagccctcgatggtcccacctgtcagtgtcgcatctcctcttttcctttctttctctccccctcctcctcgatttctcctcttctcgttctttacccgatccgcttttctttctccacgcgcgcgcgcccgagcggaagagagcgaggcgtggctcggggcggcggcggagggcggctggacggaggagccggagtgaggagacggagaggcccggcgggtgtcgtccgaggggaggtgcgcaagcgggcgtctcccgacgcggcgcgacggcggcccggagcaagatgaagacggcggcggcggcggcggcttcggtggctctccggccaagcggaggcggaggcggctggggaagctccgccgatggagcgccggggttcagggcgacgggcgagcaatcggccgtagggcggcgctcgcgcgggggccggcttggccgagcgcggcggcaccctggccgacggcgaagagggtgatggcggcgagagaattagccagaaggcggtggcatggcggggtgagtgatggcggcactggtggcgagctggctcgggaaggtggagcagaggcggcgatggaggtgctggcggtgaagcggccgagcggtgcgcgggtccggcgtgcggcttcgaagtgcccgaccgcgcgcctcgggccgactaggggagagcgaagacggtagtggcgatgggaatggcgaaagatggaggatggtggagcgaggtggcttctatagccatggcgaatggcgacgcggtggcttcgaggggatggaaggaggcatggcggcacaggggaggcgaggcgacgcgacagtggcgacgcggcgtgggtgagctcggctcacactttcggcgtggactgtcgaccgcgggagttggagcgcgagaaggcaaggcggtgcaccgggtgcatcggtgttggcgacttggcgcggcacggacgacgggaaaaaaaggcgaggnnnnnnnnnnnnnnnnnnnnggcagcgtcggcatgcatgaggccgacgcgatgacgcctgccacagtggccggttctgtacgaggtacggggagggcgaggaagtcttcgttggggcccacatggccagcgaagaacgcggggaggaggtgggggggcccacgtggtctcctaggtgtaaaaaaaaactcacggcccagcacatttataaacgagaagtaatttgtgaataaaatttttatataattgtttttagcgacctaaaagtaaaggttgaaaaataaattttgatgaaaaaacatcaaaatcagcttcaattttaaggatagggccgttaaattctaccaatcgaaagaaggggcaacaattgtgtaggacttcaagtaaagtaggaacaaatgaaagggcgcctgccacaatggttggcttctatatatgcgaggtacagggagggcaaggaagtcttcgtcgggggcgtggcacgtggggaggagatggaggggcccacatggtctcctaggtgtcacaaaaactcaaattctacccgacgaaagaaggtgcagcagtcatgcaggactacatgtaaatcaggaacaaatgaaagggacgcctgacacagcggatgactctatgtgaagtacggggagggcgaggaagtcttcgtcgggggcccacatggccagcggggaacgtggaggggcccacatggtctcctaggtgtcacaaaaactcaaattctaccatacgaaagaaggtgcggcagtcgtgcaggactataggtaaatcaagaacaaatgaaagggacgcctgccacagtggccgactctgtgcgaggtacatggagggcgaggaagtcttcgtcggggcccacatggccagcggggaacgcggggaggaggtggaggggcccacatggtctcctaggtgttacaaaaactcaaattctactagctagatgaaagaaggtgcagcagccgtgcaggattgcaggtaaagtaggaacaaatgaaaaggagaatcgaagagggtcaaaaggaaagaggaaagccgcacagccaacctgacatgtagccagcaagcatcagtgtattttggatgggctggtccgggctagattagtagagtgatggaccaatgggagctgatgatgaagatttgccaagcataaagcctagaaatatcagattgacaaacagttcaaaactacagcagcaaacatgtacttttgtcacaaatctgcagagctgacatctttactcactgcattttccatttttcaccagaaatctgagcgtagcagatatatcaatcattggctgttctatttatcagatcaaaatattggtagtattgggtattatatttatcagatcaaattatggggttagggctagaatcttaattgttcttcaagatcacaatcagtcataattgagtcctagttacaaggtttcaggtctgatgtaagtcgaaattattaactggtggtgcacgaggtacaggaaatgtccattcaagagttgaacttaaatcctttcaaaaaaaaagagagaagaattgaacttaaacagattacaacagaagtccgataatatatatgttcttccctttgttgaacaaactatattttggccaacctacacacacagtgaacccatcacctctaagtatgagagtgagcacatcattgtattaagaaggaataaatgacggacagaattgttggacagcagactgccttcaacgggatcagcggattgccttcggagtcgtggtttgtcgcacccggatcgctgtgttctttgtgatcaatgcgaggaaacgattgatcatctcttggtcgcatgcccggagtctcgacaactttggtggattgctcttagagctattgggcattccgagtgtttaccgctcaatgagccctcttttcattcttggttgtgtgacagccgtaagaagatggtcaaggaacatcgccggggattcaacatcatcgcaacactagtagcgtggacgatttggaaggaaagaaacaatcaggtcttcaactagaagagcggaacatgggcggagattgtaagggttatgacgggtgaagcagagctttggaagagcggaacatgggcggagattgtaagggttatgacgggtgaagcagagctttggcggctggctagagccgcaatccccgttatggtagtccctgactccctgtgaatggagaagggtcgccaaatttagtatgagattaggcttttgtccttcgtttccccctccagtatctttgtcccattcgttttttatttttggcccgctttgtacatacatttattccttcttagagtcactactcttcattgaattaatctggggcataatttctgtggcgaggattggatgattcttcactattggatcactgcatctcaatcccaagaataacatcctggcaacatcttctgatcttgatctgtctgttttcagcctgggcattttttagccgcaaaccgaaccgaaccgcaccgaaccgaaccgaattgttggttttttcggttttcggttgtcagttcggtttctgtttttgtgctattcggtgtacggcttcggcttcggttttatagagaaaccgaaccgaacaaccgattaaaccgacatatcccgcagcggcggttttatagagaaaccgaaccgaacaaccgattaaaccgacatatctcgcggcggcgcagcccacggcccaccagttcgcagcccatcaggccatcaagggcaaggccaaccctacgccacgcccccgactcgtcagtcgtcacgcccccgactcgtcactcggcgcagccgctagcccggccgccagccgcgcagggtgccgccgcagcgctgccgctgccctacctcgccgtcgcgggctcgaggcggcacgccgcacggccgcagcgccacactcccctcccctgagcagcagctgtaggccccggcgagccgcccgcgagcacaccgccccctgcgcccaaagacccaaaccctaactcggcggccggcaaacgggctgctggcggcgggccggcaacaccctcgtggagttctccgaccaagacaacggcggcgcggaccgagcagtcctcctatgtaagttcttcacttcttgttcgtttgttctagttgagtccatgttgagtgaatgagtgttgtattgctgttctatgttggtaagttctgatttagtgatttgaaacatttgatctagatgggggacacagatgaaactgttgcttgtgagattaatcacactcaatctcaagacactgaaaccggagtgtcaactactggagtggtagatgcaagcaaggacaaggaggagcagcagcagtccaaggatggagagaaagctgatgaagaatccagaaaaagaaaaccaatggctctaagatctgatgtatgggaaagtttcagcaaggtcaaacttgctaatgggacgagagggccaagtgcaagtggtgtaccaagctatttcattgcggctcaagaacaaatggtacgtcatccttgaaagctcatctgaagatttgcaaaaagaatcctaacaaaccagtagttgataatcaaggaactttgcaactgacaccatgtgatggcaatagtactcttggtactgtgaccacttggaaatttgatccagataaacttagaaggtgttttgctgagatgataattgaagatgaacaaccatttgtcctatctgagcgttctggtcttaggaaatttatgactttagcatgtccacgatttgttctgccatctagaagaacaatcactagagcttgtgttaaagtatatgaagatgagaaagaaaagcttaagaaattttttaaggacaattgtgtaagagtttgcctcacaactgatacatggactgctaagaacagccaaaacttcatgtgtgttacagcccatttcattgacaatgagtggaacctacagaagaaaattattggtttttttttggttaagggacatagaggggaggacattggaaaatcattagagaactgcttggctgagtggggcattgacaaggtttttacaataacagtagacaatgctagtgcaaacaataatgcaattaagtatatgagaagggtcttgaatgagtcaaaaggttgtgttgctgaaggagagtacattcatatgcgctgtgctgctcatattatcaacctaatagtaggtgatggcttgaaggaaattggtacatcaattcaacgtgtccgtgctgctgttaagtttatcagatgtggaacatctaggttggtaaaatttaagaaatgtgctgagttagccaaggtacagagcaaagcatttctaaacttagatatttgcactagatggaactcaacctatcttatgttaaatgctgcagagaagtaccaaaaagcatttgaaagatatagtgatgaagacccatactacaaattagaattagaaggagagaatggtccaggggtaccaacaagagcagattgggagaaggctaggaagatggctgattttcttgaacacttttatgacctcactctccgtgtttctgtacaaagtcgtacaacatctcacacttatttccatgagattgctgatgtattacttctgttgagagaatggtctcatagtgaagacaagttgagcaaggaaatgggtacaagaatgctaatgaagtactacaagtattggggagagaagtatggtgagaggcagggggacagagagaagagaggagagaaagataagggggatcaactactcaacttcactgtcttcttctgtgttgctattgatcctagatacaaactatcaaattgcattagaatgggaattaaggtgatgtttggggatacagtaggagaaaaagtatgggaaacagtgaatacctattttcgtgctttgtttgaagagtacaaggaaatgtataccccaaaagataaggcaccgcaacctactgaatctgaatctacagctgaaaccagcaaaagagtgagttgtaggtggatgtcagtaattactcagcaactt

SEQ ID NO: 54887 - DNA, 5986 bp, Oryza sativa
cacttggtttggtgtatgcaatgctgttgttgcctgttgggtgcctgctacggtgctacctgggactttatatttctctattggaatatgaagaactcttgatctatgtaactgtactcttagcacatgttgatgtgtgtactgtgtgactactttgtgtaattctatgcagctgtgctgctggttattgcatgcttaaggaattgatatatctataatatcatatatgctgttgcttgtgttcatttttatgtaattctgtattgttgtggctggtggtagtaacttttggttaattcggctaaaaccgaaaccaaaattaaaaaaccgaaacggaattttgcggttttcagttttttggagaaccgatcgggtggtgaagcctgtaaaccgaattttatagcaaccgaataaaccgaaccgaattgtcggtttaaaccgaacgcccaggttgagtctgttttcaactcagaatccataatatttctcaggatttcactttgctgcgatggagttctcttgtagaaccacttagcatctcccagatagtagagcacacgttttcttaagccctttgcatctagatccccagtaactagctgcagcaatacgatgcccaaagctgctacatatccaactgaatcttgcaaggctcagtgataagccgtccaaattctttcgaatacagataacacattccgagatcactgagtaagcacgcatttcctggcctgaagatgatgttgcttggtttcaggtccccgtgaatgatcggcttgggctttctgctgtggaggaacatgaggccggagcatatactgacggcggcaaaagcaatggcaaagccagcctgagtgcctgacgtccagccaccagctcgctgaagcagcagcaaggcaagtatcaacgaatttggatgggctgagctaggctagtagagtgatggcccaatgggggctgatggtgtagatgagccaagcgcatggctagaaaaatcagattaaagaacaattcgaaaacacagcagcaaacatgtatttttgtcacaaatctgtagagcaggaatcttaacaaacctccttttaaatttttcactagaaaactaagcacaatagatatatcaatcattatatttatcaaatcaaattattggttgtattgggtgttatatttttcgccgggcgtgttggctgttatattaatcgatcaaatacaattatgtgtttagggctagaatcataattgtttttcaagaccacagtgagtaataattgagtcgtagttacaaggtttcagatccaatgtcaatcgagattattaactggtggtgcactaggtacaggaaatgttaattcaagagttgaacttaacaacaatagattacatagaagtccaatgacatgttcttttccatttcttgaagaaaccatatattggccaacctcctcatcacacagtacttgaagccgtcaccacttaagtatgagaggcactacttcttcattgactcaatctgggcaaaacttctgtggcgaggcttggatgatttatccattatggtttgctgcacctacctccaaacaataacatcctgtcaacgtcttctgatgttctgtctgttctcgagtcaagattcacaatcttctctacgatctttctttgctgcgatgaagttttcttgtagaaccccttagcatctcccagatagtagatcacacgttctcttaaaccatttgcatctagtttccctgtaactagctgaagcaacacgatgcccagagcagatacatccaactgaatcttgcaagggtcagtgataagccgtccaaattctttcgaatacagataacacattccgaaatcgctgagcatgcatgcatttcctggcctgaatatgatgttgcttggtttcaggtcaccgtgaatgatcggcttgggctttctgctatggaggaacatgaggccggagcatatactggcggcggatttcactctgatttcccatgtgagatacttgaggtgactttccagtgtgttgttttctctgaatcggtaaacgattgcccttttctctatgcatgctcctaagaaaggaaccacattcggatgactgatatttctgaggatttcaatctgcattttcagaactagtgtgagaaatgaagcaatacacagtggttctatcttgcattttcagaggtactgttagaaatcaacagggtgtataatgtattaatggtgtcattggttttctatactttggaatgcaaaacttcagtcgcttttggtggtgtttgatgaacttatgtttgaacatagtgcagagaaagttatgtgttcaacgaaacttaccgcttgatgaaactcttgcatcaaaatccattctggtagtgttcctttgggaacagttgtagcaatatccattccatcaaaatctgaccgatacacattatatgtagctgttccacggagccacttcgctcgtttgctgactgcagcatctatttctgaaggtttgaacacaatgaacttatttccgccacttgagcgagaagctttgttcttgttcgcctgttcaaggtattgctgcaaggaccatgttagaacaaggaacattgatgaacaattgaacatcattttctttcttaatattgccgactgatagtgtctgatgcatgagcaaggtatattacaatgtaacatcatcgtttgaagagcaatacttacttgtgcagcagtgactacacaaacgacaatgattgtaacaatcgccaaggtgaccatgacagcaccaagaaggatgaaggtcgcaacagcactgatggcgccaacaacgacgacaacaatgccaacagcaacgtccataggcttttcctctgcttgctgatgaggattcttttgaaccttcgctttctcccttgtcaccaaccatgatcgtagatttcagcaaacatggccaaacgaagtgttcaagtgaaacaagaatgaaagagtccagattggcaccatcttgtgccggttctttaaaaaaaaaaaacattctccagattcaccttacctttttactggttgagcagctgcaggattttggtggcctcctcctccaaccatggctggtaaacaggttgcaaacgcttgatctctgcagattttagattgagtaactggatagcaggtcaatcaaatgactgcaggtatgagatgaaaagtaactggttatgagcgagcaatgctggtgttgccggtcgctggttatatatatgccatgggcagaagccagaaccagaaggttgtccgtgataaacaacaggcgctgccaaagcagcttgactgatgggaggtacgaggtctttttgttcgtgtttctgcagtggtatacggcacattcttcaggttgaagttgatcaatgcagcatgctgtttcacttttaaattagtttttgtagtgggtgatggaaggcatacacgtcaggagtctcctgtgcattgctttccgtcaacttgatctgtgtctttggttataatactggggctaaacgcgtgagatgatttggatgttggagtggttatctggtagaatagtcattgtctaaaaaaagacgagtagaatggtattgatagacattacatagtcctaccaatctagtatcacgcgtcagaaatggcatccccctatcaacttgctaataatatactgatgattatattaaattctcaacttgctaaattgtactactgattgtagtttcattttcgttataataaactgagtagtagtagtagtaagaataatagcataagcttgagtcagtgatcatggaggagtttgtaccttttactgctgacgagtcgcaataaacatcaccacttttctgctctcaatttccaatggtttttgaattccagcaatgcaattaagaatgtaaagatcactcgagcctgacaaactggaaaaaaaaaaagacaatgtaacattacctcgctcgatgcaaattctttatgctgatggcaaggcttcaaaacacaactttgatgactcttaacaagcaacgaaacgcagcgcagcagagaggcatttcgtcgagcaggttgcagaccagaaatgctccgtcgagagattgaccagccaagcagagtcaagaggaggccaactagatcggtggctgggcgatggagtagcttgcaccccgtgcacccgggaggcggcggcgcaccggccggcggccggccacgccgtcttacgacggcgctgctgcagttcgcgcgccgtggcgaccattaccaaccatatgcatttgcttccggcttcccgtgctctgttcgatcggaaaagttgcacttccagcgaacggaaggcggcgagggacggcgagtccggccggcggggatcggtgacgtggcaatgcccgccattgcccattggcgacgcgagaccggccgccgccgctgcctcgctagcgggaggaagaggttgcagaccacaaatgctccgttggattcacaaaatttcaatggtggcgatcattagaagggcatatttgcgagaaaattgcaatattgggatagcaaacattggggatttactgttttgacactccgagcggatgacaaatgggcccatctgtgtctatgaaatgtgggtccagtgtcattatagcaaagggcctaatgggctactttgttcgccgcgagccggcccagctcaatatgggaggcccaccaattgtcatctttgaaactgttagcattttgtttttttgaaaaagtccaaatacccccgtaaactttgaatgaaagttcatctaacaccgtaaactttaaaactgaacatctaacctcctgaactctgtaaaatcgttcatattacccactaaagtggttctggatgatggttttacatattttgaaagcttaaactcacaactttaaataactaatatatcatatttgcatatcattagttgtaagtcatcaatttatatatatacagtgataccatcctattattatattggtacttgtttgtaagtaagagctaacaagtggtaaaagaaagatttaagtggagattgtaatatatatgttcaatgtatatgccatgtgatcaaacttatccaatttatatacaaagataaaaatcattatacaaaaccaccttagagagtaatatgaatggttttgcaaagttccgagagttggatgtccggttttacagtttagggtgctagacagacttctatctaaaatttaggagggtatttgaactttttccttgttttttttttgggtaaagaacatgttagatgatcagggaaaatatgaagtataaactccatacttgtatatctgaaaactatcgtaagataatagaaatggatgtatgagatttgtccatgtcaccacctaagtagtcgtctattttatatctgaaaacactgtaagcttcattgcctcactggacagcaataggcaaaagaatatgtacaagttatcagcatagtactgcttgattgacaagtgattagcagccataagcatctcaaagttaatatactcggaacaaaaactcaaggtagaaaatgggacaacagcattttatttttgacaactgaacatcaaaacaatgcagcatattgaaactgttacacacaggttaagtatgttcttaggggacagaggaagctgtatgcctactacatatcatattaccattttcacaccaaacaaatcgaataaatttgaggtttttctttcatgaacagacaaaccatcaaccaacttaaccggctcaaaagaaggagcgatgaacccaaaccatctgagagtaagtcgtactatgcatcgattgaatctgaggcagcacttcactggctaattgaggacactgtttccctgctggatcactgaatctcaagcccaagaacagcatcctagctgcaccttccactggtgtttgacaccttttcagctcaggatccacaatccc

SEQ ID NO: 54888 - DNA, 1644 bp, Oryza sativa
gaatgccctgtaactagctgaagtagtatgatacccagagctgatacatctgtctgaatctgaatcttgcagtcatcaatgtccatgaaagtccgaaagattccctgaataactttttcaccgggcattccctgaataacttcctcaatggcggatggtacatgttttgttggatgtaacagagtggaaattccaaagtttctgagcttgcatatattatctgcagtgaagtggacgtttcttggtttaaggtcaccgtgaatgattggcttgtgattatttctgtggaggtaatcgagagctgagcatatgctggctgctgttgtaaccctgtctctccaagtaaaagatttctttcctctaaacgtaaaagatttcttgatgtcagtgaggcgatcttccagtgtgtcaggtaaaagctcgtagacaagtgcacgccttggtgagcatgctcctacaaggtttgccaggttcttgtgctggatgcttctgaagatttcaagctgcattttcagagatatagtcagaaaaacagaagaatatataatatctataacttgcatgaagatatacagctattgcatattgaaatgttatacatgcaatgtcaaattattgctgtcattattttcaacaattttcaatgggaaacttcagtcacattgggttattgtctttgtttccttccaatcttaaatatgtaatgatgcgtaagctttttacgcctttcctgaaaaatattgggttattgatgatgcatttcatccattactagatgcacctgagcaaaaatgcagggcagaatgcatactatatttttttttgcggggaaaaaagtgtattactcattcaaaacgtcctcacagactagctgtgaaatgaaattacaacttccttccggccaaagcccagaaattgaatcggccctagccctattagctaaaaggtggctaacaccgttttggctacgatggatcttggtaaccaacacttccctacgctctgacaacaggcgtttaatctcctggactaaattagctaattcagacagatccctattcccttccttcagaagattgactagcgaaacacaatctgtttcaatcaagatagggcgcatagtccactgcagggccaaaatcaatccctccatgcaagctcggatttctgcctccagggcattcttgcagctatccagggacttacatgctgcaaaaactgtactaccactgttgtcccgtagaatcataccgatacctcccttcccacgatcagcatcaaatgagccatctacattaagtttcatccagcccagcctcggcttctcccagtgcaaacgggtcgatgcagtaggaggaccatctggtcctcttcttctaagtgcacttataacagatctgctaacaacagttttacctttttccagatcagcgtgggggtattccctgatttggaatagagtagcaatataactttccaggaatcttttggagacttccagcggaggaggcggcttattatgtgtgatttcattacgcacataccagtttcgccagagagttaataaaaacatctcatgttcttcggttggtagatattccaaacaatcaaacagccagtaattgccgaattggaaattcacca

SEQ ID NO: 54889 - DNA, 2849 bp, Oryza sativa
  unsure (1)..(2849): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagaggctggagtccacaacctagaacttgaggtgtgtaattcagtcgcaaaaaatttcaaacaaaatgttgttcgtaaaaaatttcaaacttgaggttgctaagtatacttctgaggggaacatggtaaagaatcttaggttggctctcacgaggttggatgaaactgctgctggtgttggtacattccttcatctaacaagccgttttggtagtgctctcttgccagatcatgctgaaaagattaatcaagagactagctccactttggtggccactgagatctttggccgtgacacagagaagaacgaggttatgaggtggttggttgacaatatagagggagattcgaacactcctggaatcaaccgagtccctgtttctgcaataattggaatggggggtataggaaagactactcttgctcagattgtgtgcgaagaatttaagagatttaacatactttgattgtattgtgtgggtatatgtgtctgataattctttcaatgcagcaaggataacaaaaaacatcttggaggcacttacaaaacagaagcctaatgctaatactttggaagcattgcaacacattctcaaagagaatctcgaatcaaagaagtttttgctcatattggatgatgtttgggaagacagcaattggggtgaatggcaaaaattaatggctcctttccagaacagaccccataacggaagtagaatcctgttgacaactcgaatgacatctgtagcagatatggttacaagtgtgatgcgaagtaataatgattatatgaacctaaatggattagacgaatatcacaattttatgatgttcaagaagtatgccttttatggtatgaaaactgaagattatgaacatctcctgccacttgctgaaaacatagcaaagaagtttcaagggtgtcccttggtgacaaagattgcaagcgagcatctcaggagcaatgtaagtcatcatcattggaataatttatacaggcagttggaaaacttagaaggaaaaacgagtgccattatcacaccagttcttcagttgcgtcaaaaaaaaaaaaacaacagttcttcagtcgagctactaccatctacctgaacatttacagctttgctttagatactgcagtatatttccaaaaggttatgaatttaagaaggacgaaatagtgaaaatgtggatggattcaggattgatcctaattgatagtggaacagaaaggccagaagacatcggagaaagatacttggtgcaattggcaagaaaatcattctttacttttgcgacagtgggagatccttgtagcaaattctacgcagaatattatgtgatgcatgatttagtacatgaattggcatgcagtgtttctgttggtgaatgtctaagacttgaatctagtggctatatgcagcacaagtgtacagttagacatttatggattgcaaacttcaacaagttaacaaccgaggagattaaggcaatttccagctttgagaatttgcgttcacttatcattgaagactcctatcatgtcaacgatgtttggatagctgcattggaggaagttgtacagcttctaagaggattgcggttattgagcttaaaagggataaccaagttatgtttggcaaaagaagttgttaataagcaccttcgttatatctctttctctgggatgcaggatatagatggaatctctaaactctatcatttgcaagtgcttactgcagtgaaaagaataagtacagcaccgaaacaagtgaataatatcgaaaacctttctcatctgcggtatgtatcatatggcagtaacggttttggtgaattttttgttggcagattaacttcacttcaagaattgcacaattttgagattcaactgaaggaaggttacagaataagttcactgaggaatttaagcagtatttgcaagctacagatttgcaactttgagaatgttgggacccatgaagagattattgaggctaagctaagagataaatcatatcttagatcgttgtccttaaactggtctgagactactaatgtattgagccacattctcatcttgaaaatctggaaatatcagggtataatggtcttcgatttccaacttggctaagccatccatgcctgataaatatggtgtcactagagctgagaaaatgtagaagttgggcatacctcccagctcttggaaatttacagcggctcaagcatcttgaattgcacaaacttgcagaattgaaacggatcgaccaatcatcaggcaattccctgcccccaaatctgaaaactctagtggtggaaggttgcaaaaaattaggggaactgccacttctaccttcaagtttgacacggttagaagtaaatgatgttggattgaccacccttccaaggatatatgaccatcatgttaacaacatggattttgaaagcaaggaaaccaagctaatctcagttatcatcagcaactgctcaaatttaatttctctggaggaaagctttctactgcaggagcaccatatccgaagtcttcgtatcctaaggattgttgattgtgaaaagttgatccgagctcctttgttattttcagaaatggataatcttgcagaatttcatattggtaagtgttaccggttgagagtgagggaaaacgatgataatgtactactcccccgcacacttaaggaactctccatggtgcagtgtggtgacctccagcttccactgctgg

SEQ ID NO: 54890 - DNA, 1582 bp, Oryza sativa
cctgcagcccggcatcttctctggagtctttcattattagaagatgtaatccagagttgttggcacgctggaaaaggaaagatagttctgaatgggacaggatttcactcatccgccatatgagaataggtatgccttgcttttgcatctatccttgtcatcatctcctgcaatctaatggtcacttggtcagtcctagagatgttattcgtatgttactttgtttttccttctagcaaaattttaagtttgtttttcacatgttaaccaaaacgatcccctgttagaatctgatttgggctgtatctcctgccaagctgactgtaagttaatctacaggagatgcatactacaatttcgggaaaccagcggacaaattttatagctgtgattcttcagaagacaagacaagaaataggtatgtgagacacgtactacagtttcagggaaccagctgaccaactttatagccgtgattctacaaaagagaagataagaaataggtacttgttctacatctttcacaatagatcagaaattcgtcaattctgatactccattattattactaatctatttcactggcactctacagattagtgaagtccaagatgtaagcccctactgtgtgcaagacccagttagaagacagttttattagtgtgactggctgtgaataccttaactgtgccaatggattcttcagaactacagtcagttccacatattttatagaaatatctgcaaggattcgaggccagtgtcttgtttctcagtctcatgaatgtgaatcacatgtggaattaaaggatggaaatgcacacacaaaaaaatgcaatgacatgttcatccgttcatgccgttccttgtcggtaaacaagcttgattgttcagtagtagcctctcaaagtaaaatggccaaccagtattgaactgaaagtcatccaggaaaagctgatcgatctcttattttagagctctagttgatatgtgtgaacattgttaatttcgcttctttttcttcaatattagtgagtttcatctgatcgatgaattttatttttatcttaattttatgaggttgtctaatatcatattagacacatgtgagtgtttttctttttttgaagaattgttatgatgtggttttatatggaggttttggtattcactgtctgtttataaaataatccttgcttgaaacatcaccactcctctatgtttaggaaaattcactgtatatctctgaaactttgtcaaatactaccttatatgtccctgaattttgcgacattagagagcttaataagcacctcgctaacggctgcagaacgccgaggtctgtgacgagaagctccagatgctccggaggctcgtagtccctcgccggcgcctcgacgtccacgctcggtgtcaccggcgcaccgcccaagtccgccgttcgatcatctcgttgttgcttgacgtccttctgccccaatgtatgcaacctcgcaaactacacgcaaaaattcatgttcaaataaaaaaaaatcaagttgagttcaaaaattcaggttcaattcagatcagaattcatgtc

SEQ ID NO: 54891 - DNA, 1404 bp, Oryza sativa
ggagttctgggtggtggtgaccatggtgaccttgcggctcaagtttgccgtcggcgccatcgcgccactgtactactccttgaggccatgaacaacgccggccgagctatcctgctgttgaactactccttggtgcactacaccctgggactcatgcagctctcatcgtccgacgaaaaaccagatgacttcttccaggtatgggctgtcctcttggtcactctgcagtacagcgtgaggatcggcatcccgtacaggaagagcaaggacatgtccctcatcgacctgctcatgtccctgtgggcagccaacctcatcagatcccagaccgtgctgagcctgaagatccctctctggttcatctggtccgtcaacgcgctgcggatcatcgccttcttcatctcctccaatagcgcatttgatatccacaccaacaacatgaggctcgtaagcaactacatgagatacgagcatgaacttggcaaccccgaggatgtggatccagccaccatggcagggtacaggtatttggtcctaggagaaggcaagcaggagatgaaggtcgagcctccagtattcaagctcgagctggacgtgacgaaccctgatgagatggtcaccgttgagagggtatggagtcttcgcggcagccggtttctcggtggtggaggagtggatcaagacaaccggctcaaggacgtttgtctctcgtttgcgctgtacaagcttctccggcgtaggttcggcaacctgcccatacacgaggcccggcaacccaagacgaagagactcgtcttcgattacatcctgcaaagaggtagcaaaaactacgagagggcgttccgcgtcaccgaggtggagctgcggtttctcagagacttccactatagcaaacacgcaatcatgttcgccaaggggttcccgggttggaggatgctcctggcaggatctctggttagtgcagtcatgtatcttggatttgttgttcatcgcttatccaagagcccggacacggacagcaagttgttcgtgacttactgtatcatcgtccttgtcgtcatcaaagaggtctgggagattgcaatttacgttctttcgcagtggaccaaagtactggtgctgtgcaagtacgtcaaggactcaaggttgcgtcatccgctgtttgagtgtgcattggggtttttctgcagactaatcaccaatgccaaatggaatcagcgaatcggccagtacaacatcttggtggatgttcttcaagaaagaagcgtcctgttcgcatatcgtcatctcaaagggagatttctccctgtgaagataaagctgcagggagaggttaagagcgccttgttcgagtcattcagtgcactgcgaaacgcgaatgacaatgatctggaatcctacttt

SEQ ID NO: 54892 - DNA, 3134 bp, Oryza sativa
accttgtccaatcactgcgcatacttggtcactcagtcactggtgccggacaatggcctcgtcatgaacaaggtctacgaggttgtgcagaaagaggccagcagtgccatttctggttgcaaatccatggcagacatctacagaaacctgacaaggatggcaagaactccggacgggagtgaaggcaggtcgatagtcaagatgggcgcgcagctggcggagcaactgaggctggcgtacggcgacgacgagcaggtcgcgctgtggagagacctgagcaggttttggagggggttcctgcttcaccttgccgcgtccaccaaggcggccaagcacgacgtgcatctccgtgggccaggtgaactcacgacgcacctgtgggctttgctgtcccacgcaggattccttggaagcggtagccacggcgagcaaatgctagacccagctgacctcaacgatgtcctgtacattccagctatatgaaagcccaagattctgtatttatgtaacacaactaccctctggtaaccggagtacgtattatatatttaggaggtatcaggattgttcatgtatgtagtgataaagattggaaaaaaatcgtattcatattttgttcctggggttatccccattttcttagatggtattgctcaagcaacatcactttgaatgctaaaagtaaatgtatgctagctcagcaatttcggaaattacaatttcccaccatttacattatacccaagctaggcagcaacacctcaccataatacagaaatacactaaaaaatgatttcatccctcgaggggatataccatcggttcattcatattacctaaatagttattaaaaaaattttaaaaagaaaatacaagatatattaatatgaaatatatcactccacaaacatgtaaaggcaaattcaacttctacaagttgtaacaaaaataacaaatatatctgctaaagtatgataactatttttagtttaattaattttttttgttgtaacttgtagaaattgaatttgaccctgcatgtttgtgtagtgatatgtttcatattaatttatcttgttattttttaattttttaatatttttaatgacatacaagcaacaagaggacatatccacgagggatgaaaatctacatccgaaatacgcaagggaagcgagaacttagctagcataatggatttgtttggtcatctacatgggagggtggctcacatgtgcgggtgcaggaggtggtcgtttggttacctgcacagctgtcgggcccgactccatgcgtgtaaaacagcctcctgagccaaacgcgagggaaacaccagtgttgagcttcgctcctcatccaggtcacgctcatgcggaaggtgggactgttaacgaccttgaacgagaacacagggagaggaactggaagaatcgaacaaggaagaacacacagaagaacacgaggaacttaggcaatctccactatggtattactactccaatccaacaggattgagctgccgccgccattcgccaccggattgccaaaattcaccattcaattcggatacagagttcttatactctctctctctctctcagttcttacccctctctcaagatagctgccagctcacgccagcttacaagttcacacggcccattctggcccaacaaaacgacgattgggcttaacgagtcttgaaggcttcaagttctttcctgctccctcctgttcatcaaccggcacggtcttttgcttctgttctgcaccggtctctctgatggatgtcgccttcttgacagcctccttgtcagtgaccttgacagggacacatgagtgcaggtgcatatataggtgtcgaaatataatatccggtactgtggtttagggatatgaattaaattaggccactagttaaggtagtgaacctaatccaccctacaaatcttcacgtgtgcttgaaatgggcctgagttgggttggatatggaaaacccgcctttccaccaaaaaatatgggcctggattggctgccaacgtgggtcctatacttccttcatcgccggaggcgccgccgtgccggtgaccggcgggcggcggcgatgggggcgaggcggagggggaggagggatcccgctccagttccggccatcactctcgccgtacgtgcccttgctccggccagaggggctcccctcgcagaggcttcttctccgggggccaccttccgtcgggggcagccctagctcgatccgcggacggagcagaggcagcgcggcgcggcgcggcgcagctcggccgcatcacggatgaccgccgcggctgccattccggggcggcgaatcagtcaggtgcgtctcctgatctggctaaatccttccccctaatggatgctctcttgatgggacgaaaaagatgcaggctaggctagtatatgattcttagttagtttgatttgcggttatgcgacgaacagtaggatggatgtagttgggtttgtagtttgtagttgccccctactagaaattgcttgcaaaatccacggaacacaggtgaggaattttagtacagcttaagttgcaactcatcaactgtaacaccctgaaaattcgaccaacgaaatcaaaacaccaaaaatatggattttcaaaaactttttaagtaataaattgcatcatgccgattttattcatctatttcattggattttgatctcggaatttattaatcgcgaataatgaataactaactaggaataaaccctaaaaatcaagttggctaaataaataattaaaatataaattaaaataaagattaggtgggattggaaataaataaaatattatcgcgaccatattagcaataattaaattttagtacgatggaatgagaattaaccctaattaaaaattcaaataaattatataaacaaaatatgagtgatattaaattagggtgaatttttagttaggataacacaaatatggagtaaactttatttatgcaaaaattagaatttatagggctatatttaaatagaaaatgggctaaaatcgggataaataggaaaaagttactgttcattgcggcatagatgttcgatcgtggtccccctggccccgtcccctttca

SEQ ID NO: 54893 - DNA, 2573 bp, Oryza sativa
gcgtcgccattacgccgcagcccctccccctctccttctcccctctctacaaataccccccttttctccattttcccccaccccatctcacccttcctcccctcttccctttccactgcgccaccgctctcgtgccgccgcgccgctctgccgccgtcgtcgccgctcccgcgccaccgtgcgccaccgtcgctgccgccgtcgtcgccgctgccgccgccggtgagccgccctccttccccctcgcgtccaccgccgccgccgctcgggtgggagagagccgagagagagagggagaggaaaagagaggccgccagagagaaaaagagagaaagagagaaaagaaagaaaaagagagagagagaaaagaaagaaaagaaagaaaaagagagaagaaagaaaaagaaagaaaaagagaagagagaatggagaaaaagaaaaggataaataaatagaaaattaggaagaaattaaggaggttaatagtttaagaaaaatctaaaataattagaatttaattatagattaattatggtcatagaattgcaaaatttaatataaattatagattattcttggtaatttctaaaagaaatcaattcgcggtagtagtttagatgtaattaacgactaaacaattagatgaatttttatagactattacagattagttttggataatctctataagtaatcgattcacggtagaagttcggatttaatcactaggaattttagacgtatattatatttaatcggttagtcataggctaaattaaatcatataatattataagataatttttggattccgtccgatatttagctcgcgatagaaaatttctaacctattatatggatataatgctcgggtagattaaattaaaagcttatgctaacaaaatatttatacccgcaaaatagtttaggatgtataaatcgaaattggatttgccctagttcgcgaatagtaaagttaatataaaagaatcaactttcgcattcgacttccatttggatttattggatctttatttgaattttaaccgaattcaaatcgtttcttcgcacgtaattttagagcccgagggagttacggatccaagcaaggaccaagaaccgcaagactttgagcaaggcaagtcatcactattccttgaacatgttgatcccaattgcgaaattgttttgtttacaaataaaattgcatgcaatgatgaacatcctacttgtgattatgccatgccttgattattgtttgtcttttattccttcgtaaccatgtttacgtatgagtccctagtcaattatgacaattgcttagaaatgttattctaaaatcatgcatactcatatttatcaaatgctatatgcttgggcaattacctttgggaaggtaattgagatgcggcatgtggagacatgagcaccacattgccatgatgttgatgacatgatttgtgaaaggagaaataaaattaaacaattgttttcgactggggcggatagaggatttgggtggtatctggaaaaggctagtaccgtccccggtcaattaaggaccgagccatgaagttaagcatgaaacgacccccgtacaaccgtacttctcgtatgggtatagacctagcggattagatagtcgagcggaggcagtatccctgcatagatggttcacccctgagtgaagcaggtgcgctacggtgggacagccgttgaggtagggccgagaggcgtgccctacatcggtgtcgccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgtgtctcatgtgttgggacgaggctcatgtgttgggcagtcgcggagtacgggtaaagtgtacatccactgcagtgtgagtaaactaaatatattcgaatagctgtgctcgcggttattgagcaccgggacatgtattacacttggctagactctaaattctttaacttgtgtgggatgggatattacatgatgatttttatgctgatggagccacttcctgagaggcgggaatgtggacgtcctcagaaaaccatgacgactcaatggcgggaagctatccttgggatcacaatggatggtggacagaaccgtcgttgtttaatgaaaacactggtactaaaatttgatcagtctgtgctaagtcttaggcttgtgacaagaattacaaaacttgctttgcgcaaaagaaccttagccatcctttgaatacccttgtcatgtgcattgttgctgtggtggcttgctgagtacggttggtactcacccttgcaatatacaaacttaatcagaggtcggagatgaagcttcggagaatccctacgcttactaccaggagggtgatgaagacgatggcgcccagtaggtcttagttacggtcgttgcctgtggcaatggag

SEQ ID NO: 54894 - DNA, 704 bp, Oryza sativa
tcggctctgtctccgagcatggtcggcacatgttgcacatccagcacgcagcccccatcatagatgttgtggccgtggaggtcaaactgagccctccccacgtcgcaggtcgcccgaaaccaaatgattgcctccacacgccatgcatcaaccataagcatctgcaccgccactactccataggggttgaagacttggtgcatcacgtcggtagaaacagggtagatgaggtggctcacttggacatggagtgtagcacttgcaccacatcccagccggctcggtttcatcgaacacttggtaggtgcctccatcactgacgcctccatgacccaaatcccactcccagatgttgccactaccatcacgcatcgcccacctcgtctccttgctcggaataccatggatcggtggttctgatcccatattgtcacgaaccaagcaccacccaaccaattctcaacgcacagaggcctcaatagattgcaaccactccaaatacaagtgttttgggatacaaattgaggggaatgagaggtatagactaggaagcgaaatcagacaaagaggaagcaggagattgggactagagaaaagtaatttagaggggaggcggcagcaaggaggaagaagccattttcatccaattatgttcgatccttctccaactacagttgcctcttatatcagcttcccttccagcc

SEQ ID NO: 54895 - DNA, 12315 bp, Oryza sativa
  unsure (1)..(12315): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtacacgagtacagaagtattccgatgaggatcaagaggagcagcgatacgatgatgtgaatctactcgaggaacatcgcgattgagttgccgttcgagcagccagctaccaacatgcccttcgccgttaccacgagaagcgcatccgagcacgcacactttcgatcggcgactacgtcctccgacgggttcaaagccaagcagggcgaaacaagctctcacccaaatgggaaggaccgtacacgatcacacaagttctgcggccaggcgcattcaaaattgcagacggcgatggtcgcgagttggcaaattcttggaacattgatcaattacgtaaattctatgtataagtcaatagtatccatacttgtaaggcatcttacagcttcaataattcctattttcaggtcaagaccacaatcaaagtgttccttcccgatgatcccttacccagatgacacctagcgttgaaacctatcctcatgtccctttacgccgtcttgacaaggcctccgaggaacctaagggaacttcggctggggaagcccagagccgataaggccttgtcggatcctgtagagatgaaagaccatgtaagatctggtcgtgtaagagttcttgccgtgcgtattaaccaagccttgtaatcggaaataaactttgcaacttcatggctggaggctaggaacagtgcttgttcaaccaaggcaggtcaaaggtccaagagccttatcttccgagaagaattccccgatgacaaggctaggggctagggagggtgtataactcaaacgactgatcaaagttgcgaagtgacaagacactcatacacactacatccagagtaagaaagcttagttagatagatttcttttctattccacaagtatttcttacaattccatcaaaatccaaaactatattacactttttccctaagacatttgtcacaggacacaaagactaccaggaaggccaacgccagtccatcgactggaaaaccttctccgccagcggcgctatcaacttcgcttggccatctatctctgtaggagttctccgagaatgagaaacccttcgcggaggaactcgaggtgcagctgcggacgatgatctcgtatgcaggccaacacgtgccccccggcatattggcttgagcgacgacactcctgcttcaaggcctcgtcgaaacaatgaccgatgccttcgagctaggggcaggccccgttcagccacaagatgtatccggccgccgattcctcgggatccccacggggtactcggagctctctacagactctcgacatggatgtgcagcaactcttcagatacgagttgaaccacacctcacgacccgggagtgtctctacggcctggtcctttctcacttccagcatagtcctttcgagttccgcgacctcaaacttcgtcctccaatactggatgcgacgatcctggtcagcaagcgcactctcgagatctgctcagcatggaaacgactaagtcaagctgctcttctctccagagaacacaacaaatcaagtcgatccagatggaagggcaaaggaaatgatgacaaagacaatcaacctaagggagtcgtcgccatgctcgtttccacaggcgaacttcgatctacatcgccctccagcacatgtggctcggacgcaagtaacggaatgatcactggcaactcaggctgcccgcgctgctggacatcctcgacatcaacatctctacaaataacaacaaagtactcgagatcaaaatgctaaagaaatctaaggcaatgaccgcacacactaaggcggttgggaccaataaaagttttacaaagcatgactaaagagtacaagagagctaagaccctactcttcaaaaagcgggaggacggactcccccagatcgccgacctcctccatcacatccttccgcgcgtcgctagccgccccctgatccaggatcttccgcagatcgagtttagggagcgccagcctcacacacgcaaggacgtggcacgccccggtgtagatcccgttagacgtctcctctccgatcctggccgcatgctttgaggggatctcctccatcgccgtcactagcttcgcaagagaagacgtcagcgagaactaatcgggattcaccgggatggtggacttgatatcgcactccccggtgagctggtgcagaccagtattggtcacccgaaacgagccacggatttccgacaagttgttctcgagctccgacatgcggtgctcgaacccctgccattgtcgctcgttgccggccactagttccctcatcttctggaggtcctcgcgaacctccgccagatcgcgcgccagccgatcggtgcgctcgttcgccgacgacgcagccgctgccctcgcctccgcaatctcgtggctaacaccgcgagcaccagcctcgaggaggcaccccatctcgacctggagctcctcccatgtgaggacggcagtcgacggaccccgaccagccgagggatcgccggctgggccgctcggcgtcacctcgcggctcctgggtacgaccacgacatctgtcgaggccacggcaggagacgcgctggaagtccctccggacattcacttacttctcgccgagacgcactgcaattgagacagactgcaagagtttgacgaagtcacgaaacttcaaagtcattcacttacttctcgtcgagcgtcacaagccgctgccgtcgcggaggcgggggagacgcatccgaggcctagagtacaacgtatatgaggtgaggtggaagttttccgactacgcgaccaaagggcaggagaacttactgagggggtgggcggattccgacgatgtccgatcacagaggagaatgtcctccccttatatcgatatatacttaaatcaagtgattgggatagatcggtcatcatgccgagacaatataaatcacttagatcgaaatatatatcaataacaagactatatatgtttatagcgtagccgatcggataaatctagcatgtatcggctaatactccgatactactctatattaggatattaaagcaagaataatatatcgaacaagagcctactaaacttagacacagcaatatcttgatataaagggtagatttaacatatcaatgaagcatatagaacaaataaagttaaatcagatacgatcagctgaaactccgatgctattctaatcggcaactagaaggcaggctagagatcgatattctaagcatgacttaataggtcaaactcaactgatacagcattaagtatgaaaagaagaacgatatctagacaatcaagccgctagaagtttcatagaatggtagatatctcatataatctagatcaacatcaagatctaacctaatcggcagctttctgtatgcagatgttaaccgataatagattaggtggtgatattgctagagattatgtaagatatatgataacttgacgaactacataaacatgattagagtatcataaagatggaaacactaatcctgagaacgcaagtcgtcataacatgttttacctcttgttgaagatcgaaactgatgcagctcaacccgaaagcaagaactcgtcgaaacaaaactaaaacaaaaggatggcgatgcgccgagattgtattgaacgtgtgtgttgttaattacatagggctcgaggtctatttatacccgagaattacaagatatacccataccagacacgactattatctctaacaaactctaagataccataagtctttgcggcagacttttgcccacatttatctataaggaatttacataagatatcctaattaatagatacaattgccttcctaggactctatccgtgcatggcaatcatcttgaagaacattaacttgaacccgatgtcgcgtacaagtcatattgtcgggatcggctacatcggcttacctagcccgactcagacccagccgatcttatcgtagccgatctggactccagccgattcctgctctgttttcaaactcgatctccgcttccgactttgcttcgatctagtcttctctcccaacgctgatgttaccaaatttggttgttaacaaagtcataatacgatctcggaagaaaaacgcaaaaggaccgctgagtacactcacattgatggcagcgtcgcgctcggccgcccctttctcggaaaggggcacggggacgttgctcgccgtagtgggaccactgatcatcagttggccgacacggcgcttcacggttgcactatccaaacctgtagatcgtgactaggatccgataagtcgggaagaacacgcgcataagggagtcaatttaattaacaagaaaaataccccgaggagaaacctaggtcgcgtcctccagcccagaataattaaaggctggatgggctcgagcctggagcggctggatccgcctaccaatgaagtcggcagcgacttcacaccccgacaacccccgtactcggaggtcatcaatgatatctatgaaagattggagggatggtatcaaggcgggtttcgtagtctaagacgggatcttgtctagttgctcctcgggaacaataaagaccggatccgaatcttctatttgaagatagaaccacctcccccaccatttgctgtgagaagaagggcaccggaaagggatatagcgcgactttaggccatcccggagtcggaaaccgacgcatccagataccctgttggattccatccagcgcaactcatagtaaaagcggaagaggtcaagaaatggctctaccccaatgtaggcctcacaaagatgcgaaaacatactcaagaaggcgatggaattggggttcaagtggaggaaggaaagaccatagaaattcaagaccaagagaagaaattcagaaggtggaggaagaaaaccacagagaataaagtcctcgatcgcaaccatgcgacctaggactggctggggttcagtacctcctacttctctctccgcggtcctgcgaccgggaagggtgccatcttcctgcaacttcttgagcgacgcgctggtggaggtagacttgtcgagatccatttctgccggggatcaccggagaaaggaccgagatgagctaggtaaggttttttgtgggagcagaaaaaatgagggacgttcgaaggctggagagttttttcacaacaaacgggcttcaacttggattcccaaaactcccttaaataggcgcaccttcgacggtgcgaattcaaaggaaaggagagagatggccgccggaaatttctaggcccgttacgcgcagcagtttttcggacttcaatttaaattcactcatgaccgttgagcttcacccgacgttgtcgatcactccttgtgtctcggtcctcacaccgagaacaacgacaacttcaacatcataagtcgcgatcggtttcacgagttcatttaagcagaagtcgggggctactgtcagggttacgggtaaggtataccctctacccttcgatatacgtcacatatcgatatggtatgctcgcgcgtatatggacgttttcggcatacgttaaggaaattcatcatggagttcacagatggaaggagtcctactcggtcagaactgggtcgtcattgtgcgatataaaagggaccccctgggaggacctaaggcatcgaatcttagagccaacacatccaccacagcctacgaagtcggagcttatcggagccaggtcgccgggagatctagtcggatcaactcgactacgatcttgtcggtatcgtcgagttccactattccctttgtaatctatggtttccatcatataatcccatatcaactggattaggggtattacctaccaaggggcctgaaccagtataatccctgcttcctgtttgcttgatgtcgtactacgtagatcctcgtaccagcgtaccctaataccctctatatccggtctacgggtatccccgatcgacacagtggggctggtgtgggccaagtccaccaaaggtgggccccacgcgttagcggcacagggagccaccggtccaccgtggaccgggaccaaagggcggtccaccgctggtccacgggaaggacagcctagatcagccaagccgatcgggcggtagagggcgagccgctggggcatgggcgcggccgagaccggcccggccggccatggcacggtggcggcgcgcggccacctgcagacggcgcggggagctgcggcaggcacgggcggtggcggaggaagtggaatattaaaagaggaggaggcgacaagggagggcggccgatggtgaggagaggcggcggcgctgcgcgggcaaacggcgcgggcgaagcactgacgatgaccattaggtgaggaagggcggccgagcacctcctcgacctgtagaaccatgaggaggggttaggggaggatagggtggctcgaggcagcgtgaagcgccgatcggaggggattggaaaagggggagctcaccggtgcatgaggggaaacagattccagtggtggaggacgcgaaccgagcggcggccggggttctcattgtccttgcggaaccgatggaggcgacgacgcagtgcggggtcggccggagaggcgacgcggtgtagtgggcgacggtggcggagagagatggtgaatgtggcaacggcgtttcggcaatggattggggaagaggagaagtggacggggtgcagtggggcatggcggctgcatggctgggcaaggcaacgctcgccagcgggaggcggctgtaggcggtggtggctcgggttggtggtggggtggtggttccagtggcggaatggaggagcggaggggacgccggggtggagcgtggcgtggtgaagctagcggcgcaagtggcgggatgcggcggcgacgggagcggctgtgtcggccggttggagctcgacggcacgcggcggtgcacggctcggcgtggggagagcgcgggggcggcacagggatggattttatagctcgatgaagtgacggggagaccggggagtgatgaatttgaaagggaagtggtgtgtcggcaatgggtttaaatcggccccaaccggcgccgatttgcgagggagggggggaacgtgggcgcgggttggaggaggtggatggcggttgcgggcgagcggacggagtggggcggaggggcattgggcgcgcgggaaaccggcgacgtggagcggcaatggcggcagttggggcgtgggaggccaaaggtagggtaaggacctgacatgtgggccccgaccctccatgttagtgggaggagagaagagattgggctagggggcctcaagcagactttgggaggggggatggaagcagagtgggccgacggcccaggaatggggggagggggggatggagattgggccggtggcctgaaagggaggaagggggagtttatattttttttataattatttctcgagctccgaaaattcatggaaaaatctggagagtataatagggctcagagaatattacaaaatatttgcggccaatgatttttaaaggaaatttttaattctcccattatttcactttataaattttctttaacttttatttattttctagaaaatgcattattaaatgatttttaatcccgaacgaaaatcgggacattacagtctgcgccctagggcacccctaggacgtccctaatcatacttaatcactagccgtcattgtttagattccggttttgtttagattaatctgtcaagaacaatttcgccgctagatcggtttgtgtaaccccaaattcgagtgcttaatcattcatatgcaattatgtttcaatctatcttgatcttgcttgtgttcttcgattcgcatgcagggattagccttctcggcgaggtcaaccgggtttcgacacggttgataaccagaggagacgtggtgctgcgattgcggggctcagtagcgcgttcgttcagaagccggatctagttgtgtcgccactccgcccaaaacgactttttatcatcacctatcggaagatcgggacctaactccctcatcaagatttgttgggcacttatttcatccccaagaaatctttgtggcatttgttactcttggtggttgaggacacctagacagcttggagtcaacctcaagacaccgatttgtttgtggtgcggcgacggagtttgtgaaggtcggatctcaccttccttagtggaagtaggagtgtatttgtgcaacctcacaaggataaggttggaaaagactcggttcattgtgagctcctcaatgaagagtagaatcccctcaaggatttgaactttggtaacacatcaacttggaaaaatcctagtgatatcaacttggaaattttctataggaaagttgctttaaaaaatcatattaatccatttttgaagtttaaaatagttaatactcaattaattatgcgctaatggttcacctcgttttgcgtatcttcccaatcttctctatttccttctcctcaaacacagccttagtcactgtttgtgcaaacctattaactacttgtgccattgtctctttttgtttgccttactagcttgctaaaaactgagattttcggaatatcagaaaatatttcgaaatattcaaaaatattccaaaatattaaattattctgaaatatccaaaaagtttagcttccccatttacataatagttttaaatgcctattcacccccctcttggcgacattaaggtcctttcacccttaaaacttgtcaccgtccgagctccctcggtctcccctcatctcctcgcgtcttcctatctctccaccacaccggcgaactccagccaagcctccctgtcggccggagcagcgccaaaccacgccaccacctttcgtagcatcgcagcgacctcctcttccccggcttggcctccgttctgcccgaggcaagccagagcgccatgtacaccgacgtctagaacatcatcatcctccagcagcccctccccattgagccgggtgctgccagcccatgctgccgccgccgaccgccccacctcaccgtgctcatcctcgacatccccttccctaagcccgaagctattaacgaccaaatttggtaatatcagcatcgaaaaagaggattagatcgaagtggaatcaaaggcgaagatcgattcaggaacagaatgagaatcggctggagtccaaatcggatacgatcgggatcggctgaatccgagtcagactgggtgagccgatacagccgattccgacaatacgacttggtgtacgacatcaggttgagttcatatgcttcaagatgattgccacgcatggatagagtcctgagaaggcaattgtatctattaattaggatattttatgtaatttccttagagatatgtttgggcaaaagtctgccgtaaagacttacggtatcttagggtttgttagagataagagtcttgtccgatatggtggacatagtttgtatttttcgggtataaatagaccccgaaccccatgtaatcatttaacacacatgttcaatacaatctcggcgcattgccacccttttgctttagttttatttcgacgagttcttgttttcgggttgtgctgcatcggtttcgatcttcaacaagaggtaaaacttgtcatgacgacttgcgttctcgggattagtgcttccatctttatgatactctaatcttgtatatgtaattcgtcgagttatcatatatcttgcaaaatctccggcaatatcgctatttaatctattatcggctaacatctgtaggtagagggcagccgattaggttaaacatcgatgttgacttagattacgtaggatatccaccactctatgaaacatccagcagcttgattgtctagatattgttcttcttttcatacttaatgctgcatcagttgagtttgatctattaagtcgggcttagaatatcaatctatagcctgccttctggttgccgattagggtagtatcggggtttcagccgatcttatctgatttaactatatttgctctatatgcttcatagatatgttaaatctaccgtttatgttaagatcttgttgcatttaagtatattacacttttgtttgatatattctacttgttttaatatcttagtatagagtggtatcggagtattagccggtacatgctagatctatctgatctgctatgctatgaacatatataatcccactattaatatatatttcgatctaagtgatttatactgtctcggcatggcgaccgatctatcgcaatcacttgatttaagtatatatcaatataaggagtatatattgttaatatctacagccgatcgagtagatctagttctttcttatttatttatgactgccgatcgatacatatatgacatcggctcaaagataaatgatatgtcatcggcacttagccgatcggctatcgtttataggtttaaccgcaatttctttgtctttatttcttgttgattgcaggatcgaatcaactggcacgctagcatacctgaaggcgagttttggacctgcactagagttaagcagatctcccaggcctcgtgttttccgtcaacacgcttttggcacgcccggtggaaccgattagaagtcagaagttttctctcatggacgacaagccgccagcgtcgccgtcctcgtctagccccgattttgttaaagagaagattcagcagttgggcctatccgaggttaatgaaagcaacatcgtgaccatcactccagacaagctgacatccgatcaaacgaaggattttgaagcgatgatgcagcaagcacggaaccagttcttgagctcatttatgcaaacccgcaagggaacagtggtgcagaagtataaggtaaaggtagttgctgatgttcctgggattagttcttccaaggatggagaggtgaaataagctccagatggctcgggtcaaccgagtgacaaaggtgcttcagatggttctcaaggaaatcaaggtgacaactcccaaggagtacagggagttcaaggtgatggtactcagggggttcaaggtgaaggccctaatcaagacgacaatacagcacagttgccgttcaacaacttccaagatcaagttgactatgctgtacaccatgctttgatcaatcaatctggaatattaaccaatactttggcaaacatggtgaaatcaatggttgatggttcgatggctgggtatcaagctacaggaccggtcttcctaccggaaggagtgttcccaaattatcggccattaatcactcacaatcaaccagttgcctagtcaatccccctcaatgcaccatcggctcagccgatggcaccagtatcggctcccgcacttgctgcagcaccgtcagctccaggccagttagttaatccccggttgttggtgagagaacaaccacagcacagcggacagaacgtgaatcggctaatgcaagaccaggttgcatctatgttcttacctccttagcataccgttaatccaacccagcagcagccgattcaacaaacaccgccaaggcagcaggttgtacagccgattcagcaaacacccccaatccaacaggttgtccaaccagctcagcagacgccgtagagacgccaggttttgcaaccaattcaacagacgccattaaggcagcaggttgtctagccaattcagcagcaaggcttaatgaatgcatcggctgggtttgcgacacctggtggtcagcctgtgcagcatgctgcaaatcaagttgtcccggagcacttggttcatcacgtacaaccagatggcatggtgatacctcaagttattcctgagcatttggtgcgcaacattcagccggatcttcagaattaccaggggggcaatttgaattatcagtatcagccaccatcaccgcaag

SEQ ID NO: 54896 - DNA, 8530 bp, Oryza sativa
ttcaacctaatcggttcaaagttctagatttttcaaaattctcagggcaagatagcacatcaacttatgagcatattagccgatttttagctcagtgtggtaaagcatcggctgtggatgccttgagggcttggttattccggttgtctttgtctggatcggctttcacttggctttcttctttgccatatgggtcgattaacagttgggctgatttggataagcattttcacagctatttctatagtggggtacatgagatgaaattgtccgatttgatagcaattaagcaaagacatgatgagcctgtgtatgagtatattcagaggttcagagaaatgaggaataagtgctacaacttaagtttgactgatgcccagttagccgatttggctttttagggtatgattgctctaatcagggagaaattctcatatgaagactttgaaagcttgtcgcatcttacacagaaggtaaccttgcatgaacagaggtttgcagaggctaggaagaattctagaaaggttaatcatgtctgtccttatatatatgggtcggatgatgaggatgatgactctgagatagctgcagccgaatgggtaaggagcaaaaaggttattccatcccaatgggtgaagaactcagggaaagaggagaggtatgactttgatatcaccaaggctgacaaaagttttgacttgctactccgagagaagcaaattcaacttgctgccggtcacacaattccatcggctgaagaattgggcaagaaaaggtattgcaagtggcataattctaggtctcatactactaatgattgcaaggtcttcaggcagcagatccaagcggctattgaaggaagcaaaatcaagtttgatgattctatgcggccgatgaaggttgatggcaatccttttcctgtcaatatggtgcatacagctggccgaacagccgatgggggtcgtgcaagaggttttcaggtaaattcagctaagattatcaacaaatatcagaggaagtatgataaacagcaggagaagcattatgaagaatatgatgatggctttgatcctcattggggttgcgagttctttagattttgttggaatgaaggtttgagactatcatctattgaggactgtcctgggtgcagtgatattgcggagagctcaagccgatcgtatagtaggggcaatcggctaaggcatacaagggttccctgttcatcaaagattgggtccagtaaacaaagatcgtggccaggaggactatgaaaacaggaaaactcaatggtgtccttctggtatctttacaaagaatcagaatagaagggttaatcaagttcctgtagccgatgaagccacagccgatgaagcaagaagattggataaggggaaaagtgttgtaactgcttcggtcaacatggttttcacgttgcctgccgagtttgggatcaagcaagccgatgtcgatgaagttgaagaggaatcggctaaattaattttatcaccagaacatgcagttttcgagaagccagagggtacagagaatcggcatctcaagccattatatataaatggttatgtcaatgggaagccgatgtccaagatgatggtcgatggtggggctgcagtaaacttgatgccttacactacgttcaggaagctgggcagaaacgccgaagatctcatcaagacaaacatggtgctcaaggactttggcagcaatccatcagaaaccaaagaagttttgaatgtggagttgacagtcggcaacaaaaccatccctacaacgttctctgtcattgatgggaagggttcttacagcttgttgcttggaagggattggattcatgccaattgttgtattccttcaactatgcatcaatgcttgattcaatggcaaggcgacaagattaaaattgtgccagacgacaggtcagtcaatgttgccagtgccgatttagctctttgggagatgaatggtcttgattgtttatctggaaaagtttgggatggagattttctaaaagtgtccgattctgatatacatccaattgaagatggagagcccaagctattattttgaaggcgtcatggagggttcaaatgtctacaccgaggacacaatagatgatctcgatgaaaaaaaaaggacagggtttcgtgttggccgatgatttggaagaaattgatataggtccaagtgatcgaccaaggccgacatttattagtaagaatttatcctcggaattcagagccaagttgatagagctgttgaaagaattcagaattgcttcgcttgggagtattatgaaattcctagacttagccgatcgattgtcgaacatcggctacctatcaaaccaggggttaggccacaccaacaacctccgagaagatgcaaagctgatatgctccaacctgtcaaggctgagattaaacgcttatatgatgctggttttattcgtccttgccgatatgctgagtgggtttctagtatagttcctgttatcaaaaggaacggtaaggtcagggtgtgcattgattttcgaaatttgaataaagctaccccaaaggtcgaatatccaatgccagtagccgatcagctggttgatgctgcatcgggacacaagattttgagttttatggatggtaatgcaggatacattcagatctttatggccgaaaaagatatccataagacagcttttaggtctcctggtgcaatcggcttgtttgagtgggttgtgatgactttcggcttaaagagtgctggagctacatatcaaagagccatgaatatatatcatgatctaattggctggttggttgaggtctatattgatgatgtggttgttatgtctaaagagattgaagaccatatagccgatttgaggaaggtttttgagaggactatcacgtcccaaaacgaccctaaaatatatcctttaaattatgccaagaataattaaaatcagtgtgaaagcctccaaaaattaaaatgtgcaaagtaaaagtcaaataaggcttagaggatttttgtatatttcctaaaagcctgaaatgtgtaaataaattttagtggaattttcagagcacaaataataattattaagaaataaacaaagttgaaaaggttttataaaaagaaaaaccctaaaaccctccctccctctcttgggccggctcggcccacttccctccccctctctcctcttcccccgcggcccactcggcccctccccgtgcgcgcgccgctgacgggcgggcccgcccgccaccctctgacgggtggagcccacccgtcatctccttcctcccgccgctcccgccacctcgcccgcgcctagcgccgccgccgccgcgaatcccgccgcctcccgtcgtcccctcgtgaaatcaataggggggaattactccccgtgatcccctctccctttccccccattttcccctctctctctcacattcaaacggccggatttgctcccgcaaatctcgccggcgccattgatggcggctggacctcccggccggtttccttccttccccggccgccctctcccccttccaaccctatttaaaccctcttcgcgcctccctcgcccgtttccgccccttgccgcactgtctcctttccggcatcgagctcgcgccatcgccgtctctctcctccgtcgccgacgaccttcggccggctctctccgctcgccgggaccgtttcccgccccggcgtcgcctcctccggcttcgccgcaccgtcgccgtccccgtccaccccctcgtcgagttcaccgaccgccggagcgccgccgtccccgtcgacccgagccgcgccgccgccttcctccgctccggccgcctttttcgtcgtcgccgtcgacctagggtgagccgtggaccgccgcctcgtttcctcctttccctcccctctctcagccgccgctccgccgtgcctatggccgccgccggcgaccataggggcgcgggcgcgccgcctccggccggccgcgccgacgtggctgccttcgggcgcgctgagcggctgccgcgtggggcccggccgtcagccgcccgcgccctcgggtgcggctgacgcgtggggcccacggcgccggccggtgtgagcccgggagcgcccggtccaccgtggaccgtgaggctgccgcgtggcccccactcccgtggacccggttcgcgcgccctctcccctcggctgacgcaataaaccatttttaaattaaaatttaaatgaagaaattagtaaatattcacttaaagagcatataaacttcaaatggccataacttggccatttgaactcggaattggaccgttcatgtctctaatttttccttaagaagtcaagaacccattttggtgctttgttcctacttgttatatggagtttattagagtaaaagcctttttcctttccgttggtcgtgtagacgctgcagcttcggaagatccgctctacgtggaggttgaagccaacgtttgggaaagcgagcaaggcaagtcacatcatccttgaacatattgaatcccagtttataaaattattttgatttaaattattgcattatcgctttatttaaattcccgcgttatcactgttttatttagccatgcctatttaccattcttatgaccttattattattgttattgttattattaccttgttcaccctagaataaacaaaaccccaactagtgggtactctattcatggtaccactagtatgaatttaggtagatgcttcgctgtttaattaggcaacattaggtggttttacaactctagactttgggaatattcatgtcacctggacactatggaatggttggattattgtggaattggattcacacctccccctctattcaaaatcctcaaaaaggttttaagctgggctcggggtgcatggttttgatagtagtacctcggccatataaggaccggtcttcgggcctctgctgcaaagcactaccgtacttccacatgtctagtgggtaaggcttagtttgtggctcagtctggttataaacaaaagtacacggatggagatggacaaagtcaggggacgatggacatctctagggcaaatgaaggctacacgagctgtggcccggtagtcaagatgtcatggcacagggctggtgtcctgctgctaggggctcaatcctgcctacctgtcccggaggttccggccgtaggtggttcggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtggtttaattcttaaaacctgcttaacaactaaaatgtggaatggttggcctgggttggcttgggacgagctgggacccaaggtcgggttgccagttcggtccaaatcatcgtaggccttaggttaaggcaggttcgtgggggttcacggccttgattaataatattgcatagctctaggatcgtgtttacaaagtagctttgagcaactaagtgacttttaatgctgtttactgcaaaccctaaccccctatattataactcccttgtactcccttgcatttattctacactcgtgggtgtgtcttgttgagtacggtggttgtacccagtcttgctcaatttttcccaatcccagaagaggagttcctagatgatgaaggctttggtgtctagctcgtgcctgccgtcaagcgcctgtggtcgtcgccctagtcttccgctgtttttcgtttgtcttcctgtgtgctgggccttcgccgcccatgtaataaattatctatttacgcttccgcttgttaaactctgtattgtatcaacttttggtgtaccttgcctcctgggacaaggaataatacacgcacgtaaggaacgcccgttgggttatttccggtcgtgacaaggaccaggaaatatggcctgaagatggacccgacaatatgtgcttttggcgtatcggctggccagtttttggggtttcttgttcatgagagggggattgagataactcagaggagtgttaatgcaatcaagaatattcagcctccggagaacaagacagaactgcaagagatgatcggcaagatcaattttgttagaaggtttatttctaatttgtccggaaggttagagccttttacaccattgttgtgattgaaagctgatcaacagtttacatggggggcagagcaacagaaagctttggataacattaaggaatatcttagttctcctccagttttgattcctccacagaaggggataccttttcggttatatctgtcggccggtgacaagtcaatcggctcggttttgattcaggagcttgaagggaaagagagagttgtgttttatctaagtcgtctgctcttggattcataaactagatattcccctgtggagaagttatgcttgtgcttatatttttcatgtacaaggttaaggcattatctattgtccaatgaatgcactgtcatatgcaaggccaatgttgtcaagtacatgttattagctccaattttgaaaggaagggttggaaagtggatatttttcttaactgagtttgatcttcggtatgagtcaccgaaggcgattaaaggacaagctatagccaattttattgtagaacatcgtgatgatttagtcggctcggtcgagattatgccatggactttattttttgatggatcggtgtgtactcatggttgtggtattgggttagttataatttcccctaggggggcatgttttgagttttcttatactatcaaaccttatgcaaccaataatcaagctgagtatgaggcagtgctcaaagggttgcagttactcaaggaggttgaagctgatactattgaaatcatgggagattctttgctagtaatcagtcaattggcaagggaatatgagtgcaagaatgatacattaatggtttataataagaagtgccaagaactaatgaaggaatttcagctggttactttaaagcatgtatctcgagagcaaaatattgaagctaatgatttagcccaaggggcatcggggtataagccgatgatcaaagatattaaggtcgaaattgcagcaataacagccgatgattggagatatgatgtgcatcagtatttacaaaatccatctcaatcggcttctcggaaattaagatataaagcgttgaagtatactttattggatgatgaacttaggtgtgttgcttaggtgtttgagtgccaatcaggctaaagttgcaatcggtgatgttcatgaagggatttgtggtactcatcaattgactcataaaatgaagtggttgcttcggcgtgcagggtatttttggccgacaatgcttgaagattttttcaggtattacaaaggatgtcaagattgtcagaaatttggagcaattcagtgagcgccgacgtcggctatgaatcctatcgttaaaccaaggccattcaggggttggggaattgatatgatcggcatgattaatccaccatcgagtaaaggacataagcttatactggtggcgaccgattatttcaccaaatgggtagaggcgattcctttgaagaaggttgattctggggatgcgatacagtttgttcaagagcatataaaataccgatttggtattcctcgaactattataactgatcagggttcaattttcgtgtccgatggtttgttcaatttgccgaaagtatgggaatcaaactgttaaattcttcaccatattatgcacaagctaatgggcaagccaaggcatctaacaaaagcttgatcaagttgattaagaggaagatttctgattatcctcggcaatggcatgctcggttgcccgaagcattgtggtcttatcggatggcttatcatggatcaatccaggtccctccttataaacttgtttatggtcatgaggttgttctgccatgggaagtgaggatcggctccaggagaacgaagttgcaaaatgatttaacagccgatgagtattataaccttatggccgatgagagggaagacctggttcaatcacggttacgagcacttgcaaaggttaccagggataaggagagaattgctcgacgctataacaagaaagtggtgcccaaggatttttgggaaggcgaacttgtatggaagttgattttgccaattgagactcgggatagcaaattcggcaagtggtcgccgaattgggaaggaccgttccaaattcataaagtaatgtctaaaggggcttacatgttgcaaggactcgatggtgaagtgtatggaagagcattgaatggcaaatacttttagaaatattaccccaagtgtttcggttaatgcatgatcggctgatgttgccgataaatgatagccgatgtat

SEQ ID NO: 54897 - DNA, 19546 bp, Oryza sativa
  unsure (1)..(19546): unsure at all n locations
atgcttttaacattgtaaaattaagggggcacatatatgaaaaattgcaaatttttgagcgcaaaatatggagttatattgaatcagcataacagttattgagataagttacatgaagagttagagtttcttagccgattacaaaaagtttctaagacctattacataagatgtcactgagacaaatactgctggatagccgaaatagctctttgcctgatttgctctacttcttcaatggcttaagcatcttgagcatcggttctagagatgactttcagagacttggtcatatcagcgacattcttgatagctgatttcagccttgccttttcttcttcgacggaccacgggagatcggctagtttcttgtgttccaggtccaattcgggcgttgcattcttgaagttgtgccaagagatcgatcttgcgagcttctagccgactaatattacacttgatcgggcattccgatagctgatcaagtttggacttctcttcatgcacgagttgccgattagcctgaatagtaacttcaatttctttgcgttcacggcgttcggctagtctctgcttggctttctccaacttgaattgatgttattcaagataagcagctggagtaaggacatctgccagctcctcaggaaccaaagcttgaatttcgtgcagccgtgtcctaattgatccacagtcgaccaccaagctgtctaaagaggaagcttctagccgatgagagatatcttcaagcgttttctttacatcatcggataagggggctaaggctttgctcgaagtatcttcttctgcgtcatcaagataatctctaatatcaaaagagaagagatcagctaaaacctgcaaaaacaatttcaggaagattgagagctaagtagatacaaccggtctaaattcttgtatcaaaatagaatttactgggatgacaagagcagttggttgtatttcttcctcaatatggtgactccccacagccgatggagttcggtcacttgacgattgctatacaaaaggagaaggaggaggaggaggctgtaaaatagataagtgttatataaaatcggctgagatcaactagtaaaagaattaagaatatcttaccggtggagcctgtttgagaatcgttgctgctggtctctttttcacggcagctttcttcttctgcaactatagaatcagtgggtaatcggctataagtaaagaaatagaaagaattgaaagttgttgcttacccttgaaaaatgggctagagccgaaggagtcggaggagtttgctggggcgaagccgatgatgtttcttcagtatcgctcaccttagctgcagcctgatcaacatcctcgccaatttcttcttcgtccagagcttgttcgatggatggatccaaggcaggcaggtcatcagtcggcttagttttcttggatttggcctttttctttggagctggagctaatgcgtccacagccgatgacctagttcttcttttcttgcctacatcggctggttctctgattaggccttggaggagagttgaagtcctgggggcatgatagccgatgacagggggagatagtccacctccattgggaatcagacctggagcatattcaatgtccctgccactgttgctttgacgtggaggagaagagtcgattgtctgcagaacaggaacaatagattagtcaagtaatgaatcggctgacagtcatttaggttaatgacgacaaggtttacctggggtatgacatcagggaatagatttgtcatgtacatcgaggccgattggggaaatagatgcagcttccattcaccccaccatctgtcaaagtttctgctcttgaatcctgccaactcaatgttttcagtactgcccagagggggtccttggaggttaagcagctgatccatcatcaaagttgatgagatttctcctcggcactagatattatcggcaaagaataagccgatcgggagttggcccattacaagttgtctagctgagctcattgggtgatagaattcataagagacttggatgtttctcccttgatgaatgccgacaggtaggatgcatgggctgattacagttgagaagacttccctggtcttttggtatctttcatggttaatatcctcaaacctaaagtctgatgggagatcaaggtctgctgagtcctcatagggaaaccagactcgggcatctttctgaaagccctcataaaaactgcaaaaccaatccttgagcagttcagccgatagttttgctctagcatcggttggtgcggatgcgtattctccatatgacatgcatctacgatgagtacgttcctctccatcatcgtctacagtcggctccaaccttggaaattcagcttctgtcacggatggccgattgacaactttcatgaccatcagatttagccaggtctacagcagccaccatggtccacctgctccaactactgagccgacagctatcttggccgatgcattattcaacatttggtatagatagccgaggaggattttgcccaaaggaaattgtttctttgattctagggcttcggctacaaattgccaattggttgtaggatcagaactggatccacagaacaggaatttttctagccacattagcaagaaagctacatgctcccgaggggtgacaggcctttgacccatatatgctgctacatagccagaccaaccccatattcttttggtcctgaagtcaaattggtttttggtgttcatgctcatagggttagccgatgaagttacatctagtccggtgatcatggtgatgtcgatcaaagttggagtcatcggcccttggttgaacaggaaggaattgatggtgttggaccagaaataggtaacggcagccatcagaggctcatccttagctgagttggctgtggtaagggcaagcgcttggccgatcccgatctcatcccagtgaactttcttactagccgatacactgcttgtaccatgtggtccaattcttctcaggggtggttttctcgagagatggccaagacttaaaagtattcttccagtgacctagattagggttggctaatctaaaggggattctattagttttgccgatgatgaaatcagtggggtctaggttgccgatcggaccgagaaaataatgtccctcatgcgatagacttggaatcgcaatcagattggataggtgctacaaatgcgaacaaagatagagaagaagaaaacaagatgaggaagaggaaaatcgatttcatgcgaagaaaagggatctagccaatgagaacttacctcagcgtactcggccgacggtgtggtagatgggctggcggaggacgacatcaccatgggcggagatctagccagagatggaatcgtctggggtcgccttgagcgtcggggaaattgccggagagaaaggggacgaggttggcttcggcggtgaaaacggaagtaacggggtgaagatttttcagggcggtggttagtatttaaagcactgagggtaacggtcggaaaacagcagagtgcgaaacttgctcggagtcgatatacggcaaatccgaaacattaccaaatattccggacttgggggcatgtgttaacgaccaaatttggtaaaatcagcatcggaaaagaggattagatcgaagcggaatcaaaggcaaagatcgattcgggaacagagtgagaatcggctggagtccaaatcggctacgatcgggatgggccgaatccgagtcagactgggtgagccgatacagccgattccgacaatatgacttggtgtacgacatcaggttgagttgatatgcttcaagatgattgccacgcatggatagagtcctgagaaggcaattgtatctattaattaggatattttatgtaattttcttagagatatgtttgtgcaaaaatttgacgtaaagacttatggtatcttagggtttgttaatgaaaggaacttgatgtcgcctagagggggggtgaataggcgttcctaaaaattatcacaacttcatagcatattagagtgatgataacttttgattcaaatcgaaacgtccggtatgggattggaagttccggtctcaatcgaaaagttcggcggataacaagataaacactagctatgaacttgtagcttaaacaaacaaaatgtatatgaatcaaaaggtgacaaataaggtatctaagcaagatataagttcaccaacaaaatcaattaagcatgcaagtagatcgggtaaaaacaagcttaagcacaatatgagagaatgcaagaacgggcaaaccaagaggggagacgcgtgatttgtttcccgaagttcggatccacggatcctacgtcttcgttgaggagccacaagggccgggcctatttcaaccctttcctcacgaggttgcacaaatgcactcctcagtttcactcttgatttcttcccttgtggaggcgaaatctaagccttcacaaactttctttggcacaccacaaccttgggtgctcaccggcaacgcctagcagtctaggataccttagtccccaagagtaacaaacacaatcgaagatttgcttgctatgaactcgagtgctcaaagtatggagtgaagctcactagctctcaacttctcaatcactcaatccaactcttttcccttctcaaatccctcccacaaagaggcaccacaaaggatggagtgaagctcactagctctcaactcctcactctctcaatccaactctctccccttctcaaatccccctcacaaagaggcaccacaaaggtagggaaatggggatggctatttggctttggatgtgtctaatactccccaagagcagcagccactcaaaggaggggtggaggagtttatatacccgagcccctcaaaaactagccgttggaggtcaagactgtaattttcggagtttctgaaaagcattttcggacaagtccgaaaacttacagaagcaaatctcagattcgcagccattttcagaatgtccgaaaatttttcggattctgataatttttcggactttccgaaaagcacagagtaaaacgactataacttttcgctcaggagtccatttttgatgaacttggactctatggaaagctcactcagagaactacccaactcaaccaaaaacaaggtctaaaaccactcaaaggataggttaaagcttaggtttctctcaaggtagcactatgataggtcactttgagcaccgagacatacacaaacacctcaacgttgcatccctcttaatagtacggcattcctaaactcaaatgtaaataagtagagaactataccattaggaatgcctttttttcatctttctttcattgtcttgagggacgccaatgccgataccgtttcaccatatattcttcaaatgattgatgcggttacttgtagctttaaatggtctcgcacggtccatcatgacaaagccgtcactcgcccttcaccaccggatttggttcttcggcgccaagccccttgcttgccctttaccgccgcatggtccatcgcgaccgagcatcgcttgcccttcaccgtcttgccataatagccacttcgtatcacacatcttcaatatcttcactttgtcattcttggtattgttagatgtaatgatatcacttgagcatcaacacctttgtaatccttgggacctatttctttcattcaactcaataaaattattagtcccaatgatccggttgtcaacctacacatgttgaccaaccgatcacatgtataaaaggatatgaataaatgatgggtattaatcaacaccacaagtttcatatacgcaaatatatgttcaagtgtcaagatccaaattaaatgaaggtgaataatttggatcgattacatgcataactaaagtataggatttgctccccctaaatgtatgcatacaaaatatttgtgtgaagcaagagtatgcattacaagatattaaacattgagagcttatcctatataagaatagaaggcatttatcaaatatagacaataaaataaaaacataccttcatcatctccacgttctcaatgtaaaaagactaaataagagataatactcaaacaaaacattagtctcacatgcaaatgccaatcacgtggaaatattatatacgaacatatcaatatgtacatgaagagaaagagtgatacatatagcttgatcttcatgtatttcatccttgtgatttaggtccaccaacactccacttttatatccacatgagactaggcaaagaaatgcttataaaaacattcgtcacacattattggatttgttattaatcatcaaaaccaaatcaatggcacttgaactttcagttaaagataagagtcctgtccgatatggacatagtttgcatttttcgggtataaatagaccccgaaccccatgtaatcatttaacacacacgttcaatacaatctaggcgcatcgccacccttttgctttagttttatttcgacgagttcttgctttcgggttgagctgcatcggtttcgatcttcaacaagaggtaaaacttgtcatgacggcttgcgttctcaggattagtgtttccatctttatgatactctaatcttctttatgtaattcgtcgagttatcatatatcttgcataatctctggcaatatcgctatttaatctattatcggctaacatctgtcgtcggtagagggcagccgattaggttaaacatcgatgttgacttagattatgtaggatgtccaccactctatgaaacttccagcggcttaattgtctagatattgttcttcttttcatacttaaagttgcatcagttgagtttaatctattaagtcgtgcttagaatatcaatctctagcctgccttctggatgccgattagggtagtatcggggtttcagccgatcttatctgatttaactatatttgctctatatgcttcatagatatgttaaatctgccctttatgttaagatcttgttgcatttaagtatattagacttttgtttgatatattctacttgttttaatatcttagtatagagtagtatcggagtattagccggtacatgctagatccatctgatcggctatgctatgaacatatataattccactattaatatatatttcgatccaagtgatttatactgtctcggcatggcgaccgatctatcccaatcacttgatttaagtatatatcaatataaggagtatatattgttaatatctacagccgatcgagtatatctagttctttcttatttatttatgactgccgatcgatacatatatgacatcggctcaaagataaatgatatgtcatcagcacttagccgatcaatatcgtttataggtttaaccgcggtttctttgtctttatttcttgttgattgcaggatcaaatcaactggcatgctagcatacccgaaggcgagttttggacctgcactagagttaagcagatctcctaggccttgtgttttccgtcaacagaagcctactggaaactcgtccttgctggtgaacagcgaggacactgccattttcctcctctactagcccctccctccatcccctcgttgtcgacttgttagtctccgtcgccctcctccattcgtcgttgttgctgttggcggttattaaatgccgattctataccgccaacatctgcataaaatccagataataaaacatccaacatagtgataggtgtttaatctcacgtattccaaaagtgtttgtgtatatttgtatgcaggtattaaaccccgaagttgggaggaaatctagactaaagtgaggagaaacaagtatccatataaggatgggttgtgaacatcatcaaaataccagagaatcagcccaaaactccaagaaatggatagaggagaatcaggggagtccacaggccgaaggccaggccgggagggcccagcccaggttcggccgaaaccctctgatcaccattgatcctggggtttggcgtggacgctgcagatgctctcctgataacggttgtggggcagttcggacaattccccttctcacaaccgtcataactaccctataaatagatctcactccctcacttcacacacacacttccaagcttgagctgaattgtaagaggctctattgtactatattgtatactagaataggaagagagtagagtagaagaggtcagaagaattctggagttttcggtaatcttctctcatttcttttattctatttattactctgatttcaatataatattcttcctaagtaatttagatttatcctatgagaattatctcttggttagttcctaaatagcacacgagattattgttcactataatcaactaaaatatagtgattgctttggtgagttataaacactaaagtagatattaattgcttagacgtagtgtttaggtaattgttatccagtaattgctgcgtatcctacagtacgtttgaggtatgtgtagaggtggtgacagccctcgagatcactcaagtcctccctgtccgggtacgtagtagagcgacatctaggaacagcgggttgccagtgcctgaagtattgcgttaggattaaacttaagctttccctagacactatttctcactagtaaatcctctctatcctagcctatcttttgcttggtgatcttatcttatttagcaactttatatctcatatgcttgattgttatgctaagtctgctctttatactaagatctcgtttcattacggtatatttggcttcttgtttaatatattctgcttgtcttgatatcatagtatagagtggtatcagagtattagtcgatacatgctagatctatctgatcggctatgctataaacacccatataatcatcgctttaatgtatattttgacttaagtgatttatattgtcttagcatggcgaccgatctatcccaatcacttagtttagatatacatcgaagtgaagattgcatgatgttaatatctacagccgatcgagtagatttagtcttatattattcactcatgacagccgatcgattccaatgtgacatcagctcaaagataaatgatatgtcatcggcaactagccgatcggctatcatttatggatttaaccgcgattttcttgtttctttttcttgttgattgcaggatcaaatcaactggcacgctcatgaacctaaaggcaagattttggacctgtgcagaagttaagcatatcttccaggccagtgtgtgtttttcgcatcaatatgcttttggcacgcctggtgggaccgagttgcgacaacttcctctcatggcagaaaagcaatcaccatcaacaggcaagcctcccaaccctccaatcaagcctccggggactactcaaccgtcatctgaagttggagctgagaatatgatcccggtcaccatagacaagttatcaccggagcataagctggagcttgaacaaataatgaaaagcgctcaggagcaattcatgaattcattcaaggaaacccgccagggaatggtcattcagaaatacaagctaaaggtggttgctgccgatgaatctggaacaaactcatctcaagacggcagaaccaagggagctaaaggtggtgcaaatggttcaggtgacaaaggtttagagcccagggatggtgaggttgaggatattggtgaagaaaatgctgagggccaacaagagtctccgaggtgcaataatttccaagaccaaatcgactatgcggtgcaacatgctatgatcaaccaatcatgagtgcttgtcaatactttgacaaatatgatcaagtcagtggttgatggcacgatagctgagcatcaaaacacggggccagtcttcctaccatgtggcgtctttccaccgtacaggaacttgatgacgggcaaccagcagcctgccaccaatgcaccaccggttcagccaacgacagcagtttcaactccagcaccaggtgcaccttcgtcggcacagaggcatatggttaatcctcgtgtccagaccagagaacaaccgcaacatgctggacagaacatcaatcggctgacctaggagcaaattgcttcaatgttcttgccaacacagccaattgtcgagctagtgcagtagacaccaccaagacaacaggtagttcagccaattcagcaacagacggtgcaacagataccaactgggcagagaacacccgacaatcggcaaaggcagcaagttgtggctcaagttatccctgagcactttgtacataatattgttaacagtgaaatttggtaagcccggagtaatcatcggcttagagtcagcatcggcttcgaagtcctgagattagctgatgagagttatcaagtcgtcagttgtcggattcttgctatatttggttaaggaaattgatctactaaaggaagcttatccagaagagaccgagttcaaagagaatgcggcatggcaagttatctattaattaggaatagtttgttagtttccttttatctttaggaaagtgtgtttactgtcctataaggactttatcttttccttttatatttagtttctttcttgtccgacaaggattagtatctccctatgggtataaatatgtacacccgaggtcattgtaatctatcaatctctcgatcaatacaattactctcggcgcatcgccaccctctcttctgaggttttacttatcaaccaatggaatttagcaactgacgcggggctgcatcggttcagtttgatctccggcaaaggggtaagtcctacgttccgctggccctggtgaatctatcggctacgttggtgttgttcaagtctgcatcgcttcgatctcttggatcgctctgctttggttcatatatttgcctatctgatatctcaattctatctctaattgcattgtgtttagagacgcatcggtttagttgggactgtctcggttaggtccgatcttctatcttagccgatatatctctacaatcacaatgttgttctaaatagatttgttatatctatcacattagacagatctatcggctcatcgagtattagattatcatatacaatctcatgctgcatcggttaggttcgacctactatattgttgttgataatataagtcttgttaagccgataggttcatgctaatgttttatcggagtgctagccgataacttatctagatgttgcatcggcttataaggattgcatatacatataagttggatttagccaatgacaacaaaggtttaatttatctatctaatcttggcttataaggccgcagctcgtgtagccttcatttgccctagagatgtccatcgagccccgacttcgtccatctccatccgtgtacttttgcccaagaccagactgagccacaaactaagccttacccactagacatgtggaattacggtagtgctttgcaacagaggcccgaagaccggtccttatagtggccgaggtgctactatcaaaaccatgcacctcgagcccagcctaaaaccattttgagggttttgaatagagggcgagctgtgtgtccatttccacataatccaaccattccataatgtccaaatgatatgagcattcccaaagtctaaggttataaaaccacctaatgttgcctaattaatcagcgaagcagctagctaaattcatactagtggaaccatgaatagggtacccactagatggggttttgtttatcctagggtgaacaaggtaataataacaatagcagtaataataaggtcatcacaaaggtaaataggcatggctaaataaaacagtgataacgcgggaatttaaataaagcgataattgcagtaatttaaaccaaaataattttataaactgggattcaatatattcaaggatgatgtgacttgccttgctcgctttcccaaacgtcggctttgacctccacatagagcggatcttccgaagcagcagcgtttacacgaccaacggaaataaaaagggttttactctaataaactccatataacaagcagaaacaaagcacaaaaaataggttcttgacttcttaaggaaaaattagagacttgaacggtccaattccgagttcaaacggccaagatatggccttttgaagtttatatgctcttaatgtacatatttgcaaatttcttcatttaaattttaattaaaaatagggtttattgcgttacctgaggggaggggcgcgcgggctgggtccgcgggagtggtaggccccacgcggcagcccctcggtccatggtggaccgggtgcaccggagggctcaccagtcggcgccgtgggccccacgcgtcaaccgcacccgagggcacaggcggctaacggccgggccccacgcggtgaccacacggcacgcccggaggcggctacgtcggcgctgctggcgggaggcggcggcggtccataggcgtggcggagcggcggccgagagaggggaagggaagggggaaagaggcggcggtccacggctcaccccggggcgacgatggcgacggaggaggaggccggagtggagggaggcggtggtgcggctcgggtcgacggggtcagcggcgttctggcggtcggcgacggaaacagaggggtggacgaggtcggcgaggacgtggcgaagccggaggagacgacactgaggcgggggacggtcccggcgagcggctaggcccggccggaggtcgacggcgacggcggagagagaggacgatagcgcgggcacgaatccgacgaggaggagggacggcaaacggcggaaacggacgagggaggtgcggggagggtttatatagggttgggagtgagagagggcagccggcggggaaggaaaccggtgcgggggtcctggtcggcatcaatggagcaaatctggccgtttgaacgcgggagagagagggggaatggggggaaagggagagggaatcacggggaatatttccccccacttaattgcatgcgggaacggtcgggggcgacgggatttgcggtggcggcggcgctaagcgcgggcggagcggcgggagcggcgggaggagggggataacgggtgggccccacccatcagcaagggtggcgggcgggcccgcccgtcagcggcgcgcacgaggggagggagggcaggccgagtgggccgcggggagagtagagaggggggagagagttgggccgaattcggcccaggagagagaggagagggttttaggattttctttttataaaaccttttctactttgtttatttcttgataattattatttgtgctctgaaaattccactaaaatttatgtacccattttaggcttttaggaaatatacaaaaatcctccaagccttatttgacttttaactttgcacattttaatttttggaggctttcacaaggattttaattattctaggcataatttaaaggttatattttagggtcgttttgggacgtgacaaacctaccgcccttaaacggaatctcgaccctgagattcagaagaactgacgaagaggtcgggatgggctgcctttagctcgtcttcatgctcctaagtagcttcttccttggcgtggttgctccacaggaccttgcaaaaacggattacccgattccaagtcctgcactccatagtgtccagaatcttcacaggcttctccacgtaggtcaagtcttcgcgaacttcaatctgcactgaatcggcctgctcggacggcactcgaagacatttcttgagctgcaacacgtggaacacatcgtgcacattgcccaaggatgcgggcagctccaactggtaagcaacttctctgcgtcgagcaatgatgcggaaaggccccacatacctaggtgcgagcttcccctttgtctgaaacctatgcactccctgtagtggcgtgacctgaagatacacaaagtcgtgcactgcgaattccagatcgcggcgtcggttatctgcataacttttctgccgagactgtgccacctttaggttatcccgaatggttctgactttagcttcagcttctctcagaatatcggtcccgaacacttggctttccccaacttggtcccacaacagcggagtccggcatttgcgtccatacaacgcttcatagggtgccatttgtatgctggctcggtagctgttattgtaggagaactccgcataggggagactcttatcccaggtcttcccaaaatctagaacacaggcgcggagcatgtcttctaggacctgattcagacgctcggtctgtccatctgcctgcgggtgataagtggtgctgaaattcaatcgggtacccagctcttcttggagcttcttccagaagtgagaggtgaattggcttcccctatcagatacaattttcttaggaacgccatggagactcacgatcctagcgaagtaaagttcatctaatttgttccctccataggtggtcttcacaggaatgaaccgagccaccttggttagtcgatccacgactacccatatagaatcatatccgccttgagtttttggaagtccggtgatgaaatccatcccaatttcatcccatttccattctggtacctgtagaggttggagcagtccggccggtcgttggtgctctgctttgacatgctggcacacctcacaaagggccacgaactcggtgatttcccgcttcatactaacccaccaatatttctctttcatgtctaagtacatcttcgtactgccagggtggatggaataaggactttcatgagctccctgaagtatcaattgtttaaattccttgttgtccggaacgcatacacgatttccgttccataaggttccgtgttcatcttccatgaagccagcggctttaccctgcttcatattcttgaggatcccatgcatatccggataattcttctgagcctcgcgtatttgatcaagcaaggtgggctttgcttctagtgcagccaagaatccatggctaactacacttaggttcagagcttccaactgttgattaagttctggtggaatgccacggacgcaaagagtactgcaatggccctttcgactcagcgcgtcggcgaccacgttggccttactagggtgatagtggattcccacatcatagtctttgatgagctctaaccatcttcttagccgaagattcagatccggctgggtgaagatgtatttcaaactcttatgatcggtgtatatttcgcagtgatttccaatgagataacgccgccagattttcagagcatggaccacagcggtcaactccaaaatcatgggtaggatagttgccttcatggggtcgtagctggcgtgaagcataagctaccacatgaccttcttgcattaatacacaccccaatccttggcgcgaagcgtcacaatacaccaggaaatccttgcgagtatccggtaagattaacactagcgaggaaaccaacctttctttgagagtttgaaatgctctctcacactgcggactccacacaaatttttcttccttcttcagcaactgcgtcatgggcctggaaattttggagaaattcttgatgaatctccgatagtaccctgccaaacccaagaaactgcggacttgggtgaccgacttgggttgcttcaaatcggtgacggctgttactgtttcaggatccacggcaactcctttagcagatatcacatgccctaagaacttgacttcggacaaccagaattcacacttgctgagcttggcatacaactaatgttcccggagcttttacaacaccagacggagatgctgctgatggtcttcctctgactgtgagtagaccagtatgtcgtcaataaagaccacaacgaacttatccaggtattccatgaacaccttgttcattaaattcatgaagaaggcaggagcgttggtcagaccgaacgacatcaccgtgaattcatacagcccgtaccgcgtggtgaatgcggtcttagggatatcttcttcgcggatacgcaactggtgatatccggaacgaagatcaatcttggaaaagacagtggcacctttaagctgatcgaacagatcatcgatctggggaagagggtacttgtttttgatagtgacttcattgagagctcggtagtcaacgcacatcctctttgtcttgtctttcttttctacaaaagtcacgggagcaccccagggggaagtgctcggccgtatataccccttctctttcaactcttccaactgcttcttgactttggccaattcatttgctgccatacggtagggtcgcttgtacaggggagtggttcctggagcaagatctatcctgaactcaatctcccgcttgggcggcataccgaactcactgacaacgggtatttctgacagtcctagttgatgaagtactgagctgccggtgggagtcgggtgcgcaaagaaaacaactggttgatcaggcttctggtacacggtgacagtacgtcttgcacaatccactactccttggaattgggtcaaccaattcatcttgaggatcacatccaagtccttggtgtctagaaggatcagatccaagggaaaaggaattccctggatctctataggtacgaccgggctataatactttgctgtcatagcccctccaggggtggtgatgagcagagagttcctagcctttctacccccagttgatttcttcccacaaattgcacagatataaacgagtgggaggctccagagtcaaacaaaatggtagcggggatggaatgaatgaagaacataccaacgatgacgtctggagttgtcagcacattctctgcagtgatgtggttcacacgaccccgggtggcatccttaccaccgttgttagggcggggaggcgcttggccttgctggctcctcggcttcgggcatttatcagcgaagtgcctgggctcgaagcagttgaagcatagacgctgctgaccttgaacatccctgcgaccttgaccaggctgcacggccggtgcaaggggacggggtgcacggttcccttgctgattctgctgttgctgcgactatgggacgcgtaccacaaattgaggtcgtggcgcggggtgaggttgctgctgctgctgctgtgaggaggatccccttggatagggattggtgtagcggatcctttggttagccccctgttgattacggaaattcgccaagcgacgtttgtgtgactccagttccttgtgcttggcctctaggcggatgctcttgtccaccaggcgctggaaatcagggtaatccccagagaccagacgcacagaaagttcagggtccattcctgccagaaacttttcctgcttttcttcatcttcacgaacatcctccggggcgtaccgggccaggttattgaactcatgcaatgtcacatcctgatttttgtttcaggatttataaattatttaataaattattattagaatttatattaattgtgcattaatttactagtgaagttaaatgtgggaaatcaaatttcgtaaaaataaagcatggatggatttaatttttagtaaattctccattgttaattatactctctggaattttctcggatttttcggagctcaatttctaattttaataatacaaacaaaatttcagtaattatccacatattaaattaatcattaaatggtctaattataatcttgttaagtactttgagtgtccaagtattttcaggatttttcttgaaattatttgagtattgaaagtatttttaacaattcaaagatcatttcagtgattaatttaattggaaaagtaattaaaattcctcctttccttttcgggccgaaacaggaaaagtcctctctttttcttggcccaatctcctctcagcctgtagcccctctccctctctctgtagaagtctgctttgagtccctctttcaatcgggccaagaagtagaagcccagccgaaagtgtacttttcgtccctgtcgctacagtggcatcttcaacctccagccggcaggagacagagcccgatgccgccattgccgtcgatttcccctccaaatccggtctcatctctcgtgttatttcagaattagttgaggggaaatattcctcttatcctcctctatcttttcccccaagaatcggactttatcccgaagaaatcaacgcgcaatcgagctcgattcgtgtttatctctccaaaccaaaccctagaaaatcccggctccgattctctcgttgttggatcgatctctctctcccatgtctataaatagagtcccctccctctcctctttcggctggcacctttccctctctccgcagtcgcttgtagcgccgtcgccgcgttcgtcttctctgtccaccgccggcagccgctccagccgcccctagcagccgcctcggccgtcgtcgacctgcgccatcgcatctcctgggttcacaaggaggagctgcacaccgtccacccctggtgtcgaaacatgaattcggcaataataaaagggggtagcgcacgagacctaaaagtggatggatgcagagacaaaggatttagacaggttcaggccctctcaatgagaggtaatacccttctcctgtttggggatttgaatccgccgggtgtagtatagatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggccgttccataatatacagggaaacgtaatacccaagtcatgatctgctacatatttcatatatataagttatcccctataactagtcggataaccatgccgtgtgggtatggggtacccataatctccacagtagcccctgagaccttcacagtcagaaagataatcttctctcgaactagattactccaaagccgagtgcttcaatcatcttcgccatgatctccccagtactttttctaaatcagaagactgtggagggctgaaaaaataaagtcaggtgcatcgactagatgcaccgagtggtttcgataattgtagtcaaccaagcgacttaatattaatatgtagcatatgcggtgtgaatccctgaataatatgatccaagtgatataccgactgctttgtaaaatatgatgagtgtaacctaaagttggctacatcattgaaaattcacatagcaaaatagctataaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 54898 - DNA, 826 bp, Oryza sativa
ttttattataattatatacaataaataaaggcatgtttacttttattatagtgttttgaaagacaaatatatatatgtttttctagtttctttaaactaaatatttttaaagttattgatggtcaaagttataaaaatttaatctcaatcttgtccaaaacgtcaattaatatagaactagagggagtaattaagagtagcatggaattaattaaacatgtgacatgttgggctaaggccaaacatgcctcacacaaaagtgttactccttgatctcattattggttccaattacgaaatgcatgcatcagttgctaacaatgtactaacatgtaagttctataccaagatggcactcccaacaattaattggtagctaaagctctcttattatatgggccctagcttctgtacttaaaaaaccgtgtctcaaattgtccccgtgtagatgatttttattaaaattcaacaatattgttttcctcttctataaaaatatatgattcaataaagcaaaacacatattgtatttgcattaaaccgactgaagattagaccttacttttaggatttataatcactagaaagatgtatatccaagaagacaaaaaaaacatttcaattagttaagtaaagagtgtatgaacggccgagtttagttccaaactttttattcgaactttcaatttttccatcacatcaaaactttcctacatacacaaacttccaattttcccgtcacatcgttctaattttaaccaaacttccaattttagcgtgaactaagcgctgtgtttagttcagcgcaaagtttggattttggttg

SEQ ID NO: 54899 - DNA, 1025 bp, Oryza sativa
atgtgtataaaataaattatctaaatattgtcaaggtagtcatagatatagatcatgaatttatgttgctagaaatatccagcttataaaaaaaatcctagatacatggctgtagcaaaagagatttagattttatctcaatttccgttagcattttttcaattaataatttgttaagtttgtaataatttaaatctaatcaattatgtgctaatgaatttctgttttacgttacatctatttcaaacatcaccttagagcaggtagaatattgaattataagtcagctataaacatatatcgaggagataaaagaagagagagataagtagcgggctacagatttatagccagctgcagcacagacttcacgatgcaatgtgcgtacagtctaacatatacctttacatataactattgtatgaattgagggtgtgttcgcagttgctagttcccaactagggacagtacgcacgtgattaattaagtactactccctccgttttatattataagtttttctagcattgctcacatttatatagatgttaatgaatctatacataatatctatataaatatgggcaatgctagaaagtcttataatataaaacggaggaagtattagctaattttttttttaaaaaatggattaatttgattttttaagtaacttccgtttcgtgtagaaacttttttaaaaacacaccgtttagcagtttgaaaagcgtacgtgtgaaaaacaagaaagagaggttgggaaaaggggcatccgaacacagcccgagtataaatgatttggagctggtaccagtaccggtcacacgcggacgcggtgcgccgaccgtccgacccaaccccagccccagcacgaatctcaacgcgacgccccccccccggcgggggcgcccgccccgacgcggcgaagcaagcaatcctcctcctcctcatcacacaacacaaagacgactgactactcctgtggacggcttccaacttcccccaatttttctctcttttttttt

SEQ ID NO: 54900 - DNA, 14730 bp, Oryza sativa
tatgaatttcaatgatgttattcaatcctacactcttttttttttcatatttggtctgttacatattgctattatatattgcagatagagtctgcactaccgagtatttctaggcctattatgtccttggatgggaatgaggatgctattgttggagcccttaaacaaagcttggtaatctacattgtttttgttagctggcaagtttgatgtaaagcttcacttgttttaaaacttaaaaaccaatttgatgtgcttttacagaggcaactagaatctctaggagcacagagagcaggtcttgaagacatgcttaaagaaatgaagagaaaggtactatcttttattgcttattttgatatcgtgtacataaactactataagtcccagacatatgttatgacagattaggaatttcttttgttcagtattagcttgttgataatcatgtagttgacttttgttttatgtttaaaagctcatgcaaatattctgattcttctacatttggtcgtatgtgcatactagggaaatatccatgtttttactttttttttagaatgcaggagagctgctttatttcattaagaaggaaaaaaaccagccatgcaaccaagggctcacaagcccttccacaaatagcatcactctttttttttttacatttgaacctagtcttcttgcgatcgcttcatccccccccccctctctcctttgtatggacctatctcctgaagtgttactcattattttttactgcattttactggcaataaaattagtttacaaccagttgcccattgatcttcactatggatggatcatgttcatgcctgatatgtggtgttcttggagtcctatgcttgtacgtgtatgtgataacctgctaggaaccaattaaaagctatacatgtgctctccgtttaacttccacttgacaagttttcagggaggtcttgcattttcttttcaaagtttgtttgtccttggcaccttgtaacggtcgaattcaatatctgtattcatgactgatagtgacacatataacctgtgatgccatcatgttcatttagaattatgacatacaaatatttctatcaggatgacatactccctaaattgatggccggtgttggatcacacgatgatctttttaagaaggagatttcaaagtatgatcctgtctgtgctgagatagctgataacattgtggcgcaagaacaactgctgctacaaatacaggtaagccaccattcctgataaagattgatatagtccacctttgcaattctcttattctagaagttcaatgtaaacacctttctgctaaaatctagatagacatcccccaaaaaatgtaattatattgaaatttttaaacgtctaatagcatcaatggtttagttggtattagcaaagaaagaacaaccagaaaatattttgaagagttaactatactgtatttcatgttctttcgtccttatgtctaacactatttatattttggatttctgcacaggcacaaaatgaacagtttgctgcggtgttcaacctagaggattacaaaggtatcccttctgatttattcatcaatggattatattgtgcgcttagtgactttgatagctggatttttgcccattcttaggtagcaactaatgatttggatgtgggataattatttctgttacacttaccaataaggttgggaacttatatatacacatacctagtcatcaaattgtctgctagctaaaacaacagaatgctgtgttgtttgtatgcatgtgtttttctctgttaaccattcaattatgtttcttcgttgaatacattttctcctcctagttctagttcaatttaagatatgaagaaccattgatgctggaacttggtctctttaattctaatttacaattattttatcatgtaaatagtaccacaatcagtgtttttaagtatgtatcctggtttgtaagcaatgagctgtgtaggcctgatttgtgaagcatgttttcagttgctcgtgagagatgttacaagcaaattgctgcggctgttgctaaataccgagatattaagaagaacattaatgaaggcctcaatttttatgtgacattacaggtaaatgcgcgtctctgtttctactgtagttaggatatatatgatgacagttaccattgtatgtaggaggaccactgtatatgtatttatatcctgaaatggtccttttgtgcaggaagcaattggcaaaataaagcagcagtgcagtgacttcataatgacccgaaacattcaatgccgtgaaatgatcgaagatgtgcagaagaagctagcaggtttcagcttctcatcttcttccagccaagcaagcatgcagaggaatacttctgtgccaccagatcagaacagtccatcaccaccaccaccgtcgtcgcatgctccccatgctcagggcccatatggtgttccacccggaggcgattcaagacccgggtactctcagcccgagcaaagacctgcttactcacagccatacccgccctatggcgcgccaccgcaacagcctccatatggtgcgccgtcgcaacagccaccttatggcgcgccccaccctggtcactaccaacagccaccacaccagcaacctcccaaccatgactatggccaacaagcatatcctggaggatggcgcgggcagtactacaatccacatcagccacagccgcagccacagccgccatatcctcagccaccgtacaatgcccagggttcttaccctcctcaccagagcagctactacaggcctcaatgagagatggttttgggatgtggcagaacatgtttgtgtgcctctttttatttttcttcagactgcgcatatgtgaattacgttttatggtgtactgcttacaaagtgaggtggtgtaatatcgattggtgtcaggttggttagacaatagcctgtatcatttggtccgtattaataatgttgaatatgatatatacaggccacgcgcctgcaatccccattaatatgtgccattgttgagcagtatttctctctcttgccaaattttgtactacttgtcagtgaacaccatcctgacgtttttccgcgaaggatgtcatagggatattgaagttacaaactgcacaataactgaaaggaggatacttacaaaaataatagagaatgatccacaaaaatatgtgattttgctaggtactccctctgttctaaatataacaaggtttttacatcacgtttatagaaaaatatattaacatttataatacaaaataaatacattctcatgacctattttaattatggatttaataactgatttaacgttgcaatactaaaataaatacgttattaagagctattttaattatagatttaatgaaaatgtttgttaatactggtgtattcttttttacttcccctatttcgcactataaatcgtgttgagttttgaatagatttacgtgtggatttatgcatatgttttacacttcctctatcacataatacaagggattttagaggatatgacatatcgcattactacgaatctggacactatttaaattcgtagtactagaatgtgtcacattcctttaaaatctcttatattgtactctctctgtctcacaaaaagtccaatgtggatataagaggataaacaaaggaacaaagtacccctaattaatagcaaagttatattgatgggtgggtaggtgggggttattgaagatataaaacttctcgattttacagatggatggtaggtaagaagttagaaattgtttattttggaacaaattttaaactttagaagttggtttattttgagacggagagactatatgtgtttggatcgagggactaattttttttgtctctgacatatcggatgtttggacattaatttggagtattaaacatagactaataataaaactaattgcataaatgagagctaatccacaagacaaattttttaagcctaattaatccacaattagcacatgtttactataacattgattaggcaaatcatggattaattagtctcaataggttcctctcacgaattagtccaggatcatggaatgggttttgtcattagtatacgtttaatacttctaattagtgtcgaaacatccgatgtgacagggactaatttttagtccctggatctaaacaccacctggaaaacatcatataacgtgaaacggagggaggatatatagtcagggggtgatgctacagtaaacatatgctaattatggattaattaaatttaaaagattcgtctcgctaattagctttcatttatacaattagttttattattagtctatgtttaatactcttaattagcgcctaaatttccaaagtgacaaggactaaaatttaggccccgtttgatgtgaactactagagacaaatttttatggcacgcaaaacgagaaagcttattagcacatgattaattaattattaactattataaattttaaaaaatagatttattttcttttttaaaacaacttttatatagatattttttttaaaaaaatataccatttaatagtttgaagagcgtgctaacggaaaacgaggaagctgaagttggagttggagaaatagaactcacccttgctatgcaaacaccccctcaatgttagtactgtaacatgggagtgagggataaaagcattgccctcactcgagcatcaaacgtgagggcacccctcccttcccctggcgcccgcggcggcgctgatctgttcgccgctgtccgtcaggcctggcgcccgcgggggcaggcatggcgcgccgcgtccctacccgcccgcgcggcggtggcggcggcggcgtcccacgctcggagggctcgatccaagggcgaggaggccgcgcggggggcagtggcgccgaggacgcacgccacgtgttcgacgaattgctccggcgtggcaggggcgcctcgatctacggcttgaaccgcgccctcgccgacgtcgcgcgtcacagccccgcggccgccgtgtcccgctacaaccgcatggcccgagccggcgccggcaaggtaactcccaccgtgcacacctatgccatcctcatcggctgctgctgccgtgcgggccgcttggacctcggtttcgcggccttgggcaatgtcgtcaagaagggatttagagtggatgccatcaccttcactcctctgctcaagggcctctgtgccgacaagaggacgagcgacgcaatggacatagtgctccgcagaatgaccgagctcggctgcataccagatgtcttctcctacaataatcttctcaagggtctgtgtgatgagaacagaagccaagaagctctcgagctgctgcacatgatggctgatgatcgaggaggaggtagcccacctgatgtggtgtcgtataacactgtcctcaatggcttcttcaaagagggggattcagacaaagcttacagtacataccatgaaatgctggaccgggggattttaccagatgttgtgacctacagctctattattgctgcgttatgcaaggctcaagctatggacaaagccatggaggtacttaacaccatggttaagaatggtgtcatgcctgattgcatgacatataatagtattctgcatggatattgctcttcagggcagccaaaagaggctattggaacactcaaaaagatgcgcagtgatggcgtcgaaccaaatgttgttacttatagttcactgatgaattatctttgcaagaatggaagatccaccgaagctagaaagattttcgattctatgaccaagaggggcctagagcctgatattgctacctatcgtaccctgcttcaggggtatgctaccaaaggagcccttgttgagatgcatgctctcttggatttgatggtacgaaatggtatccaaccggatcatcatgtattcaacattctaatatgtgcatacgctaaacaagagaaagtagatcaggcaatgcttgtattcagcaaaatgaggcagcatggattgaatccgaatgtagtgtgctatggaacagttatagatgtactttgcaagtcaggcagtgtagatgatgctatgctttattttgagcagatgatcgatgaaggactaacccctaacattattgtgtatacctccctaattcatggtctgtgcacctgtgacaaatgggacaaggctgaagagttaattcttgaaatgttggatcgaggcatctgtctgaacactattttctttaattcaataattgacagtcattgcaaagaagggagggttatagaatctgaaaaactctttgacttgatggtacgaattggtgtgaagcccgatatcattacgtacaatacactcatcgatggatgctgcttagctggtaagatggatgaagcaacgaagttacttgccagcatggtctcagttggggtgaaacctgatattgttacctatggcaccttgattaatggctactgtagagttagcaggatggatgacgcattagctcttttcaaagagatggtgagcagtggtgttagtcctaatattattacgtataacataattctgcaaggtttatttcataccagaagaactgctgctgcaaaagaactctatgtcagtattaccaaaagtggaacacagcttgaacttagcacgtacaacataatccttcatggactttgcaaaaacaatctcactgacgaggcacttcgaatgtttcagaacctatgtttgacggatttacagctggagactaggacttttaacattatgattggtgccttacttaaatgtggaagaatggatgaagctaaggatttgtttgctgctcactcggctaacggtttagtgccagatgttaggacctacagtttaatggcagaaaatcttatagagcaggggtcgctagaagaattggatgatctatttctttcaatggaggagaatggctgttccgccgactcccgcatgctaaattccattgttaggaaactgttacagaggggtgatataaccagggctggcacttacctgttcatgattgatgagaagcacttctccctcgaagcatccactgcttccttcttgttagaatcttccccaatcgtctgggagcaaatatcaagaatatcgtaggtttttccctgaaaaatacgaggcttctatagaatctttgaactgcttcgaagctttttgcagctttgaagttctgagttggaattcttttctactacactctacagttgtactagaggaggtatcttttctctgtttgtgtaaatagcaagcagatcacctcatgtctgttttagttcatgttaaccaagagactataaaatatacacacgtcttggcagttagaacttagaagcaatgtcgccaccaagctatattttttaagtgcctgttttttattctcttttccaagaggttttccaccggtttttggtgtaaatgttagcatgtttctcggtgtaaattgattcccacgcattgctatataatcttggccaatggtttttagtgcctgttttcaaatttggttagctgtcagtcaggaggtgcatgctattaaatttacttttgccgatgcaaaactgtccattttcagtttttgaattcataaaactccatactagcttgaagtatacatgtatatattagcaatactagctttcttccaagctaaccattagttgttagagaagaaggcaacgctcaaaatgtcctttttagtttttatgtttgttctgcagacacttgtctgtaaatttgaaattaattaagcaggtttggataagctgcttacttttaatatgtatagacttcaaatatcctttggctgattgcatccaaaattgctacggaaagtctgaaattttgtttagattatgccaacaatgcatgcagaaaagtttattttggttttataggcaggctacaggcatgacattgctgggtcaatagcttgaaagctgaaacagtaacctacaatacggaagtaactgaaacgctgggcattttgctttcaaatgtttgaatgccagttatgtttgatagtcctttgcactttccatttaatcaagatgtccatatctcgggtagataaattgtttatcttttatgatatcaattggatattcgaagtcacatcctactactactaatttgatgatgcattagtttcgatcacaagcatgttttttggcagattgatatcagaaattaatgggaggatggtggtgtgcttgcaaggctggacgtttgctaccagaggagtgtcctataatacgaggcgtgcagttcagtgtcctgtaataggagtgaatcggtgtaatttctgaagaaattacgcgtttgcttccctctgatttcgcgttggggggacaacatggctttgcgcctgaagattagtagtattagggtaacagattgttgagctaatatttggtgccgcaccggagaaactgaatagtatatgttgttaacagataggctcatagctgatatgtgctcttgattgttgctcagtttaattaccggcaaatttaacgagagtaaattcatcccatcagtgtttgtaatttcagcccaaatgcacctgtgagttaggcccaaagtggtcccaaaatctgcctaaacctggcacaaattcggtcggtagtgtcgcacagtttcacttatcgcgcggcggttatcgcgcttaccgcgggggtacggtaggagaaaccggcgatatggtttagatgaattttgaccaaattcaaaattctggaaaaaaaaaattggaaaaaaaatcatggatatagttcttgatttgtacttgctaatggtgaagaaattttttgaaatagagtaagctaaattcaaatttaaggacaaaactgaaaatagtttacaaattggaaaaaggaagacaatattaggccttaagtatcctacatattcttccaattattctcaatttttagttttctacacatattcaaccgtattttcgatttttttcctatttattttttatttacatgatttcagctacacagctcgcgataaccgtgcgaatatcgtggtaaaccgtgcggtaaccacggtgaaatcccgaaaccgccaagttctgaattcgaaattttggatgtgatttttgtacgattttagacggttaccgcactaccgcagggtgacggtaaccccggcccaaacgataaggtaaaccctggtcgcacaaatttggcccaaaaccgaccagttatcgcgctaccgcgggatgcctcagtaggaccttaggtcctaggttcgactccccatgggagcgaattttccagtatttaacggcattgtactttcagcggtagacgacataccggtcaacagcgaggcgtctgtggagacttcgtcaatttcaaggatgatttgccggcccagtcttcgaagatgctcataggggtaggatttgcacgcgtactttcatagggatgagtgtgcgtgcgttgtgagtgtctgcgttgtactgtgtaattctcaaaaaaaaaaatcatcctataactttcgacccgaaaacggacgtcaatttgacccaaaagtgcgtctaaagttatcccatttcacatccacggtaaatttaaagtttatacattaatgtgatttaaaatttaaattatttgaaatgtgtataaaataaattatctaaatattatcaaggtagtcatagatatatatcatgaatttatgttgctagaaatatccagcttataaaaaaatcctagatacatagctgtagcaaaagagatttagattttatctcgatttccgttagaatttttttcaattaataatttgtcaagtttgtaataacttaaacttaatcaattatgtgctaatgaatttctcgttttacgttacatctatttaatcttcatcttcatcttcattagtttcaaacaccaccttagagcaggtagaatattagattataagtcagctataaacacatatcgagtagataaaagaagagagagataagtagcgggctacagatttgtagccagctgcaacacagatttcacgacgcaatgtgcgtataacaggcgtgaccagatattaatagtgtaagatatacctttacatataactattgtatgaattgagggtgtgttcgcagttgctagttcccaactaggaacagtacgtgcggagaacagagtggtccattagcacgtgattaattaagtactactccctccatttcatattataagacttctagcattgcccacgttcatatagatgttaatgaatctatacatatatatatatgtttagattcatatatatgtctatatgaagtattagctaattttttttaaaaaaatggattaatttgattttttaagcaactttcgtatagaggatggaaaaggggcatccgaacactacagatgatttggagctggtaccagtaccggtcacacatggacgcggtgcacggactgtccgacccaaccccaaccccagcacgaatctcaacgcgacgcccccccgccccgacgcggcgaagcaaatcctcttcctcctcactagtagcatacccgtgctaacgctacggtgacaactaatattgcaaatgaaacaaccaaataacagcgacacaatatatgcttcatcaatggtacatagaacagatagttaggctaaaagagcgatagagttattagaaaaaaattaatcagcatgtatccacaataccatctaggaacaagccgtcccttgctatgctataaagtacaggtattgctcctctcaaatacacaaaataataaatatctaaaattagcttgacttaagccatccattccgcttgatgtggtcctgattatctggacaaggctacaaaacaaccaaaatgtatattatcactgtagttatttgtatttacacaaaaaagaatattggtcatttcataacttgaagataaacttctgtgataagcaaggtggactctcttggatgactaacgaatgaacctctgaactaaaattgacgctcatttaatacattcgtaatcaaagtcagttgatcggtgttttcatctatgtgtagaaataaacaacgggaaacagccgatatagctaaattttgcccaaaaaattacatgtcttgtcatttcacttacaattatatgcacatatatgactaaagtttctgcatttatattgtaatttatgaaccaatgaatcactaaatatggaggacttatgtggaatatgcaaataaacaaagagaaaccatttgtgtgcacgtggaacccgcgtcacaaggggtaaaattacaatgttgtatattttatacattttacatttttaaaatgtggttaatgatcaaactatcatgactctccaatgtctcaaatcaaagctgcagctatatatatacaaaacacattgtggtttgaggcacttttctgttgcactggaaaatatataccaatcaaagcagaatactgtaaaataagaagtaactctttctagtctataataaaaccttcacttttgaaacctactacagactcatacttgagtctagttgaaggttcaggcgttcagctatcttgaaaataaacaatctgaagtgagttcatcagatgctttttcactgtgccatacaacatatctcggagagctaaggggactgaaatataccttacatttcaaaaaatcaacatcttcagaagatatgttagcattggagttatcagtaaccatggagcactccacataaagcctagacttgtctgcgtttttatgtggaggtaatcaatccttgtctgatcagcgaaagaaattattaattaggccatgctgcagaaaatgatttaaagatgcttatgccaaacaggaaagcaaagatagcaagcagataaaattccatatactctaccttgaatatcaacatcactgccctttgaactggtcaaactctaatactgattgttcagtatatctcggtaatctataatagatgcaagggcacaaaactcggtaagagtgaaaaaggcattatattagttagcactaacctccaggctttccaatattgacaagattaacatagaagcatgaatatggtcttgtataacacgctttctttaatttgtcatattcctttttcatataaggatttttctatgacttgaggaagtaaataacaatacaattaattcttgaacatgcaaaacagtatgaagcaaaatacagtctacatatggaattttgcacattttatcatgaaaataatttctcactgtagtttatcttatcaaaagaagtaacacagagcatgagagatgcaccgctaattgtgcctcctgcaaggaagaaagttagtagagctaatcgtttgatagtagtgttagttccaaaggctactgcaagaaagagagaagcagattactcttatcttttagagaattttattactatgtatgtaattctatactaagtaattctgcaatatttttcatgcacaaatcctccttcacttcagtctctcatatactcaatcctgaaacaaggagggcaaagatggctacctccacaatcactctgaaagctttcaaaaatttgatgaagctactttgaaacttcagtctgaagacctgaaacaccaaaaacaattgatagtttgactccgaattgatttgtgaaactattctaaactcaattgcgtaaattactaaattggatcaaatacatgattggttacagggcattgagtaaaactactgaaacatttgcaaactcaaaattgtaatcataaaacctaaacagatgcataaaccattcagtaaagaacgcaaggcaagcttaattaacctttgcccgtgctgtcgcagtaatttgttgcatgcccagtattgatccagtccaaaccatttctccatgtactcatctaagcttgcatgctctgtggcaaccggaattcactaataaactggtaagttgttcctttagagtttagacaatacatcgaaagtgcttgcacattactaatgcacgacattttacatatttaggtgtcatgaataaaaatgtaaacccaatttgactttttaaagggaaaaattgtcactgcatgcacaaatcagaactttccgtgtgtgtgcaagcatgccattcattaatatatgcaaagacaaacttaaacgacacaaggtaaactacagtatgaatacaagtggttcaatagagcacaattccagaattgaggtatataaccttcggtacacatcacagaataatgtatacaacggaaagtaaaagaagctctcaatattggcatcatgatttagataattaaattcttctttttaatttggatgtcaatttggatggtgatctctaaagagagcacacaacatgtgtatcaatttaattggtttcctgggctatgttgctgaccaagcaattaatgaagttcaaaagaaattatctgaattttcagatataaacatcccaataataacttaccttgttgcagtgcgaggccgatgccggggttgagaaatccgaccgcggggacttggaatgtcggactcacacacggccggaggaaggggctggtgccgggatcgaccgcgaaaatcgggcggcaacacttaggccagatcggagcaaggagggaggagcgccaaaaatcaaatggaagacatcaaacccaaaaatcggttgtgatctgtcgacgaatctggcttgtcggtccttactgatctgtctcttgattccaatccccatctctctaattctttttgttcgctctaattctttttgttcgtcctttgagcaatagggatttggtggagagtgcgttggtgacggccgcaagaggaatgcagtagggggaggaggagcgacggcgacgatgtgaaggcagtacggcgaggaggaggggatggaggcgccggagaggcagtgcgatgattagggtttgctcgggggagtacgtgggggaggcacgccggttgggcgaaggagggagcgagcgggcgaggcggcgaggggagcgggttttggggagagaacacgcacgcgggggaggaggagtgatctggaccgttagatgatcgggagatattctggtccgttggatttgatgaatgagtaacgtaggtgtaagagtgagttggtgaattatagggtagatagatagatagattagaagatcacacaacacaaacgactgactactcctaccgcgacggcttccaacttcccccaatttttttctcctctttttttttggaaaaagtacgaattacccccctgaacttgtgcggtcgatcgaattacacccgcgaacccgaaaaccagacattgttcaccccgaacttttaataccggacgaattaccccctcgatccaatccagaacgattttgtcctacgtggcgtacacgtggcaatccagcagcattttctttttttttaattgtgggacccacatgtcatacggattccctcatcctctctctcttcactctctctctctcacacagcgcggtggcaggaggtgggcggcggcgcgaccggcaacggcgggcgcgacaggcgcggttggcggcgaggaagtcggcgcggcggcgggcggagtgctcgttggcgtgggggtggcggtggtcg

SEQ ID NO: 54901 - DNA, 4995 bp, Oryza sativa
agagagtaagaggggcttcgtatgacatgtgggtcccactttttttaaaaaaaaaaagaaaatgctgactggattgctacgtgtacgccacgtaggacaaaaccgctctggattggatcgagggggtaattcgtccggtattgaaagtttgggatgaaaaatgtctggttttcgggttcgggggtgtaattcggtcgaccgcaaaagttcagggggtaattcatactttttccttttttctttcctttccttcgccgcaaagcactccaacgccgccgccccgatctcttccctccggcggccgccatgtcatcggcggcgaacgaattacttgttcagaccgaagagatgctgcagaaggaggcgaaatggatggcttaagtcaagctaattttagatatttattattttgtgtatttgagaggagcaatacctgtactttattatagcatagcaagggacggcttgttcttagatgatattgtggatgcatgttgattaatttttttctaataactctatcgctcttttcctaactatctgttctatgtaccattgatgaagcatatattgtgtcgctgtcatttggttgtttcatttgtaatattagttgtcaccgtagcgttagcacgggcatactcctagtgaggaggaagaggatttgcttcgccgcgtcaccgggggaggtgtcacgttgagattcctgctggggctggggttgggttgagattccccaggcgcccgcggcggcctcgatctgggcggcgcagatcagaggacggcgcggatcggcgagcttcgcactgggcacgtgtgcctgtgtgtgggagtcaggcctcgcagccgccgctgctgctgctgctgctgctgcacctgtcagctagggcgggcatggcgcgccgcgccgcttcccgcgctgttggctcggagggctcgatccaagggcgagggggccgcgcggggggcaatggcgccgaggacgcacgccacgtgttcgacgaattgcttcggcgtggcaagggcgccacgatctacggcttgaaccgcgccctcgacgacgtcgcgcgtcacagccccgcggccgccgtgtcccgctacaaccgcatggcccgagccggcgccgacgaggtaactcccaacttgtacacctacagcgttctcatcggttgctgctgccgggcgggccgcttggacctcggtttcgcggccttgggcaatgtcattaagaagggatttagagtggaagccatcaccttcactcctctgctcaagggcctctgtgccgacaagaggacgagcgacgcaatggacatagtgctctgcagaatgacccagctcggctgcataccaaatgtcttctcctgcaccattcttctcaagggtctgtgtgatgagaacagaagccaagaagctctcgagctgctccaaatgatgcctgatgatggaggtgactgcccacctgatgtggtgttgtacaacaccgtcatcaatggcttcttcaaagagggggatccggacaaagcttacgctacataccatgaaatgtttgaccaggggattttgccagatgttgtgacttacagctctattatcgctgccttatgcaaggctcaagctatggacaaggccatggaggtacttaacaccatggttaagaatggtgtcatgcctaattgcaggacatataatagtattgtgcacggatattgctcttcagggcagttgacagaggctattggatttctcaaaatgatgtgcagtgatggtgtcgaaccagatgttgttacttgtaacttgctgatggattatctttgcaagaacagaagatgcacggaagctagaaagattttcaattctatgaccaagtgtggcctaaagcctgatattactacctattgtaccctgcttcaggggtatgctaccaaaggagcccttgttgagatgcatgatctcctggatttgatggtatggaacggtatccaacctaatcatcatgtattcaacattctaatatgtgcatacgctaaacaagaaaaagtagatgaggcgatgcttgtattcagcaaaatgaggcagcaaggattgagtccgaatgcagtgaactacagaacagtcatagatgtactctgcaagctaggcagagtatacgatgcagtgcttaccttaaagcagatgatcaatgaaggactaacccctgacatcattgtatatacccccctaattcatggtttttgtacctgtgacaaatgggagaaggctgaggagttaattttttaaatgttggatcaaggcatctgtccagacaccattttctttagtagaataatttataatttttgcaaagaagggagagttatagaatctgaaaaactctttgacttgatggcacatactggtgttaagcctgatgtcattacatacaatgcactcatcagtggatattgcctagccggtgttgacgtaaaacacgaggcctgggagatctgcttaactccagtgcaggtccaaaactcgccttcgggtatgcttagcgtgccaattgatttgatcctgcaatcaacaagaaacaaagacaaagaaaccgcggttaaatccataaacgatagacgatcggctaggtgccgatgacatatcatttatctttgagccgatgtcatatgtgcatcgatcggcagtcattaataaataagaagggactaaatctattcgatcggctgtagatattaacaatatatagtccttatatcgatatatacttaaatcaagtgattgggatagatcggactccatgccgagacagtatgaatcacttagatcgaaatatatattaataatgagattatatacgttcatagcatagccgatcagatggatctagcatgtatcggttgatactccgatactactctatattaagatattaaagcaagtagaatatactaaacaaaagcctaatatacttaaatgcagcaatatcttaatataaagggcagatttaacatgtcaatcgagcatataggataaaagtagttaaatcaggtaagatcggctgaaaccccgatactaccctaatcggcaaccaaagacagactagagattgagattctaattacgactcataagatcaaactcaactgatgcagctataagtatgaaaagaaggataatatctagacaatcaagccgttggatatgtcatagagtggtggatatcctatataatctaagtcaacgtcggtatttaacctaatcggctgccttctagtaacagacgttagccgattagaggttagataacgatattgccaaagattatgtaagatatatgataactcgacgaattacataaacaagattagagtgtcataaagatggaagcactaatcccgagaacgcaagccgccataacaagttttacctcttgttaaagatcgaaaccgatgcagctcaacccgaaagcaagaactcgtcgaaataaaactaaagcaaaaaagggtggcgatgcgctgagattgttattgaacgtgtgttatcgattacatagggttcgggtctatttatacccgagaattacaagatatgtccataccggacacgactcttatccctaacaaactctaagataccataagtctttgcggcagacttttgcccaagcatatctctaaggaaattatataaaatatcctaattaatagatacaattaccttcccaggactctatccatgcacggcaatcatcgtgaagcatatcaactcaacccgatgttgtacaccaagtcatattgtcggaatcggctgtatcggcttacccagtctgactcggacccagctgatcctgatcgtagccgattcggactccagccgatttttgctcggttctcgaatcgatctccgcctccgtctccacttcaacctaatccccttttccgatactgatattaccaaattttgtcgttaacagccggtaagatggatgaagcaatgaaattactccctggcatggtctcagttggggtggaacctaattgtgttacttaccacagtttgattaatggatattgtaaaggtagtaggatggaggacgcgttggttcttttcatagagatggtgagcaatggtgttattcctgatattatcacgtacaacacaattctgcatggtttgtttcagacagggagaatagctgctgcgaaagagctctacgtcaggattgttaaaagaggaatagagactgaacttagcacgtgcaacataatccgtcaaggactttgcaaaaacaatctcactgatgatgcacttcgcttgtttcagtagctatgtttgttggagttgcagcttgaaactaggacctttaacattacgattggtgcgttgcttgaagttggcagaaaggatgaagccaaggatttgtttgcttctctctcagctaatggtttagtgccagatgattggatgtacaagtaaatggaagtgttatagaacaggggttgctaggaaaaatggataaatgctacagttaggaagctacttcacaaagggcaggtaggcagggctggggtttacctatcctaaagtgatcatattggtcttttattgattatgttgatattgtgtgtttacactacttcaagtctcagccctatattatgataggttaggggtctttttttggtattgtattatcttgctgataatcatgtcggtgacttctgtttacgtttaaaatctcatgctttaaattatgattgttctacatatggtcctactctgcatactaggaaatataaaatattcatgtttttatatttgaatttagtcttcttgcgggcagttctctttcttccttttcacggaactatctcctgatgaagtgcaaccctgattatttttactgcattttgctggcaattaaattagtttacaagggcttgtccatttatcttctcagtagatgtgatgtgcagaaaacatgacagcatcttttgtttgcct

SEQ ID NO: 54902 - DNA, 5828 bp, Oryza sativa
tgatgcatcgttttggtctgctcccttgtacatcgatgcagagcagaagaagcggcctgaagacttcttttttttttttaagactttgaagcggcttgaagactgatttccctgaaagcactgggaatgacagattgattcggtgcattgcacttgaccttttctctttcaatttactgctggtgattgttgtcactatttaacttgtactcctgatgttctagaccatttatattatgtatgtgtttatttatagatgatgtaaatatcagcgcaaatggggcatgtgatttacttatatttggggactggggtagtattcagcgttgaaccagctgctagcgtactcgttgtcagagaatcaatacaggttcagtttgatgggaaaatgagtttccctgataatgctaagtaattgttatggcataatcactcagttgggggcttgcagcctctgtccaactgcataagcttccagttccaccgcttcactgctaatagcattttgggctgcgctccgttaccactttcgaccttaccaaattttaatagggtctccaactaaatttgtactttcaacatctttaccctaccaaaatttagatgttccggaagtttcctctcagaaacactaccagatttcagagagattccaaattaactagcatattcaatgccaccaacattgggtaacaccaagatttggtattgcccaatgttggtaaggttgatgttggaaataaagtgaacaaaccctttttattttactactgtcaccgttttgagcttcctgttaaacccatgtcttctttctttttttactccagtctgatccatgaaggactacaagtaatcaagtcacaagtctgaatccatgaacaaaaggagagacaacattgggcagtacagcttttgccgctaaaatcaactagatagtcgataaacacaatatgaaagttatgccgctcactacagttaggtggcatctatgtaccgttctagcaactatggcaaccgatccgcaattttctgcagttgaactgaagaacaaactcagctgtgcagtgacccccctgttgcgaatgtcctccagcttactaaaaataatgggccatgcgagaggactggggcgcctgcctgctgttgctgcttgcgccgatgaagccttgcagaaggctctgtgcggctttcacttgatccggaatgccctggatctccacaatggactcggaagaaccgggatgggcttcgtgcaacttcactctcgcgccagagatctgggatcaaggggagattttcatgaggaaaactattggaggccattggggcatggttaagactgggcatagtgcgtgatgtttcgcatacgctatacctgacggatctcagctagattgacaccaccagctccaatgacagattccagataactattggaatccgaaattcgacggagccacctggatacctgcaaagagatcatcactcaatgattatgaggacaaaattcacgtttgtgtcctgtaaaaattcagtttgcataagccatacccagtgagacctgacagtcttcggtaatcctcacgtccatggatctgctcagcggcctgaaaagaatgaaattcaaatctattaagcactgaagagaacaaaaatatacattcagatgcatcagagaggcatcaggtgaaccaggaaacaaggaaataaaaaatgagaaaagatcaacacccaactaagaaaactggtaagcaacagcagcagagaacagctgaataactgaatctagggtttgcaacaacatcgtaacaattgaatagtgttaccaatgatagatattagagtgggcacaagacagaaggatatatttggatcaccatgacatattctagaatattttggtccttttttcagacatctgaaccatcatggaagaaaatagacataatgcaacagtcatatatatggtttcatgtttctaatggaaacatatcaggcgagggccatttgcaaagaagaggcaagctaacgcattggaaatgtacctcggtataatcataagcattggaatttccagctctggtgattcctaattgttgcacattactattcccagctctcgagaggcctaattgtagtgtacccctactagagtacctatcagtaggtacttggtcaagataagaacggcgggacatataatcggcaccaggactaatagatgagggcagttctctattaggcaagcgagtagttgctgcatatctgtcgtatgaagcagatggtgtaactttgctatttccactagggtactctcttttagagaagtactctacaggatacgcagtgtaaggatcacgaggcccatcattgttcaaccctccatatgatgtatcattggcaggtcttctatatggtggatcaatggctggtcttccatatggtggatcaatggcaggtcttccatatggtggatcaatggcaggtcttccatatggtggatcattaggaggccctccatatgggggactattggcagatcgtccatatagcatgaattccctgttaggcaagatatcaacaggaggaccatcaaaaggggcaaaaggtgtcggattattggaagaacttccatctctgagtgtcctagttctaagcctcgaagcaatctctgtcagggctcctcttgcaatagctggaagcccagcaacctgaaagcttggaacaaatgtaaaagcacaatgaaatgttaacaagtaaaaactgtagttataaaggtaatatatggatctctggtgtaggtatggccaaataaattacctgcacaagctcctcatcaaaagacaagtacttaggtttatctgcttttgagtagactcggatttcagccccagtccgtcttctcatttcagtaattacctttccaccttccccaataatacaaccaactttgtttgatggtacaacaagccgtgtcgtcaagtggtgattctcagcaagtgtacttactttactatggagcaaaataagcgcctcaattgttggagacactggatcatctggaatctggaaagaaaatgtaggaggatataatattgtaaagactcatgataaaaatggtaaggcaatgccaattggaataatcatctgcatattacctcctgagatgaaacaacaattaacctttcttcagaagcatttttgccaacttctttaacctgaacgcaagcacctgtctgctgttcgacttgccgaacattgccaccacttttcccaataacttgaccaatgtgttcagaagcacacagaattttaatagagaactcttcagcttcagcagaatgatactgcagtggcctgtttctatatggatcaagcaagggtatttgtggtgagtgatccacatgcaggtgtggcaacattggatttgcatgtggtaattgtggtggagcctgatgcttcctttgtgtgcttgcatctataatttcttccagaggtggattgtctttacgaggatgttgatgcagacgagtagatatttcatagagagcttttcttacaagggaagaagatccagatatctgaaataacataagcccaagtgacagtgatttccaaaaacaacaaattgacaaagcaatcatacttccattgatgcacatcatggtattacattgcaattttgcaacatgaaattacatatcattaagaaaaaaaggcatattgataaaaagttaagagaggtaaaaactccatgccagatcaaaaagttccattacttagttcattcaagagcttaacagggcatattgacaagaaactcagatagtagtacaaggattgatatatgccatactgagtgatttgtttttcacgagtaacgaatgaacacaaaccaagttaactgataccattactcaaggacattggtatgaatgaaactacggatacaaaacaagttggaacaaaagataacaaataagttttttgaagttacctgcaccaattcatcacttttaagtgcacactgaggaagattttcagatggtaagacacggatccctgctccagtgtcatttcgtagctgttgtataatggagccaccttttcctagaagacagccaacttgatttcctggaaccaaaattcgagcaattacatcatcaacattttcagacttttcatgaacaattccagcatggagatcttcatctgctgcaattttgtcatgtatcttcaacagggcatcttgggcaaaacaatgaggcttcatgtcctcaaatccatcagtagaaatattttgagcagcttcttcagtctgacttgagtagttaaagataataattactctctcatctgcaccaggaatggaatcagcgacccttatctttgctttagttgtgtctcttagtgccttaacaatatcaccgcctcttcccaagacactgccaatctttttaaccggacacagtatcctgtaaatggtttctattggctcagaagatatggttccatcatcgtgccttgagtttagccgtttcctctttccgtcatcagaattgaaatgtggcctttttctggaagtatttgatttatgccttctagatctatcatgatccatcagtaacctttgcctgcataaggaaaagtccatcaacataaatgagaattagacataatgtaggacacaggcaacacacaaataatggacatggcgcacgatagaagtatgagaaatgttccatgatggcaacatgcatgaccttgtaacttttgcataactcaacatggaaaaaagttgccattaaatgcttatgtggatactttgggcctatggaattactcgtagctgtttgcaggaacaataataacaggcaaaggctatacatctaaactttaaagtcacctcactgaacacacgccacagtaactaaatatataccttgtcatattttctaaagatgtatctatacagtgcttccacagttccacctattgtattccttcaaacaaacatttaccactatctagtttagtctcactgtggcatgatcttaattgatccaagaaaggtagtgaattttataacgcacggctcaagatccaagtatcaatatttgtaaagtactcgagtcgtgcaaactcacagtaggttttttaaaggcaaaatgctgatatcaggccagcgtgtccaaaaaggaataccatggcagattaatgcgcagttgcacattattggagtaaacagattaagaaaatgacaagcaacagacacaaagggcatcctgtcattaaatgaatttaatggagatgttccactaaagcatttcacagaaagtaaaataaaaggactatgtataatggcgccaaacatcctttcgtagagatctacaggtggctgctaggcaactggacaggtaggacttgaatttatataacagggtcagcatacaaatcattagtcacatgtatagagcatcacattagaagcaaaagtcatcctaacgtacgtgacgtgcagcaactccataaatggaaagaaatgacaaaataattacactccatcaaggcatcaggccatcgcctggtcaataacggcaataactagctcctgaataagctactgaatgcagaacatgagatgccaaattgatgactgtacacttgccgccttgttgctgccctactaatacgtaatcaaataaagtgtcatggcagtgggccgagaggtcgaggccttccctcgtcttacggtagctcagttggttggataggattaggttgggtccttccctccatctatataaggatgaatccagggggggagg

SEQ ID NO: 54903 - DNA, 1455 bp, Oryza sativa
aactcattcaacatagtatctaggaatttatcgaatgtatcccttcttagccacatgttagtctcctcctcctcttcttcctcttcctcttcctcttcttcctcttcctcctcttcctccgattccacatcatccacttcaaacaaccccaactcctcctccgattcatcctccgattcctcctatacaattgaggaaagcagctcatgcaattagcaacaaagcagcaaaaagtgttactacctccgtttttagatatatggcattgttagctttgatacatgatgttcgaccgatcatcttatattctgaataagatgattgctcaaacattatgtccaagtcagcggcatcatatattattttaaaatggagtaaatgctagtcctgaaagtgaatgtccgtacatcctcggagctgcttgtcagtaccaaacgatatcgctctacatccaagtgaccaccagcgtatgcattagtattttgggggtgcttcataggaggagtccccttgtttctgcaaccataacagtgaccccctttacagagaaaaaaatgcatttgtcaagtaactgccaaatcaccaaccatgcacaagcagatgtacatccgagtaattgaaggaaacgaaaaacgacatatgcaaccaatatagaggcctgtacatgaaacagtttaagatattgtacaagcatgtatgacatgaactactgtaacgtaacataatgggaaagcaaaactgccaaattagtgtaataggaattgcggatgatgttctatattcagcagaaaaagttttgaaaatatatctaacagaagagttggcgcttcagcagccatgcaagaacagatgttaacacatagtcacaaagttctcaggttgatgaggtcgaggaatttgtacgctacttgctagaggtttttacactaccgcaagggtcatgaatgacactgtactcgaacataacggcaaataaactgacttcagtttaataaataattggaaatcatatcctacattcagcagcaaatatacaaatgctatcgtaaaaatatacattcaatgggtctaatgaattgagttccaacagtgtgtaatgcaatatatagagcataggtgctaagcaaaaggcagaatgcaacatatgaattcagtatagtctacagagtagataaacaaatattcctcaatccagatttatgtttgaggtaaactgtaagtgtaccaataaccactacaatgtgaatttagaagatagtttaagagaaaagtatgaataccattaacttcagtgtcaatcttgcagaaacagatgaccttccaggccattcttctttgcacatgtgtcacttcagcaaagaatagtttgccactgctatcgtcagctcccttttgttttgctgtgaaattgaaatgacgataccacatacaattctcacaaaataattgcctact

SEQ ID NO: 54904 - DNA, 1514 bp, Oryza sativa
ttcctgcaccccagatcagagcacgccacactattagtacttagtggagaattcaaagtggggaatatagaagtgacactaagttgtctaaatggttataggtccaatgtagggttaggaagagtttgtgtagaaagttactgagcaaggatgaaactcccaggtacctatgttatcactgattgagtaataaaaaagtgtccttgaaattataacaagataagagaattgaacatgtacaatctccatgcctataagttatcaatcaggctaattgatacggttatcgcaattatttgatacagcagacaacagaactgtgtgtgtttgtaatcaacttacattacaattcagattaaaacataccttaaacaaagcatagtatagtatatatttactttgtggacttactgtcatgcctatgggttacgattagtactccctggcaaaaataataacagaggatagtttcgctaacttcatcattgtcataataggaccacatattatagatgcaacctggtttttttttttatcaactcttaggctttctattactccaaagttaagtatatttgctgcgttcttaactaatttgatgaaacaaaattaagactgtaaagcaatacctttatatgaagagtaatacatgagcaccatgagtagaaacaatgcatgcaaactacctagtcaagttaaagtacactgaccaaacaccgttgcttactgtggagaattaaatgaatgagctacaacaaattcaagaagaaactttaccttgctccatgctgcagttcatcaagaaagcacttgatagcatcgtcagcttcatctactctctgaaacggtccacccacatcagggtaagtccagcaagagcccctggggtctattctaatgtagaacagctggtagcaatttacaaaactgcggaccaaaatgctagacccaacagatgaggaagctgattgcagatagccatcagtggtggtgttatctggcgccgttcgtggattatcatcgaaaatttcgtccaagagcgaagggccacatcttgcagagatgtggacagtgtagcatctgccacaggcttgtcaattctggatgggcaagtgctagatgagccatcatcaatgatgttatgactggcagtaatcaaatcttgtgatgatgtggtgtcaaaagactcccccaaggatgaaacatctggctcttgtaagggtactagaggtgcagactgagcagcacctgccacaagcttgtcagatctgaatggagaaaagcacagtgagtacatagtatatcctacaaaaaattcacatccaagaacaatcgatcactgagcaatgcctaagtaaggccgagtttagttctaaattttttattcaaacttccaacttttccatcacatcaaaactttcctacacacacaaacttctaacttttccgtcacatcgttccaatttcaaccaaacttccaattttggcgttaactaaacacaccctaagctgag

SEQ ID NO: 54905 - DNA, 8384 bp, Oryza sativa
tgcttttcttttctctttgtgaggactttcgaattttttttcatttttaatttttaattttttaatatttacagaaatattataccatccaaaatatttacacaaatggccccttccacccaagtggagagcgataaaggtgtgcgcattttgcattgaggtcattttgcaagagggtaaatacaattttcgccttaccaaaaatatatttttctagtttttttttttcaaattatccggccctcaactcaccctgccgccctaaatattttcaccgtacaatatttctataaatattaaaaaataaaaatttaaagatgaaaaaaattcaggactttccgaatcgtttgtgggccgagaccagagaaacagagcaggctataagtctatttgccctcccccatctcttgctctgattgaatcacctcactcaagtactcgtactcaaccaaaaatcggggttataagtcgtaacacctcccccatgtttaagaaccggtgcaaatcgaaccctttcagtggtttgggaagcagttttttttgttgacgtgaggtgggattcacatgtcagtgactcttctatctattctctctcaaggtagaaggagggttcctgaggcgaagggaggcgatgagaatcattgacaacactataatttttagttgaaataactatagagtaaaattcacaaaactacacatatgttgatcaaattgtcacaaaactacagatttaatgcgttgtatcataaaactacagatttaacatcaaatttataaaaaaactataaatttaaggtcaaatattacacaactacatatttaatattaaagttattacaaaactatatattttagagttcaaaccctaacactaccattatgttagagttacaaacattatagttttgtgattaaattggtactatacctgtagttttgacatatatttgctacttaacctatagttttgtgacttttcatatcttaaatattccaattttgtgacaattttgacactgaatatgtagttttatgatacaacactttaaatttatagttttatgatattttattcaaaatatttgtagtattgtgaaatgtactcatatctataccatgttaaagaaaggtccgagggtccgagggtctagcttcgagtctcatcccttaataaatttcaatacaagagtcatacccaatgttttgtttaatatctatatcgtttaaatttcaccataaataacctagttgaatttctttacatgggagcaatcaaaggtgatcttgtatgtatagatggccaaatgagccgtctggtccaggcacgactagatacaggcctaagatcaatctggccggcacgggctcacttacacgctgggccgttggtgccaaaaccccatgtcatggaccagatcatcggccccagaccatttggccatctatacttatctgggagcggctgctttttcacgagaaaaagaaaaatgaaaaactgctgaaatacaaggtgaaaactgaaagaaaagagaagaggatggatggaaggcgagcaaagcaaagaagctgttagtgggcttccttcttcgtcctcctacattccctcttcttccctttccccctccattagtactaagtactaactctagtttctctctctagttagttagtttggtagaaaattaggtaggcttttagcatcaggttggtagaaattcgaatccctctgcgtggacacgtagcggggagaggaaaaaaatcgaagcttttcatgactgcagccatcgccgcagatggccaccaagcgcgcgtacaagctccgtatcctcgattcttcttgccgcttgaatcctcggtttgggagttttagattaaatttgagttctttttttgggtcgagttgttcttgccctgcctgcttatcgttgtatgtaatctaggtttctgatcgagttggggggagtccgcgtgtggtgatcggtttcgatctgcgctcatgttattttctttgtgctgttcttggtttgatgattgggtttatcgcggtacgctgctgggattgatttggtacgaattccaatgagatgagacgatttgagaccatgtgaactctactgttcagctctagcagatcttccttttgtatgcgtgtgcaagtattatgtagttctctgcttaaagccagactaaattttgctgttttttttttttgccggaatgaccgaaggaggtcattcaatgtaattaagacggaagaaaagattacaagaaaagttttacatcgacagttggctgtcgagaaaggatgtgcaccagagcacacgccccgaaccatgtgccaaccgcctaaacacacgctacagagagggaagtccgttacccaatccgaatccaccatctgaacatcggcggcacatggcttccgccacacccgaactgacgcccctccgtcggccgacttcatcgaaccaccatccctgagagctgacccaggacccctccgttcaaccacccaccggcctcctcgccagatctggccgaaggagaacctgggactaggtggcattgcttcagcagcctgagcttcccccactgacaagctgccgcctcaatccagcttagaaactccccacaaagaaggggaggagctctaggaagggcgagggtgccgatcgacaacgaggaaaacgaccaaccgccgccaactccctttgcattgccatctgggcctgcaccaatgccagaaacgctgccgctccggctccggtgccacccgccggcgccccctttgtccggcctccttgccccacctagccgtgccgcgccgctactggccgctaagggcaccgcggcagcccagctgcccgaccgtcgaggcctagccacgccatagggcccggcggcagcgaaggcagagccgggggcggggaagacggcagggtgttgaccagcttccgcagccgctcccaaccgctgccgccgccgccgcacggttcggccgcacgccgccgccatgcacctcgacggcatccgcatccgcgtccaggccggcaccgccgccacgcaaccggagccgccaccgccgccgagctgccaccgtcgccgagccgcgacagcgccgccgaggcgccaccgccgcccctagccgcctcgcgccgagattcaggcgaggatggccggatccggacttggggactccggatccgccgcctccccgcaccgccccaacatcgacgtcgccaactccgaccgcggtgggggtcttcgtttgttttagttcgagagaataaagactattattagtgaagttttatttcaaaaataaatattagttagagcattgagttgtcatcttacaaaaattgactcctgtattatcttctgcttggatagtttctgctgcaaataggatcacactagggtcagatgctgacacttaccatgagaaaaaattggatggatgaattaatcaatacaaaatcttcaaatatttattatgtgtagctcttttctttaagaatttagatggtgagatatcatggataatacattcactgaaatgaacatggtttaacccgaaaagcattgttatgtcagtaaattgcgttaccttgttgaaatgtatattttgaaatacccttccaaaaaagtgattttctgaagcaacactgaaaattgcccaaatgccaaatggtaatctacaacagccaaccatgtttccttgacaatggccagaggagtttgttgcgcatgcttccgatgtcaactgtgtcaagtttgggaggaagacatcaagaatcctcatcactggtggggaggaccaaaaggtcaatctttgggccatagggaaacccagttccatcttggtaatattccactggcctctgaaaggtcaatcgttcatgtgtaatacttcttttttttcttccttgtctttgttactcagttttatggggtctttattagtcagtttgaaagttacatctcttcttacaagttaatgtcactatgaattgcagagcctgtcaggccttacgagtccagttgagtcagtgagctttgactcatctgaagctatgataggtgctggagcatcaagtgggacaataaagatatgggatgtagatgaagcaaaaggtacgaactaatatggataacaatttgctgcattattcatttaaagaaacacttcgctgcatttaaaccgaagtataaactgtagttgtatcacacaactataactttgttaatttttttttgctcagtcgttcgtacttttactggacatagatcgagttgtgcgtcccttgatttccatccttttggagaattcttcgcttctgggtcttcagacactaacatgaaaatatgggatatgcggaaaaagggatgcattcacacatataaaggtcacacacggcggattgatgtgcttagattcactcctgatggccggtggattgtctctggtggatctgataactctgtaaaggtacaattctgaatatgtctattaatacaaggcaaacacaatcacagcactggaaaagaaataacatgctatgctgattattcgaaccattaagctgtcatatgtatctctcgggtcactgaaattgttttctgatcatcttgctagatctgggatttgacagctggaaagctcttgcatgactttaggaatcatgaaggcccaattaactgcttagattttcacccccatgagttcttattggctacaggttagatagatgatcctttattataacacttgtagtagatgcattcactgtagtgtactagctggcagtttgatgacatgttttcctccaaaattatgctattatgaatattattatttctggcatggatcattgttgactgatgcttatttgtgtcatctagacttgacagcctatacattgctttcttgtttcaaaaatatttgcaggttcagctgataagacagttaagttttgggaccttgaaacttttgagttgattggttcttctggacctgaggtattgaatatattaattgttgtatatcttaaagcaattcaagttaatgttcagagtttgagccaatttagatctataaataccatcgctatgtagcgctctgtcatactatctcctatatatgagggtctcatgtaagtgttagatacatgtcatcatgttcttggcttcaaagagattcaattaaaaccaagttccagtaatctatttaagtttatggtaattctgcctaaacctggtcctttaaaaggggataaaagaacacagcaagtcaacattaagcagtacttctgtgcatatttggagtcactaaatggtaagatatcaatctgaccagtgattcaggcatccagcatgtcaaaccaaatgatataatcatacctgaaattctctctctgcaaatagctttcaagagcttatataatttaatattcatttatgcaaaacgatatgtcagttcaagtttttacccacgttccttaatttgtacctttggaccctaatgttttgtcagttagataatacatacccatccttaaagaaaagattgattgtaccttgagctataccatgagttatttcaatctccgctccttatcttcttgtttcgtggatgtaactaatatattctgtttcttgcagaatagccgggaatactttgtgccagtacgttgatccttaatccattctatctatatttttctactcaaatggatggcagtgctttctgtctacaaagttctcgatgtaaatgaaataatcaatacttatcttatctgcatgtactcttaattttcaggctagtgtagttcggtctatgacattcaacaaagatggtaaatcacttttttgcggattacatgaaagtttgaaggtaactgctctgttggactgtcgatatcctctgaagctttggaaaatgacctcacaacagattttatttatttattttttttacctgtaggttctttcctgggaacccatcatatgccatgatgtggttgatgttggctggtccacattaggggatctaattgttcatgagggaaaacttcttggttgctcatataaccaaagttgtgctggaatatgggtcgtggacttgatggtatggttctacactatttactttgttaccaattgggcagttctgatatgttacttatcccaaatttcagaaaattgaaccgtatgctgttagcattgctgaagcacatttgaatgaaagcgtaaataggtcaatacaggctgataatagcatatcatcagtgttgggaaggttatcagtttccagaagcccaggtaaacaattatcatttggcgtataacatcaatataatttttcttcatccattatccttgagttatgattcttcaccctaaaactatgtatattttgctatttctcgaaaccgcagccaaggaagcatcttccgatactttgcttaaactctcaatgtctgcttcaaaagaagttcctgttccagcttcttctgcagtgacaaagaaactaccaaaagaacctataacaagcaatattcggctcacaagatctgattctctaccagttgtttctcctagggttagattgaacccaaagttctctgatgaccagaagaggcagacagattatgctgtgcctataacaactccaagaattcgctccaaagtggatctctctataggtgctagagcattccatcgtaactcagtaccatcggttgctcccacaaatagatccaggtccaaaatatctgcatatagtagtgaaggatcgtcgttcatccctgttgttgtccctaggcatatccctaaagtggattctggtcccaatctcagtaaagttctcactactgatttaacaattgtcgagcctcaagacatagaacgaggtggtctggctgtggattgtggagaagatgataaattggtgtgtgtgattgattcaaggagctcaaatatgggtgtacaaaatggccgtagaagaaaagccggtgatattattacacataaagaaaccccagagactgctttgacagttaatatggatcgtgacttcagaagaaaggctcctgaaactgaaagtatgcaacaggacatatttcattcagagcccattagttcaaaatgtaaatatattaaagaaacttcaggtgctggagacattaacttgtctgggtcagccattactgaaagtgtcaagtctaatgaaggtggtgactggtataatgcatcttcttttgtaaaaccaaatttgactgttggaaggaatccagagacttcatacatcaacagaagaacaatgtttggattgagacattcaacggattcaagtgaaaaacacgctgttgaacatggtaagtgttcaaaccgatatgttattatttctctttgtttcccttcaacttaccttgctctttgttgggaggacagggccttccaatttgtctgcaagttatgagagaaatcagtatgcaccaacactacataacttggtatgcatactccaaatttccagattatgtcattcacgatgtatttattcttatgttggtaccaaatccatgttatgccctaccttattgtttctgcagaggaggcgctcttcggttgctagagaacagagtgcatcagctggtgatgaagatgatattgctgatctgatggaaaaccatcaagaattcattcatgcagtgaagtctcggctaacaaaactagaggttataacgagtatggtcatctatagcatctgctattttgagatacctcgagtaacggtaatctcaatgtgttatgtgtaggtggtttacaggtgttggcacaataacgatgtaaagggatctattgatgctacacgcaggattcaggatcttgatgtgtgtacttcttaattaccatcctgttctgttgaagttccatccattataatgtctgatgagttctaccacttttacaggttaccgccgatataattagtgttctgatggagaatgataattctatcacactagatatttgtacttgtgtcttacctcttgcctccagtgttcttgaaaaaagcagctatgacaggtacttttccttgaatatattcttgtagcatttctcttagtaagtatgcattgacatctcctattgcaggcacctgaaagttgccttggagatgatccttaagcttgtgaaaagctttggttctacaatatcttcagctgtgtcatctactccaccagttggtgtagacattgaggcagaacagaggtaacctttcttgcctctcattttcattgcatctaaatacattgctgaggcttcatgtacattacaatggttcaattcacacatgtgaatggggtgcagga

SEQ ID NO: 54906 - DNA, 1356 bp, Oryza sativa
aagagtgacgaccatggaatgatggtggtcttgatagcatagggggcctctgtggggtctggtctctggaatggtggtagcgagatcggtcatcacgatcttgcacatgagaacttgaagagggtgaaacaccagtccgaggaggagcacgtgcagtagacatttcaggcatctgagattgtctttgatcacccccagaagcacgggaaatgttaggagcatctggctcattacgttcttccctctctggagtattgtgcaggaggttggcatgaacttcaggtatatgagaatcaaattcagatctcttaaggaaagacttgagacacataggtgcagcacagataaaaatcccttccatcattttcacagtttgaatcttctgaatgcgctcatcacaactgaaaaaaatagttaacaaaagtttaaaagtggcaggcgccaaaccaagttgatctgtaacaaaatactagaagataacaatgctagctagtaagatttctcacttttagtgcaatatttcttgaaaaatcttatgagcatgtgcaacatttgattggcgaagagacacaaaaagtagcattccaaggcagacagcaacatgaagtgtatcactgcttacccagtgtccatagctattgatgtaaaagattaacacatcccatgaaagcaataacagaatgcaaacaagccatagtttattagtagtaccaaaccatttgaaattcatgcatactataatactccctccgtttcaggttataagacgttttgactttggtcaaagtcaaactgctttaaatttgactaaatttatagacaaatatagtaatatttataatactaaattagtttcattaaatcaataattgaatatattttcataataaatttgtcttggttgaaaatgttattattttttctacaaacttagttaaacttgaagcagtttgactttgagcaaagtcaaaacatcttataacctgaaacggagggagtatatcttatgatctactcagttgaaactcattttggtagaaaacttaacaactgaaggaaattaacacatcaatcaggaattctcagagatcatacgagaaacttcattccatacagaaagatcactttgttactgcatgttatcctactgagaataagtcaataaactaacaagatcaagttccagaaagttcaggagaatgcttacagatagcagctggaatcacttctagcacaggctaaacagaaagcatgttcacaaggaatctgaaataaataggaaaaaaaaagagatgtcataacactatcgtagggttcaccaaacatatagtaacaaaagaactatataaagttaat

SEQ ID NO: 54907 - DNA, 4482 bp, Oryza sativa
ggcgccggcgccgcctacgccgccgcctccgaccccgccgccggccccggccgccgcgccggacgcggcggcgccggagtccgacgagccgatcttgatgaggcgaatgtggagcatgtcgctagggtttctttgccgcttctcttctctccagttgggtgggggattttgtttgtttgcttgcttcctcctttcgttggggcctttcgttgccgagtttgggccttttgggctgcactttggcctgctagaatgtaaaaaaggctttcggcaaaatttaaccattttgggcttgtttggcagagctccaactctttagctctagaagttggatctatagtggagttgttgagcaatctaaactcagctcaactcatattttaggtggagttgaaactgtttggctgggctttagctccataagagttgaagctagagttggagccgtaccaaacatgcctatttttttataaaaaaaatagggttagagtcgtaattgtagttgaaaataggggtgtcggacacaattgacttaaatatgtatatattttattttgtttggaactaaaatcattggactttggttaccctgaactaatccatttgtcctaaaataagttcattaccaatacaaaccaaacaaaaattagaatactcctactttatcaaatattatgtgattatttttcattttatttatttccaatgcaattattcctaattgcataaactttggtgtaataattactcaaaatgcacctattttggaacaaatgggagggaaatatgaactaattgtggaataaagggagtatataaaattaataaaaaaagatttgggattgtcataggaaacttaacagggttagttttctaacagtgaaagtacatgtaccaacctcttcataaaaaaaagacagccatttcttttccatgacatgagagtatagatggccatctgggctgcccagcatggcatggcccaggcccggtcatgcctgggctgaggcttgtcgggccggcacggctcgaccgacacactaggccgtgtcgtgccaccccaccggcggcatacacggcccaatactactcgggccgtgacgggccggcccgaaggcacgatggtccatcgtgcttcctcagagaaaaagtctatttttggtccctcaactctgtggggtgtgtttaaatggctggaaaataagtctattttgtatacctcttgtcttgggccttgccttagacgactatttaagtctattttgcatctctatattttttttatttgatcgggccatgctgggccagcccaccgtgccgagggtgcagcccaggcacgacccggctgtcggtatcccgtcaaaaacttccagggtaaaaatttccacttctcatgccgtacacattataccctaggagatcatgtagagaggtcatcccccaatttgctgcaagcctgcactgctgtctctgctgccggcaatggccggacaactcacgatggcatccttacaacttcaaccactgcaactgaattcattcaaacccatccgattcctgtcgttagatggtagcatctgtaaatgttcttggaatatccgtttcaaaatatatttatctgtcattgaggagatcaagatggagtttttactgtagatatatttcagactttgtccccaaatttagtgctttgattgatgaatgccatggagtactactattaggtaagggtatgccttgtcctttctcattaagtttttttcaacaatttgcagtttgccgtgttcatagtaatgatgcaatttggcattttctgttgtgaatttggacgtgcaatcaatgaatgaataaatgaatacatccaagtttccaacaatttgatgcctgttcagtagtacttcagtcctcacatccccttctgttctctctgtagatgagatgagaagaagagaagaacatgagctgatgaccatttcattagttctcaaaaaaagatgaacacttcatttccaatcacatcttctattatattcctgtctgatctctgaattctatcctaacctctgtagaaaaaacatgcaaggacattggtaatttagttgaacatactagcaggcttccaaaagcaagttagaaaatattcctcatgccacattgccactttatgccacgcatgtattcgcccataaccagacaattcacacaaaccccatgatctactagaatttcagctggctaagttggcaagattcagtcactgtgccagtaaagggttgtaattgcacaccaacttcagacgcttcatgtcattggattaaccagcatgctatgccgtgctgagaagggagcctcacctgtctcacatgtcttcccctctgaatgcagcaagcacaagatttaagcgcaagcagctgcttgctctagtcgtaaatatttgacgtttagaacaagactcagttaaacttttaaaattccaaacaaataaaatggtatactttatttgccttgaaaagtacgatcgtaatattataaaactaacacacacatcacctaacactacgaatctggacagggagttaggcggtatctaatctagtactatgttactgtattttaggatggagggagtattagattttatatacttgcttcaatgtggaattggtggtcggaatttttgaagtttgacgaaattttgttctcaacaaataaatgtatttatgataggagggagtactggtgtactaccatcctgggtttctcttttaatttattggatctcttcagtcatggggctggctcatggtggcatcatgccatcaagatttccatctacttttgccaagatatttcctgcacaagattactactactatccacttttgccaggatatttcctgtaccactgttcacaaagatatgacaggttcctgtgctttctatcctttcatcaaaccgtatgacatcttgtgcccagttgctgctgttgcacaatggtttcatttgtgtttgttattgcaactgctcactgcattaacttctatacatgtgatctgcagctagcatcgtctcagctcatgctgctgctgccaccacacctagggtgtgtttagttcatgtcaaaattataagtttggttgaaattggaacgatgtgacggaaaagttggaagtttgtgtgtagaaaagttttgatgtgatggaaaaattggaagattgaagaaaaagtttggaactaaacccggccctatccattgcaatatttcattgaggtcacagagaaaagatggatggggatcaacccattatcaccaatttatgttacaacagtatctttgctttttcaaacagttacagtaacaaagccctgaagatagaacagcttgtcattactgatgaacatcgccaaaccgcttcttgacaggccacaggatcttgttatgttcagactaatcatgggtcatggaactcgcaagtagcatatatacagtttgttcttgtccaaactccaaactgcatactgtatactctcctgacaagatagaatagcttgccattactgataagcattggtgaactgcttcttaacaggccacaggatcttgtgatgttcagactaatcatggatcatggaaatatcaagtactactagcatatatacagtttgttgctcttgtctgcatacaaataaactctcctcacatgataaaacagcttgtcattaattacttatcaacattgcaaaattgcttctttaacaggccacaccatcttgcaatgtgtttagattaaatgatggatcatggtacaagcaagtagcgaacagtttgctcttcaatactcataaatatcatatgtcctttcttggatgtttttctcttgcacaaccaaactgcatactgtcctgacaagatccttgtgaaaatcttcagtaccttgctgccatatgcatcattgccaatctgtagcagctgtagctccattttggacaaacccactgctgcaagatgccatccaaacaaaatggaaccatcaaatttccaacttgaataagttgttactactaactgcagcaagatcagagataagacagagacctgaaactaagcactagctaaacttgcattcagctgctgatatacaccttgatattagtaattatcaatacaatacaacaacacagcttgatcgattaattaagcattgctactactataacacacaattatcatatcagatattcaggttcttttttttttagttcagttttagcctctccctctctctctttttcttcctctgtctccacttgttcagttgaggagttcagagtttcagagttttcagaagccgtgtctgtctcacgggtggtcaggccggcggcaggtcgtcggcggcgtcgacgacgtaggcgcggagcgacggcgagcgcgcggcggagaggtccgccccgcggccgcgggcgcccttgccctgcacccgg

SEQ ID NO: 54908 - DNA, 4230 bp, Oryza sativa
tttgttgctactcgtgtgtaattctccatagttgttttatgttctattacatgtggtggtgaaagctgataacagatgtataataagcagtttaagagattgacaaaaattatgaaaaatatcgatcaaacccatcaaaattcaaatttaccgcttttttgctggtagtttttccgaatttattgttcctcatgtataattatcaatagttgttttatgttctagtattacatatactagtgaaaactgacaacagaggtataaccagtttaagagattgacaaaaattatggaaaatatcgacgaaacctgtcaagattgaaattggcccatttttgcttcaaatttctcaaattcgttgtttctcatgtcatgttctatacatgtacttgtgacaacagaagtaacagcagtaacacatggacaaaattttgattttgattttttggtcttgggtttaaattttcctgatttgttgttttaaaccctgatttgagttcactggttgcttcagtttatgagctgtaaaaaaagttgaaatttttacctgcaatgcccagtagtggaagctgatgtatgacatgggatacctccagaatggctttgggatgtcatggggaagcctgaagtatcctgaaaccagcatgaatatcccctgtccatttccaaaagatatttttctcttcaataaatgttgttgcatgtcatgatcatgagagaatattaacaaacatcaacattatgttgtgcagttccaagtacagtgtcaaaatttaatcccagtttgtatgcgttgcaggactccaaacagtgcctgataaagatggacaggatcaagttgttgtgatggatggtaattaattcacctgaattcctgcaccgatgatgatgcccatgaggaagttggggatgacactggcaatggccatcatcaagctctcgacgacggtgacgcttgcgtagaggcagaggacgaagaagaggtagtgcgtgaagcccgggtggaggcgcaccatgaagtagcacattgtcccggagatgaaggtgatcaagatcaagaatggcattgccgagatcgtgttgcttatcacgaatgccagcacgccatagtgcccattgagcctctctctctgaaacacctgaaagagcataaaaaagattctgtgagcatggtttgctgtaatctgaagaacttttctaacccatttgttgattcagtggtgacacaaaccttcatgtcttccacaaaagacgggaatcctccaatcgacatgaacgtgacaaagccgaagacgaaagaagcacatgcacctcttgcctaattgttttcacagttttatcagatcaccaagcttaacatcaagtattcagttcagggtagctagatacttttcagtgtaagtttgcatccaaatagaagtgacaactgaagaaggaaatttttaccagaattgagctgtatctggtgccaacattgaggtagattgtcccgatgcagactgtcacaacaatgtagatgataagcctcagccagtagtacccgaagtcccgcgacatgttgatgaacgatcgcttcgtgagtgtgaaagcctgcatccaaaagctagcctggctccctcctgcatccagcactgtccctttctgcaacaaaaataccatgtgagtcctcttagcttgcattacaatggtctagctgtggttgaatgtttggggaagttgctgtagtaatctagttacttacaacccgtgccatctcattgactttctgctgcgcagcaaagtagtactgtgagttcttgtagtaggtgatcagccttctgatggcctccgaagtcataatccgatcaagtgggtcatcggatctttcaaactatgtatgcaaaatgtgagcacaatttcagtcaaggcatgcacaggtaagagtgccagttgtaggtactaggaggagactgactgaatcctgaaacttactcttctcttcattgatcctttcagagtggccttcaccttgtcgaagtctgcgtttatgcatctgaggaaatgatccgatggattgcgcagcggtgggcaagggaagccggcttgggcaaagaactgcaaaatgcaaagaacagtacatgattcagggaacccatatagatattagcattgcagaagcaacttaatagagtttgtgaaaactgacatacctgacaagcttcagaggccagcccaaagtaaacagttttgcctcctgaaaggagatacaagcggtcgaaaagctcgaaaacctcgctgctcggctgatggatcgatgctatcactgtcctgccatccctcgctagcccacgcagtgtctgtgtcacgaagaacgctgaagcactgcaacagattaatcatctgcacatcagttacttagacagataattgctactgtaacaattacaatcacttgacaaatgacaaggcatagtaaccttctgatagttataccaggaatgagtttgataaacactactggttgaaagcaaagcaaggtagagagctgtgcaaatcaaatctccacatctcaagttcagctagattgctatcatgcttgctagatagctagattgctatcatgctgggcctggatgtaactaaatgtttactttattttctcccaatcttaatgaaattggtcggccagcctttggccgacccggcatgcttgcatgatccattaattaatgtaataacaaatgatttgccataaatataatagcagtacctacctgtcaaggccactggttggttcatccaggaagagcagcctgggcctcatcagtatctcaagggcaatgctgaccctcctcttctcaccaccactgattcccctcaggtgccaattgccgaccaccgtgtcggcgcagtcctgcagccccatctcgacgattgtgccctcgacaagggcgcgcttctcttccatgggcatcttgtcgggaaggcgaagccgcgccgagtatgagatggtctccctcaccgtcaatgtgccgatcaagttgtcatcttgggtcacataggcctgaaattacatattttactgaaactttcagtaagctggagcctggaggtaacttcttttgttaccttgagattattactgcatcagacgaagtaagataatatatgcacataacttcaggtatcaccttatcatttttgacaaggtagaactttttacatacagaaattttgctctttttttccttgataatactttatagttattgattggtacagaagttaaactacttcctacatattaggttgacagttttgacagaaacaaatgaagcacaactgcacaagtcatgaaaaatatcagcaacaaccttcttttggactatgttttttcttttaaaaaagctcctgttaagtcataaagaaatgattttggacaacatggtgacacacgctacatgtacaacaaataatcaggattgtcaacagatcatgagtttttgatgagcatagtttctgaaaaaactggtaaaccacatcccatctgctggggaagttcctagttttccttgccaacaagctagatgactgaatgagtgttaactccattaccaaacacatacctgaaagagcttttttttttcctatctaaaaattaacaagcagaaactagttaattgattgagccagatcccccaattaatcttggccagaaatgggtgatctatatccatgaaagggagttattaatgcagtaaattacatctgcagagaggcagtctgtccaaacacatgcagaagccagaaagcagcaaggttccaagaaatggcacgtggcaacaacaaaaaaatgacccatttctttctcattctgaaatcggttgttcaggtgattcagataaagacccaagtaatgaaagcaacagaaaggaaaaaaaatatacaatacacattctaatcaaacacacacaaaaaaaaataaatcttcttcaagaaaatgaagtactgcaaaaagaacacacacatattccatgttttttttttcttttgtactacaagtattctccctgtgtgcagttatacttcaagaaatgaactacttcctccgtttcacaatgtaaatcattctaacttttcccatattaatattgatgttaatgaatctaaatatatatgtttagattcattaatatcaatatgaatgtgcgaaatgacagaatgatttacatcgtgaaacggagggagggg

SEQ ID NO: 54909 - DNA, 2510 bp, Oryza sativa
gtgaggtcgcgccacgccaggcgcgcggacacgtcgccgaggaattccgccgccgccttctcccgccacagcgtctcgctcagcgggctcagagccgccaccgcccctcccgccgccttgatccccacgtcctccaggtccgccttcaccatccccgccgccgccaccgccgccgccggtactcctcctcctcctccctgcttcttcatctctccctctctcgcttgctacgtccgtacgacgccggcgacaccggctcaccgtggcatgcgatgcgagagctagtgatggagctagctagctagctaagcaaacaccacctatgagggaggagaagaggaggaggtggtggatataaaggccagtaatggaggagcaggttagagagagaaaatctagggagagaagctagagagagaaggagatcaggtgcagaagtaatgaggggtgtaggggtttgacctagggtcaaggtagctagctctagagagttggaggagtagaagcagcagcagcatgcatgcaatatgcaagcatgcaatggagatgaatggcatgtcataagggggggctagtagctgtttggtgtgatctagaagcaatgcattgtgcatatgcatatgcaatgcaagcacaagagaaagggcatgtttaattcaagaaaagaaatgtttgggtgtcacatcggatgtttgactggatatcggtaggggttttcggacacgaatgaaaaaactaatttcataacttgcctgaaaatcgcaagacgaatcttttgagcttaattaatccgtcattagcgtatgtgggttactgtagcacttacggctaataatggacttattaggctcaaaagattcgtctcgtgatttccgcctaactatgcaattagttttttttattatatatttaatgctacatgcatgtcttcaaagattcgatatgatgttttgggactaaaccaggccaaagagagagaatagattggtagagatgaaggaaattctctgacttagctgtatgtgcaattgagccactgacatgcgggtcataacgaaagtggaatatacatgtcagtggctcaaccgctggattcttggccatgtaatgcatgcactggattgcaagttgttgggttgtgaacagccatatggtatctcatcactatcatgcatgcaatgcagccacacacggtttaggttctttctgctgcacaaatgctatcccgaccatggtttcttgttatagtttttttttttcatttgcaaaagagagtattccctctttcagaataatatcatttatggtttattttcagttatcctaaaataagagaaatgcccagggttttccagctagctccacaaggtggtgtgggctagacgacctgggttcgaagcctcaccccttctaattatttgataataggtccttccctgatattcgtgtttttaattatcctaaaataagtttatttttagctatcattaaatcaaagtttctgaaagcagtggataaatgcattgggggtggataaagagagaaataattgcattgagatttgataaggtgggggtattatattattattattattattattattattattattattattattattattattattattattattactattattatatatgagatgggtgaaaataaacttattttggggccgagggagtagaggataaggtttttattttacacctagtgcaatggtgcctatcatttacgtgcgattaagattttatagcaaaagttgagaaattgttaacatcgattagaatgagataaatatttaatgtttaggtcaagattcagttaagcttttaaaattctaaaaaaaataatatattacaataagttttataaaatataaaattccttatgtccacgaattttcgccaattcccttatgtgcccctaaatttagcctcatcccctatatagccttgagtttttatttattttgatcccctccatgtctattccgtgagtcgatagttaaaccattagatttttgtaaaaatatccatattacccttgtctgttagtgtacttgtgtgcaagttgattgaaaaagacagcccttaacaaaaaaatgatttatttttaaaaaaacaaacataatatagttacttgatcgtaaatttgaaaacaggatgagataaaattcagaggtatagaagggattaagtgaaaactcatgtgcacataagaaattttctctttataaaatctagtgagcttgtgatatatatgatagtagtagtaatttttcgaggcaaaatctacatatatcatttattttgtttttaataaattattgatggttgaagtgtcattaaaagtttaactgaattttgttctaatcataaaatatttttaactggatagagtatatcgtgttcggagtataggaatttttttcctcgtgaagtccttgtgttctctaaaatcctagtgtgtaacctacgctgggttagatatgt

SEQ ID NO: 54910 - DNA, 2625 bp, Oryza sativa
agattcaggatgaatctctcatgcaaaaaaatgcagtgcagcccaagcccgggccctgatcactcaaactcaactgcattgaagctgtggcaggtggatgttggtaggcagcatgcatttactcattttttagtgctgttctgctgctagctgcagctgggactgctgtttactgtgcatgtgtatatatgcatggattaatggatatatatgtaggaaacctagccagtcttctggattctcatcaagataatagttttctgaactctcatttattcaattagcaattaaaatataatatagatagttatatatgtttaattatttctaggaaaatgacatgtttgtaggaggaatgtatcagatcaggtagtattgtcgccagtataatttatagcccatcctttcattatgctggtgaggttgcatatacttggattccatgttattttttttcagatatttttcatctctttaatggaagaaatgctggtggttgtgaaggagtatatgcacgcgttcgaggtcccgtgtggatcccagattcagaacagtgtttctcttaattaacttgatattgatccagggaacatctagcatgtttgtttctactttctctttcagtgtagtcgattaattaccagcgatccaattatacttctcataatctcatactcttattatgttttattgaactccgtgccatacacacaaatctcaaagcaaatctgacgacaaaccaactataaacatttgcattgcattgtaaattaattgattttcccttgattggttgactgctgaacagatccttagattaattcgagcttgcacttttgcagtacactgtaacaattccggcaaaaaagtacaatgtaataacaaacccacccaactctatcctgacatgggaattaaatctacccaatggccaatatattacagcaaaatagtgaccagcaattctgaactaagtactactgtttactgttactgcatgacctattcactctattctgatgttccaagataaagctatttctattgcataagatttatcttaaaagaagccatttcttcacttatcctaacatcttaatcaatcataactatttttcatttaccttcttattatatttttcctctcggccaattacaatcttctctcaatcattgccatctatttttctcaatatatgtgcaaaactttagaaatgcttgcatttggggatagatggagtaaataaatatatacaccctgtggcactggcctacatatatactgtgtcccctacacctggatcatgtaatactcttaggtggtgtttacatccagggacttaactttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggccttactttggcccctactacattgtgtatgagtgagatatttgcacatcaagtaccctgcagtttctgtgttctgatctacacagtagctagtgtccaattaactctggaagttaatgtaattaagtgctcttcataaaaaaccaatttaatgcaagcatgtttacaagtaaaaaaaaaccttctagatgagatagtaaactctcataaggtatttcacatgcatgagttctgacaggtagctgcaatggtgtagtagtagttgtgatgctgcaggggtagtatccatggctgccacactgcaagtactgcaaaaccacaggacacagaagtggagctcagttaattactgttgttttacagagagggatgatgagaaaaaatggcgggaaatgttgatgattattgttagtagtcaacattagtcttaaggtattaattaatgtgggaagcacatgtatagggaaagtaactttgatatgtgccctctctctcaagaaaaaagaaaaactttgatgtggtgccatagttagcaggattcaaattctgatatcacgattatacatatgtgagtgttcttgctagaaagttagcaaaatcaggtcacaagagtgaggtcgttcgtcggtcagcgaatatggtggcatatatagcaaaggagtgttgctccaagaaatgtgttacgacttattgtcggtgcctcccaatttttcttaggttttttttcttgatgaggattgtatccaacataacctgattgtataatttggctttaggtttatcctcaaaaagtaaaaaaaaagttagcaaaaataaccaatttaatcgttggtctctgtttttttagcgagtagagtatatacctagaatttacgacatcgattcctcataaggacttgaagaacttttaggtactaatgatgacaaagaaactaagctcatcacatcaacataataccattgttttttagatgt

SEQ ID NO: 54911 - DNA, 4938 bp, Oryza sativa
gtccatcacaaaacatctaaaaaactcttgtactattttctcaaacattttttttcactaaacatagttactaggaaaatggtaatggtcaatgttgcacaaaatggacagacaccatcagggaccaaacaaataaatttgagtagctagaacctagaagggagcagaggaccatgcatgcaaaaacacagcaatggcacaaggatgccactccaactgccagcaggcgaggcgtgtgtgggggtggaccgcggacaggcgccatccggccgtccgttctcatcatcgaacggctcagatctcatccgtacatttgatgtgctgccacactcgctatctaggtacgtagtaatgccttttatatgtccctctccctccttgatcacacgttgatcatttcattgggcggatagtacatcagatgagatgatatcactcatatcagaggaagagatcgattggatgttggagtaattaggacaaaagggttagtgttatgtttcgatgtaattttggattaattaaccaagctagattcaagtatgatatactctctctatccacaaatataaaaggttatagtttttttttgacaaattaaggatcaaaagtaaagactatgataccctttattagacaagagatggttggagagtgtgaatataaatctcttatatttttagacaaactttgcctcaattttccttttcctttgtaaaactccctttttatagttttctcctactttattcaatgaaattggtgtggtctaagtaccggttcgttaaaaaaagatatatttatagactgaggaaattaagtcagattatggttgataagtaaatgctcaggccgacatatttgggtaggagccatgtacaagtgagattgatgtagttgttctgctttgccaattaagcaagggctatgtgtacaaatgcatattttgctgaggttactttcaaaaaagaaagttttgttgaggtgtaaaaatgacaaacaaaggccttgctttattgaattttatttgatctgatgacaacacgagagcacatggtatatagccttaggattttccatggcagaaagccactcagctaatgctctcactactgaactgccaactgtagctaatctctacaaaaacaacagcacaaactgagcaatgcatttgagcaagcttggttttttcacactccgatgataacatggctcaatgaactcagaagcaccatcttgacagaatttcatatgaaatggaaacgtaccgatgcaaaggatcatggaaataggggctgatattgcagccctctgttctcaggcaggcccatcatcagattgaggttctggacagcctgaccagacgctcccttcacaagattatctatctgtggagttgaagaacaagaaaataagaatttcgcatctttaagtctgaagaaactagtttgacaatgggcataaagatggttgaagacgcatacaacagagatgatgatggcccttccaggaatcctgtcctcgaagacattcatgaagcagtaatttgatcccacgacatggcgcgtgtgaggaacagtgctgccatgtaaaagcttgacaaactcttcgccctggggaagatacaggtagataaaattgtgatgctaacaagaggagatgctctcactcacaacattacataatctcaaaacattttgatgaattcatttcagtagaaaacgtctgtattcaaatagtcagacagataatttagccactggtcagacaaacaaacctcataagtagacttgagatgctggtacaaatcaccggcagtcactccaggtgccatttcaacaaacatggtagattgcattccacgtttctgttcaacgtaaatatgaagaatttgatttaactaatgcacacactccaggtgcgttcaatacagtacaaaactgcagaacctggagttattaagtcaacaaaaatgagaaagtaagtgcttaccatacagatcagatttggagtaaaactgatagtgactttagatttagcagcctctgaaagtccttgttcaatctcgggagctaacacggttttattgcaatgtgtcagtagggccagtttaaaagcacttggagggcagatagccagatataagtaaacattctgtaaccactttatcgactatttgtttgtccaagggagaataaacaatttcgttaaagagctataacacagtaactacaacactgatgttgattccagctttttggaaaatggcaaaacaagggttaccatgacggtggccttttattccataagcatggatgccttcagctatctcagtgtaaagattcgcctccttcgctccacgtcctacacaaatgcatgcattagagagaaagattgactagtaatcatggcagatatacaaccactaaatttgtagccatagtagtacagtacgtcagtatctcaagttacatgcctgctccacaaaccccagattttgcatcaatgataatgttgctcagcttgatcagttttgcctgcatggtaaaaacaaatggtaaaagatacatcaatgccatgtaaattcaactgataacattttaaaattttgcatagagttaagggtttagaggagcatggccaacaaactttacactatggcaactatcctttatatgctaccaaaattggttagttttgtacactcaatgtgattatattttgttggtttcattagaaatcagagaaccatatatgactaataacttctgttaatcttccctcatcacctttatcagaggaacaagaggaagctgaatagatgtgggataacatcctggatttgcaacaagtcgtgcatttcttatttcatctcgaagaacttcagttaaaccatacacagcctcttgctgaataaacagagaagcaagccacagagtatgagttcataaacaaacataatttaatgatacataacttaagatcttactaaaagcaaatgctcataaacaacgctgagaactaaagatcttataaatagtagaagtgcataaccaacaccaataactaaacaagtatgtagggacaggtagccaggaaaacctgaagttctggtgccctatgtgcatgaccataccactcagcgtactcattgatatcacgcaaacggaaatcctgtaaagatggtcaattagacgtagtaagaatggatattagatagcatgaaagacaatatctatgcaaataaactgttagccttgtgaagcataccgcagaaagatcaacaatcttcagttgcttcggtaaacctttaataatttcctgataaaaatattgcaagcaggtatcgctttaaaaattcctccaatatgcagaatagtgtaattgtgacctctaaatgattcaggaattggtaggaagaatttcagagaagggcatggcaataatagacaacctgggttgttccatgtggcaagcaacaaaaaaccgcatcaacatttgaaaaatctgcatcttttattgcaactaaatttgggaggtcctgcatatcaaaagataaccagcagagtcttacaattttgatcagcaaaatgactacaatatggcccagaaattctaataaaataaatgtactaccaaaaggttcaaccgattcttgatgtgccaaggataaaaaaaactcagtcatttcttccttttaattttttgaagaaacaagtgtaggcaatctcgggtaccaaggagcatggatcaagaaaaaatcttacctgcgttatcaaatgaggaaatacagatccgaactgttcgctagcttttctatctgcggtcatcactttgatatgaaactgagggtggtttgccagaagccgaacaatctgtcaatgcaagcgtacttcaataattaacaaacagaaacaaaaaagaagtcgaagatctccatataggatatagtcatagaaaataaatgcggagccggatagaagaaacataagaacagaattacaagtacattcgttgaaaggaacccacttgtataagataacaacaacaaacgcaattggaaataacacgataaaatggaactacctcagctccagtataaccactggcccctagaaccgcaatctgcacctcctcccctgatttaacttgtgttgtcttagaagagtatagtttctgtggtgaagagacagatgccctcacacggagcgaagggcatccgacctacattgcagaaccatttgtattagtattcagggcactacacttattattttgaaaaatgggatgaaaaacatatcacctttggagtcgttttgagcatgaaaccactgcatgacttcaaattaagcccacagactcccttctacagaatgacaggaaaaaaaactcatttgattataattaaaacatatgtaatgaagaaatggcacgtataagttggaacaaggatgactctttatgaccaaccagatgcaagatgcagtggtggtggcagattactaagtcaaacttcttcaagttcaaccaagtttatatcaaaatatagcaacatgtaaaaaccaaattactgatacatcaatctaatcgtgtagaatgccaaacaccaacgttcgtaagaatccacacctcggcaaattcagcactgcttgtaagttgtaaccacacactgcctaagaaattaatcagcattgctaaaatctcgattctattcttccttttcgtttcagctgtcatattacatttcaaattcgcacaatcgcactaagagcaatcaattcaacgaatcaactcaaccccattatacacgctaatagcctggttagccaattaggtagatgctccacgatccccgaacaggaaacaaaaaagaagaagaagaaagaggtaaagctccacatagacaaccatgagatcaccatctcgagggacacccat

SEQ ID NO: 54912 - DNA, 877 bp, Oryza sativa
ggtagggatctttctggccaaggtgaccggggtgttctagcgcagatgcccatgccgatgcaaatgcagatgtcacttcccccacctccccctacacagcccccttcagctggacagcaaacttttagcagaacttgatgattatttatgtacggtaatttaattgttgctgtcaaaattggattgtacttatcgagaaaacggtggtctcatcattctgcgttgctgatgagaaatgtgttgtgccatgaacgatcatatccctaatgaaattcctattgagatcgaagttttcatgatgtttgtgtgattgttactctggatgatttaatgccattgtacagttggtgtaatctttacatgttgaaacgtcagaattcattaacctattaaaacgtttttggactttatctcatttcccatttcctggagatgctatagcagcagtggacttctctctctctctctctctctctctctaatagctcattacacttacaatcaactaaatagtgctcgcaaggtggtaaggagcaatatctgacgactgatgggaaaagaaaaactatatttggtacctgctttgttgcagtactgttgccctgtaattatataactctgaacttgcagagatttttgaatttttgttgactagtatttgattgcaaaccggatggtacaagaatttgctgtacatttgccaaggatgacctgtatgtttcctatctatatctttctctatagctgtctatctgttccaaggaaaaaagatgagtatttgggcgaaatatcgccgtatggctatcatatcatctatctgcttgtcagctgaaagatatcctgaagaaagaggcttagctcctgtgcagatcttcca

SEQ ID NO: 54913 - DNA, 3932 bp, Oryza sativa
  unsure (1)..(3932): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctacagtgatcattatgaaagaggaaagggagttgtcagcactcaacttattggtgaaagggcacaaataattcttgacgaagtcagagacctgtctctttttactcgcacagaatgcttgttgcatcttggtatctgagagtttaatttgttctatttgcacaaatttttgaatccttcttagtcactgacatcgataattatctttgaaatgcaggaaagtacttccgatctgtgatggaaggatttgagaaagatgattttgaaactgtaatattggatgtttaatctgcatttgtctttgcatgttgttgaaatttggatcgcttcactttggtcattccacattgtgtaggttgctgaggcagttcttaaggactatatttttgttcacctgcaaaacaaccatgacaaatttaatttattgatgtaagttgaagttttattgctcttttctgtgaatttctatccttttgaacctctttaatgatgtgtatctcttattacttttcacttcttagatttatgctgcagaaactttatgcgattgtagatcaaactgcgtcacctgataaagctgatgctctacagtaccaggaagttctcttgcctggccacctgataacagtttttctaaaggtcactaaaccctctgccgtcaagctcatgaccttttttttttcctttttgaaaatcaactccatagtactacaaaaatggcattcaatgttatgtgcttagtaaaaacaatactataacataaaatagcataagttttttgtcttaacctttctacccttgttcaattctctgcctctaccttctctgttacatatttgcatggactgctggaccatgaccaattgaccagtgttagttacaagatggatgtttttaaactgcttggagctggtgctgatgtgttccttcaagcataggtgctaaggtagaacaggtcatccagcacatactatgttgatagcttgagctagtagtcctttgcgttcatattgactactacctccgtcccaaaatataagggattttggaatcccttatactttggaacggaggtagtacttatttcacgctcctagtatggtacagaagatctaggttattaacagtgtaggcatggtagtggttacaggtagtacgaagatgtttttcacccaattttgctaaggtagtgagttaagtcatattttgcttcgcacttttgctgtgcctttgagcttatttttttattctatttgtttcatctttgttccctgtgagcatcgcttgacgctggttctttgatgtcctattttatggctgagattttgttggtgttgcttttgatttcttttctgacatccagttctgttttcctaactcttgtttttctttcctatcatctccaggatagacttcaagattggttgagaaagtccaaacggttaattgttgaagaggctacaaaaaataaaagctttgatctcaatgactgtatgtttactctatccatgtttttatacaggaaccctttttagttgacctgtgtttctgaagtatactacatcgatactagaatccactaatgatccatcagcgagtgaatgctagtgatctttgcattcatatgatccaacaagtcttcatatggccagagacccagagttgtttatgggttccaacatctggtgtactctttataggagtggacgaggggtagcctactatcaccactgttgttattgtcttaggaaccaaggtctagacatgcttgttgggactaatttccataggaataagatcagtttggttagtatcacctatttccataatattagttactccctttgtcccaaaatatagcaacctagtactggattagtcaccacctagtattatgaatctggacagagaggggttggacagagggctctgtccatattcgtagtgctaggtggtgtctaatccaatactaggctgctatatttttggatggagggagtagtatatatgttaattagtatcctatattttatagaattttttggtttagatagcaagttaaatatttgatttgtttggaagttagagattttattctggagggtcaagttaaagggacatcaagagttattgagacatctagtggaaagccttgctggctgatgaggattgggggtagggttctcatagcgaggactgggtgtaggtcatctaactgctgttttgagtcttcaacttttgattctcttggctgaactataatgggtgcgtagtgtcctgtttttaggaagcctggcttgatccttaagaatataatttctaccatcctaacaaaccaaatctctaactttctatctgaacagattacattttaacattatagaaattgctggtactgaccaatctaatcttatttgcaatgaaactaatcacttataaactactaacttgttgctgcagtcatcacgcctagaccttggacccctaaacaggcttttgtctaataaatcgtgttgcatgaacactgcattctctgcatttatggctagtattggtagttgtacaagtatgctaaactcttgaactagtaatcattaacatgacggatcagaaactacagaccacaagattaatcctaacagcagatcccataaaaataccagctacaacttttataacagttacgactatttttcttttgtgcagcacaggaggtcaggaaatttctcagtaaaacttcagcatatgttggcaaagctattcagagtatgataaaggtcggaaaagtaaattcacaatcagggctagatctgccacaggtgcatctcttacaaatgcttactgcatctggtattttaaataacatttggcgataatatactggcaaagtcatatagcataaaaacacatcgtgatgcactaattgtaaaaacaacaaagaactaaatcaatttgcagtgaagtgatttatagtttactcaccttttcgtgaggtatatattttttctcgtgagtgaatttgtcgatggttttccttgtttgctctggtttattgcatcacactctcccttgcatgtctaagtaacttccctagtaactattatctcttctttcaaaggtatttgagcagggatatcatgtccaccctcctatttttcgaccttaattctttttcacactcaattacacctattaatttctgagggaatattaaaaattacgtaatgctgtgtatatgtcaacccttcaagtaagttttcaagatgaaagataacaatatgcaaaatgaattacgtcaaaaactgaaaacgatctgttcaaaagtatcactgctcactacacattatattgagttacagcagaaggtatcatgctgcggcagcacagtgctggagatggccatggggtaccggccactaacccaccgcttcaatgctggctataggctgttttgaaataatgaaggcatcacttacccacaatttacattttagtttttcagacaatatatcccaagtaatttgttggtaactgattccttctcttctgattaagagatgcttgacacgagtcacagattatgatatatgttcgtagtaaaatctcttggcaagaacgttcattttcagttaagttcaatgttgtttgtgttcacagtcctctcagatcatttttatatgtgataagcaccttttaaaatttgcagcgagatgggatgaccattcatgctgaac

SEQ ID NO: 54914 - DNA, 13707 bp, Oryza sativa
aagtttaaaattgcttccacattcaggggtctgctctctaatactgctgttatttttcctagatagtttatttttcctcaagttctatctcatatcagtgcttttaattctgtttagattccagaggatttggaagtgggttatgtacccttaagccatggtggggcttatcctggactataccttttcaccaatccagctagatttcttcgtccggtcagaagtctcttaggtctatccaatggagggccaaatattgagctgattggaccatttgaacaggttcccttttatccacttcaatggtcctatattagtttattattacaagatgactaatttttcattctacattaggcattcatggaaatacgatgccctgatggtggggatggtggaagaaacaaattatttcctgcaactcatgaagaaatccaccctacagccattcttagtgtagttgcaaatttgacaccttggtctgatcacaatcaaagtcctcggaacatgtaccaatgtcaggtcagtagccagatcttcccttactgtaaatcaatttctcatgcataatgaaaattgctcacgcataatgaatgctgagaccttttttttctagacctgctaacctgcttgcttgttcacagatggcaaagcaaaccatgggattctgtggccaagctctaaaattccgtactgatgtaaaagcatttcatctacaggtttgttttcctgtgcaataattactaaccaactatcattagctacacttctttggttgttagaagttgctctatttctgttgaatatgtacctgcccaataacatgttgacaaccttaggagcaaatggtttgtgccatgtaaagataatttgtggttctgttgtatcaagtgttttaattggtactattttcatttattggtggcagatgtatgtcatcctgctcttggcaggtttgctaattttgtgccttttgaaattgtcccaaaatcaatgaaattgtctgtttctaagtacttaattatgtgacaacatatcatgcagaaatgattgcattgaaaatccttttttataaccagtcaggtggctcatataaatattttttcagacccctcagacaccaattgtccggacagctacatatagcaagtattgcatggatgagttcccatccggaacaaatgctattgttgcggtgctatcatacacagggtgagcatttcattatgttgtgtaatgatcatttgtttgaactttaacatgataaaatcatagaactggtattgcaatctaggtatgatatggaggatgccatgattttgaataaatccgctgttgatcgtgggatgttccgtgggcatattttccaggtaagtaaatgttttttccccttttttggtgactcttgaagatatctcattaacactaataagaatttaatgtcaaaatgtgtatcgaatggcatacgcacatctttaatgtactctccatcccaaattttgatgggatgcctttttctgggcatctgaatcattacccattgatctattttgagatttgtggctttaacctgggtatcttttacacaaatatatgcgacatttcagttctgcaaaatattgaatccatatttgatttatttttgtgaaactgcagttgcattaatttgaaagtagttcaataagttttctttcttcaaaagttgctattgattgtaaagatgtatcagacagttcttgacgtggatgttggtgcctaggcatccaaatatcaaaattagtttacctatctatattttatatttgaataatcctgagcattagatttggattcttcaattcggaatgccatctcagtatgcacgtttagtatccaccaacagagagtacctttggaaaaatcttgattggatgatctaacttggtatagattgaaccttaagtttgacaaaacctaaaattagtttcttttatcctttgtactctttctgcagactgagtgcattgatttatcagcaaaaagtagagataatgttacggagttcttttgcaagagtaatctttcgagggacactaccgctgcaatcgaatcagatggccttcctcggattggagaggtagttatgtgctcgtactaagttaattttttaccatgtggagaagtggtagcagtgtaatttcttcttgacgatattccccgtactcaaatgtatgtgtatgaaacagaacatatttccaaatgagcagtactacagcgtctgtaacaatctcactggtacagtaaggcctatcaaactgaagggctcagaacctgcagctattgattatgttgctgtcaatgggacaaattttaaggatcgtctacaaaaggtgaggccatggccacctccagtatcctgtgctggatgaaatttatcttcggcaataatgtgtggatatccctattcaccttgttaaaaaagggcagactaagtgcctgtgtttgtttaaatgcaagaaaaaagtgaaataccttcagtttctttaaactacaaaaaaacccagcctcttttggaaccaatgaactttagtatgttacacaatgcatttcttgaatgttagtaggattattgtttgtgaaagtgtgttctaatttgttttttgtcatcttggcatgcttttcactactgcatgtttttgtcaggctaatattcgtctgcgtcgcgtgagaaatcctataattggtgacaagttcagcagcagacatggtcaaaagggagtttgttcgcagttgtggcctgatattgatatgccattctctgctaatactgggatgaggccagatctcatcattaatccccatgcatttccttcacgaatgactatagcaatgctcttagagtcgatagcagcaaaggtacaaacttctttcataggttgagagaagcttgcatttttttcttcattttgaaagaaatatcatgattgttgcgagagagagacagagattccttgtttccaattcttctcatttaagtatgatagcgtcttggtactttctttactcactgaagtcttgtcttcacaggccggaagtctgaaagggaagttcattgatgcaacgccttttgcaagctcagttaaagagagatcaaattccattgtggatgaactgggacccatgcttgcttcttatggatttaattaccatggaacagaaattctatatagtggagtttttggcactgagatgaaatgtgagattttccttggacctgtatactatcaacgccttcgtcatatggcctcagacaaatttcaggtgggcaatcattatttgtgtaccatcttattatgtatagttaaagtcgttatctggcttatttttcctccttttctattcgatatcggattgaagatctctacaatgctatgcatcaaaagtattcattgctctatttatctagtcaccaatgtttccacactattgcttgtagattctcatggatgtgttgggtttcgcaggttcgtaccacagggcgaatagatcagatcacaagacagccaataggaggaaggaaatacggtggagggattcggttcggtgagatggagcgagacgcgcttctcgctcatggtgcctcttacctcctacatgacaggctccattcctgctccgactaccatatcgcggacgtgtgctccatctgcgggagcttgctgacggcgacggtgatcaaatccgaaagccagaagaaagccaagcgcgacatgctcgggctccccaccgtaaaacctcccaagaactttgcctgccaggcctgcaaaacaagcaaagggatggagaccgtcgccatgccttacgtcttcagatacctggcctccgagttggcggccatgaacataaagttggagcttcggctcagcaatagaacagagcatcctactactaccagcgaagaatcctgaatgatttgtcttggtagatctactctgaagatattataatcactggttcatctggagctggcagggcacaagtgtgcagtcatgccatccgcggcagtgtcctgggggatactgagaagttttgcttagaggatgtctccagttttgttgtgtgtcactgctgttttgtttcatgaaaaggcagagtctgttgtatcaaaacatcaatgattataccaattttataacattagacgtaactgaacttgtgtgcattgcaatgacacatctgaaatagtgaaatacgaagctttattcgagagatttcgcaacaccggttccctcttctgaagtgatatatgtgttgtgaaaaaaagattactccctcggacctaaaaaaaaatcaacttaggaggggataaccatatatctagacatatgactgtctagatatatttgttctaggaggagtcacatcctctcctagattgattattttttgaatggagggagtaatatttggtctctgaaaatgacgatcgtaaatttataatgaaaaatactttcgtataaagtaatgatcgatacgtgatgcccaaaacctaattttgaaaaagaaacgtagaacacagtagacggagggagtatatcggaatgacccctcgagattaaactgggcccactcatgagtgggcttaggcccacagttcttgctgtatcagtataatgggccgggcttaaaactccccttcctcctccacccgccatctctcttcagttccccaacccgccgccgccgcctccactagggcacgccgccgccgccgccgcctccatagggcacgccgccgccgccgccgccgccgccgtcagccatgtcggactcgacgagtacggtgcgttccccgccgcttcttctcctcgtcctctcctctatgcactgtttgtgttagttttgacaacgtttggctttgctgggtttagtcgacttgcccgtgtcggatgaggaggagtgggaggatggggagtcggaggaggacgaggagaaggtgggctctcgtaagaaggccaaggttcacgcgaagcagctcaagaggctccaggagaaggttcgtctccgtcctcgccgtctcctacgattcgcgcacccttctcccaagcttatattgcttactattattacttgttactagtaagcatcaaaagtagcatctgaattgctcggctccattccatatgtaatgcctatgttgatttagctttgggctgtttatactaggattggggattctggtatgtgttttttattctggtatgtgttattctggtatgtgttttttattcttatatttatactaggactgagcacgcaaggcagtgaatgttagaaggtatattgcatgcttaataggtggatattggctcgctctcgtatgcatttggtaaacttgtctggttggcccttgttgattgattttattgattttggaaatggactgcaatcttccgagttttacacgcggaagtttgtgcagagtactgaatagtgacgtggttgctgcaaataagtactataagcaaggcatacaagttccttaacaaatataatgatatattttagccattctgatcattttgaagaaggtgatggtaaactaaatctcaagttctgattgtgcatttggtaatcagggcaagtactataagcccctatttattgcccataaatttgccacataggattagatgatgagttggaggagagaagttaggagagagagaatgagccatccctcatgcaaggggcaacctccacacaatctccaagaaaaatgtaagatgacgtgagagtaaactaatattggggtttgtgtactagatgtgacatgttgtatttgttacctcttaagtaatgagaagatgacatggtttaaattagatgtggcactcacctccactataaaacttgccctcaggaagctagttgtaatgtcatagggattgctggtatgtaaagagtacttttgatatctagaattacgtagctcagtactgttatgatttttttctgcttacgttggatttatagctgtttatacataaaggtagttctacagttctacttgcacttttagtgtggaataacctatggctctggtttagcggccctggcattgcaattgggacagatgaaactgaagaaatcatatgtgttaagcacatccagattccagtttaagtactttcagattagttgcttgcactttgaactagccctcttttttggaataaagaacatgttattgactcgacttttggacagtcttattctaaaaataattgatactttttgtttcctggtagtgaccattagacggctttttacaaatttagatgataattatcattgttcaatttattgctgaaattcttatctgtatgcatcattgttaacactgcaacaaccaggaagtttttcttgagctaatcatttcttccatccctagttcttgtcatatctgtgctgctgtattctgtcagctgcttacgatggctgcaaaactcttatttgtaggatcctgagttctacaagtatttggaagagtgtgataaagagcttctggaattcgacgatgatgactttgatgtaacacaaaactatttattcatttattttgcatttttttttcttcttgcttgagagaactatatacattgtatgtttgctgcatattttgtttaggataatgaaggaagtgctgagaaacatagttctgttcctaaagaagaaccgaaagaaattgtaaagcctattacaatgcaaatggttgattcctggtgccaaggagcagaagatgggaagataggttctatccggtctattctcgaagcattccggaaagcctgccattatggtgaagaaagtggaaataattctgcaccgaaatttagtgtcatgtctggcagtgtacttgacaaagtcatgcactttgttttgaaaaacatggatagaatccttcgtgaattacttgatgcacctagctttggggggaagaaagagacagttagtgagctgatgattactaagcaatggaagaggcatgggagattaatgaggttataccttgtaaatgcactccacatgataacagagttgactgatgagcaaatggtagcatttactgtacatcgtgtcagagcttctgctgtttttctggcggccttccctgcactcctcaggaagtatgtaaaggtttgtagctttggctcctcatccatctttagtaacctttcgtgtcatctgatgtctctgcagagtttgtaatttcttttattttcacttgactaattcgattacaggctctgctgcatacctggtctagaggacgaggtgctatgcctcttgtttcatttttgttccttcgagatttgtgcattcaactaggttcggagtgccttgatacgtccctcaagggtatctacaaggcttatttggtgaactgtaaattgtccaaatcaatcagtggatcaaaattgcagcacattcaatttcttggtaattgtgtcagagaattgtacaatgtggacccacaaagtgcatatcagcatgcttttgttttcatccgtcactggcagtcatcctaaggggagctcttactgaaagaggaccaaaggtatgtgtagttgaactctgatgatcatatactgcaatgtaattatttacttggcagctgacaagttttgtggtccctatttcattttgcaagacatcgaaggacaaaaagcagaaagaaagtatcaaaccaacgaagaaacggatggaggtatgtcattattccaatgttgcatatgtactatcgaggaatagagtccactttgggataacactattgctttctttcttatgttagtttagttttactctctattctatattctattactctaactgagcctttcttttctgacttgttatttgctgaccttgttcttgtgtagaaatcctaccaaaaagtttatgattggcaatacatattctgccttgagctttggacaagtgttgtgtgtggatgtagttctgaggaagaccttcgacctttggcttatccactaacccagataatacatggtgtggcatgcctggtaccaagtgcgcgttactttcctgtacgcctgagatgtgtgaagatgcttaatcgcattgctgaagctactggtaccttcattccggtgtcttccctgctgcttgatatgctggaaatgaaagaacttggagggaaaccagatgctgtaggcaaagcagtgaatctgttcagtgttaaacaggtatattttctcgtaatacaacacttcctttgggaggactactttgaaaaaacttttaataggtacttttgtctggcaggtagataagaaaacagtgaagacacgtgcctttcaggaagcatgcatcttttccgcggttgatgagttggctaagcatttggcccaatggagctactccattgccttctttgagatgtcctttttaacacttgtccggcttcaaaacttttgcaaaaccgttaaggctgacagattccggagagagatcaaagatcttatccatcaggtttgtgaagcatgtaagagagaattgtacctaactgaatgcatgtatgctgatgtttgtatcctttgtgattccagataaaggctagtgctgagtttgtaagctcaaagcgtgcaggaattggattctctcctaatgatccagccgtggattcatttctacaggtatggttggtcctgttggatgtgcactgtatatttgttatactcatttagtgtcattttgtgagatatataatgttcatttcaggttgagaaggaagcaaagtcaagtcctctatcaaaatatgttgctactctacatcagagaagtcaggacaggatggactctctggacgacacaaggttggttacttggtttcattgatgttcatctaaatttaggagtcagccagttgagtcgtagcacttataaacagaaatgcaccaatttttttttacctcgtcgtcttatcatgcaacattttctagtagtctttacatgtgagtggagctatgcttgatgctccatattgcgagtacatataattaataaaattactgatcattcttttccctatcagcgttattgtgggggcagagtcctcaaccttttcacggaggttgtcagaagcacagaagcgacaggatgaacaagatgatggcgaagacaccattgcattcagtaagaacttgttgactgaaaagaagaaaaccaagtacgctatcaccttcctctttgcctctttttgtttcttttattggaatggtagacgttatatgtttcctttcgggggtttgcagaactccaaaggagaagagcaagaagcgagcccataatcacgacgatgtcgctacggaggaggatattgttgaggatttgatcttgagttcagacgaggaagacgaagatgaggacaagaatatggaatcagatgaggatgatggctctatgcctgttgaagatgacagcgatgacgatttcgtcgacccagacagccagtggaagaaacagaagaaagagaaatcaaagaaacggaacaagcggcaaccctcaaagaagggttcgtcaacaacaaaaagaaaagagaaaatcccacatcccaagaagaaggcgaagcattagccagagataatgaaaacgatgatgatgtgttttcaattttgaaagaaacagacgcatcatgaaaattttgttttaattgagaaagacctctgccatttcgttgcgttccttcaccgttattatttatttatgtatgcttaatcgttcagcttggctgatgttgttgattttgctccatacatttttctttctggcagattgtgtgctgagttaaacaagtgataatttccttggggaaaaaaaagagaacgcgaaaatagtattgaacaggctacaacctttgtaagacatgaaatcagtcttaactagtgcgaatcatggggatattccactactttgcacggcttaaattattgtccatgaatcggtggacctgtgattttcagttctgattgtaaactggtactagcatatgaagctacatttgaccaagccatgagaaaaattaggactaattcctttttctaaaacaaaatctccacgactttagatcactgataattcagtaggggagaacaacgagcctcattatttcaatttgctccgttgccaaagttattcacaccattatatatcaacgctaacttaattaagagctcccttgtcttaacactagcccttgacatttgtcttaacactagcccttggcatttgcaaagctctgtacaattaacctaaaccataaaaatattttcaaaccatataatattttcaactaaacaatactgctacctccttttcatattattagttgttttgactttcttctagtcaaactttaggttcaatcaagtttgtagaaaaatttaacatctacagcaccaaattagtttcattaaatacaacattaaatatattatgataatatgtctgttttgtgttgaaaatattgctaagtttttttataaatttaattaaacttaaaattaaaacgacttatatataatactaagtatcatgtaaaaaaatattgaactaaaccgattataagcagcgtgatggaaattccagccgttgacaatgtccaaccacggccgtgtgggccccactccacacgcttcccttcttcccgcccccgccacgatacgaagtttacaaacagaacagcagcctcgcttaatccttctccgtcacgtacttaattaccaccttttttacttaacttaatccaactcctaatcatcccattgcaatatgtctgttttattactacgtttcgtcgcgttcagctctcgatcgattacgagagccatgaagtcgccgttccgacgcgcggcgagcgcgccggcgccggcgccggcgccgatgccgatgctgtcgttcgcgggcaagaggccgaagcacttcacgcttcaggacagctcggcggcggagagggacgccgacctggaggcgttcatgcgcgcgcgccgcctcgtcgtggtgtcgtcgtcggagagggtcgccggcgacctccgcgcgtacctgcggagatcgaggcggtcgccggcccgcggttcgacgcggcggtgagcagggcggtgccgccgtcgtcgtcgcagctcgggattgcctggcaggacgacgcggcggcggcggcggcggggggatggcacaggtggagtacggcgggcgcggcggcgtgccagtggcacacgtcgctggtgaccgagcgggaggtggccatgttcgcgctcgcggcggagtcggcgcgggcggcgctggcggaggacaggcccggtgcggacgggatccggcgggcgtgcgccgcgttatgcgatgcggccggcgcgctgagggaggcggcgggcggagccgacgctggcgccgcgacgggcatgtcgcccgcgcgcgtcgcggcgctggagggcctgatgctggcgtaggcgctggagtgctacttcgagctcgccgtcgccggagggaggccgccggcgctgtgctcgatggtggcgaggcaggtgagcctggactacggcgacgtgcgcgccgcgctggaggcccccgagctgcggcggcagcacgccgaccaccggcagtgggcggcgcacgcggaggcgaaggcggcctacttcgccgccgaggcgtgcctccgggcggcgcgcgagcggcgtgccgagggagacgtcggcgtggcgatagcgcggctgaggcaggcggcggcgacgctcaagggatcgaagcctctcaagaaggcggcgcgccggtgcacgccgccgccaagtggctgaagcgggaggtggaggccgagctcgccggcgccgagcacgacaacggcatgatctactacatggcggttccggccaacggagagctcgccgagctgcccgggctgcagcagaggctcgtccagcccaccccattggagaacatcctgcagcaaggaacgcacggcgacggcggagctccggcggccggcggctagccgccgtcgcgcgcgtagctgaagtaatggacattgctgttcatagtgtatttgttacattgaatcgagagtttcgagacgttggcacgttgcatttcatggaggcctgtctcaaaaggtggatttgtttttttttaaaaaaagaaattgctaccggacactcaaaaatcatgtaattgactgaaagacacaacaaaaatgtgaaactgtcgatgaaaactacaaaagttgtgtaattagttgtaggacacccggaggcattattttataatttccgggctgaaagagaggagataaatttcgtaatgacgggaataccccccactactccttcctttcttctcgatgcagcggacatgtaggcccgcgcacagtgttgtccttcctcctcttgccagcgctccactccaaatcctctatcatccatggcccaaccgactgctaccttcacatcttcaccctcaccgcccctgtcctttgccttctcatctcgctccggcctcagtggtgacgctagcggtcgccttcgtcgtcgtatcctatgccgccctccttctgctgttcgcatgcctctgcgtctacgagcggcgccggcgagggcgtggctcacgtgtgcggtatgggcagcctccatgctactcaccaccatgttcgtatggaaggtcgcggcgctcatgctgtggcccgtggttgccgtggtgtgggggctctccatagtcaccgtgctcgacatggtttaccacagaactttactcaaatccgagcgattttgatcgagatttcaaaatggaatcttgagggcaatcgaagagtaaagtgagagcatcaaatcccctcagcctattctggaaaaatgcgagggaatcgattggattttagaagggatgcaacggcgttggtcggcgttggacgatggcgagaagaggacgacgatactgtacgcgggcccacatatcagctgcatccagaagatagaaaaaagtagagggggcattcccgtcatttcgaaatttctctccccataattcctcccctatcgttttttccttctttttttccaggtagagcagagggaacagaggagcggggcactggtgctccggtggctgggaggtggcgacgtcggcggccgaatgtgttcccgagcgccgcgctggagagccccgagctgcgacggcatcacgccgactaccggccgtgggcggcgcacatggaggcaaagccggtctacttcgcgtcgaggcgtgcctccgggcggcccgagctgcagcagcagctcgtccggcccaccccaatctgggccgattgggccgatctcagcctcccggagcggagaccgatctgggccgtccatccgcgccgcccagccaatcggacggtgggtgtattactgtactgccaggtcggtgaccgtacaagccggaatattcagtagcgtcgttcgctccctggcttctccatttcttcagctccgccgccggcggcggcggcggcggcgcaggcatggcgcgccgtgtcaccacccttacccgcgcccgcacccgcgcccgcggcggcggcgtccccagcgcgcagggtggtacgacccaagacctagggcgcgcggggggcagtggcaccgagggcgcacgccacgtgctcgacgaattgccgctacgggg

SEQ ID NO: 54915 - DNA, 966 bp, Oryza sativa
ctgattgactctgcttaaatccctaagctgctgcaactccgcttccaatccagcagggcctccgcttatctgaacagcctcaacgtcttccttcaaatctaaaggtaaggtgatattaccttctaatgaaagaatggaatcgggcaagtccatttccttcaacctaactctagtgatctcactagcttgctgtaatttctccgcttgagtcctgatgatgttatctaccatctcagtgtacttggaaagtgctttcatgcttccatcaggcacaagtgatgaaaaaagcctctctttgctagcatctagaacttcagccaaagatgtaggctttacaagtgatgctgcagggagcgcgccaagagaactagcatccggaaccctcatcagataaacacggtcattctctttcatagccctctccaagttggtcttcatattactctccagcttattaacagaatcaagaagtggggcagcaactcccctggccaccttcttggcatctgccaaagcgctaattccaatcttcagacgtgcaatttcctgtgcaatttcttctttctcgtgaagatccaaagaacacctatagcaagcatcagcatagaactgagctgccttcagctggacatgagaaacccatgtcttatcaaagtgctgactgagaggagctgcgctaagagctgcataggcttcttcatagaatatgcccacctgaaaaagggacatccacaaatcaatccaatagcacatctgacaccaatattacaaaaaggtgaagaaatatttgtatcttgaatgtttgtaaaagcagtaaaccctgcaaattgtactttatttaatcaaataaactgcaagacctaatctagcttctatttaccaccaggagagacacatgaatgctaccaaatcaatcatattgtaaccagtcagtttcatttaaaatatgatcactccatgggatga

SEQ ID NO: 54916 - DNA, 5874 bp, Oryza sativa
agttcttttttttctttttgaattacaagtaacagaccaattgggtctctgccgttcattcgttcttgatgtccattattgctgagttcgcaaagattctctgcacgtacctttgcaaatattctctgttcttgaaatgtaccgtatccctcctgtttgtacttcccacttcagtcaaacagacttcagtcaaacagagattggaatcatctgaagtactcccttcatcccaaaaaaagacaaaccctggtttccgtgtccaacgtttgaccgtccatcttatttgaaaaaaatatgaaaaaaattaaaaagacaagtcacgcataaaatattaatcatgttttatcatctaacaacaataaaaatacaaattataaaaaaaatttatataagacgaacaatcaaagttggacacggaaacccagagtttgtcttttttttgggacggagggattatctcgttttccactttcgacttctaatcatgtatcctcaattcagggaaggagaatgtgcaataaataaaaccggcagcataaagccgatggaaacaaatgcaaagtgcacagccaatctgattatgaattcagacgtgccacaactaattcagcaattgcattaaagatgaaaaaaaacccaacatttccgactgattactctcatttttgctgctccttcctagcaaataaattatctgaactagacctaactttcatcatcatcaccaccggaggaactccatgctcagcagcacatctcgagggcattgtaatatgagtgcccacaggtggctaaagcataaggtccactccatctaaaagaaaatactataaggatacataaccagcgaagccaactatgactattagttagtagcagcggttggggaagcagaatcactctcggtcagcgcttctcaattgtcaagccgtttgcaccctcagaaaccacctgacggatggcgacacacggtgtccattcaggaatcaggatgaccaagaatgcatcgatcaactgcgcgatgatcggtctgctgtcttgtgtcagtccaaattgctcaaccatttccacagccacagaaagacttgtatcttcagtcaaattgaatgggaattcaacactcttgaaacaacctgaaaggaagttgatgttcagtacaaaacgtgttgttgaattctggaaaagaaagatttcaaacaatatgattaccgctgggatcaggaaatcttagccataaatcaacatggctggctacatcaacatttcctgtcagcagaaactcgcccttacgaagcatgcaactgacaggctgctgcccatcttcagacatattcttgaccagagagactgagataagatcatcatcctggaggaaagagttttcaacagctctgttgcagacattctgttctctactggagctaaacagttctctatgaaagatcttacttctgcatctttaattttgtagaacgcagctggtttcttaccctatatcaaataggtcatacaaacaaaaagttaagttgttggctactacaatcactctggtatctgtagacatcaagaccttacctcatcaatctttttgaatatatgggccatgccttgacattcactgtatgggtattcgcatgtcaccatttcaagcatgcacatcccaaatgaatatatatcaaccaattcattgtaatgcccagttaacagctctggtgccataaattctaaggtgcctgcagttaatgattaatatatccttattacacatccaactgaaagagaaatcctttttaagatgaaaagaaaacagaattatatgagtcaagaaaattggtaacataagtttaaaagtggacatacatgctaaatagaatagttatgttctgagaaaactgtaacagttagaaaacacataagatggcagacatataacaatgttgatatgagatatctaccttttatactttttttctgttgctgcatgaatgttgccaaaccaaaatcaccaatcttcactttcccatgatttccatttatgaatatattgtcacattttaaatccctgtgtataattgctggcttctgactgtgcagatattctagccctgttaatatctgtattgcccatcgtttcatagccttcatattcactttcttgtgctttctgcggtacctggttacatggtgacataaaaaaggttacattgtaatttataaggtaaaagaaacgcagtatccctcttgaagttttagggtaaataattttaagcaacgctcatctagtcatctatactgaattaaagggcggtacaaacaaatgacaatgaaaaggaaaagttaccaaatattatccaagaattgtaaaggagccaactaaaactttaatttgcacaatggaaaactgtaaaaatgttcaggtagcactaattcagtaaaaaaaaggtatatttagaagatagatatccaaaccaatgaataggcaacagtttattaatatgctccagctgacagcatagttgtcgtaaggatgaggggcatactgtgtcaagctcccggatgtgaacaactctgtgattatgttaacagtcttcttctccccatcaacccatgaagcaaacattttctcaatgttcttatgcttgagtgtcttcaaaagttgaatctctgtgtttagttgcttcatcttcttagaggaccccatgacagagtcatcgatccgggattggctccatgctacctcgacaccctccagcttatcgaaggctttgtagctatttccaaatcacaattaaggaatatgatatgaacaatataattttgtcccaccagcatgagacattcaggttgtgaaacccgaattaaagaaacactggaacatcttgaatcagccaagaataaataaacttgaaatttgtcacactttatccataatagaagtacagatggttagcagaactaaatatttatggattaacatctttccatgaatatatatcaaggttaataaggtcaacaccgatcaataattttagccacagattacagaagcatgaaaagttcggttccatctctgaatgtgtctgtagattctacatggaatcgcgggtgtccatcataagttcagaacacatctaatactgataaataaataatcatcgggcatggttctactgtgatcaacaaatcgaattatattccacaactaattcaatcgtgataattcaatcaagaacaaaaagggctaaactagaaacagcacatgagattgatgaaaggatacaccgttttgacggcccctgaccccacgatctcatcatactgcacacgcagagggcaacaacaacaacaacaattagccaccacccgaatccacccatcttccgcagcagcaacaaaaccctagaaggctagatagaactcgaacagaaacgagcaggacagcaacccgtacccggatgaagcggcctgcggggtccgcctcgacgtacccctcctcgtcgccgtcctcgtccggcggctgctcctccgcctccgcctccaccagatccatcggacccgcagccgccgccgtcgccgccgccgccgctttccgccgagattgtcaactgcttcccagctgagaccgacccgcacggcggcgatttaatagcggcgggaggaggtaggcgggccgattcgtgggcccacgttgggtgggcccggcctcgccaagtcagcgcgggggacgacgggacatgtgggtggggtccacgtatcggtgagagacggttcagtgggagttggtccatgagatcgtttcggatagggatggatttcgtttttgaagaaaatggttttggttggtgatgacgaacgggagtgctgtagggatattcttttctgtggcatgtgggccaacctgctctcgattaatacttttaacactatgtactattaaaaaaatatctgtgcatcataacggctattttaatttttttattattatatggtttatttaagataaaatttacggttaaattcatctggatatgtattttgttagaaaatcatgagctacaattacgaatccgatcgtctcatgttagcatacgagttatttaaagttccaaaagcgaacaaacttaaaagccgactcaaatacgatttatatttctaaaaacgaactaacttaaaaaccagctcgtacacgtatgacgtaccaaattgccgaaaaaaacattcttaatttttataatagtagagatagagatatgtagtactactttactacaaaaccaaaataaaaaattctgaaagaaactattaccacactttatagtacacctcaactctaagattcaattggttaaaactgaacagagtaaaacttcagcaccataccatgtacggagtagatgatatactccatttttgtttacatgtctctacctttactattataaaaattgaagatatttttaccgatacttttggtacgtcatccttgtttgaatcggtttttaagttcaatcgcttttggaaatacaaatccgcgtttgagtcggtttttgattttgttcgtttttagaaatatagaaggagttgtataagaaatctctttaaaaatattgcatgctaacttgagacgatcggatccctaattgcggctcatgattttgtaaaaaatatccaagcgaattctcacggtaaatttcaccttagctaaaccatacaacaataataagattaaaataaccttcacccgttgcaacgcacgtgcatttttctagttaaatgaaacaactgagagagtatttaccaagataatcatgataaaaaaagacggggtatttaattggcagacacactttatcgtaactaaggttagacaagttgttgccatcatgaaaatatgggaataaatttttagtcataaagtatggaaaaaattgaaaagaaattaagtctatgacatgttagacatgctattaaaaaagtatggaaagccacacctataacagtgaacaaaatacacacctaacaaaagacaactaaaaagtgtggtacagcaaaatatgaccaatgaaccaaacacctatatgcacacgaagaaattgcaggactgtaattgatttaggcctttatgtaatcctacatgtcattttatcaataagtattttttgcacgcagctagcaatccaagtgctagggtcaatgttctctcttcattgatcaccttaattatttctctatcacctatgggggcactccactggttgatgggacactagctactttctacaatatccacttgagccaatgaattttgtgtgaattttattgaattgaaatcctatgaaaatattttctacgaagccctttggattgtaaaaatgtatcccaaaatttctatatgatttcttccattccttcattttttctttagattccaaacatttcgtcaaagctcatgttttacaattctttaagaagtccagggcaacatgtcttttatctctccccttttacctatggtaattaggttttaattcaaatttctatgatttcccttaattttggtacaaaaattcatcaaacaacccaaagagcagcccagaaaataaagcatgcatgcagtagtttagctgcaattgttgaaatagttagcctctgtactgccttcaactagcaaagaatagcccaattatttgaccattagtgaatgatcagggaggctgattgagaaattttgcaatctcatcttccttgaggcctctcatgtctatgtagaaacatctgtgtgatttgccaacatctatgtggtgctttctctccctcacgcctttgatagtgtaccctctgtatgtgtggttttataagcacaagatggaatta

SEQ ID NO: 54917 - DNA, 6064 bp, Oryza sativa
ccctgtaaaggcatctcttggataagccgtttgctactacggacagttcaagtaacagcttcagcgctggactgttcactctgtaactgttagagtatatggataggactctagcatccgtttgttatactagatacttgagatctaagtcttgcactcgtatatatactgatccccgaggctaaatacaataactcaatatttgcagtatatctctctccctatactattcaacatatcatcaaggcatcatctaatctccatatgtctaccagcatgctaaacaatggcatgaagagcctggagagacacgagaacacaacaagaattacagatgaacaatatggaaaataatacatcaaatgattcagttccagttcatcacatgccatgtcagtaagtgtgagttggctaatggtagaggcaaccatttatcttttacatcagaaggagttcattctactaatctgcatatgaagaccgcataaggggattgccatggtgttggatttttttgaagagtaacaaatgaagcaaacaaatgctcacctagaaggtctatttgttccccccaaaattttgacatcatgcatcctcaccctatgagttgaatacaacacttggaattgttattgttatatccttgttggtggaagtcatagttacaaaaggatagccgtgtaaactattacacaagacaaaattcacatatgtactccacaacaaatgttcccttagttccaaaatataaggcacccacaattttaggaaaatcaacatttgtaacttttgactaataattaagcatataattatatatttagtgccatgcatgcaatatcattagatcatatttgagagtagttttacatgatgttaatgttatagttgttgataatatattatgaaagaaatcaacaatcattttagaccatgaaaaaaacattaacaccttatagttcaggacggagggagtatatcaaatattttctgtatttttttgaagaaaaagcaggagctctgccattttatatatttaggtagaaaaggagtgcagccagggatggagctaggtaggagaggggggggtgcccaggaactgatcaagaaatatttttagctatagttcatctattttcaccatatgtgcaccccctaatccaaactcagacacccgtattagtctaaacttggtctaaagtagagttaagcaagcgagtggcacccctctccatttcgttctagctccgcccctatgtgcagtgttcagtacaaaggccttgcattacaataaaagacatggacaacttaattataagaggtgcttataacaagagaactagtatgtaaaatttcaagcatcaactctttggtttatatcttgaatcaccaatacagcaactagctcttcagtttgatgaacatcttggaaagctcttctagttctgtctagccaaatgttccaccaagttacaatgagtgccccattactcctcttcatttgctcctttggttttaatggcaaaagggagaaaggcccaggggcttccggctagcaccacaaggtgtgggttaaccaacccaggttcgagcctcaccagtcaccgctctcttaataaattttgatatgagagctcttcctctcatatccagcacttttgagaaagtcctaggggtcttccggctagctgacctagttttgagctttacccctttcttggtaaatttagatacgagacccttcctctcatatccaacgttttgtttttatggcaacaagattgtatatctagttaccgagtgcataatcttgatcaaactataaacaccatattagttgagcctctatggataatctttagtttttgccaagcaaaatagggatctttcctaatttccaactggacaactgacctggttcactagatcaaaaccaggtgttttgaatcgactttgaaggttggaatgattcatagatagagcaccttataaccatcgtgctttgtgtaagacatgataacttctactccagttgttgcaggaaatgaattgtttcatatgaaatttgtaagttttttttagtgaaagggaaggacctacactaaatatgcattgaaggggagagaaagaaaagtgatttattgtctttgggcgcagtctttggtttcttggaagcattaacaatatgtgcacaaaatcattacgagtgaatactttgttttaaaaccaaagcaaaccacaaaaagtaacttgtgctactttgttacaatagctcttagcctcttatggtagttcttttgacatgaacgaactttgaattgatccctaagatgaaactctgtaagggaacgaacaagggtagtaacttataaccaataagagcaacccggaggatgaaaagtacactccctgaaagaaaaggaatgtttagctacaattgcatcaagtgttttggctcccttttgccccctcttcagcacactgccaccagttctttcaccagatagtgagtgatcaggggtgtgacatcccagcccagagcttaataggattaatagaatactcatatcaacaagttgcaacttcttttccggaagccgatctctaaagaactccgaggttaagcgtgcttggcctggagcaatttagggatcggtgaccgattgggaaattcttcccgagcgcgcacgagtgagaacaaagtgtacagaaaagacttgtgttggtctgtgaggacagtctataacctatgaaagccgctagatgtaagtgggcctggcctggggagaggcgggtcgttacaaaatggtatcagagccgaccctcgcgccccagatgtaagtgggcccggcctggggagaggcgggtcgttacaaaatggtatcagagccgaccctcgcggtttcacgggcgcgtgcatggtatgcatggctggtgtggacccggagtggtcacacagcatggcacatgcgctggcactggacacatggacgtggccaagagatgtaagtgggcccggcctggggagaggcgggtcgttacaaaatggtatcagagctgaccctcgcggtttcacgggcgcgtgtgtcggggcgcgtatgtcacagttgcgcaggcatgatgtgcatggctggtgtggacctggagtagtcacacagcatggcacatgcgttggcactggacacatggacgtggccaagaggggacgtgtgtgcagaaaagacttgtgttggtctgtgagggcagtctataacctatgaaagccgtcgtgcagaaaagacttatgttggtatgtgagggcagtctataacctattaaagccgccagatgtaagtgggcccctcccatgcagaaaagacttgtgttggtctgtgagggcagtctataacctattaaagccgccagatgtaagtgggcccctcctggggagaggcgggtcgttacaagggggactaaattggttgtgttgcaaattcatcttccttcaagcctcccatgtctatgtaagaaactataatgctagaaacaccatgtgctttggtactttcctggtacaaacctttggtagcgtgccctctttatatgctattttgttagtatgacattgaaatcaggttcctgcatcagatctgccacagatagacctgcaaacttttgccttcacctcctgcatcacaacaacatgcccctgtcgtcgccgccgtatccatccaccgcatccatctcctgccgtctccgccgcagccatccgccgcatccatctcccgctgtcaccgtagatgcgggagcgatggggagtggcgtggagatggagggatgtgcagagaggagcgggagggacgtggggaaggggaaggaagctaccgagccaaatccttccaccggagccgtccccggcatcggatctaaccactcacaaccctccccgccgtatccaagcgcccgcatcctggtagacgaggaactccgtagggagatgcagaagcgagggggagcggcgtggagcagggagagatgtgcggggaggagagggacagaggtagggagggaatctagacgccgccacgtcgatggaatcaatccaggagggggcggcggggagaaacgcgagagaatgagagagagacgcgagagaaatctgggaggcgataaggttcgtgtggtgtaaacaagagaagtcgctgtccacctatggcccacatgatacgatagagagaaagtttctggttttgtggttttgtgtgcaggaatcggttttttatgggacaaagccctccctctagaaatcgtctctttgtgggacggagggagtagcttggtagtatgttccctctagaaatcgtctctttgtgggacggagggagtagcttggtagtatgtatgatgggaggtgatctgtcttatgcatcgcactgtaaaattgcaattttccagtatttactgtgtctgttaaagacagcaaacaaccaacagggagaaagttttttttctacaccacaggcgcctcgctgtcgacgggtacgtcgcctaccactgaaagaataattagccgtaaatgcgagcacccgtatcaaatctagaatttgaacccgggtgggttggttccaccacaaggaacctaaccagttgagctatgctcacttcgcatatagggagaaagttatgtgaataaaacatgaaaaatataaaacggtggtacgatcaagatgcatatattgaaacaccttgtcagaatttataatgtcctaagagatgcaatactcccattacaaagctggccttgaagtgattgccttctacatcagctctggttaggctgtactgttgggaactatttcctccattctaaaatgtgttgttggtactcattagcgcatgattaattaaatattagcttaaaagaacttaacatacgtaatggtgtaattttttaaaacaacgatcatatagaaaatatttttttaaaaaaattaccggttggcagttcgagaatcatgtgtgcgaaaaacgaaagtaagagttcgaaacctagactaccgaactcagtattagtattatgtttacataaatccaaaatattttgtttagacgatcatcaacatattatgcttaaacatttggtgcaaattattttggcgtactagctaattactgaatgcatattcctgatcaagctaatcaccatgtgcattgagcctctctctgtgactccatggataatatttatccttctctagaagaattgtgcctatataactagaaaactggcctggtttactggatcaaagctcagtattttgaacttattacgaactaatctgaaaaacgttgataaataatagagggagagcaaaactgaaaaacgctgcaatctcgtcttcctcgaggcctcccatgtctacataaggaactgctaacaccaagaacaccgtcaactttccaagcaactgtccaagcgtttggtatcagcacaagattggatcatatagctttagcaaacgtgtacctttgaggaattgaatatggttgccatttgaggaattgaatatagcttttagaaagtgcacacaccaattaaaatgttttattctaaaacgttgcgctcttctttcatatatagtagtattgattaggccaaatctcttggtacaagatcagcacaggtgaacattccattttgaaagccaaggataagagtcttgttacaagcaaacctgaagagcaatttggaagctaaaacttgttacaatattgcgcacatggtttggcttcctattgcctcctcttcgcacaaaatttctggttgttccaacaatggcagactttgtaagggctcaaagaattactgcaatctcgtcttcctcagggcttcctatgcctaagaaactgctaataccaagagcaccgtgtgctttcctacgtacacagccatctagtgctcttcccgtccaaggtttcggtaggactccctctttatatatgcgatgctatcagaataaacaaactactttttgtgtactgtgaagtaaaaatttatctagctagattttttgtaagtgattta

SEQ ID NO: 54918 - DNA, 1376 bp, Oryza sativa
ttcctgcagcccatcagctgaaggacagaacactaaggttaaatgaaccttcagaattttgacgcaaggaaaatatgagcgaggaatcatgaagtttttctagtttcttaccgctgtaccataaacttctgctgtatcaaataaggtcatcccattatctatgcttgtgtcaaatgctgctttacctcctgcagtctcctgtctgatgaaatcaaaggaagcacgttttcttatcatttctttgttctgtttttggaagacttttcttcccaaaacagcagcaacgattgtatcacaaatacaaagaccataacatacacctgaagtggaaaccttacaaaagaaaaactctcccagaaagagggggaagaggggcaggaaaaggacagagttgataattaactaaccaatgatagggacatgttaagttgctaattaactaatcaggaagagatttacaccgggccctcttgaaagggaaacaccaaaccaaaaccagtgacctgcctgatggttgtagtccggaacaagaacaatcggatgaccgttggtttgtagacgatatgtctcaacaaaagggactttttggttgtcgaaatcacatgacaaaatatttcacaccggagaggattgaagtgacatgcgtgcaagtgcaagtcacccggggaggcaatgcaacaagcaccttgtgcgcatgggaagcatgacctgatcacacactttctgcccctgctgctttgagctgcttagaaccagacctactacaggtaacacctaaacaactgagaatcacctggagctaaatttgactgcaacaattagcaacaagaactaatcttttccagcacaaacaaaacaagcttgaacaattcgatggattgattaatgaggcagtgcgtaccgtcccactcggagtcgttccagtaggtggtgtccccccacgaccaggcgccgatgccgagcttgctcaccgccacttccgacccacccagcctcaccttcccctcctcctcgctcaccttcgccgccgccgcgtccgacgccaccgcacgcgccgccgccaaccgccgccgaccagctccaagaacgggccgctggcaacagcagccgccgccggccaccacctgcagcgccatggccgccgccattgctctgctgctacgtgtgtggtgcgtgcgtgcgtgttgctgctggctcgaggagaagagaagcctggctccttcttgtactctaccaccaaggccgcgacgaggcgtcgcggtcgcgggagccaacgatttttttttcaaaaaaagaatacaaatttggcggtagagttggagatgccacgtgagtaacgtgcagatgctgctgctgctgcgagatatctgcatgga

SEQ ID NO: 54919 - DNA, 1143 bp, Oryza sativa
aacacaaatgtagtcgacagattcaccagagccggcggaacgtaggacttaccccttcgccggagatcgaaagctgatgcagccctgcgtcaggtgccaaattccgccggttgataagtaaaaacctcaggaaagagggtggcgatgcgccgagagtagttgtattgatcgagattgattgattacagggacccctggtacacaatttatacccttgggtctatggagtccttgtcagacaagaaacaaactttctaaaagataaaacagaaacataaagtccttatcggacactaaacatactttcttaaagataaaaggaaactaacaaactattcctaattaatagatacaattgccttcttcggactcaatccgcatgtggcaatcctcatgaagcaccttaaacgaacccgacaatggttccaacatccccttgtcggaatcggctacatcggcttccttgtccgattcgatatcagttaatacaccgtagccgatgctgttccgaagccgatttatactctgtttctcttaccaatttccttccaaatccgcttcggtcttaactccaaatccgatacatgatttaccaaatttggtcgttaacaccggtatagtgaattccatagctcatagtgccctttagatagcgcattactctttccagagcctgccaatgatcatctcccggatttgagacaaaccggctcagcttgcttacagcaaatgagatgtcaggcctcgttgcactagccaagtacatcaatgaaccaatgatttgtgagtatctcagttgatcccttgctattcttcggtttttccttaatagcacgctgggatcataaggagtaggagctggcttacagtcactgtagccaaagcgactcaaaaccttatctacatagtgggattgcacaagtgtaatcccaccctcatctcatctcagtagcttaatgttaagaataacatcagcctctcccaaatcctttatttcaaagctcttggacagaaagtccttgacctcctcaatcacattgagggtggtcccaaagattaatatgtcatcgacatataaacacaatatcactccttgtccctcaccatagcgatagtacacacatttgtcagcttcgttcacaa

SEQ ID NO: 54920 - DNA, 759 bp, Oryza sativa
  unsure (1)..(759): unsure at all n locations
agtgaactgctatcgtattcctgcagccctttatcttatagagagacgtgtcaatgtctaaaacgataaaatatttttttttatttacctgggcgaggagctcctcgggggagccgaactcggtgatggtcttcttggtggtggggttgattatgacggagacgttgctgttggcgtcgaagttgtcctcgtagcggaggacctgtccggggaactcgcgctccttgctggggttccacttggacgggatcagcagcttgaacccctcgccgctgtaggcgatgaactccgtgttcgtcttgggcttcccgaacacgttcgccgcctcgccgtaggccgcggcggcgggcgccaccttcacccccaccgccgccgtcgctccggccagcagcgcgagcgccgcgcggcgggagacgtcggcgtcgtcctgcttctgggcgcggcagacgaggaggtgggtccgtgtcgccggggacggggaggcgacgcgcgcggcgacgcgggccgtggactggtggaggaagcangaggtggacgccattgccggccggtgggctggtgcctcgccgctgattgcctgcctgagagtggagcggggtgtantgtggtggagggagagggtgatggggcgaggtggcgacgggataaccaagaggagagcgcattgggggcgccgcggtggctaggacttgtggtgtttggcccggcgagtggatggtgttcggaatcgcggataaggcttccccccgccccttggcg

SEQ ID NO: 54921 - DNA, 4804 bp, Oryza sativa
taattcttacaatctgaacacaaaatacccaaagaaatatacagtaaggccctaaaattccagaaaatgcgactattaaaagcacgaacacatcatctgctcatggaggacgtgatcaatcaaatgaatgtctagtacttgagctacataactggatgtataaccaatgtaattcagaataaaacattgctgtgtttacattcaataagaataaagtgatgcacacacaactatagaactgtaaatcagcaaccaagtgcaagatgtcaaaaggcagataaacctaaaattgtggtaaataacaaatatatatactagtaagcacgcatggccaaatctagagaggcaattttcaccttgtccatcaacttgttcaacttcttcttttgtttttttatctctgtattcatcttatcattctcgccatctaaaccatcttggacaaaacaatctgcacaaaatattgagataattggatatactagagcagcataaaactgaattaagttttgcatcatcaaacactaaccattgacagcattgccatcctcactgtcagaataatatagacattcagagtcctgcacaacgagcaattcaggggcaatataacagacaatagataatgtcactggttggaaacagcaaacttatccaaagcatgctatagaggttttgggagccttgatgacacactattggcaagaactgagccatggtgactacggctgctatagtgatgagctaatgatagccaaccatcatacttgatatataatgtactaacataccaaaaaactgttcatctcttgccaacagatactacagtctcctacttggattttgcacagaaataagcagatttgtgaagaaagtttatcaacaagaataaaaaggaataatgcctatgcccttgtcaataggatggaattaagaaaaaggcttgatatatgtggaccaagctcaagcttggacaaatacaaatttgttatatgcttgagcacaatacatggaaggcatcacaatactgtaaatatggacagttgtgaacattttttaaaaaaaaagcatgattctttatgatggaatgaatgctggttgtggatcaatgaataagatcctctgaaaaggataagcagacatacctctgaaagataaccatcactatcagacagatcactgtttaattcacattcatcttccgggaactctaggccattaaccaaagctgcagcatcaccgttgttcctagaggaaaagaatttcgaatttatttagtaaattaaataaaagaaacactaatgaactattgtgcagtattatcatgattaatgaagttgtaaagttatgaagttgaattgaggttagtctattgcatcatttgagttgcaagcaaagttctggtcagtctcaatatctagtacaattcagaccagatcaattccatccaaaaaaacaaaccgacactatcaaatgtgtgaacctagcaaagcattgcaccctccccttctagttttcaccctattgtatgttggaaagcatcctgataagcctaccaaaataaacaaaaccgtaaggagaggtgaaagatgattacatgacgttatcgattgctcgctgcggcatctcgtcatcgccatcgccatcgcgctcgttcccgcgaccgctcccacctgaggaaaagaagagcatatgagctaccaacagaagagcccccgtggactggagccgtacggaaccaaaccacccggagaagagggaggagcaggagacgacgggggagcacgaacctctgcgagggcggcgggcgaactgcgagcgctgcttgcggttacgcttggcggcggactggaggtgcttgcgcgcgaacttgcgcgccttcttcccgagcttcttcgccatcccctcccctcttgcctcgctagggttagggtttcaggtgttctcctctctctctctcttcttcttcttcttcttcttcttcctcctcgagaagacggtagcgccggcgctccggcggagttgtggggtgagggttttggggttgaggacaagagaaacgtgggcttaaatgggccttctatggagcgcattttgtgggctgaggctgaacagctcgagtacattttcggacactttgaagtttttttccatcccatttttcaccctaaactatataaaatccgttattttttatctgatcctatcatcctaagttttcacaacccaaatagtagtttttatgtagaaaatttttaacttttagttatatgccaaatgcaataaggtcatttcagatccctaaaacaaatgtctaactattgatagactaacgaaaatcgttagacaagcgagaaagatagaaacaaacccaatgatatatgagaaatcaagtaaatatcatgagcttagttttcaagaatcacctgaaaaatcaacgacacttacgctgcattcgccatgtggtgtttgggaacaaatcctacacgcacgcaaaataaagtgattcattagcgtataattaattaagaattagctacaaaattttaaaaagttagattaatatgattttcaaagcaactttcgtatataaaacttttgcaaaaaaaaacatcgtttagcagtttgaaaaatgtgcgcgtgttcggttctttccccttcttttacatgtttagcaaaaaaacacacgcttctattaaggctgtgtttttgttgaaaagaatgtgtttggttgggtttgacgcagtcggataggagatggtcgtctctaagagcatctccaacagtttctccatcccactcttcaagccaaattttagccattctagcccaaaaacgtgctccaatagcctctccaactggatgactaagccatccggctggccaaaacccccctacactagccaaatttggacaaccagaaatcattggccaaccgtaggccccacacagattcctcccccctcccccctctctccttcggctcggatggcgcatgcggccaagacctcgacgcaggcgtcgtgcactgccgcgagcaccggcttccatgcgtcgcctgcatctccaggatggtgcggcggagccccttggccgcgagcgctaggccgcgggcgcccggcgaggaagaggctgtggtggggttcttggggagccgagctcgatgcggcgcagaagtgcggaccggcagcagagagcacgatggcgagcatcttgaacccacgccggagtgccaccatcgtcgtcgaggtcgccagccgctgtcgccgtcgtctgcaccgtcgccatccactgtcgtcgtccctgaggttgccattatcgtcgtctggatccggctccgtccgacctccgttgcctccgtccccaccggattcgggcggcgcggcgttgattttggcggcctctgccgtctccgcctatgcctccttgggctgcggttgccgacttgccgtcgtcgttgccattcgccgacgccaccatcgccatccactgcggttgccgtcgtcatttccattcgccaccgttgaggaagaggaggggagagaaaatccaggagaggaatccacccgttgccgcagtaacgacacgatcaatgtgtattgaatcgcctgcccgttacagaggtaatctcgcgaattctgaaccgttgcaaaagaatctcgagacgtggacgcgacgcacgccacgccacgcccacggcctcggcccggctcggcgcgcgcgcgtgtgactttccgatccccacctcaaccggtcaacatggaacctccaataactccctatttaagttgaggttctccacttttaattcccagggtggtattattatctttaacatttattatgggcccttgagattttaatagaaaaatcgggcctagcccatttattctaacaatccccaccaaattttatggctcataagaaatgttctcgaagttgaacctgtttgatataccagtgttttggtggagactgttaagttgaacttccacctaagaaaagagctacatcagaccacaactgaacaatggactatgccttgaattgtcattcttgtctgatcaggtttcactcaaacccttgactggtactgggctgccgtttgcatcccctctgtttggagcatataagtcaaactccaggcccttttatgagtatctagagatcgcccaaatctcatatactgtgactagcagtcgaactcatataggtgtgttccttctgagatgttctgcaggtcaacatctctgcttagaaaagccacttgaatcgcattaaggcataagccatcccaccatgcagaatagaagagaagtacatcatgaaaatgagctcttttcaatggtctcttctctcagccacacaatagtttgtttcgccatccaaattcacgggatctccgatcacaatggataggtttccactattgtgcaaccttaggtgggtatcaagcccatttctcttgatgcactgtctatcacattacgtggtagccccttggtaagctgatctgccagatttttagccgtttggacatagtccaatgctattactccggagtttttctgctttctgacagatttcagtcttcttttgatatgcctagatgacttcatgttgtcctttgaactgttcactttaataatcactgtttgattatccagttcattaggatagctggcactggtttttcaactaccggcaaatccatcaggagttcacgaagccactcggcctcaactgtcgcagtatctggtgttgtaagctctgcttccattgttgacctcgttaagatggtctg

SEQ ID NO: 54922 - DNA, 794 bp, Oryza sativa
  unsure (1)..(794): unsure at all n locations
aggaggttannnaagtgagctgctatcttattcctgcagcccggtgtgtacttgtgttattgcctttaaattagagtactccctagtgctaatggcactaagccaatggtttactctaggattagttgaacacttgaacgtactagcaggcatgcatgctcatgtcagacgtgacgacttgcaaaatgtcgtgtatcagtaccaagtctaaggccaaagtttttttccaaactttcaacttttcatcacatcaaaattttcatacacacaacttttctatcatattatatcaattttaaccaaactttcaaactttagtaaactaaacacagcctaaatgaacttcactagcaactcatcaaaagattagattatatatacacacaaacacaagattaattaaggagaggtgagttagtatagaggtggaaattctctacttgatcgaacaagaagagcacccaacgctcgcaatctcctcaggatgccgccgccgccgccgacgccgncgccatcgccaccggtgcgcgtggtgtcgacgcgcacggtgaagccatcgcggccacggccgcgggagcgcatcccgctcaccacctgggacgtgtccctcctcgccgccgactacatccagaagggcctnctcttncggcncaccgccgccactcttcacctcgtngaacatttcgccgncgcccttcgcgacgcgctccacgtgtactaccccgtcgccgggccgtttcgccccgacaagcacccccggcggcggttgctccgtctccatcgactgcgacggc

SEQ ID NO: 54923 - DNA, 755 bp, Oryza sativa
cctgcagcccaattaatacacaagaggtataatataatactccactagctagctagtacagtagttgagcatgaaattttgtctaaattattatttctctctctctctatatatatatatagttaacatacctgacaaaccatatgtttacacgtcgtgttacattagagttattgcgcatatatacataagtttcccattatatatatagcactccagatatattcatatataccatgcctctttattgccaactatatatatcacataagtaagtaggagtaattaatagataaaggcatgcatcgaataattagtacgagtagctaactagctagtacacagcaaaacctctgcagtctgcacactcaccacagtgatcacctattacaggactaattgaaagtgctgcatatttgcatgtagatgagtactcttagaccatgcagaacttattaacgtagagatcgttatactcatcataatatagtctagatgatcagtagtaataatcatattatatccgtaattaaatcaggcagctggagccacatcgacgtcgtcgtcgtcgtcgtcgccgttgctgcgacggttgccgacgaggaggttgctctccagtagcaatgcccatgcaaggcgctcacactcgctcttcgctatcgccattgatgatctccaagcacagtgtattttggctatcgaggaagacgaagaagaaagtgtttctatatgtatatggtcgatcgagttgagtg

SEQ ID NO: 54924 - DNA, 733 bp, Oryza sativa
ccatgagatgcaggaacgggttcaccggaggcgcgacgtccatctcgccctccagcatcttcaccaccgcgcccatcggcggccgcgcctccggccgctgctgcacgcaccagaacgccacctggtacatcctcaccaccgcctccttgcaccgccgctcgtcgtcggcctcggccacggtcaccacggcctcgccgtcgctgccactacagatctcgtcgctcggatgattgatggcggcggcggcgtcgtcgaccatcatcaactcgccgcgctcgtacctggcccacgcctccatcggccaccactgctggctctccggcgcggcctcgtcgaagttcctcctccggccgacgatcttgaggaggagcatgccgaagctgtacacgtcgcacttctccgtcacgccggactgcatcaacgtctccggcgcggcgtagccgggggtgccgcgcatgccggacacggagacgtgcgtgtcgccgcggttcaccagccgggccagcccgaagtcggccaccttgggcgtcatgccgccgtcgagcaggacgttgccgggcttgatgtcgtagtgcacgatcttgtgctcgcactcctcgtggagcgtagcggaacccccgcgcgacgccgatggcgatggcgcgccgcgccgggacgccgacgtcgcggctcaggtcgaacaggtaggcgtctagcgcgccgttgcccatgtactcgtacaccagcgcgcgca

SEQ ID NO: 54925 - DNA, 4905 bp, Oryza sativa
  unsure (1)..(4905): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttcagcaccagtaattgaaaacataaaagtattaccgtaaaataattttttggtaaattttatgtaaattaacccgggtattatggttcttactgcgtagaaccacagtatcgcgtgcctgggcttaaggcaataccctaaatttaccttcgaagtatactttattatccgcactgctcacgtggtggctatcacgccgtaattcaaaaaactacggataattcacttatacctaattaccctactttgtgtctttttctccaactatgtgtttacgtatattcgttaggatttaaatttgaggcctctaactctagtatcatatattcatacgcaatcagctagtccaacccaaaaaaacaacttaatttgacaaggagatatggacaaattccaagaggtcgatcgatcgcctgagtaaacacatgggttaaaacccaaatttgccggacaattaactagaatcaaaatcacttgaaaaccatacaaatttaagacattgactttataatcacatgtatatgctattccctccatcctaaaatataacggattttgaataaataagacacatcttatctatctagatttgtaattctaagatgtgtcttatccatcaaattccttatgttttaagacgaatgtagtattatctagctaaatatggaagcccgagtcgagtcgataagcacacaaatggatagaattcgccgaacaattaaacaaagatcacttgaaaaagcacacaaatctactaccaaaacacaacataaaacagaacagaacaaaccaaaatgaattaccactagtaataataataactgataagtctattcttcataaaaaacaaattcaattttttttgttctgctcccacgtgaagtcgcgtccccccaacacttgtccagccaccaccacttgttctttccttcccctcctcttcctcctcctcctccgatccccatgcctcctccgcctccgcctccctcccccgccggccaccgctagctgccgccggcgccacccccgaggttcgtctcccccggatccgtgctcctcctccccctccgaatctccccgccccatttcacccacctgattttctttacagcggttgcgcctagggttcttgattttgagcttcggagcgaggcgaggcggagatgtcgttccgcagcattgtccgcgacgtgcgcgacgggttcgggagcctgtccaggcgagggttcgaggtgaggctggtggggcaccggagggggaggtctcacagcgcggtgcacgagctgcgtgacggccacgcggccgccgccgccgccgacgtggtccagagcagctgctgggctaacctgccgccggagttgctccgggacgtgatcgagcggctggaggccagcgaggcggcgtggccgtccaggaagaacgtcgtcgcgtgcgccgccgtatgccggacatggagggacatgtgtagagagatcgtcaagaaccccgagttttgcgggaagatcacttttcctgtttccctcaagcaggtgatgatgatgctctcttgcttagtcttgtatttccgcgcttcgatttcagatttgtttaactaacatacatctttgatggttgtcgtatacacggcttaatatgctcatttatagtatgcgaaatgaaattctgatatagaaatatttgatatgttcattaatatgcttttcttgaccatgttttgtttttcagcctgggccccggaatggagccatccagtgcttcattaaaagggataaatctacccaaacttacaacctatatctatgtcttagctcaggtaagcctttatcctagtattgtgtttgtttttgtactcgctacatggcatgattatttgggggaaattggttctacgacactgaaagatcctgttgtgagtaatttgctatctaatgatctctatacactttaatatcatcgagttaggccgttcacttttataccattccatctgaatttaataggttgccattaaaacggactcatttgtcctctagcaacgacataagtgccacatgacacactcgcactaaaccctttcatttggctttgtcttccttgcgccgaaactacagcgccagcccccgtgatggccgccctttccattgcgctctcttctcctcttgatacagcgcgcttctcctctgaatcctttctatgcctcctttttttctctaaatcgaggcctcatcaacttagacattttcgctgctcaactgtcatggcttcaaggctgcatcacgaaaggatctgagaagcgagaactatcatgccatggtcgttgtgtgctgcaattcaggctgatttggattttcgtttggctttgtcttccatgcgccgaaactacagtgccagcctccgtgatggccgccctttccattgcgctctcttctcctcttgatacagcatgcttctcctctgaatcctttctatgccttccttttttctctaaattgaggcctcatcaacatagatattttcgctgctcaactgtcatggcttcaaggctgcatcacgaaaggatctgagaagtgagaactatcatgccatggtcgttgtgagctgcaattcaggctgatttggattttaatttggctggcaattggtgcttgtaaatttctgaaatcagaagagcccgcacatagcatccctgagttatttgggcctgcttgatgattgccgtttgccaacgagatgggaatcgtgttgattgaagctgtagctgatatgcatttcagcacatttcgttagtcatttcaaatttgtcaccggtgagcatgttggcctgcttgcaccaggcatggacagttgctgccttcttgaatggtgcagcgctagcatcgtggcagagcagtcgtgaccatagttattgagaccggaccggtcattaaaccggcgatgccctcggttcaatggtttgttggttcaaccggttgaaccactggtttgaagcggttcaatctaatgtaaatatatagtttattccttcaaaacacaaggtgtatcatagcccggtggttggttggttcagttccatgcatgaggtactgggatcgaatcccacctgtgcccctttttctcacatttttccctctccagctgccgaggtgaccgcgcgcaatgcagaccgggcggttgaaatccggttttcttggcggtttttctacaaaaccgggcggcccaaccggtttatactgggccgattgcacagccggtcttttagttggaccagaccggcggaggctccggttccggttttttccggtccaactgctggtccggtccggttccaataactagggtcgtgacagcctgataggagctcgtgctgatgcacatcctgcaacccgacgctgcagctgtgcaacgtcttgaggtgcttcctcatcagtttcaccaggtcctccatgccacccaccactgtggccctgacagcaacgtgaatggctgtgacttgcattccaaaaccttgcaaatccaaatcaacaagatacacactagagcttgagaatatgggtggcacagcaggcggcactgcagcggtgctggtgacaatctggttcaagaagctcaagacgtatgtctaatgggcataagtgtaagttttgagtgcaaaaaagggggaaaatccggtaaacactaatggaaggggatgcaatggttaaaaactgaacgacgtaatctttcgataatattaaagtgtaccaagatctttcaatggtaaatttctatgaatgggatctttggatgtcataggaccaattttcccttattatttagactgcatcacagctagcacttcctgtgaggggcttgtatgagtatctattgtttatataagcaagaatgcatgataccttgcataaacaacaaccagagattaatgtatagcttgcatatgtggcataatcatttacgctccatcaccgctagcattccctgtgagggacttgtatgtggtatctattctttatataagcaacaatatattatacatgacagtatttctccttgcataaatatcaaccaaaagttaatgtatgatttgcactgttagccagtatgtatgagttattgaggcatataagttatgtatgaccgtacagcttgtttggtattagtttaattattgcatactgatcttgcttaattattgcaattcccacgcgtgctaatcatttgtgcatatggatattcataccataccacctcctttgttaccccccccccccttttgcagctatttcgtcctgttgtgagctaatttcttactgcatatatccctcccaccagcatacttttttagtttctgttatatttgctgacttcacatgttgtaacacatctcatgtagctgtgctcgttgaaagtggcaagttccttttatcggcgaaaagatactcccgtgcaacctgtacagaatatacaatatttatgagtgctgacaatacatctaggtcaagcaacatgtacattggaaaattgaggtaataacccaaaataatggcaactttgtttagagaaggtacatcgtctaagtgttttaatggtataatctgatatatttactgtgttggacttttaggtcaaatcttctcggaacaaagtttgtaatatatgatacccaacctccatgcaacacagccaatgtttcacagtcagggaaaacaagccgtaggttctactccaggaaggtgtcgccaaagaacccttccagcacctacagcatagctcaagtttcatatgaactgaatgtcttggggac

SEQ ID NO: 54926 - DNA, 2157 bp, Oryza sativa
cagtagcagatattctgacatctcagtaggtggccccatggtcggaggccaggcattgggtgacagtgatgagtccaaggagaggccattgattctccgtaacaaggccccaagatggcacgagcagttgcagtgctggtgcctcaacttcaagggcagggtaaccgtcgcgtctgtgaagaacttccagcttgttgctgcaacacagcctgctgctggagccccgacgccatcgcaacctgccccgccgcctccacctgatcatgacaaggtcatactacaatttggtaaggttgcgaaggatatgttcacaatggactatcgttaccccctttcggccttccaggcctttgcaatctgcttgagtagtttcgacaccaagctggcctgcgaatgaaatcatcggtgcgaaagcatggttatcgattattgtaacaaattgggccccctccaaatttagctgggggctctatcctgttgtttgctatttatgccctattaacttgtagtcattagaaaaccaatgttttttttctagacatgttccctgatttgtagatgctgttgtgttgtatctgtatccctacattctccttttcttttgttttttttaacaggttgctctgtagaagcatatttgctctgcctgtaactgtaataattagctgactgaattgttatgttcatgcttggcttgtgcctagagtttcaaatcttgagttgtatcaaaatttcgtaatggctgcctgttgtgggagatgtgcaatgtatttttgatgaactttgttgagtggcaataaagcaacaatcagttccatgtgcttccaagccatttctccatccgttgtattctatcatggaatatccgtttgtcatttgatgaatgtttaatcggtactagttttagccgaaactctcttgaactaaagatgagcaatggaagaaaaacaaacctaaattattcctaaaattaagctgtgaaattcaaaattgtcctaaagacatactccctccatcccataatataagggattttgactttttgcttgcactgtttgaccactcgatttattcaaaaaatttgtgcaaatataaaaaacgaaaagttgtgctcaaagtactttagataataaagtaagtcacaaataaaataaataataattctaatttttttaataagataaatcgtcaaacagtacaagtaaaaagtcaaaatctcttatattatgagacggagggagtagtaagcagctaacggctgctaaaagttaaaaagaagtttgacagtgagtttttgtaagttatttttaaaagcacatgcacaactcatcagggtttaaatcctagtatccataaataagtggtctttcaatagaatttttgtgagattatggttgtgttgttttgaacttatgctagggaacatattcgtcaggtggtaagtgtgctgttgcgtgtgtaatgatgtgtatgggtgtgcggaaatatttgtaagtttttttttatatatatgtaaagcttttgaggggaaaaaaagaactgaggccgatctgcttgttccatttccgcagtgttcaaaaccagttggccgctgcctgcctgcggatgctctgagaaagtgagaagtccattcggactgctgcgtgagaacaacgcgcgtacgggcggcgccgacttcgacgtcgacgcggactccctcctccacgctcgccggcggccggaagctcctccgggtgaaggtacggttggttcccgagcgagccccaaccctaaaacctttgacacgccgcccgcttcccttcctccagtccaccgatccaatttgagttttcttttttttttcttcttcctttttcctttgcgcttgttcgttggattggtgcttggttagaactcgttactccggccgcaacgtccagcggctattgtaatctggagagtgcttcaatactctgtggatgcgatgcgatgcgatggtgtttcgagttgtttttcgtttaagccagcaggtgtggtgtgcgggatttatgagaaagatatattcgatgattagcactaatttgatctgatttcgaccactgtgaaagttatcagatagaaatgagtagtatgtggtatgtaccaagcaatttatggtttggatgtatcatcattcag

SEQ ID NO: 54927 - DNA, 926 bp, Oryza sativa
tcttgaattcaattattttccttctgcaggttgcttatgtgttaggtcagctgcaaaataaagctgcttcggatgcgctttccaccgtctgaagaatgttgatgagcatccaatggtcaggcatgaagctgctgaggcccttggttcaattgcaggtaactaatactgcaagatttgttaagtctcatattgagcgtccatatttcatagttttctgagggtactcccactgtcatctacagatcaagaaagcattgcacttctggaggaattcgcgaaggatcctgagcctatagtctcccaaagctgtgaagtcgcgctcagcatgctcgaatacgagagatccggaaaatccttcgaggtatattccctagatcaacagaaataacctttgtgcctttgtggtatcgtctaaccggcttgtgtttgttccatgcagtttttgtttctgcagactcctggggtgcagcaggagtcctgagtaagatagatatatctactccaggcttctatatcgatctactgccaagctgaccgacaaattttgtcatcaattttgtcaagacgcttcactcctatcaatagttataccataagagtgtttgttgcttatgtttttcaccactattgtttctcctggtctcctgctgcttatgtcttggaccatgagagtcaaaacagctagtaagaatttacctgagaattttcggtttcatggtaactagaaataccatgtaaaactttacacagatagtcaatgatgtatcgacatagcaacattaaatattgaaggacttcatgagcaaacagaaagagaacaataggcggacacgttctagagcaaaggttgctgattacctgttaagagtggattgttcctatcgagaatgattgtatactcgttttacatgattgtgactgttttg

SEQ ID NO: 54928 - DNA, 894 bp, Oryza sativa
tatattccattatactataataattaactaatcatccttttgatattatgcttcaataacttgcagttgctttcaaactttatgatctcaaacaacaaggtttcattgagaagcaagaggtatcttccttctgcttgttcataagccactctttcttgttttgctatttactatactccatgagaagcaagtgttgcatttttttagacacatgctttcagtaccccatatattagcataatttcccacctaataatttagcacaacaattcaacttgtcaagtcatgttccaggataagccgtttactgtactggcttgagtatttaagaattgtgagagtttttatgtctattacggcaaactaaactgcatccctctggaaggttaattgtttatttgtttgagaaggcatacttgatttagcatcaactcatgtagcagctgttggtcaagaaaagttattctagtccttgattatcaggtgaagcaaatggtggtcgccacacttgctgaatcaggaatgaacctttcagatgagattatagaaggcattattgacaaggtatgcatgagaacctgcattgcagtacagtgcgtatatctgttgtatttatactcagttgcttatggagaaaaaaaacatttgctttgttactagacatttgaggaagcagatacaaagcatgatgggaaaattgacaaggaggagtggcgcaaccttgtgttgaggcatccatctttattaaagaatatgacactcccatatctcaggtcactgttgctaacctgtttgtgcattctgtttctttttggtatcttaggtcactgttgctaacctgtttgtgcattctgtttctttttgttcctaataaataacttgtcaacttttctt

SEQ ID NO: 54929 - DNA, 734 bp, Oryza sativa
ggactcatttgtcctctagcaaggacataagtgccacatgacacactcgcactaaacccctttcatttggctttgtcttccttgcgccgaaactacagcgccagcccccgtgatggccgccctttccattgcgctctcttctcctcttgatacagcgcgcttctcctctgaatcctttctatgcctcctttttttctctaaatcgaggcctcatcaacttagacatttttgctgctcaactgtcatggcttcaaggctgcatcacgaaaggatctgagaagtgagaactatcatgccatggtcgttgtgtgctgcaattcaggctgatttggattttcgtttggctttgtcttccatgcgccgaaactacagtgccagcccccgtgatggccgccctttccattgcgctctcttctcctcttgatacagcatgcttctcctctgaatcctttctatgccttccttttttctctaaattgaggtctcatcaacatagatattttcgctgctcaactgtcatggcttcaaggctgcatcacgaaaggatctgagaagcgagaactatcatgccatggtcgttgtgtgctgcaattcaggctgatttggattttcgtttggctttgtcttccatgcgccgaaactacagtgccagcctccgtgatggccgccctttccattgcgctctcttctcctcttgatacagcatgcttctcctctgaatcctttctatgctt

SEQ ID NO: 54930 - DNA, 995 bp, Oryza sativa
aagaatatcgagaaaaatcgtcaacaataaccaacacataccactttcctccaacagattgcactctagctggaccaacagtgtccgtgtgtaatagatgtcccggtgcatccgtcatcacagaaacaataggagcatgtgaagaagcaaccatcttagcatgacgacacggtgtacaaaccaaatcaagatctttcttaagtttaggcaaaccacgaacaagatccaaactacttaacctagtaagataatcaaaaccaacatgtccaagtctacgatgccaaaacatcacatctttatcaaacttatcaaccaaacatgttatcacaggtgaaacaggattatcaaaatcagctttaaacactcttccatagcgagaaatattcaacacagaatcaccacaagaatcaaaaactttacttccagttttcttaaagtgaacctcaaaatcttcatcaacaatttgtgaaaccgaaagcaaattatactttaagtcctcaaccaaagctacattcttcaattcaaatttctcatttaccttaacaaaacctgtagcgagaacagcactagtagatgcatcaccaaagataatcgattcagtcttggatgccttttttgagggaggagaaccaatttttatcaccggtcatgtgccgcgaacaaccggaatccacgatccacatgttctcctttcacgccaccaaagcctacacacaagcagaagtcgaagcctcagtactggggttagatgataacaaaaatttaggaatccagtactaagacacacgaccagaagatccaataggcatatatccacgtgcaaaaacagtttgataattttccgaaaaatttctccgagggggtaccattgttctgaccgggggccggtccgaccgccgctgtaccgccggtctgaccagtgcccggtctgaccgccgctcagtagccggtccgaccggtcgccggtccgaccgcgagacccactgcggtctgac

SEQ ID NO: 54931 - DNA, 2277 bp, Oryza sativa
ctgcaccccagctttgcttttacacacttgggacaagaaagcacttcattggttttcacaacatcttccatgtacccaacacgacctaaagcatcttttaatttcaacttattcaaagtacatgttgagcaatccaaaacatcatgaggttgttttaactttttagcacaaatcatgttaaacatcaaactagcatgaaaagcaatttgatatttttgcaataactttttagttaaacacaactcatccaaagtgcgtgtgtgcaaagcaaaactaagagctagagaagatctatttttcaaatcatgtgcagcattaacatctctaattttagaaatttcattcattaaaacctcacaatttgtgcaatcatcatcattaggaataagatattttaatctagcaatttcagaattaagagattcaatgataaactcctgttttctatacaacttctcacacttcatattttttgcactcaaaatattaatggcttcctcaagagcacttacctcattgtcttcacactctgaatctaattcaccacgcgccatgaagcaaacaccggagatgttatttcccttatcttcatctccactctcaccatctacatcgcttagtggctcaaacgcggtgtagacttgatcaaaagccttcttgagattctccttgatcttcctccctttgaatgtacccttcggcttgttgtcattggtcttctcatcaccattatcttcccccctcgctctcccaagcttaggacatcgtgaacgaaagtgatccgtagaaccacattcaaagcaatgatttggtccacctcttttcctttacctaacattagtcacagctcgagaaagtctgttagataacaaaaccaagtcctcctccacgaactgttcgagttgatcatcggacatggcattaaacaaagcaaatgcggaagacttcgatgaagaagaatcaacatccaaagaagttgaggaagaaaccaaaacactcgagttagaatcaactttacgagaaagaatattcatctcatgtgttttcaattttgtgtaaagcgaatccaaagtcaaagtagacatatcaacggactcctgaatagatgtaactttcatcttccaaatagacatatcaagaccattcaaaaagtggtgagaaatctcatattgtgtataattaacatcataagaagaatcaacagatctaagatcactcaaaattttgttaaacctagaaagatagtcatccaaagcttctccaggtttcatctcaaatttaatgtactcctttttgaaaagatctcgacgaagctcttttatgttatttgttccttgatgaaaatactcaaagcaatccaaatctcatgggaagtttgaatatgagcaacacgatcataatccgaacaagaaatcccactcaaaagaatattgcgagctttacaattttgttcaaactcagtttttaaagcagcggtattaatttgttcatgaatcacataaggatgagaaacttttctccaaatatcataatcctcagccataatgtaatattgcatcctactacaccaatgagaaaaatcagttccatcgaaaacatgaggcttagttgaaaacctaacagccatggcaaaaactctagatcagttaaaatccaaagaagaaaaaaggctctgataccacttgtaggatcgaatcacaacaactaagccaaccagaggggggtgaatggttggtatacccaaaaaacaaaaaaaaattacggaaataaaagttaccctcaaattctacggatcgcattctgaccgaaggtgttgcgccggtctgatcgctggttgccgacggtctgaccgatattgtatctccggtctgaccgccgagatcagctcctgtcgcttgtcactgacgccggtctgaccgcccttacaccgccgtggtgccaccggtctgacctccgatgagccgtcggttagaccgctgaaacctcgtgaaacacaaatcgaataactcttaaagtggatgacgactttattgattctctctgtgtttacaaagtgcacaaacaacactccttataaaaatctctaggaaactcgaaaccctaatagaactatcaactaaaatctctcaaaagcgataccgggaagcctcacgctccctctctatttatacccaaggtaggcaacctaaagcccctaaccatactcatactagaagtcctaattcccctaagaaaccctctagtaaacgaaacaaactttacataaccaatcacacc

SEQ ID NO: 54932 - DNA, 722 bp, Oryza sativa
tgctttgtgggtgagtgttgaacaggattcttagcagggttaatagcactaatattatcacaaaagagagatactttcccaaaagtaagaccataatctttcaaagtagataaaagccaaagaatctgtgaacaacaactagcagcaacaacatattcagattcagcagttgattgagcaacactagattgtttcctagaagaccatgcaatcaatgatataccaagaaaatgacatgttccattagtacttttcctatcaattctacaaccgccaaaatcagcatcggaatatccacttaagcatatagaagatgaagtagaataccaaatttcaaactcaagtgtatgattcaaatacctcattattcgcttgaccgcttgacgatgtgaagcacgaggagaagcttgaaagcgcgcacacaaacacacagcaaattgtatgtcaggcctagaagcagttagatacaacaaagatctaatcatacttctatactccttttgatcaacagcttcaccatcttcatcaggatccaacacagttgtagaaccaattggtgttgaaattggcttgcaattctccatcttgaaccgtctcaaaagatccttcatgtacttcgtttgatgcacaaaagtaccttgaggtgtttgttatttgcaatcccaagaagtacgataactcacccatcatggtcatctcaaattccctgcgcatagtctcag

SEQ ID NO: 54933 - DNA, 781 bp, Oryza sativa
  unsure (1)..(781): unsure at all n locations
cggtcncaatgagctgctatcttattcctgcancccaaaatttgactaaaatggaaaaaggataaaattttggacgaaatagttgcgtgccggaggggttttcgaaatttcaatcactgcacccgtgtgctacttagggtggttgcatcatgataaaattactatataagctatgaatttgattcctacacggttatacggatgatatatgattacattagatacacacgcacgcagacataggttatcgaaacagaacagcctccctcaatctcaattctcaatattctcaaccgtgttctagattgagatcgaacataaaagttcttcaactgcccttttgttatttgtttttttgacaacatctacaatttaatcttatgaatgaataaactcaattgtcaaaagcttctttcgatatatactatttctggtaaaaaatagaaatcaacttctatatgtttggtttatgaatgaaacattggatatgacgataaatactttgctccaaaattatcacattcataccacaacttggcagacgtaggagtgtagagttagaacatgagttctcgcagaagtgactaaacactcacaatctaccatggtattagccttatattctgactntctacaagaaggtaacattgtagcctgcttacatgcactcaatgaaagcacggtttgcatctgcatatctaactattatcgttacaggtgatttattttttgattcctagtccacttggatgcttaagacaccttaaaatttatttaattg

SEQ ID NO: 54934 - DNA, 740 bp, Oryza sativa
acttgctccttgttcaaattaatcaaattgacataatccagtgccatgttggcatatttctgcttagttcttccctttgggataaattgttaatgttgttacatttggaagcatgtttaaacagaagtaggatggcaatatctttcggtgaagcgccagagcagctgcgggttttggagcacaggagagcagattgcactgtgatgtagaacaggaaacaacaggttggtccgctctgctgatattgcctttgttttattgctactagatgctttgcccatttttttcaatttaacaaattctgtaggcttttcaacagaaatatttgggtgaatcaaatgctgacaagtgtagtataggaagttccattgcttattgcatgattccactttgttgatcatcatgttggcatccaccaggagaacaaaacaagagcagaagtaattatatcatttatatttgttttcttgtcttcagattccatgactgttggaatcgttggtttgctggaatcattggtccaatattgcatctatactggattctttatgcaataaattaatgctcatttctctagtatgattaggatgactagtccaaggtgtccatctcccggccttaactcatttgatgtcatcgatggtagtgtttcataatcaagttttgaagagttaatggcaagcaggcaaactcatagactcgcattcttttcctcttaacggattatggattatcgggca

SEQ ID NO: 54935 - DNA, 1382 bp, Oryza sativa
aatatatttgtaatataaacgagctccactgaaaatcaattaaatacataagttacgttagaaatcaaggaaaaacggttaacagataataaagttcatactcaactaaatttaactgataataaataagccaccatacataagtagtttgcatggtctttaaaataaggaggctaggcttggattgataataaatgacacagccacagatttctctcccatccaaggaacacttcgaaaaactgatagtgtctagttgcaattactaggatcccaatggcagaccaattattttgtgataatgtcttatgcaattgtcgcatagtattgcagaaaacaatgaaaattggtattcaattgcccatgttgcagtaagtacatatacaaaataaaatgaagcatgatgtcttacaatcaattttgtcatcaattggagcattgggatgaaacacagaaagagcccgtgcaaattcttcgaatccaagaatcccattgtgcttcgtgtcaaacaaatcaaatacctaaattgattaaattgaaaacagcgcacttttgagttgacttcagatgatggcataaaggaatgtgcatctgcatgtttaaaaagtaactaataatttataatagggccaattgcatatttgccactgatttgaatcggtattgtgaatttgccattataaaaaacgtaattgcatgcttgccataaaaaacgattggaacccatgatacttgccattagattcacggctgggaataacaccgttaaaagatgggttctcacaaaaaataggacaaggatgcccctccctgctgctgccgtctccgggcgcccgccattgttgctgctcttgctgcagccctaccaccttgctggcttgctgctgctatcgtagggagttgttgcagctgctgctctcgctgcaggcctgtagtgagctgctgctgccgcgtgctcgtgctgcagccgcgagcgttgctgcttccgttgcaacgtgctgctgctgctatcgcggcggctgccgtcgacttcctcgcacctccggcaagattacccaaaaaaggtgagattttccctacccccgttgcccgtcgtcgcaaggactccaaccaccgccgacatgcacgccggtcgccgtccgctgtccgcctggccacatgtcctcctgtcgtccgccgacacgccgcccgtcagcgcgccctcccatcgattgtccatccccacgccgccctcaagccctctacctgtgcgtggccggcagccctcccgccattcgcccacatgcctgcaagtgagagggcggcgagccagcgaggatcttttccggttaggggcaagatggtcttgtcatgctccttatcttttaagttagttttatgaa

SEQ ID NO: 54936 - DNA, 7974 bp, Oryza sativa
ccccctctccatgcttgcgggtgcatgattcacacacatatattcacactcacatgcacaaatagacatatgcaatcacatgagcagagttttcaaatatcaacttctcggtgctttaaattattccatgtaacattgactactccacattcatacaatgtgtactacatcatacgtgcttcattaatcatgatgtgtaaaactaggaaaaacgataaagtgattcagtagtgcagaaaggctagaacagaccaaataccatgaacaacatcataaaaacttcattaaacagaactcaattagctagccatacccgatcagcaaacatgctgtcttttctgttggtcttaaacagtgccagttggaattcttcctgtcaagacagccaatgccatcagctgagttaactagttcagatgccacggaattctaattttgatccatggccatccaattcacagcaaaggaaactagcagaaatactactaaccttattgatcaagccatcatcaaccacagcactgctaatcttcttgaacagctcatacagcgcctctatttcatttacgttaactgcataaccaagcagaataaactcattgacgaataaacggaaacagaacaagaataccatctattaagaatatatactgaaactgattccgtacacatcgaatcatcaaaaagaaggggagttggaaagaggaatcttacaaactgtttccctcgccaaccgttcaggatcctgcaggccgttgggacgattggagctgtcaaggctgcagcacttgaacagcaacgcggcgagccgtcggagcccttccgaggaatccaccatttgcaattgcaaactacaaccagcagctccccaatcaacaagcctcacacctgcaacgcccaacaacaacaacaacaaggagatcacccaatataccgtaggaatccaccgcccacaccaagtcagcaaccaccatcgcccccaattcggcaattccccgccggaatcacgaagacgtgaaccgaaatccacatatcccatcatcgatcacgccgctgccccaggaaccgaaactcccggatcccacccgctgcaccccccaacccaaacacgaaacgaatcctctctcccacggctacgcggtggtggccgccccatccacgaacagaattcccagcgacgacgacggcgacgacgaggccggcgggggagaaagagagggctacggggaacggggggattcggggagatcggcgggggagaggagtcacctcattgggagatccgcccgtcctcctcgcgcggcggcggcggcagcggcgacggcggcggtggcggtggagtgggggaggagaggatcagaggagaggctcgtcgtgggatgtttctagaaggcgatgaggagaggatgtcgttgtgttcccccggattctggggagagggcctttggtgtgagttgggctgggccgctgcccgctggagggctttgaagtggacccatggcccataacttatcgtgggggcccgatattctgtcttatctcgatgaccagagagtttgggcctgttcggctatctgtctgcggtggctgcggctgcggctgggccgtgtgtgtgcagcagcacggttggtgccgggccctttgtagtgagagtagagttttttctacatctcaaaagataatggattttggttggagatatattgtagtactacgaatttttgactagacatataaacatacgtctcgttcaaccaaaatatcttatagttgaaacagagggagtaagacgatgggtagagtgattgaaaagtgccactcccgctgtttatattatacaatgttttggttacaggtatgtagtttgatactaaatttgttatatttcgagatgaaagacgtgctccctccgtcttaaaaaaatctaacctaggaggggatttgatcccttctagtacaacgaatctagatagaagtttgtccagattcattgtactatggggggtcacatcccctcgtaggttgggtttttttgggagcagtatagctagcgactctatgataagcactagaaaactgtaaaatgaacttgccaaatttacatatagtttcatcgtagataaacaaccttaattctatcttactataaagttaatgttcactaactcctaaagctcaatatgcaagtgtttcacatcagcatccactagcaattattatctagagtattttaaatcacatgcaagtgtcatatcatcacccactagcaattgttatctagagtattttaaatatctttcaaatatgacatatcacttgcaattttattgtatttttagaactcaatatgcaaacaatgtcaaatcattatctccatgacattttcatattttttaaacatatacatctatcattttctataatgtataacatacatttattaatatatctcgcagcaaagcacgaggtatcaattaatgaattgcacaagatgataacagatcttaattgaaaaccaatgaccctattggctactcatcagttagtgcctgtagtcaaaattaaaattttaaatataatttaaattcgtcattttattgttttctatttttcagccttaggcctcagcttttaaagcgctaacattataagtataaaaagtcattcctaaagttatgtatgtggttgctttgtttatttctatatcaaatgtggtgcttgcagatgcatacatgcgtcactaatgttgtttgaatattgcggccagatataaaaacaaaaggatttaaatgataatggtggaataaaatgaacggtgttgggacaatggtaaaagcgacatgaagcatttcctgatgacaagggcagtaatagagcttcgtggggcaaaaaaaaaatcgtttctcgtgttttcctcttttttaaattcattcaaacttgacaagcacttgtaacgtcttggagagttgtagcatgcaattacatagaattttttttttggcaaaagtcatccataagaaattaattgtttatcgcaaagaagaaaagttatggaaaggatgatcctcaggtgctgcgtaagaatcattggccgtttttcttctgatgatgtgaaatgaggagaaaaaaggtgcaggagaattttcaaggaagagccaggattgtgattgatggtatcaccggctcttttttgtttggtgtcaatcggaatcgggtaggcaacggaaatgctaatactcgttattcattctgtagattttgaatgatgctccctccgtttttcacttgtattttaaacattcatatcttcattgatctttttaatcacatgggcattattaaaaatgtaactacattttgattaatgtttcctatatatgataaatctactaatatcagtttttttatttgaaatattataatcccatgttaagaatttgagatttgaccgtaaatgttctagcaaatagctagtaatccgttaaaaaacagaggtgataacgaatggttcaacttccaaaataatatgaaaattttcaatgctatcaagagacatacaacacgaaacaatgtaatctactccctccgtttcacaatataagtcattctaacatttcccacatttatgttgatgttaatgaatctagacatatatatctatctagattcattaatatcaatatgaatgtgggaaatgttataatgacttacattgtgaaacggagggagtacatcataaggtttaatatgttcgtatcaatcaactctaagtcatagtatcggttatttttaaaacccgtttggctattagtcttggaaatattctcccaacaactaaacgtattcctcgactccttcccattttatgccaatcacattatccttgtagcctataattccaaaccgaacaagcccagatatattgcacacataaagcattatgggcatgtttggattagtgccaatttgtgccataccaatatttttggtagcttcaaagagtactttgatagcatttgaattgtgaccaattttgtctatctagtaataaatctaccctattaaatttggtagtgccaaaacttactaccaatattttaataggccgcaaactaaatcagccctatactatgaggcaaacaacccaaagtgattataaatttgcacccatctattggcacatctaggctgtgtttagttccacgctaaaattgaatttaaagaaattggaacgatgtaatggaaaagttgaaaatttatatatatagaaaaaattcgatgtgatgaaaaagttaaaaatttaaagaaaaaagttgaaatctaaacagggccgtaactgtctcctgtctgtcgtatatacgtatgaggtggtagtatctccgtatctccgtacccgcactggcagggtgtcgctgaggtggccgcgcggctagtgggctccaactgcaaagaccccgggcccacatgtcatccaccgagaaggaaaacccaccggcaaacagttatccgggcccaccgccgctgtagcacactgctcgttgattcgaccaacgcggcatttcttccttccccctacgaaattaccatcctaccctctcccactccctcctcctgaaccaagcccacgcgcctcgccgtccgatccacctcgagatccgcgccctcctgcgctcagctcctacaccgagtccacagagaaaccaggtccgcccccgcgcggactctccgtacacccctccccaccgcgctggcccccactccgaccgtccgttcccgcctcgtgattcgtgccggcgaccacccgcctccgtggacccggtccacggggagattacaccttcacccccctcacctcacctcacctcacaccacgcgtctccccccaccaactagctctctctctctctctctctctcgcgccgccgctacgctcgccgcgccgccgctacgctcgccgcgccgccgctacgctcgccgcgccgccgcgggtggggagatttgaccggcgttgactccgggatggacgggcggttcccgctgccgccggcgagcggaggggggcgggggcaccaccggcgggcgcactcggagacgttcctgcggctgcccgacgcggacctcctcctcgacccggagggggacttctccttctccgacctcgacttcccctccctctccgacgactccccggccatctccgacccgaccccgccgccgccgccgccgatggctgcgacccccgcgccggcgccgcggccaccgggtggggcgcacatgaggagcctctccctcgacaccgccttcttcgagggtttctcgttgcagggtgggggaggaggaggaggaggaggagggagtgggggaagtggtgggcataagaggagcgggtcgatggatggggtcaactcgccgttcgagggtgagtcggcgctctccggtgggctaccggactacgcgaagaaggccatgcccgcggagaggatcgccgagctcgcgctcatcgaccccaagcgcgcaaagaggtgaggaaatcgcttgctgcttcctctactccattttgagttcagcaatttctagatccgcagggatgtgccttttgccccaatcttgtacagtgatactgcgatttcccatttcgaagaatatagttggagtcagtagtgggattgctgctgttcttggtgtttcctttcttgatctgggctatctgtgccttgcttgatttgtgatgtaattggggagatgtattggggcttgttgatttaggttaagcttgtgatggcgcttgtgtgcagaattctggcgaacaggcagtcggctgcaaggtccaaggaaaggaagatcaagtacactagcgagctggagaggaaggtgcagacactgcagaccgaggccaccacgctgtctgcacagctcacgcttctccaggtatggaactttgtttattccgagcgccagataagcctcctatattgtcttatctaatcagcttagtttgttagtcaattgttttgtttgacatgtattagttgtgcaaagttagagtaggttacacgaaactttaatgttttgactcaatgattgtcatgcatgtgaagaactgctgtaagcaaagctactgcttgaacctttttatgtttttagaagcataatagtatgttgctgtatcttgtccctttccttctagctaaagcggcttattgattgtttcaagcatgtgtgctaagttgtggatcttacttggggtgtcaaaacgagctatttgtgttactatgataatgtgttgaagaaagtgtgcaggaataacacgtaataatagcatgtagctttgcattgcataacattctatgaatttcattttttttatacaattctgttgtgggccagctttatttaaaaccaaataacagtttataagttagtacacaataaataatttgtctgcattgaatgcggcagttcgtttccttttgggttagcaacttagtgtcctacagtaaacttccagtatctgagctcagagctgcagaaagtttaggaagtggaatttttaaagcatgatagtcactagaatggaaatgtacaaataagaactttgttagtagaccatttattctacacatattttaggacacttcataagctaaagcataacttagttcttttttatttcaaactgatgttccttatggcaccttatgcatctagcacctgaatttattagattgatagttgcctagatatatgtggctttgtaaaaactagtgatagcactagtattccatggatgtcaaatggacagtgagatgtatggtaaatcatttttttgttagtaatatcaagatattctgaattttgttatggcactttgcatggtgcacaatgtaggacaagctgtagtgtatgaacacaatggagaacataataatagatttgacaagagcacaacattttttttcctttatcattaccttgttgcctgtgtaattgttgtagatgcgacaataagagtaggaattgaagcacctaatggtttaagaggtataagtatgtttgtagcgtgaacgatcgatcactcaccaaaaattgggctagtgatgaaccattttagagtgcagtttgattgatggaatcagacgggtcatgttaggatggagaaataagtgaccacagattgtaacatatgatgtctcactttcaagaaaacatgctagtgcttatcatataattagaacaaagcagtcatccagaaatcccatgaataaatgatattctaaaatgcgcctacttttatcatgatccttctgaagtcagcttattttttgtgacgataacagacatttttgctttatcttttttgagcaatgaaataatgtcagtggcttgtatgttctttggaatcttatattccttcaaccctttatgcagttctgtttgttcattgtataatttatttgatgagattcagagaactagagtgccatctaattatttatttccctatgaatacatagttttttttacttaatgttgtcaacttttacgtacagaggatatggatgctaacttaatattgctcattttagtacataatttgttgcacgtagcatttgcgtaaatttagtccgtagattgtcaagctttgaatcatcctatcgcacaacaccattttttgcatgctgctgatagtatctggtaggcaaattactcgccaatcctgtaagccaacagtttcttttgttctgtttgtgtatgtgatgtgtgccatctggtagtctcgaatctgattttttgcaattcacttgaaacccacagggatacatctggtttaactgccgagaatagagagctcaagctacggttgcagtccatggaagagcaagctaaactacgtgatggtatgcccttatcttttgttacttcatcatgtagcctttagtatgttgtgcaatactactacatggttgcctatga

SEQ ID NO: 54937 - DNA, 1512 bp, Oryza sativa
tgaacaaatatgtaggtgaattatcacttgtattagtttgaatacatcacttcatggagctagagcccatctctcaagtgtgatgagatgcatatatatatctttaaggatatataagtggaacccttgtttgacatttcaagcaaaagggaagtagatcagtagcatcgccacttgtgatgccactatttgtgcatttgtgcaatactctcttttagataatggattaactaaaacccacactctacatcctacatgtacatgaccaaaactgtgcaatactcctttcaacaaaaactaacagttgtgcaactgtaacttccaggaaacatccaaattaagagaagcgctaatacagaggtaatgtcaatccaaacaactttatggtgttgcgcaatgcctaacattcatcatctcctctccaacttgcttcaaaccaacgaccactccactctacgagctccaaactccacccatatcttttgccacatactacttcctcagaataagttaattaatctgagattaatttattttggatagacgtctgtccagatttataaaattaggatgtgtcacattctgtgctatcaccgtaatggtatttgattagagcaagtttaatagtatagccaactactaactccaaagcatctacagctaatgtaatagctaattcatacaatagttccttactatactattaatacccggtcctacctgtcatacacacattacgtcttggagtttgtgctgcagctggctacagatctgtagcccactgcttttctctctcttcctttatctatttaaaatatgtttatagctggattatagcctgctattatacctgctcttaacaatgtaatgatccaattggaatgatcacctctgcagactgacgagaccctgatctcaatgagttatcactttcagctgaatctgtagtgcttgtccacctaagcgcagccgccggcgacgcgaccaaatgctggaacgggttcaccggcggcgcgtcgatgtccacctccccttccagcatcctcaccacggcgctcatcggcggcctcgcctccggctgctgctgcacgcaccagaacgccaccttgcacatcctctccaccgtctccctctcctgcttgtccatggcgtcgcagccctcgatggcctcggcgaggtgtccggcctcgtgcttgctccacgccagcatcgggaaccactggtgctggctccccggctcgccgccgtcgtcgaggttccgccgccggcggacgatctcgaacaggtgcacgccgaagctgtacacgtcgcacttctcggtcacgcccgcctgcatccacatctccggcgcggcgtaacccggggtgccgcgcatgccggacaccgagacgtgcgtgtcgccgccgctcgccagccgcgccagcccgaagtcggccaccttgggcgtcaggccgcctgcgaccaagacgttgccgggcctgatgttctaatgcaccatcttgtgctggcact

SEQ ID NO: 54938 - DNA, 1112 bp, Oryza sativa
tgagtaggtgtcgaaaaaatcatcgccttctttttgggtataacccttagccacaagccttgccttgtacttttcaattgtaccatcaagcctaagctttttcttgaaaacccatttgcatcctacaagtttgcacccatatggacgctcaacgacttcctaagtaccatagacataattgagtccatctcactgcgtattgcttccttccagtagtcagcgtcaggagataagtatgcctcttctatggtttttggagtgtcatccatgagttatataatgtagtcatctccaaaggattttgcaaccctttgtctcttactcttacgagtatctacaatgttatcctcctcaagatttccctcaggcgtttgatcattgtgttctatcggtgcaaagtgctcatggggtatgacagtttcttgactagaagtgctaggtgtattttcatgggaaattcattctcaaagaatgtggcatctctggactcaataattgtaccaactcgcatgtcgggtactccagagtttactattaagaatctataacccacgttgtgaatagcataaccaaggaacacacaatcaacagtattcggtccaagtttacgctttttggctataggtacatttaccttggccaaacagccccatgttcgtaggtatgagagatttaatttcttcctttctcattcctcgaatggtgttacttccttatgcttcattggaattttatttaggacatgacaagcagtcaaaactgtctcaccccaccattccttggaaagtcccgtagtgtctaacatggcattcaccatctcagttagagtacggttctttctttcggctaccccatttgattggggtgaatagggaggcatcctttcatgaataattccaaactcttcgcaaaaggatgtaaactcattagaaaaatactctccatccctatcagacctcaaccgtttgattttccttttaagttgcttttctacctcagctttataggtcttaaagtaatgcaatgcttcatcctttgttttcaatagtgtcggtgacatgggatcgggagtatcatgactagaggtttgaggcagacacaatcgcccacgt

SEQ ID NO: 54939 - DNA, 10884 bp, Oryza sativa
cagcaggcggccacaattccacgacgcgtctgctcccggcgaaagtggaggtagttgtgggccgtcccatcagaaggtgactcggacggcaaccatgcaaatctccgtccatttatgaaaaggtagggtaagtccccaaggagaaggggggatggtgcatgtggtatccccttaagatatagaaggaggaccttgcccactgagagaaggagagagctttttcttggactggacctttccagattaggaaccgagaacaagggagaggctggctgatactttgtagctctttcatacacagatctcccaaaacacaggagtagggtattacgcttctcagcggcccgaacctgtatacatcgccggtgtcttctgtgcttccggtctcgcgaaccttccacatacagattgagagcttagaatctcacccagggtccccggccgaaccggcaaaggggggccagcgcggtctcccggtgaggagccccacgctccgtcaaatagatacacataacaaaatctagtgcaatcatctattagtgtcatgaaatatttctttccccctttagtcaacacgccattcatttcgcacagatcggaatgaacaagttctagaggtgcaaattcctcgcctcagatgccttgtgaggcttgcgaggttgtttcgattgaacacaagtatggcacttggaacctttgaccaaagtgaattttggatttaaactcatgttagccaagcgcgtcatacaaccgaaattcacatgacaaagtcgtgaatgccacacattggactcatcattctcgttaatatggttcacaacattattattattacacatgtcatccaaagaaaagcggaacaagcctccgctgtcataaccttttccaataaaagttccatatttagatacgacacatttattggattcaaacacaagtttaaaaccttctctacacagtagagagccactaactagattcttctttattgaagggacatgctgcacgttcttcagctgcacagtctttcccgaagtaaacttcagatcgaccatactaacaccatgaacagccgcaagcgacccgtttcccatcaacaaggaggaacctctcccgacctgataagaagaaaacaggaaaatatcagcacatacatgaatattagcacccgtatcaacccaccaatcaggtgaatgaaaaacagagagaactgtaggtaaaattttaccgtaccccgatgttcctccgccctcgctaatgaccatgttggcagacttcctgtctttgtgctcaggacaatccttggcccaatgcccaggcttgccacacacaaagcagtctccctttgcctttcccttgcctttcttcttaaaattggttgtagccttgggtttgacatcatgcttgactttcttgttgttgtgggatgcgtgagggttcttcttctgtaccatattggcactagaacctccctaaacctttttgccccagatgtcctttgccctcgccttctcctcaacacccaaagagccaatgagatcaataacactgaactcttgtctcttgtgctttagagaagtggcaaagtccgaccaagaaggtggcaatttggcaataatgccacccgccacaaacttgtccggcaactcacagttgttgttctcaagttccttagccagcatctgaatctcatgagcttgttccactacagaacggtcatcgaccatcttatagtcatagaactgctccatgacatacagctcgctgccggtgtcgaaaactccgaacttggcctcaagtgcatcccacatgtccttccctgaaggcatgtgcatatacacatccactatattgtcagcgagtacactgatcaatgctccacggaacaggcaatccgaagcctcgaacttaacctcttcctcaggagagagaggtggttcacttcgtttaccccgtgaaacatagaaacattgcatcgctgtcaaccacaatagtgcacgtgctttccacctcttataatttgaaccatcaaaagcatgcggtttcagtgttgcagcaaagtcaactaccgaaaatgacctatcaggtttttggattgttggaaatatggtcatatatcagcatattttaatccaaaatattaaggcaataaacatgacatgaacaatgtgaggtgatctagtgataaaattaaacataaccagaagcatgcttaagataaaataagcatcaacatcatttagagaacgcaataacattgcgactaatagatgtaacaaaaacaaaaatgcagtaggatggtataccctgtaaaggtccctccgctggattgtgaggcagaactgcctccgttggtgttgtcgatcggtgcgtctccagttcctggcgcacctccgttgacgccgccaccagtagacatcgccgcgacgcagaccgaacagaaccaccgacgatgatgaagagagagcagtcgtgcggaagcactctccaaaaacctgatcacccgcctacccggtgcagatctcaggcgaaggtgtggtttcggaggccctgctcgttccgatcactcgtgcgcgtaagcgatcagaaccggggaagcagaagcagcataggcgcaagcgtggaggaagaaccagcgatgggagaatgcgtgaagatctgattgggggtctctgtttgcgcgtggaggaagaaccagcgatgcgtgaagatctgattggggtctctatttgcacgtggaggaagaaccagcgatgcgtgaagatctgattgggggtctctgtttgcgcgtggaggaagaaccagcgatgggagaaagcgtgaagatctgatcgggggtctctgtttcctaatagcgcaggagaggaatccacccgttgcagcagtaacgacgcgatcaatgtgtattgaatcacctgcctgttacagaggcaatctcgcgaattctgaaccgttgcaaaagaatctcgagagatgtcggacgcgacgcacaccacggccacggctcggctcagggcgtgcgcgtgtgcgcgtgtggctttccgatccccacctcaaccggtcaacagggagcctccaataactccctatttaagttgagattcttaacttttaattcccatggtggtattattatcttcaacatttattatgggcccttgagattttaatagaaaaatcgggcctagcccatttattctaacagaagtttcctagcgaaagctcagctcttcgaggcctgttcttgagcattgtaacctcctagaggcattatcgtggcttccgttcttcgctggtgaatctttaggtgaaaaccatgtcccgtttccctgggacgggcaatggcagtgtcctcgcgcattgtgaacttcttggaggcatcatttgatgctccattcctttaatctttctccagacgatcatcttcttgtagtgccacttctaaccttcacaagatggccacgttgtttgtatgaggtagaacgtatccattttatctctctcactctctccctctccaaccaaaaggtatggcgtgccagcgattcaacagccatgatttggggagagactatgataccatgtgagagaaggcggggattgaagatgcattgagttaaccctagagggtaatataatgtacatgagggaaagggaaaatacttgaatgcctataacacacatgtatagcactcatactctaacagagaagaagatggcgatgactaactaaagcgcaaaaattatataatgtcctattgtgtgttaaaatgctttaaatttaggttattgttttggctgcctaattttgtccgagatgtgcccatcaaatccaacgaataaatgagtcatcggttgcatttactcttagctcaatcgtttaccctttagcttatcagtcatagctaaaattcgaatttcatatagtttattttttcatcgggttttaagtagctaatataagactgcatatataattttttttagtcacaagttacttactcactctctttttttaatatatgatacatcatacatttaactttttaacacatgttcgactattttcatcttattgaatttttttttgcgaatgtataaaatgtaaattatgcttaaaatgcttttagtgataaaaccactcatgacaaaattaatggtaattacattaattttttgaataagataaatgatgaaacatttatcgaaaatcaactgtgttatttatttatttatttaaaagaaataaggtagtataatcaactagctatcgagactgttttgttgatggccttacgaaaagactcaagtgtaacccagaaccagagccggcgccgccgtcccgggcaccggctgcgatgcacgagctgcacgtacggcatgcgtacgtgcatgccacacgcggcggcattcctggtttctctccccctccctttcctcttgcccgtccattgcccaccaccaccaccctgctctccccccagacgcgcgccaaatcccaaaatgccccactacatgcgccacgccgcgcgcttcccgccaccgccatggccggcttcctgcaccgccacgtgctccccccgttccgccgcccgcctccgcctccgccgccgccgccgcccccgcgcggcggcggccgtggacgccgcggcggatcctcgacccgggcgacgacgtggtgctccggtggaaccgcctcttcctggtgacctgcatggtcgggctgttcgtggatcccatgtacttctacctcctccacaccggcctcaagtcgtgcgtcaccatggacatgcagatcggcgtcggcgtcaccgccgtgcgcaccgtcgccgacctcttctacctcgcccacatgatcctcaagttccgcaccgccttcgtcgccccgagctcccgcgtcttcggccgcggcgagctcgtccgcgaccccgaccagatcgccatccgctacctcaagaacgacttcatcatcgacctcgccgccatgctccccatcccccaggttacctgcatccgtatgcacatgcatttcacaaccccaaacgaatttctctttttcagattgtaatatgtacgggaggtgcattttcacaattctttttttttcaaaatgtgataagataaataaatatgtggcatatcacttcacaaaacgttcatggttaaatttgacttgcacaagtagaaaaaaaacaaaagaaaattgaagtgcgtacttatgcgtacttgcacaagcacaatccaaaatgagtttatttttttcagattgtaatatgcacattatctaaaataaatagcaatatgcaacttctctgaatcctgatcaatgattctcttacataattcagcttatgcaagcagaatatgtgtaaacaaaactgttattttataaacaaagcagatagtaaatctcctgcttggaaatgagatcaaatttatcctgaatcatgttcacttgttggcctgtcagatagatttggatgggaatttatatgtgtaacatacatgcaggtgattatctggtttgtcataccagccgtgaacaactcatctgcaaaccacaccaacaacacgctctcgatgatcgtgctgatccagtacatccccagagtgttcctcatcgtctccttgaactccaagatcgtcaagtccagtggagtcgtcacaagaactgcctgggctggcgctgcttacaatctcctactctacacactggcaagccatgtaatgcatgataccatcatcttcagaacaattttcagaaactagaagttcataaaagttcctttgccacttcccccgtttcaaattacttggctttgtgctaagtcacttacttttaattctataaattagatagtatagtttaataacataagttctatgtttttaaactagattcaccattataaatgctttcaaaacatgcaatccacatgttgttaaaccatacgaattttgagaaattgatggtcaaagtcagagctgtttgacttaggacaaacatagaacgacaagttcaatacggagggagtagtagagattaaagattctaacccgaatataatgaattcatagtatgcatcatattgtgatgcaggttcttggggcgctgtggtatcttctgtcgatagagaggcagtacacatgctggatggacgtgtgcactagggagaacggcacgaacccggcgatacccaagtgctacatgagctacctggactgcaagacgctggaggatcccatccggatggactggcactcgcgcagcgagatcgaccaccagtgtctcctccctgaggccacctacgtctacggcttgttcgccgatgcgctcaacctggatgtcgccaaggtgaacttctgggacaagtatctctactgcctctggtgggggttcaggaacctcaggtatctctgaattcttgcattcttctcacctgatcgcagattgttgttgatacagataatgatgcataattttgtacattgatgtgttttttttcctgcgaattgtttgttagttcgtatggacagaacttggagaacagcacatacaggggagaaaccattttctgcatcctgatatgcatcatgggactcgtcttcttctcacatcttattggaaacatgcaggtatatagcttatgactgtattttgcctgaaggttttgttactgaatgcattcttgtctgaaaattttgttactaaatgcattcttgtctgaagattttgttactaaatgttactgaaaaacgcaattttacaaactcttgtttctgcttttgttactgaatgcacttgagaatatacatagttaaaaacaaattggttattgtttctgattgcaaagatgaaacatgaatgaatgaacattcatttgatttggattggtgaatgtagacgtacttgcaatcgatgacggtgaggctggaggaatggcgggtgaagcggcgggacatcgaggagtggatgcgccaccggcagctgccgctggagctgcaggagagggtgaggaggttcttccagtacaagtggctggcgacgaggggcgtcgacgaggagtccatcctccagtcgctgccgctcgatctccggcgagagatccagcgccacctctgcctcgccctcgtccgccgcgtccccttcttctcccagatggacgagcagctgctcgacgccatctgcgagcgcctcgtctcctcgctgagcaccaaggacgcctacatcgtccgcgagggcgacccggtcagcgagatgctgttcgtcatccgcggcgagctcgagagctccaccaccgacggcggccggaccaacttctttagctccatcaccctccgccccggcgacttctgcggcgaggagctcctcacctgggcgctcatgcccaaccccagcctcaacttcccgcagtcgacgaggacggtgaggtcggtcaccgaggtggaggcgttcgcgctccgcgccgaggacctcaagtacgtcgccaaccagttcaagcggctgcacagcaagcggctgcagcacgcgttccggtactactcccaccaatggcggagctggggcgcgtgcttcgtgcagggcgcgtggcgccgctacaagaagcgcaagctcgccagggagctcagcaagcaggaggagctctactacatgcagggccagggcggcgacgacggcgacgggcacgacgacagcgacagcgcgccgctgctcggtgccggcgtcggcgccggcggagaccacagggacggcgccgccgccggcgcggcgcacctcggcgcgacgttcctggcgtccaagttcgccaagaacaccaagaagagcgccgcggcgcaccacggcaaggcgaggatggaggacgtgtccagcatcaagttccccaagctggccaagcccgacgagcccgacttctccctcagctccgacgacgtgctgtgacacgccggccagcctctcgatctcttcttcttcttcctcctcctcctctccggcgatcgatcgatccatcgatcgacgagagagatgtactcaatttttttttcttacacggtcatggaatgggattagctagtagcgtgtaactagatatactagcaagatgcagaaatggaatcgcatgggatgcatttctgcgtcatctttgtactactgtatactagtgccgatcgatgtaacgtggtagaagttgaccaatatacattcagttcaggatgttcttgccaagttgccatcgatctctctctctctctctctctctctctctctctctctctctctctctctctctctgcgctttgtcaaaaccatatgtctctgcttgatgtttgtaactttgtattagtacaaagcaagtgtggtgtgtgtgggtgtatcgtgtatgcttcactaggacagttcgccttaacagccaaattcagttcaattcgaaattaattttcgtcatcatttcctgttcaagaagaatcggaattttgttaccgcgaaacgtgttgtcaatctttcacatttttatcacgaggatatgaaaaaaaaatagcctgaaagatatgatgacatttcttgtactaacgaggtataaacgaatgaccatataaggttttgagttcaaaatctctataaaaacaaatttcagattagattgtttgagaggctaagttctcaatttaaaagcctgcatatatccagttgaatacagaggttgggtaaaaattactcttctctaaaaatagctaaaaagttaaaagattgactcggctcagctcaatctgtcgtgactatgggttcacaaaccgatctgaactgagctcagtacaagacgatcagagtcatgggctttgacttttttgttcgcccctacctgagcatctgtggtaaaacaaaccatgtagaaagagttactcctaagtgcgacagaagttgagtcctcaacattgttttgatctttgaggctctgttaacagtgcgcatgaaaaacagagtggtcaattagctatgattaattaagtattaggtatttttttttcaaaaatggagtaatatgattgtttaagcaacttttgtataaaactttttaaaaaaaacgcaccgtttagcaatttgggaagcgtgcgcatgaaaaacggagaggaagggagttgagaactagcacttacgaacagagccttaggggaagttagggcctatttagttcacgaaaagaaaatttgtgggtgtcatattagatatttgaccggatatcggaaggggttttcggacacgaatgaagaaactaatttcataactctcctggaaaccgtgagatgaatcttttgagcctaattaatccatcattagcacatgtgggttactgtagcactttatggctaatcatggactaattagacttaaaatattcatctcgcgattttccccctaactgtgcaattagtttctttaatctatatttaatgctccatacatctgtccaaagattcgatatgatgtttttagaaaaaacttttgggaactaaaccaaaccttagtaacgagcactcatctattacatagtagtaccacataaaaggttatatacatgcatttctttttgcaaaatttatagtagcatataggttataaatctacaaagttacatgacactccaaaaataaagcagaactaaaactaatctccatatttcccaacaaaaaaaacgcaaacttagttattggtagtgactgccaaaacatgcttgatgttttaaaacatgcaatcaaacaaaactctgttaatccaatctaatccaatttattgcttgtgttctgcgtactgcgaaactgcgtgatccgcggaataagcaagccgatgggccgccacgtggcacgcaaaaaataaggcccatcaggcttcaccctagcctgtgccctccggcccacgcagaaaattcttatgagaaaaaaaatgaagagggtttttgttaaaaccctgcgcccaactgcacagcccacccgccgccgccaccgcctgcgccgccggcgagagaccccggcccccgccgatccaaaccccacccaccacccgcagcggccatgtcccagctcgtgctcctccgccgcatccccgtccgccgccactgcggccccagcagcagccgcctcctcagctcggccgccgccggggcaggcggcgtggggcggcggggaccctaccagcagcagcagcaggaggaggaggagagcaaggcggtgaaggtgtccgtgtggtgggacttcgagaactgcaacctccccaacggcgtcaaccccggccgcgtcgccccgcgcgtcaccgccgcgctccgcgccgccggcatccgcggcccgctctccatcaccgccttcggggacgtcgtccagctcgcccggccgtcccaggaggacctcgtcgccaccggcgtctccatctcccacgtccccaacagttgcgtccgctctcctttccccacttcgatccccccctgcggttctgatttttgacacgtatcctctttgagttgttcttcgtctctagagatgtaatcatgaattaggaaatggtattgtcgcctttgctacgagtgatgcgccctagtgcgtatttctctggattatgcgttgctggaggagtgattgatatgagtttccatattattagagggttaatgagcaattgatcattcctttttgtgtagaaatggatcatgggtagctcatagggatgaatgatgcggagtacaagagctatgctctccttctgtttagccttacaaaggctacacatttttttttgtcatgggctcagatttgtcggctaatttttctagtgaagcacaaaataaaataaatctatttggttaatgtttacctgattttggtgtcaattagcttcaa

SEQ ID NO: 54940 - DNA, 2642 bp, Oryza sativa
tttttttcgtgcattcattttctatgatgaattttggtttcttcttgttctgctaataatgctattgccgtgatgtaggtggaaagaatagttctgatcggtcatttatggctgatcttgtctattggatcgcacagaatcccccaccagcccattttttccttatatctggggataaagactttgcaaacattttgcatcgcctgcgaatgagcaactataacatactgcttgcttctcctggtactgctaccaccagtgtactctgtagtgcagcaacaatcatgtggccctgggaagctctagtgaaaggggaggatttctcacctaaacgttttaaccacccacctgatggtttagctggttcttggtatggtcactataaaggagccctggatgatccctttgtagacacagaacccgaggaactcgttgtagtaccatctgatctcaagcatggttcaatccccaaatatgtggttaatgcgatccagcaggtactaaaatcatatcctaatggagtgaatctgtcagacctccgactagagcttaaaaagaaaaatatttatctgggaaatgatttttttggccacaagaagttctcttgccttctccaatcgctgccaaattttgtggaatttattagtcctccagttggtgcaaaccagccatgtgtagttgcagccaacagaaaattgatgggtcctgacaaacaaaattttgagagttcaactgaaagtaatgtcggggacaataacttgaatcgagcaatacacaatgacaagccacctccactccctgtgtcgacttctttttctgaaaagaatgctaagaccgaaaattcttctcaaaatattgccaagaagctgcagactgcaagcgagaatccacctacatttgctgtcttatcttcccgatcagatgtgttacctgaggatcaaaaggagcacccagctgccaacttgaatgcacagatagaatcaccagaggaccacaaggaagttgatcctacgactgcctctggaattccctcttcctcaggggtggaagacaatgttaacaaggaagggctattcaaaaggatctggctattgtggaaaggccctgagagtgccaagtctgaagtttcccatcttgaaagtacttccactgtagtggttggtgatgcccaatctcctcagcaagagcataatgctaatgagcatcggagacttttgaagagagtctataaaaaatcttgtcgaaatggcagcacagacggatctgacagtgtgacaacaggcagtgcatcaacttcatctcatgatgaccgctctaaaaagttaaagcatgtggatgatatgagatcattagaaagggatacatcaaattcagaaccatgtgatagatctgtatctgtttccgtggacaaagctgagaaaggagatggtatttccaaaatggataagggtttatttagctgggtaacagggtggttgaaatttggaaaatcagatgcagataatgttacagccaatagaaatgtgattgatgaagcaagcacagactcactaaaaggacctgaatccttgaaggtttcagcttgtggaagtggagaagaggaggttcatgaaatattcacaaaatctttcttctgggatgttttgcagcaacagctatcaaagccccttggttctgagcttgtttcaaaagcaaagacaaggtaagatttttatgcctttatacattaattaatgccttctggttagttctagaccttactttgcataccaaaattttttgacctgataaaagatttccaataatgtaacatggtgttcttgtatttctttccataccagaagaaatatgtaggtctactgagtatcagcctgtcaattagtgagaagaaaataactcgcaaagctgagttttctactctgatgtcagcaagacaattctgagtgtgtttgtgacagatcaaaaactttggtttatgtgtgtagcttgatatagtgtgttatgagcaagttgaaataactgttattgcccagatggttcatttagtttgtagctggaatgcctgtaagtctatagaagtattagtttttccttttacttcaacttcctatgagcatgtctgtttgggtacactagaagacgagtactaattgccgggcgaaaaaaataattctaacccggattcttatgagatgatttgataaatcatttttggcttgtcccttcgagagaatcttactgacatgattacattttcgtgatcagggaggagttagtgcatcaattgcacaaattagattgttggcctctgaaaggcctagctgagaaagatctccatcagctggtgaatattttagtttcagagaagaaatgggttgaagaaaccccttccaggtattttccgtttcgtcttacccttcctcacaagagaacatgcattccatcgaactccaggaagtttgatggtctcagttctctgttttccaatgggaagccattgccgggcaatacactggtgatcaaagcacaaacagtcctctccctagggaggaaactttgtcggactgtcacaagctgttaaaggaccttcttctggaatatgaatatggttttaacatcagcattttcaagcttcgttttgc

SEQ ID NO: 54941 - DNA, 829 bp, Oryza sativa
atacatgctttcttgttcgttgagaagaatctccctgaaaaatattgaccacactagtactagcaagaaaatacatatgaaatacaacaaacaaagtgtacgactgcctcaaagacataccttagttggtgtaccgaaagtccttgctttgcaggtaatgctggatcaactgagagaaatggtgaaatggttgtgctttcagaaacaccagcattcttttgttgttctatccgcctaagagccagctcacatgtttcctgaacctccacggcaggatcagcagctaaactctcctcaagcaggggaatgctcttctccaggccaatagcaccaagggcttccgcagcctaatcaattgatatatatatatatatatatatatatatatatatatatatatatatatatatatatatatatatatatatatatatatatatatcacttctcacacggagagcgccgcactaaaaggagaagatggcctcacactcttatgtatcaccaccccacggcggacaattggatgaagtgaaagatctttgcgcactgcctctcacgcagggatagcctcaccctcgcgcatgcgcgcaagcgcacacgcaccctcgcgggcgcgcaagttagaagaaccccgcgcggctgagcaatgcatcacacagacaaatatattagctctctaacgctcctttattctagcacgctccatcaatgaataagtgtcactaaaccacacgctctatcattgatgtgagtgggtgagagagtgaggtaagaccttgggggagggcgccgcgggggccatcaccatggggggggcggagggaga

SEQ ID NO: 54942 - DNA, 10286 bp, Oryza sativa
tttctataaatttgatcactaagaaaaaaaaatcaaaacgagttttaatatgaaatgggggaagtatacaagaacagacataaaaaatgaaaagtgcatagactaatgtttgtacaccaaagacataagataggaagcacaggcatcaggtaacattcagacattgtggattcgcgaagaacctcaagtttctcacttcttcaattatctccactagagctttgcacaacacatgtaaatgaattcaatcaagggaaataagactgtaagagtacctaaccagtttgactaaaacaaatccactttacacaaaacaaagcagattatgaacgcatataaacagaaaatgagttcaggttaagtcatatcaacagaaaatgagttcaggttaagtcagttggtgtttcattgctgcagttctgctttgaaccttcaagtctcccacttatttcaacaaaacacaatctcagaagatcactgtatttagttagtaatgagttgatgcataagctaccaaattatctaagcacaaatttgactacattcaaataaacaaagcaaatggtacccaccttctatgtccaaaaaggaaaaagaaggatgtgttcaggtcacaaaatctaagcacaaccattgcacatgtccacactgaaattcttagctggaagaatatgtaacatcttgaattatccaaaagagcaacagaacttaacaattgaagtgcatatcaattcaggactgaccaagcagaagcttaacagtttaagcgtacatcaacagaaacttaacaactggaattggctccttgcaagtgactttttataacaattcaggactaatctcaagatactacatattaatctttctgtcagaaactgatccttttccctatacttcagtgactaaatattgcatacaaattaaattcaggacaatctgcatatatcgcttcggtacaacgtaaagaagcttgaattgaaatgcaaatttatcgaaaacgcatggacaaactaagtgaacagtaggtcacttgtagaattcaaccactgaattgggacaatgtcatctcatcacatgataatactatcaaaaaccaacagaacattggcattgtcagaaaacagagcattgactcagaaataagaaatcaacatactactgacaggttagtttttcagcaagctctcagcaagcagagagcttctgttcttgaacatattcacttgctcattgttcaccatcctggttaccttgtacagcttcaagctgcgactcgaagtattcccaggcagcttgcccagaactgatgacctcttgagcacagacccaagaattttgacgaccatgttcttcatcctcatcatcttcattatcggactcttcatcatcatcactgtcagactgttcatctaagtcattgctcggcaacttgtcactttccacaggacctgaaaaattttggttccaattcagttgtccattgactccattcaacacatacaagccatttgaatcacagtgtaatatcataaaggaaaccagtgtcaaattaatcctaggtatattgtaaggctacatatcaatcctagcctcctaggtgttgcaagggcacatatgcatcaaccatcaatgttgagtaaaatttgcatctggttcagagttcagacaacataccattttcctcaaacatgtttgatggtaagagccaggagtgaagaaattgtgatgggtaacagaagtcagtgcgcatctccaagctcttggacatcaaaactctcttggaacgtatgtcaaaagagaacagcacatcttgttctataaagtatagtacagcacagtctgtcgggtcaatcatagcaatggcaggaactttgcccggcgtcagcccggaggtcttgtagatcttgtcgccccatatgtccgcaagaggtgccttgtactcaagctgccactcggggctctcactctcagaatagagtaaactccataagcaagcctctccttcatctaactgaacgtagcatatcttgtcttggctgatcttgacgcaacgccgcttctcaagattgtgacgcgatctgatgtcggggaccagcataaggcagccttccggaagagccacataagtcagcttgggcttctcaatgaacggatcgcagaaaagaagtcccaagggcaggtcgacgaaccaaatcttgttcatatggcttagcacaccgccttgactgccccaaactgggtgttgcaagcagttggtaaggggcttgacaacccactgggaacctgaggtgtaagtccagcagcgcagctccatgaactgcgggctcgaattggtgcaaacgaggcaagcaaccatagtgtagtctggtcgaatcggatcttggacgacgccgatgcttatgactgggggaatgaggcttggctccatgggggggattggcggaatcatggtggcgactcgtgtgtgcgcgtcgcagaagtagcgcacgccgttgaaggcggaggcgacgaccattccagacccgtgtacggcgacgacgaggggagtggttggtcttgggcgtgacaggttcacggagaagggcttggcgcgaggtacgacgaagttgaagaagccgatggccttgtcgacgtagaggacgctggtgccgggtggcttctccgacttgaacgccaaatcttctccgggtgggagatccttgacgcgggttacggcttgcagtatgacccacgagcagcgccgtgcaggagcctcgtcgtcctcgtcccgagcccgatcccgatcccgctgcgcgtcctcctcctcctccttggtagtcagatgatgagctcccggcggtggtggtgacgcagcgcctccccccttgaccatcggagtcggggtgcctccctgattggcatcccgcggctgtggtgcgtctcccccctgcccgtcggagcccgcggcggaggagtgcctccctgcttggtcgtcggaggcggtgccggtggtgaagaagcagctcctcctggccccttgcccgtcggagcccgcggcggaggagtgcctccctgcttggtcgtcggaggcggtgccggtggtgaagaagcagctcctcccggcccctttcccgtcggagctccgccgccatcctccgtgctcgccggagcacgcggcggcgagcccccttcggccatggcgcgcgaatggtggtgggtggtggcgatcgagggattgggaggaggaggaggggctcggagtcggaggcttgcgggggtctaggtggggagggtttatatctcgtctcgacctcggtctcggtggagtaacgcgcaagttgatggccggcgttataacggcggcgatgctacggtcaccgctacacagcacagacggaaacgggtagaggaagagaagcctagaaacttctagaaacttcgaggttgctgccaggtcggagtaaggcctggcggcccatgcaggcccagttcagacgccatagcccagaacttgcgcgtcggccacacgcaaccactgacaaacggagcccacccgggcggcagccggatatgcgcaaggcgtaaaggccctctgcttcagattttggaataagttcactttgggtccctctatttgtcgcccagtctggttttagtcccttgatcgcaaaaccggatacaacaggtcccccaacttacgaaaccgtttaaataagatctctcggcaatatttgaccctggttttggctgaggtggcacctacgtaacaaatttgactcggttttcatctgacgtggcattgacgtgtcgcttacgtggcaattcggtctgaaaaataataaaacctatgggacccacatgtcagtttcacatacacaataataaaaaaaggtggggcccacgtggaccccacctgtcgtccacactagacactaccccttctctctctatcctctctctccctcctctctctccagctggagcgcgcgggacggagcggcggcggccggagtggggcggggagggagtggcggcggccggagtggggcgggcaaggagcggcggcggacggagtggggcgaggagggagcggcggcggccggtgtggggcgggagggagcggcggccgccggagtggggtggccgccgcatcgcccggtatgtcgggcggtcgttctccgtcgactaccgccgctccccggaggctaacgcgatggcggcggcggcgacgagggggcaccgcggcagggaggctgccatgttgcatggcggtagcgccgtgcgctctcctcctcggcggccttggggccgggagctcccgcggggccctcgttgacggtgaccacggtctgggagatggcggcggtggcggcggtggatggctcctcagttgactcggcggaagggtatccatcctccgggtcttcgctcacgccgggtgcaaacgccggcgacggggcggttgagtctttgtctccttgtgcaggcaggacgcctccctcttctctctctcccgccgacgcagccggagccagaggcgacgtgcagcggccgagcgatgagggtcagcgcgcggcggccggccgaggaggggcgcggcggacgggcgaggacaggacggacgcgagttctggacagagcgtcgtcgtcgtcgtcttcggaaacaccgcagtggtcgtcgtcgtgctctacccgccgcccctctgttcctcccgccgctcgctgccgctccacccaccgcctgccgcctctcagctccatcgccgcccctctgtgccgcccgccgccgctggagagagaggggggatagagagaggaggaaggagggaggatagagagaggggtagtgaggatcacaggtagggtccacgtgggcccaccgtttttccattattgtgtatgtgaaactgacatgtgggtcccataggttttattatttttcggatcaaattgccatgtaagcgccacgtcaatgccacgtcagatgaagaccgagtcaaatttgccacgtaggcgccacctcagccaaaaccggggtcaaatactaccgagggaccttatttaaacggtttcgtaagttgggggacctattgtatccggttttgtgatgacgctctctctcgtggctcgatcttctggtgaggggataactctcgctttgatcgagtatgacgtttgcgacggagctaccaaccagaacaagtccaggacgccgtgcaaacgctacaccacaaacgatgtcgtaccaaccgtgatgcgcggttgatgatccttgcaatgcaaacgagagaacactgcaagaacaagataagatgcaatctaaagttcccttacttcctcatacgtggctctacagcctggcccagcccccgctcctcgcaccgcgcaaggcgcggacacaattggggggcctcggggtggcgcgtcaggcccctcggggtgctatgtcagcctctcggggtgccacgtcaggcccctcaggcccttgccctgcctggacccaaggcccttgcccagctgccatgtggcgaggggggaccaggctaggcggtcattaatgggcggtgccccaaccgtccctcgaagcatttagtgcggtcagggcggacgtgtggagccacgccactggcccgcctcaaatcgggcgtaaccggtctgtgaccggcctgtcaccggtcacatccgattgacgcgcggccatgccccacgtctcctttgtccccggtggagtggaggtagctatgtattgtcacatcaggggcatcatctggactcctctccacgagaggagggcagccaccggtctgcgctcatttaagagcgaatgacagggctgcccccccacccccccccccccgtgtcaggtggaggacggcgccgggccccaccaaagggccaaccgtggcttggcttccgggcgaaggcattcgctcgtttaagagtgaatggcagggctgtcccccgtgtcaggtggaggatggcgctgggccccaccaaagggccaaccgcggtttaacctccgggcaaaggcacgggccgcggattggccacgggagggtgcccccctcccttctccatggaagagtaggtagaggcggtgcatgtggtatccccttagactataaaaggaggaccgtgcccactaaacaaggggggatggttttcttgaatgaagccaaggcaagctctagcctcaagttggtgatgtccttggtgcagttctagagtcgatcaaagtagaataggagagacaagctctctggagctagaggaactcttgtacttccgatctatattcccacacacaggagtagggtattacgcttcgtagcggcccgaatctatataatccttgtgcttgtgtaagctttagtggctttaaccgcggataatcgacctcccagagtgcacctcctcctccggccgaactcacaaaaggggatctcacgatctcccgctagagaggattactcctcgacagcgtcaaatattcatgatcggagggagtattatttagggcaatccctttctaatgacatatgtcttgtacaaatacacgagtaatttgatttaaaaatataaatttgaatttaactggtttaccaaatggtttgttaactcaagttgactcgaagcctcgaaatttcatcaaaaccaagcgattttcattgtttatttttaaccctactgccaagagctagccaccagcctgtgctcaagccattttgaaggaaatgcttaccatctcccctaatttaatattgcaaaagaagctatatttgcttctttattaagattatgtctgtagttgtaacaagctaggcccatataaataaaattgggatatatagaatgagaaggtggattgagaataaagcattgattcgtatggtggttatgcacatgacgtgagaagaagcggaaggacgtgcggtatgcgctgtgagaggggatggaagatggatgactccacttgtacaataagagatgttgatattaaatcctttgtagtattcctcatgacgacaaagtaacccacgaaagcaatccacagaacaataataaggtacaagatgaccatcaacataattcatagaacaatattaaaaaaacatacttaaaacttcactacaaaactttttttggtggaacaagatatccccaactaaaaggacactacactactgagtgtgaaaaatcaaaaagcaagaggagaagagcaccattgctcctcttttttttttaactacttgggacaccaaagagacactgagatcaaaggcctggacttccagcagagagcgagcctccctttctcctgatgcacaaccccaaaccctccaccgaagagcccagccaacatcttcccctgagcaacgctgaagccgctcacctcacgagccctgagcccttccatcatctgggccccacctgccagtgacccatacctccccacagcgtcctccaccctgggccccaccacctcctcccccacgcgcctcaggctcagccacgcctcgtcgtcgtagctcacgaggcagctcgccgttgactccatcaccgccgtgaagtgggccaccgcgtcggagaagaactccgggaacggcggcggcgcggcgagggacggtgatggtgggttcttgctgattcgggatagctcgtcctcgatcaggatcaccagctttggttgaaggattgtgatcgtgccgaggaggagaagcttcagcctgctgcgcaatggcgtgttcgtcgtcgtcgtcgtgtcgtcgcatgtgaggatcaccggtggtgatgagctgccgttgcagatcatggcgagctcgtgatggagttcgtcgtcatcgtcgccgtcgtggacgtggagggaggtgtagcggaaggggaggtgcagcgactcggcgaactccgacagccaccgccgcgcatcggccgtgcggggcgtgccggcgccggaggtgatgacgtccgtgaggtggaacagcggtggcggccggcggcggcgaggtctgacatgagcgacgaccactggacgccctcgccgacgttgaagtcgacgacgtggacgtcgaggtcatccgccgtggcttcgaggatggcctggttggcggtgaagtgggcgaacttgacgaaaggcgtcagctcttgcagcatccggtacgccggcgacgaccagttggccgccggcggcggcggcgacgacgccggcgtggccgcaccggagatccggagcttgaggcctcgggcgaagtagtaggccaggtgatcaaccgggcttgttgcttcacagcttcttctgccggcgatgtcggcgaggaggtcgtcaagcctcgacatgatcgccgaggcgtggacagcgtctccggcgtccacggccatggcgccggcgaggagaaggtcacctgcgctctcctcctgggttgccaccacgttgccgttctcgtgccctgccactgctaatctctcatcaaattcaaagctagctgctaatggatcagcattggggacagagaaatcatcttgcagttgcagcaaatcattagcagattcttggattgccatcatttccaagaactcatgatcttgatgaatctgatcgtgagagtgatcaccatcaaattcattagcagattcttggatcaccatcgtttccaagaactcatgatcttgatgaatctgatcatgagagtgattaccatcaaattcattagcagattcttggatgaccatcatgtccaagaactgatgatcttgatgaatctgatcatgagagtgatcagcatcaaattcatacatattggcattctcatgaggattttcttctgcttgaggagaccataggaggaggctactgctactgatctcttcaaattgtgtggagaagggaatgagaagggagcaagggtatgacatggtctccattgatttgttttgtgatttgagctgttaactcaacatgaattgcatatgctctggtttatgtggttttacacagtttatgtagacaaggatgaagcgggtgttaggaccatttctgaagataggagtgaaataaatttatatgtgtggacctaggatcttcatggctaatgtaagctgatttgtctgatcttgaagccccaaatgggacattcatatgacaaaggttctttttttgttgcctttttgtgtagttccctctaccaactttgtaagatatgtgagcaagcaatcgtgccaatttttctgattgattagaatgaagtagcagaggaagtgagcgtgtgcatgccaggcaatattcctgaatgcttgttgctagatgtcagcatgtggtttagttttgaatcatatgagaaaaacgattctatgcatgattctacaacctgtggacaacagaaatcactgacaagattcaatccaaggaagaagaaatttatgctatgatcttaattttaagagtgaaacaaacagctccattactctgtcatctggataagtagatgatgtctttcagtcagaaccagcagaaatgtttcagactgaaactttacatatggcctgcatgacaagtacagttattattcttactcctcttgtgttaatctgtgctcatttttttaaacagtgtccagtaagcccatgacacagacatgttcattctttatgcatatgcagtagtgtattaccaatcatgcagcaccgttactgcaaaaactgatattaaactcgagcagttttgttatatagctggtagagcattgattctaaaatgttgatatttaaaagagatgcatgggatgcaaccaatagagtgtagtaactcacttcttgtctgaatggggtagatgtgatgcagcagaaagggaaattaccaaaactaaatgcgactcactgagatattcttggttccaagatgataactcttgttcttctatctgaacttttgatttttttctccctggtagtttgacacagtattagattcagtaaactgataaatcttcagaatttgatcattcagcaacgtttcagccttctacagactgattcacatacacacacacacacaaaagaagcaacgcgattaggtgatttgatcagcttcaagcaatggactatgaaaatgaaacacaaaaaagaatatatattttttgttttctgccagacgtttggaagtgactggtattagaagacatataagcattcatgacccgcacgagaacaaacggtggaattaggggaacctcacgattgtcagataagatttctttagtgtcagactgtcagtactcaatagactcgtggattgtttatcacgagcattcatc

SEQ ID NO: 54943 - DNA, 792 bp, Oryza sativa
accattttactgaattataataagaggagatattttttttagatagtgccaataagaagagagccaaaatgaaagaacgacccgttatggtatgaaggaagaaacattcatctgaaaccgagattatacgcaaaagaaacttaggccctatttatttcagcttaagattattgtaatctagattatcgagccagattagtataagctggattataataagccgacatataataagttgttatctgtttgtttctctggattagttagtttgcttcagtttactcctaataatctagattataataatcctaaactgaatcaaacagggccttaccgaagtaactcaaatggcctgataacaaacagagacaagtcactcaagagtaggaaaggtctcaatgttagttgatttatcggctaagtgccagtcagttagctgagaagggataaatcccacttatccatttcctaacaaaaattaaattaagagatagagttattttctgtgataggtaaatctaacttccaaccgtatatccttcaagccccatcaatgcagaggagagagggatgccaaactcttcgcactaaaccctaaaaccctaaattgcccgatcggcttagtgctggaaggggttcgtgaggtgatctcagtgaaacctctgttggcacatcaagaaaaagaagaaaaaaaccgaagaaacaaaagaatcaacaacgatggcttctcaagtaagttagtgagattaagattccgcatcaagcagaggtgattatgtacaagctaaatca

SEQ ID NO: 54944 - DNA, 756 bp, Oryza sativa
tcctgcagcccagcccacccccctccgccgccatcagcagcgcggcgcgtcgagcgtatctccgggctcggtgcggcggcggcggcgactccagcacagtcaacttctcctcgtccatgtcatactctagtggggaggaaaagcttccttcccacaaggacgcaggccttggtatcaatctgatccttctccttgtgcagaatctcatcgctccagccatcggtgtaggaagagtacatcctgagagagctgtaggagtccatcgtgcgagtgcatgcggcgacgaccagaaatggtcccccgtggcagtgaagatgatcgttatggcactccaaaaggccacacatcacggccgccgtccagtactgcgtctcgacggggaagggaaatccatcgatccactgctcctcttcttcttcttcttccaccattggatcccagactacgaatcgctcctcctcgtcggagcaaaccctcacgtagaagaggaccaggccgtgtcggctgtcaaccgctgatgcgaggtcgtatatgtcgggactcgccctgaatgttgtcgtcatgtggacgaatcttgcgatctccattggctttccgggttcatcctcgttgatgaagtagccaagcataggaggtggatcatggaacttgcggaggaggcggatgaagcaggggtcgccgaggatcgcatgccattgcttgcaaaccagctggagtcgggcgaacagggctgggtcctccggtggggggcgaagg

SEQ ID NO: 54945 - DNA, 809 bp, Oryza sativa
  unsure (1)..(809): unsure at all n locations
agatgatanaacctgaactcgtgctacannactgcacccccctcggcggcgtgccgcccgtacccctcgccgagttcacgctgggcggcgccgactggaaagactagtactacgtgagcctcgtgggcggcggccgacgggggagtccgcgcgccgctcctcctactgaagaacgcgctctattaatcgctaacataaaaccgactataccaaattatttcatctattcaaactaatcaataaactcatcaattaaatcaacggattgtattatagtatttattcataacaattaaagaatacatacaaactagcagacataagtcattttaattagaacataattcactataaaattaatatcagtaaataataataacatataaaacaattatatcaatctatttttcaaatagatcatatgagttaaacaaatatcaagaactaaataaattaaaaattcgaacgttaatatctatacaacattaacgaattaattaatgttatgacaccaattaaattatccatattatagaatttatctatttaaccattgaacttaactatcaaatcgaaaaaagtgaataaaattaatcaatccgaaaaatcgaacctacccgaattaatcgaaacgaatcgataaatacgataaataacgaaacaatgtaatgcaactaaataaatcgaaactaattgctattcactacaaaaaattgaattgaaattaaatcctaaccaattaaaaaaactctaaatcaattctatatacatactatcatattaaaatacttatgatccaaactgatacc

SEQ ID NO: 54946 - DNA, 765 bp, Oryza sativa
agtgagctgcaatcgtattcctgcagcccgataagtgcacgcatatacgtggcatgcatgaaaacacggtaatgcagctgaacacaatcacatatacatgcaaatccaattccaaatcatgactagcagctagggcagctctcaaacaccatacaaacaagcacgcattacaatttacataaggttgaaaattaggagtccagaagagtacaactattatatgtctaaagaaatttgacatacatgcaggaaaggccaacggattgacactagaaggaattcatcaaactcggtgagctggcacttgagataggacgaagatgacaaggattttatccacagatgcatcttgatttgaggataaattaatgaatcaatcaagtaatactctggatgtgtttgggagctgatgctgaggcagaggcagaggtcgaggcagcagaatcatctccatggccttgacggttatcaggatgcttcacatctggatggttgggagctgagactgaggcacaggttgaggcagcatcagcatccaagcttccagcagcgtctccctggccttgacggttaccatgatgctccaaatctggatggttggggtgatcttttagagcaatttccaccttatctgggttgcagtcaccatgaagctcaaatgatcgcaagctcggaagacgctcaattccagaaatggatttcatctccctgaaactccaaacaattttttccaacttaagattcttgctgaagctgatatcggcg

SEQ ID NO: 54947 - DNA, 753 bp, Oryza sativa
ttcctgcagcccaaaaaaaaaagaacaaacatgttaaaaatagtaattctagagacaaaagcagttgtaaaatcaatttttttataatataactgagtgcagatacactgtaactatttgtaagtgttctatagtatatataagcgttttgtaaatgagtgtaattgtaagttgggtctacataaatataaatctttgtgcagatcttacagacaaaaaataaagaggctgctatataatggaatcccgttttcgaacggaatgatcccgagtaggtaacaggtgtgatacctatcaagtatcagacgattctacacaacatgatgatcccgagtaggtatcaggtgtgatacctataaggtatcagacgattctacacacatttcaggtgacacttgcaagtatcatgtgatatttatcaggtatcatgcgatttctaccacgtatcgcgtgatactcgcgaggtatcatgtgaaacctgtcaggtatcagacgatttcaaccacgtatcgtatgatactcacgaggtatcatgcgatacctgtcatgtattagacgatttctaacacgtatcgcgtgatactcgcgaggtatcatatgatacttgtcaggtataagacaatttctaccatgtatcgcgtgatacttacgaagtatcggatgatacctaccaggtatcaggtgattcctactatatatagctgggcatcccgttgggggaggagcaccccgacacgtgcggtcggccccctg

SEQ ID NO: 54948 - DNA, 764 bp, Oryza sativa
actgaacgctatcttattcctgcagcccgttttccctatgcctccagaccaataattggcaagacagtcaggtattcttcacaacaagtaccctgagtgatactatctataattctcttcattacagcgtctctgccatacagggtgggctctatacttgttggtgcggtgatgggacgactcttagcagtgcttgattctatgctaagatgagaacccatgagctctagattaagaatggctgtaacttttgcacacacaggctgcagctgctctacaataatcttcatttttttggatagacctaccctgtcaaacttcaactttggcgttgatttccctttcacatggtctctctcatcgtgcacacagccataatcatgatcgcaatcatcaactagagaagtcgagaaacaaaggcgtttaccgatagcatggatggtgttgtgtggcgaaccgcagcatgcagcggtaatggaatcaccaggcccgttgttagtagcacaagaagagcatgatgaagagaatcccaacagcttgccagccgctttggccgtgtggtgagcgttgaggaagaggtcgctgacgcagcccttggcgtgctcagcagcggcctcggaggtgtcatcgagctcgtcctggatgcggaagtagtcgagctcgtcgagcacgtcgtcggcattgtacgctaagtcccgcagcttctgcaggagctcgttgaggtcggtgttgtggatctccctaccgcgaacgttggtgagctg

SEQ ID NO: 54949 - DNA, 760 bp, Oryza sativa
agtgactgcatctattcctgcagcccacagttaccttgggacaaaatcaattgcaaatagtactacactgttagttcaaggttagtaagtttacaaacctcagttagacagccttaattactacttagcccttagtacaggttaaaactatgacccctttgaacctgaaagctagctcatcagctacatgaaactctacaacacaatgagtggaatcaatcccaacaattcccccaaaatcaacatattaggtggagtccggactccagactctcctactgagatcctaaatcaagaactggtcaatcaatcccgatcgattgcaggtttgcaggtggaataacacaaaaataatcaagagttaataagcaaatcgatgagtatgcgcattgggcgaacgtaccgtcccactggaactcgttccagtaggtggtgtcgccccaggaccaggcgccgatgccgagcttggtcaccgccacgtccgacccacccagcctcaccttgccgtcctcctccaccgccgccgccgccgccgccgccgacgccgacgccccggacgcgcgtggcgggcgtaccgccgccgccgctcgtcggctggggaggaggggcgccaggcagccaccggcgacctgcagggtcccggccatcattgcaggcaagctacctcctcactgttgctcgggcctcgcgcggcgggggttgctgggcttccactgccagtggccgggaggcgcgagctttttttgggccacaacgagag

SEQ ID NO: 54950 - DNA, 768 bp, Oryza sativa
ttttgactgcttctattcctgcgccctgcatgaagaaaagattcttggcccgcggatgcgattatcattctgcatatcgtctggaacacggggtgcattcatagctggagaagggatctgaggcatctggtttggcagagaattgttcatgtaatatgttgttctttgcatctgattcaggccttgagcttgaccccaggcatgcatgccgtgttcaatcccatgcccatcggtggcatgagctggtgggtaccggggaacatcatcggcacaatcccggtagtcatccacatgatctgaacatgaagcaacagtctcacaatcaggcaccgtgatttgattcatccagaaggattgaaattctattgctactgtggagaaatggggaaagtttgatttcaaacctgaacttgcatttgcagggacttcaagtactcaattgcttcatctagtatggatgctttgtcagtctgagaaacagctagaatcatcaaattgccacaaaattcaaccatggcaatagccaagaacactatactattatacaggataacaaaaattcccacaacttttcgcagaaattattttaccttgttgcaatgaggtaccagttcttgcaatgctctcaacttctcattgatcctatcccttcttctctgcagcaagaacagcaaaaaaaatcaagaacattcaccttgttgcaaatgatgcaacaccatctattcatcaatggttggttggggttcttgaggtcttacacgctctgac

SEQ ID NO: 54951 - DNA, 759 bp, Oryza sativa
ggtgagctgctatcttattcctgcagcccggggatattgtattggtctagcttattccatgttctcaggatgaccactggtgtcagaaggttgaagctagaattacataatcattataaacgagaggtaaaagctgaaactatacttggtttgtttatctgatgcagagttactaaggaagttacgagaagcaatttgtatttacatttcctgtcacactaggcttgatttgctattttgctacttgccctactctatatagtggtttgatactgatatatgtagtaaatgtgtgacatatgcatctcctatcggcaatactttggggcaacacaacaaggatttagaagatgatactaactggctatgcgttattgatattagaatacttaggacgtgcgtaaatttatactccgttttcacagaactttctcataggacagaggttggcttcaaactagtacccaagttgttattcttttgcagacttttttatgctggtttatctcgagttgttcaggcagcctgacagcttgaggcaagcttaatgttgctacactaatataccgctcttttcagttttgtggatcggattgtgtttgtgatcttccaccaaactggacatccgaggaacttgtgttgaactcccttcgtgaagtgcaaatcactaacctgagaggaactgagaacgaatttgctgttggggagcggctattcagttgggcagcagtgctgaaacagatgacaataaatttcctg

SEQ ID NO: 54952 - DNA, 764 bp, Oryza sativa
aattagcttgctatcttgttcctgcaccccagtataattctgttccacacgtactccctcactctatccattaatataagcatatgtttggtaattctcagcacacgttactgtgtcaccataccgtttgaaaaccgttggccgctgataaaatttggtcaagttctgttattaactgtaaagttcagtttgggtttttttttttaacttgaccggaaaactaggcgatttatgttctcaagcaagctcggaaagtccggttttcataaaaacaaaccgatgttcatcggttttgtaaactttgttccgaacattaaagtcgtttttaatctcaacattaatcttcactaaaacaccaacattgattatattgcggactaaaaagagtatcacagaaaattgtcacattcaatctaacctgcatagagaagtaggagtaattcttccgtcccaaaatataagcattttataaaattttttaatggtatctaacaagctagagagataaaactaaatagggacatttattcttttacctgagaaatggggatgttcgtttattggttgagaaaagtaggtactatgtactaagaactataagttttgaacgtagcgaggagtatattttgggacggagtacatgtttatttactgatatatttaagggagtaccccataaaactcccacctttaaactaacatgcataaacaagttaagaatatttccgttcaaaaaaaacacggactagggaagtttttttttt

SEQ ID NO: 54953 - DNA, 760 bp, Oryza sativa
atgaactgctatcttattcctgcagccctgccttggcagatcagccgttcagaaccacctgaagaaaatgcaggagaaaaaaagaatggagcaactttgcttactactatgtcatcgaaattggtgcactgcaaatttccgagaattcaaagtgttagtggttgttttagcttcagcatttgggatcttgttgatctccagtagcccttgagcttgttgaaagatgaaattatcattttttccctcttacaatttactcctatgtctgaataatttgcattctaagtttttggcaatgggtagacttcagaaaaggaaatattgagcagcaagaacacctgagttggggtcttctcataacttcctccaatctctttaatcctgttaataagtggttggagctgtttggaataagaaacatcttcaatgagcagagttgcagcagtgcaataggagagggttcgtgaacaaggatgcaacaagctcataataatattagtaaaaaatacaaccttggtcaggaactcaggagtgtatattcgtccacggggcccagttgggggattatttggagtgtattttcctgtcagaacacctgaacagaggagacatattaagctaggaatttattttcgataatcactcatttgagaaatggaatgatgatcgatgaagtaaacatttcagttctaagataagacattttcatttaaactactagattgaacaattttcttgcaaaaaaaagatcttgatatag

SEQ ID NO: 54954 - DNA, 764 bp, Oryza sativa
  unsure (1)..(764): unsure at all n locations
ggtgaactgctatcttattcctgcagcccagcaagccacagaagatgccttggaaatcatggaaccaaaggaagggatggcatttgccagtgtgaatgatgcttttgtgttctatgagagatatgctcagaagaagggattttctataacaaggagaatctcaagcactttccaatccttcaccttcgcttgcagaagacaagacaacgctcaatgctcctcaaacaatgcatggaagcatcatcagaatgaatgtccagctaagataattgtggatcttgatggtcctgacgacaaattcttcttatcttcagttacgcttgagcacaatcacgatctcagtccaagtgaaacaagtcgaatggaagttttcatatgtaacaaaaaactgattcgtgtgctaaaagaagaagggtgtcaaatgggagagcagacaatcatgccaacaagaagtccagtactccttgcttgcaagctgaaaatcgcccatttggtcaaaaggatcccatgaacaatttgcaattggaaagaaaactgaagctcagtgatgcatataggctntatcattacttcttctgcatgcagttcaagaatcctagctttttctatgctttggactttggcaaggactcctgcctgagaaatgttttctgggcagatgcaaaaagtagggcttcatgtaaatatttctcggatgtcgtgacagttgacactacatacttaatgaacaaggagagcatccctcttggccttttgttggtgaa

SEQ ID NO: 54955 - DNA, 753 bp, Oryza sativa
  unsure (1)..(753): unsure at all n locations
atggagctgctatcttattcctgcggcccccttgcgtcctcgccacttcacttcctctccacgagcaagaggagcaagaagaacgaggtcaggtcaggtcagctcagctcactgccatgatcactgtactccagttctttgcttcttcctcttctctcttttgattagcttttctgaattttcagtgaagtgtgacctgccggctgtcgaagaattgcggcgccatggatgcgggtgcaactgcaaggtcgtcgtcgtcgtcggcgatgatgatgaaccagaagaagcccttgctgtaatcaagatttttcgttttctttttcctttttctttttgatcttgtgttctgtgttgctatggttcttgatcgatgtaaagattggaggatttcgttctgtttgcttgcgtggcgtagctcggatggcgagctggtggagctcctgtggcaggacgggggcgtnnnnnnncncncncanacnnnnccccnnncnnnccncnccctccccccgaacgccncctcctgcgacgacgagacggctcgcccactgctcgctggcacgctgtcccacggccggcggccacaccactcgcattgatgcgtattggcttgcacgctcgcaccgtactgtggacttgaccgaatgagccgcgggaccgctcggttcgacacgcctggcacggtgcgcccgcacttcccggccgtgatccatggttcgcttacggtttcgccgctctaggactccgtgcgtcgcg

SEQ ID NO: 54956 - DNA, 761 bp, Oryza sativa
  unsure (1)..(761): unsure at all n locations
aattagctgctatcttattcctgcggcccgacttcgtcaacgcctggccgagatcgcgcgcgctaagctcgagaacgcggtggcgacgtcgcgcgcgcctctcctggagcgttggtcgcccgacggcggcgcggcggcgccggtggtgctcccttacgacgacctggcggggctcatcgcgaggacaacgacgacgaccctccgctgctgcgcgagcggatgctgcacttctcggcggagtcactggcggcgctcaaggagcgcgcgcggtgggagctcctcgccgccggggacgcagccggcgcggccgccgtgacgaggttccaggcgctgagctcgctgctatggcggtgcgtcacccgcgcgcggcggctggcgccgggccgggaggtggtgttccgcgcgtcggtcaacagccgcggccgcctccgcccgccgctgccaccggagtacttcgggaacagcatcctccccgcgtcgacggaggcggtgccggcgtcngagctcctggcgcgcgggcacgggtgggcggccgccgccgtggggcccgcggtggccgcgcacaccgacgagcgcattcgctcgcgctcggcggcggcgccgtctgagtcggcgttcaggctggtcgactcgagcggcgtggtcgtgagcaactcgccgcggttcgccatgtacgggtgccaactctggtgggggaaggcgcgatccgcccaggatccgctagggggacaagatctacggggacgtgtccttgttctcct

SEQ ID NO: 54957 - DNA, 782 bp, Oryza sativa
  unsure (1)..(782): unsure at all n locations
ggtgagctgctatcgagttcctgcggccctgcctgatacatgataggcacgctggcattctgcgagcgatagaagagttgcagtttgggagtatggaacgaggataccccggtgtttgggaagatgtacagagtaggtggtgcatgcgtcatatgggagctaatttcttcaagcaattcaagaacaaggagctcatgaacatgtcaagaggctgtgcaatcagaaccaggagaaaaaattcaatgagctttggaagagattagatgagttgacagccaaatgtagtgatcagcgtgcagcggctccatcgaccgccgttgctgaccctcctcaagctcttggacctctcccaacggatagtccaacattggttagaagaactgtattggagattcggaaattttctcagtggattctgcatgaaccaaaagagaaatgggccaaggcgtatgacacaggtggtgctagatatggaataatgacaacaaatttggcataagtttacaactaggtgatgcgcggtgtccgtggactgccactagttggcatagtggagttcattntacatgggacatgcaggtattttagggatcggttccaggcagttcttccctctatgccgaacaaagcattttgtttggagctttcatgcagaaaaagctagaggagttgcgtaaaaaggccatgaaacatcgagctctagtgaaggtacccaacaacacaggtttgagatactatgtcaagataaggcaagcangggtatctaccgcaagagagtgaat

SEQ ID NO: 54958 - DNA, 3521 bp, Oryza sativa
ttttgctgtatgatagtttgacataccagcggagaaagtggagcaaatcaaaccaaacaggcgcatccaagccaccaccaccaccacctcctgcagtagagcgggccacgaattcagaacctgctgtgaagggtgaagacgtgccttgcacatcagcataatagtaatctatgcagccccaaattttgtgtaacttttggtgcttctttccctcatactgcctccttttttttctcttttctgggctgtttctttgcaccatgtgcttgaaattcgcagtccaccttaggctgggctagatgctaacaagatcttaacgataaatcccaaaatcttatttatattttcatatgcttgttcatccacattgtatgttagtatgctccctccgttcctttgtggatggcgccgttgttaataatacttatagatggtttatcatatcataaacgaaagctttgtgattatatttaggatgcaacacacttggataatatagaatcatttgaagtgtaaatgatctttttattaaaaaaaagacaagctctaaagttttactatgaatagtgcccggtgccatgtgactaataacttactccctctgtcccaaattagatgtcgttttgattttttttttgcaatgtttgacaattcgccttatttaaaaaatagtgcaaatataaaaaaagataagccatacttaaaatacttttgataataaaacaagtcatatacaaaataaataataacttcataatcttttaaataagaaaatggtcaaacgttaaaaaaatgataagtattttggaacggatgtagtattaatttgctgtcatcagaagataattacacaagctaaaatcgccacgaacaggaggtatacagggtagataaaaccagtagtgcagcatttgccatagatgctactatcccctgacgatttgctctccagcagcagcatggcatgtcttctcctgcgacgccgagacctccacttttcgagggcgtcggggaggggcatgaccaagagaggggacatgaggcggaacacgagcaacttccgcagggggcggaggtggaagaggccgagctcgacgcggcgctcgcggtaggctcggaggacggcggcgatggcggcggtggcggcggcgatgtccgggaggtggcgcgcgtaggcgtcccaggtgcggatgccgtcgacggcgtagatggtttggtcgaagatgagcaggtgccaccggagccacacctcccggcccagcggcgtcgtcttcaacctctcgccatcctgcatggacatcgtgccccccggggttcgcaccagcagcctgaatcgcttcctcggaatcttgaaccttaacgccgccattgttcttgctcttgctctgctagctaattcgtcgacgcgcgctctgtatgattttcttttctttttttttttttttagacagagagggagatgctctgtatgatcttggtcgatacttgcacagttattacacgtcgaaacttaattggtttttatataggagtctggacggtgacagctacaaattgtgtgacaacttaacgacgcggcccagtttaatctgggtatgtacatacaattggcccagcccggctgtctgagcggtcgttgtaagttgtaacacggatcggacacgacacgaacacgatcgatatatccaaaaagaagaaaagaaagtaaaaaagatggttcaaaaaaaaaagaaacaagtgagaaagatcgaacatacggtcgaatccggaggccaggcagggagatcagatggcagctcatggtggctgatggcactaatgcactagcatactcaaccaagccaaaaatgccaaaatattcgtcatttgatttcattgtaaccgaaaaagaaaatgccttgccaaattatgggtgagtttgaggagaaggagattgagaagattgaaaagatacgcaaaacgaggtgagtcattagcgcatgattaattgagtattaactattttaaactttaaaaatggattaatatgattttttaaagcaacttttctatagaaattttttacaaaaaacacaccgtttagtagtttaagaagcgtgcacgcggaatagaggtactttctcacctaaactcaccggaacgaacgcaccctatgtcaagatgcaactttggtacaaaaccccccaaaaaaatgactagccaatttctgccaaaaaaaaatcaacattgcagtttttttttttttggagaactgcatatgaatatcagtcaattagctagttagtgttagtgtaagagtaggcccgtgcgtgctacttgtgctaaatttgtggtctgcaagagatggtcataacgaacgcgaggaagcaaaaacctcttcaaatcaacatgcatgatcaaacgtactaatccaagcaaaatagaggctaggttattaaacccgcgtgcatcgatcatcacaccaagaaatgcatcaccacataggagtaacatatatccccagatcagcatatcacatatatatctttgttcaaatacgacgatcgagtgcaaaaccatacgtacacacagatatccatcgatcggcgatcgctactgatcctatcacagacaacatgcaagctacgtagtccaaactaaaatgcaacgaaaggtaatccagttctcaacgtaggccaacccgaccgcatgcagatagtatacctcagctcagacggcggcggtctcggtctcggtcgcctcgcctccggtggtggcagcagcacgtaggtcggtagttgccggcgccggctccacctcctcctcctcgtcccaaggaccaccagcagcagcaggagcgacgacggggtcggccgcggcggcggcggcggcggcgatgtcggggttggcgacgtcgatggggtcgccgtcgcaacgacccgtcacagtagcgacgacgaaggggtcgcgaggcgtggcgcgcatgaccgtcatgttgttgatggactgcagcattccgcgcgtgaaggagcggcggtcggagttgctgccgcggccgcgcgcctgaggagccgacgacttcttgttcttcttgttcttgttcttcttcttcttccccatgcccggcggccggcttttgctctgctcgtctactctcgtcggaggagtgggtggggtggggtgagaggcgtgagactccttatgtaacccgcgtttatatactcgagctggttacttgcgtggtttagccgtctcctctctctctctgacacctcttgtaacaagaaatgattcctcctagttatctctctctagctctctctctctctctctctctctctctgacaccttgtaacaagaaatgattcctcctagttaatgataacccgtctcctctctcacacggattgacacaggtgaaaacctgacacctgacacacaccctccccctcctctctgatcgctcgtctctccctctaatcgctcctctcttgcacggagtaatcatctagaataagtaaagaaaaatatctagaataaaa

SEQ ID NO: 54959 - DNA, 1137 bp, Oryza sativa
agaatggaggatgacagtaatataaggtaaaatctacagtcgccactattactgtcattttaataaaaccttaagcaagtgtcctgtaaaattaataagcaatattacttacaacacagttattaatacagtcatcttcactgtattgtgtttcctactaccttgatttagtactggattccagtgaaacagttggcattcctgagtcaattcagtcaagatgaaggcatctactcaaccaagataaacggtatcagtcactgaaacagcagtgaccaatcaccattctactagagcatagccaaaaatcaagattatggcatatactcgcatgacaattggcagagttacgctggttaactaaagaaaatgtgatgaagggtatagagcccttagctccctgccgtcgctcttttgcatgccaaacatatggcaaaatgttaataataaatagaggaaagtcgttcaaggatgcaacagaagctatggatcagtaattcagtagttaaaaaaccagtacatagttgagctaagttatgccaatcatctagcaccacacgtaccttgaaaaaaggcgcagaatttcacaatgtaatctggaagttgagtacgcatacatccggaaatttgtctccacaactacaaaaccctacagcaccaacatcatacaatgtaattattaacagaaagtattttcatcttcatttgttgttgcttaggtgacgagtagattgaggttatgaaagatttggacgtcatgaataactgtaatagcaaggatataaaatgttctgaaacctctttgttagacgatgaatctgacaagcttgctgagagatttgtagccagttttgtaggtatgaaccagctgtcctttcgaccctgccatggcttaactcttgacatttgtattcatcaagttgactagggaaaagactaaatcaaagttttacctgctgaagtttgaccagtcccaactccgccagatccctaatagcatttctttggacatcggtcagagtattcaagctataagcctgaagcatgaataagttaaacagcatgttgaagcgaatttgcaacagatgaaccaggccacaaagcttggactccacaacagatgaaagataatgctta

SEQ ID NO: 54960 - DNA, 2886 bp, Oryza sativa
gtcgggatcgaaagtgtgcttatgatcaatattgccagttcgtatttcagtttgccccctagccgaatttacaacatttgaactctgtgcgtgtttgaaaatatacatagtactatttgattgacattttgaagatggaactactagtggaacgactattaattcggctataatcgctactagtatatgaagccgaattatttccactagatattatgtagtgcgacccataagactgagatataacatgtgactgaccgatacttggcatggcatgcaatgatctaatagaatcaactgaattataaataccgccatagccatacatatctttcatcggcaaattttgttgtgtagtaataggttccgaaataatcgccgatgaattaaaaggtgcgcctacatattgtttattgctaccattattaaaatttaaagcatgtgaattattttgcataggctgtgacttgttattctcataatttaaagatcttgaacattgatttaaagcatatctagcaacattgacatgagtgttgatggcacttgaagaattattttgtggaacgagcaatgtgtctgtagagtgtacctcacaactggcatagcaaggtgaccacgtagcactccagtacgcatccatgtatttttctggtgcaatcaatgatgagggaatgttaggtcccgatctttcgataggtactgataaacagtcgatttgggcggagtcaccacacaactcgatccggcttctgaacgaacacgctactgagcctcccaatcgcagcaccacgtctcctctggttatcaaccgtgccgaaacccgattgacctcgccgagatggctaatccttgcatgcgaatcgaagaacacaagcaagaacaagatagattgcaaccaaattgcatatgaatgattaagcacacgaatttggggttacacaaaccgatctatcggcgaaactgttcctgacagattaatttaagcaaaacctgactctaaacgatgacggctactaaataaaaaagattagggacgtcctacggttgccctagggcgtagacccccttgggctaagcctacgacacaattacaaggccgaaaacccaaatcagattcggactggatgagatacgtggcttgttttgcagatttctggcagctcggtaggaattttgacatgggaccaaaaccatatgaaagtagactccataatctttctaacaagtactcatgggcccaaaaattacttctagatcagcggctaggtccattttaagttgatgctctcaggagggccgaatccgaatccaaaacatgtataattttatctcgtcttctatgggccaaaagtgacatgatgaggtagaagtagacttggagaaggttttggtttggtccccaatcaacttctttaatcatccatgcattagttacgctcggtctcttttcctttgcctaagcaagtacgtctgcaaacgaaaacacacaaaactcattgtgtagcaacgtttgttcaaataaatatataacaagtaaatctaatgtagaacatatgaacatttatttaattaatacataaggtagttatttatggttatatccgagctagttatgttcttatcatcctccctttcttgattggaaaccgtcctcggtttcaccttgtcatggagtgtattgtacttatctttgtctatcacaacatcctgtgcggaacatttcttgatggacatatgattggatcctaaaatctttgtagtcgaaaacctcaacactcctcttgcaaaccaacttgtaactcatttaaacaactagaggaactagatagagaattacttatatgcatgcggtcctctagacaatacatttcatcatgaaaaggaggtatagtcaaattcgaacaaatatatactcgatgcacattatattctcctttactttcataattgccaataatatgaaaaatcacatcagaagggcatggcaattcaaatctagcaaataatttcttctttaagcagttgagtggacaaatatcatcaaattgaatataaccccaagtatttaaagaagatagcaatttaatttcttcattctcgctagcaatgtgaataacatgtttaaactcaacacttggtggctctactatagaactagcatgttcattcactagttgtggcatggatataagtgaagcatcgcacaactcttctttgtcacgagaaacatcaagcaaattgttttgtgacaaaggtatttcagcaattgtttccaccatgggttgctctaatgtagcgtaagtagtagacatagttggcacctcataaatatgcataccttgagtagctgtagcaccgttatcattaccttttttctcatctgcagaaattataggcgcttgttcaattgaacattcttcaaacatgcatggagctatagataggactttttcctcttcgtctttcttctctttgtcattattaccttggttattctcagatgcctgtaaaatattagtatccaaaacaataggcacaacattacgttcgttttgtaataactcagacttagttgaaggcatcacaatagtatctttcctggtatctctgaaaatcacatcgattctatttttcgtcctttcaatactatctttgaaaatttccttgattccattcttcatcctttcaagattatcttcgaaaatttcagtaaaactcatgggtaccaatttcatttttcgaccattttgtctaaatgtgtatgtattagcaacaaaattatgcgaaccattattatcatatagccatggttgaccaaacaacaaagaacattcttgcatagggacaagatcaaaattggcagtatcatggtaatttccaatc

SEQ ID NO: 54961 - DNA, 940 bp, Oryza sativa
ccccggttgagaagatgaataaacatgtagaacaacagaagttgagtgattactcttgtaagtatgaacaaaccttgagccctaagacgcctgcatttaataggctctctagtgcacttggattgagggcattctctggaacgaggcctccccaaaccctgtttgagaacagcagacaagtcaaaaaaggtcggaccatgaaacaagtttagatgcagaattactgttattatggtggatgagctgtttttacctcccttggttctctacttgctaatgtgcaatgatactgaaacgtgtaactattgcattgcaacttacctacatcaacatgtagtttatccttagctgcatccaactgataatcaagcacgtaatgtcagtgttgactaaagagaaagcaggtagtagcaatttgatgctttatatactgatattggtacgataaagaaacactgaccttcagcttgagagtttcttcagaaacagttgacgggtagctattaagaggcatgtccactaatgttgtaatgccacctgaaatgaacaaaccgtgaaactttgagcaaaaagtctgatctctttctgttattgaaaagaaaaagaaaattgattactccctactaactcggtctcatgtctcaatccaagaatacgaaaatgataaaacaacagtcccagtggcagtatagtattcagaacacatcccaccatatgcgagggatgttgccgtaccgaattcagaatgcatcccacatgagagggataagaactaagaaacgtgccttatttagagcatccccgacattagtacgcaaggattaactttatttagattgacaagccaacacgttaatgagggttaacttgatatagattgataatgactgataaaaagctgcacctgcagctgctgctcttgtaccagtggagaacccct

SEQ ID NO: 54962 - DNA, 2233 bp, Oryza sativa
aatcagaacagtgcagtgcagtcacaccactagtttcaagcaatcgttcgtataagtgattgattttggcaagtcgctagagatcgaagcctacacatcgatcagtccgggcatgataaccgcgtcaccgtagtccaccaccggtcgccggagcaggaagctccggtaatccccgacggcgatcgcgttgatcagccctcccttcacctccactgcacacacacacagacacacacaatccacaacaagaagaatccgtcagcgacatggactcgctcactctgaaaacccaaagcattcaactgctctatcatcatcagagtaataatcaatcagtccacttgtcgtcgatcgaggtcatcacctgcggcggggccgacccgtccgagcgtgacgacgcgctcgctggcgatccagaagtggtcgtgggggagaaggctgcacccctcaccgcccaggctctgcaaagacaaagggattctcctcagctttctcgtacgagagaagagatcgcagattcgaataccgggggaaagggaatctcccggagaccttggaaaagggcgcgcggtagaggagcgccgccgcgagcgccgccgccaccgccagcagcggcaggaccctgcccttcgccgccgccatcgccatcgtcgtcctcctcctcctcctcctcgcgctcgtgacgagacctcctgtccttttctgcgtctgcttccttccttcctcgcgtgcgcgtgggctgcgcctccactggctctgggctgacgtggattcgggtatctgagtcgggtgggagtggatctgtacacctggtccagtggactggtgggtacgaggattcctgtggggcccacctgtctgtggcgtggtctagtggaccgcgacctggatgatccgattctggttttgttgcgttgtgtgagggcatccaagtggctggaacctttggagggatctcttgccttttagtctttcttttcgtttttttataagaaaatcgagattcttttttatttttttattaataaattagagaatctcgtgtgttgttttaaggaattagagaatctcgttgtagcggtgagggggtgggtgtgacgcggccgcggagatggacggcgtggattgcctgctcggggtttgaaacgtcactggataggaactgaaattaagatttaaataaaacaaatcaaattattcaattattagagcaagtttataatagtatagctcactactggctccaattcatctatagccgatctaatagacaatttatacaatagttgcttactatactattaatatatggtctcacatgtcatacacacattacatcttggaatccgtgctgcagctggctatagatctgtagcccgttgctcatctctttcatcttttatcttattaaaatatgtttacagctggcttatagcctgctattgtacctgctcttatagcggcctgcgctataggtggaaaattctacgtggggtaggacataaaattctttccagctgtataagaggaaaccagcggctaatttgacaagtagtcaacatttggtactccctccttccctaaatgtttgacaccgttgactttttaaaacatgtttgaccgttcgttttattcaaaaacttttgtgatatgtgtaaaactatatgtatatataaaagtatatttaacaataaatcaaatgatagaaaaagatttaacaattacttaaattttttgaataagacgaacggtcaaacattttttaaaaagccaacagcgtcaaacattttgggatggaggtagtatttgttagtggcttatcatacattttctttttataatttggtgggataccgttttattttgtaatttactctcatctttatatagcgcatacagacgtgtgtacatagagctgaaaatcattttatatttccatgcctccagtaaactccagctttgaatattgtgatgggactgtagtattatggtgcttatccgagtctcgtatgtactatctccatcacaaaatatgttgattttttatataacgttcgattatttgttttattcaaaattttagtaataactcctcggttgattaaaaattacaacaaaataaatgatatgcatataacatttttcaactaagatatatgatcaaacattatgcgaagagtcaatgatgtcatatatttcaaaacggagagagtagcaatttattattagtatc

SEQ ID NO: 54963 - DNA, 1370 bp, Oryza sativa
cacccccgcccccgaccgcgcgagctccggagcagttggcgtcgacaaggaagggaggtgaggcggcggagatgttctccggcgagtggacgccgccgtgcggcagctgctgcaccaagaagtacgccagcctcgtccaaatcccatgtcagtgtgctaccgcccaatacttccctctcgcaagtccccggtagaggatttggtttaatttgttgtgccatttttttgttttggcgcgattgggcttggatttgcagggagggtcttctgcaagaaggggtgcgacgcggacggcgacacctgggacgagtgtgagtattatcatctgccaaatgtcgctgtgaattgattcatccgctcattacccgattttggttttgctgatggtttagttcatcgccgattcaaatattttccataggatgagatatttatgttatgttattcgtggctgtccttgtgaatggatggaaaattaatattaggcgtatatgctttacaccgttgatggaaatcatgttttggagttcaatagtactagtatgtggctagttatctgacaaaataggcatggttaacataatgacccccttcattcagtggaatatagttaaaatttttaattggtaacttgcagtgctgtttgtgtcaatgctagctgcaatgagtcatgtactcgtgtttacagtggatcgttggtgcattccttgctcagaagtttgtgttgtttctgttggtgccctaggagcattttattcttctgttgataccaatctgtgtgatttagggctaagattcattccgattttgattgcacatgaaaaaattttggcttaaaattgctgatcactttgttttctagcatagcttagcttacttgccataaaaattctcaggcataagtaaatgtacggaaatatgctacaaagatcctgttttggaagatcaccagtggagtgcatatatcgatcggtctccaggacaggatagctactccttggtgagtttgtgatctgtttgtacaattcttataatttccatattccttttactgaaagtactttggtaagtgataacccattcgatggcatatgtttgtactgtatactgctgtcacagcgaaagattaggttgcattttgctgaccgaaattataatcaccctcacatgattacttgatcataaacaggaagttatagttgtcatatcttctataagaaagtgcatatatttaccatctgttgcatgatggaatagaattaactgcactagttgattttgagtaagagttgtttgttcaagattttgtatacctttcacatgattatcacagtaaagatcagtacatcagactgctgttgtatggtccg

SEQ ID NO: 54964 - DNA, 2800 bp, Oryza sativa
gtagctcttgtttattgaggcataaggttttataatctgtaatgactgtctttctttacaatcagatgggggggacaaggacaatatgaaaaaaaaaagaagtcagcccttaaaaaaacttaatttattcctttttatttattgtttttatcacttgtaaagttcaatcaattaattcttgtgatattatttgcatccttagtgactttttttactttctgtttcctgttataaatgtgcctaatcaattaagttaatttgccaaccaccttaattatgacaattacttttggacagtagtgtcattttgtaccacctaccttaattcttgtactgaatccaaatggacttatatttgaaattgaagggattttgtttgggcatcgaagttttccacccgtttctttaaaatccttcatattatgtttacattctattctgtggataattgtttaccacttggtctttcttcaagcttgtcagcgagtttttccgtagcaacgaggaagctcaagctcaaattgttccccacagggtacagttcttaacccatgactattattatttaccacaattatgtattccgatataacatacctatgatgactttgctcctgaattgactcattgtattttaaggtgaatttttctgtatatatataatcaagagaaatattcttttacacagtcatgtttaattaatgtgataaaattttgatcaagtttgcgaaatttatgccaatccactagtatccatgctagctaaatccgcatgatcacctaatgatgttgtttttgtgcgatgatgttacatttttgcctaggtctaacaagtgtcctagtgtgttctgctctgctgtccatggaacatatggctaaacgcagggtccgggatcttttattataactatatcacattagagaacatgcacagacaggagaacaataacttgcttctactataattttcaactactctaccccaatgtgtccctaaaagattaaccaatgcagcatctataaatgcaccagataaaatcttcccaaaatgtgactagtttcatagagcctgaattcctggcactaagattgatttttcttgaataaataaacaatatatggaagtacttcaatgactcctctagtgtaggatctgaaaggaaaatagagtggtcaaccaaagataattttttagtgaagtgttctactgatcaggttgtgctattaggctgtgagatgcaacggccaggatgttatcccatttgactaaaaggcaccgaaattatccttttcacctgcataataactcttaccataaacaacagatcaggcaagtataatttaaaaaatttcgtgcacttgatatgagaattaccatacaagttgatcgaggtacacaaataaatagggtgtttggtttgtggatccggttgccgctagcaccatactacattagtaacataaattttaaaaatttatgtccgatgttcaattccttttcgactttcttttaactggatgtttccttttgacttcagttacaggatgaaattggggcagatatccagaagatccaattgcagaacgaggagatgtctggtcatgtaagtttacttagacatgtatttagacacctgcggcagaccagatttaactacgcagctaactaccggaatcgttttttttttttgcaagacatttattttctcattagttccttattttccagtgatgccacagctgaacgaggaagaaaaatacaatatatgtgttgccgatagaggagaaatctgggtttctttggacaaacttgtatatattgccgctagaggaggaaatgaataagataaacttgtttaaatgtttctgtaactgtaccaaacatacatcgatgtgacggaagttttcaaatatatgtaaattattattatttatatactagggtgaatttgtgagccgtgtataccatgtgcgcacgatcgagttggatttacatatatgcgcgtgcacgcagccagctaaccacgggccacggcattgtcgcatttaatttcctctcaggcagcagcggcaaaccggtagaccaaacaaacaagggggttaattaaatccgtaccactatgaatttataggttttaaaatataccattataatttataaaattaaaactatgtcattataacttaacattattttaatatgtcaccacttactcattcactacatttttctaatattttaaaccaaattggccttgtttttttcatccatcctcttctttcttcgcctctccttttcacctctcaccgatgagttcatgtagccgtccacggcacaggaaggttgtagtaggacaccccgatgagctcgtgcagcaggtggccatggtgtaggaagagctcgtgagtatagttatgtggagcaaaatatcttcatcgttttgagtgtgttataggttgtattcgtggatagcgctcgaagagtttgtgagtatagttatgtggactataatatcaacattggttttagagcatcggaagttcacattcttgtttctatagcaccgaaagatatcagttcactttagtagcaatgaaagttatctcagttccccattttagcactatcgttagtttttctgccatttgccgtcaaaattttcctctctaatcggttgcgccatggtagcatcgtcctgccatcctgccgctagcggaagaagggatggcacaacgcgtgtgctcctacgctgctggccctatcgccttggatcgtcgctcactcttgctggaccatttg

SEQ ID NO: 54965 - DNA, 1576 bp, Oryza sativa
cgccccgctccgacacgccagtcgcccgcttcggtcgccggccgcccgtcccactcaaccggccgaagagagaggatagagaggaggggagagtagtgaggccctgataggctgtcaatgtcatcgtccacgtggcatgctatgtaggtaagaccacagtcaaatgaggctttggaccgggatgatacattaaaccaagtttagagatctcgatgctcgttttgcaagtttgtggatttaagtaaaaccttgttacaagtttaagtactactagtgtaatttactcttgatttttcaaggtaaaattctctcctcgttgatcaatcaatccatccatcttcaggagtagattcagatcagattttgagtgagaacccagatcccagattatactacttagtatcattttatttgattgtatgatatgttattgttttaagccaatttcattgacacaagaactaaaacggctggcaatactggggcaaagcaaacctagcaagacagcaataacactggtatgccgtttgcccacccgactagccgaaccgagcaatagctcaggctaaccagcaaataaagcatttctaacatcacgcgtttattattccagttcatctacataaacagctgataaagtaactgaattacacttccacgtaaactagattacaggagtatctgaataatataaaaaatacaatcactatacgctgtccacatgaagtacaatgtagcacaatcgaatggagagtggtatataacaatggaagagccgggctaaattatacacacagggacattgccatttgcagttttgccgcaaatcaaaatgtgtagcgcatacgatcatatacactacaaatcaacaactgtaagcactggatccacctgaaagacaagaacaggagcaatatgtattaacataaatattttcgatacttgtgtgcagtgagctaaacagaagcatctcactactacacctgaattttatttggcgaggattggagcaccacatgcagcctttgcatgtttgtcttcagcgaacacaagattcccacccacaaaggtggacagtatcttccctgaaagctgctttcccaaatatgccgaaatattctgcaaaaatgtgaaataaactttacacatagaatccagacttcacatataaaatgtgatcttcaatttgtagcattttctagctgattgttgaggaagaggtcaaaagttccacatggtccgacattttatatggaaacaagtggaattctaacgggttcgagttagaaagcaaacccgatgcttatggtagacaggatggctgtcatcaagatggaattgagcctcaggtttccataccacaatatcagcacggtatcccggcagaacagcaccctacaaattgagtttaatttctttttagcaatatcagcatgtactgtatcgagtgagacaacagatgatgatataaacaaagatgaaaacattaatcataaccattagctggttttaagttacacaagtgtcatccagtaagaacagtagtatggcacaatgatgccatgcattttgctaa

SEQ ID NO: 54966 - DNA, 3735 bp, Oryza sativa
gacacaatccagcagtggaattaaaattaaaccatgcacatgcatatgatgccagaacacgctctctagtatatatttcctctgatgcattcctgcagctagcagtacttgcatggattccattctctacagtacatattcccttctcatttctccatgctactctttgttttcattttctcttcccaaataaaaaaatatgtataccagaagacattcctatatttcttttttggttcttgtatttatcatctgatagaatatacagtttcagtcgggctctgcgctcagtttgttcccttccttgcgcagccttgaggacagacacaagccccatccctagccttaacttttccattgcttaacgagaccaggcaaagtttccctgtgatctgcagagcatttaacaacaagacagtgattgcatccaggaaagtcacacttgtgtaagaaactgagaagaaaatgatggggccctattgggtactattattggttggaggaactaattaatagtactacagacgatcagaatatgagtcagttgcatccataaagacaagcaaatcaagcctctttctaacttccccggctagcttgcagctcttcttccccccttctgctccggccctctcatagctagatcctcacatgtactgctgtcttcctcaatcctgggttcagatgtttcacctcttctctatctagccctctttccatcatctttggcacctgcaagagctagagctgtaaaagttagttagtgtcatttgatggatccagcaaggtactggatcttggccaggaggaagctgggagatcagaaggcgcctctcttccccacccctcacatcaccatcggcgccggcggcagctccacctcctactacgagtcatgggaggaacgtgccttcgcggaagactccgcagggcatctcgggggctgcatctggccgccgaggtcctactcctgcagcttctgcggccgtgagttccggtcggcgcaggcgctgggcgggcacatgaacgtccaccggagggaccgggcaaggctcaagctctctggggttgtggaggacggcaccggcggcgaaagccacggcatgccgccaaaccaaaagtacatgatacaaccatgccctccccaaattggcaccctgcagcacgcctacagcccaaaccctagaagtggcagtattctcgctgctgacactaaccctaattccatatgtgatgttgtcgcgtaccctgctagatccttgcttcaagttgcagctgctagaactgccttgggcaaacaagtcctgaacgcccctcttgtctcatcgaagtcgccgtcggctggtagagaacatggtaagagggagacgttgtttcttggtgctgttcgattggcacaggatcatgacacggtgagttctaatcttgacctgcgtgttgggaaaaatgaattgaagataactactgttttggggtgccgatcaagaagggactttatgtacgataacgaccgcgcggatgatgaaaagactgttgaagcaagtcacaagaaaagaagaatcgatttggaggtaaaccccctgattctaacttcttcaaccagtaatcatcaacagcaagatggtggtgatgaccaacatcatgaaaagatactaaaactttatcgtagctcctcggttgaagaactagatcttgagcttagactcggggaagccccaaaagaacagtagatttcatatccactgttgtatctcaacttgattacaaatgtttaatttgtatttattcaccactcgtgtttcattgaaatgttggtttgcactatctgaatttatccttgttttatcctatatgttaattctgcttatttccttggaatgatttgaagaaatcatttttctcttgaaagggaactgtaatgaaaaaaagaactaaagtgacttgttatatgctgtgtaagaaggtactgaattccaatttaaaaccttacttgcattgatgcacaaaaattatcacataatttagttgcaaaactttctctggttaaccttatatattacactaattgaatgaactgaatttgccagttaatcaaaacatcttgtggctaatctcgaacaatgtcaaattagattacgctaaacaaatatagttgtattcgtgtttatatcctttgttaattctcttaccccccatagatgatatgtgggaatagtgtatattttgtcaaagataaccacatgaaaaaaaatcaaaaatttgtcatactctgtcacaatgtgttgaattgtagttataaaattttatctagtagagcggttaattttatcgtgcaaatgatataaaactaaagttacagaaatatctcccagctgtactgctggacaaagggtttttaaccccggtttataaccccctatagtcccggttatgcaaccgggactacgaatacaggactacagatacccatctttagtcctagttaaaataaccatgattaaaaatatccatttttaggcccgattggtgttaccaaccggaactaaagatggagccaggccagctccagttggtagattttttttctttttttcattgttttaactttgaatattcatttcactacttccccaaatcatccccaaatcgatcatcgcagaaaaaagtatcatctctaaatctctaaattgatcatatccaaatacatcacaaattctaaaaaaaacatcacaaatacttcacatattcacatcacacacaaatcaaatacatcacagattatacatctcagatccatgcaatgaatcacaaattctcaaaaaaaagaacaaaaacaattttgcgatgtcgctgccgcctcctctctggcagaggcgccggccgcccgccgccgcccgcccgtcctactcgctcgccctctggcctgcttgcttgagaggataagaatagagagaggaaagggagaggataagaaaaaagaggaggataaagaagaggtgattgctagaggataagtgctagggattatatactatgcaccgatttttagtcccagttggtatttccaaccgggaataaaaagaatagggggcatacacttttttaaccaggactaaaaacgatctttagtaccaaccagactaaagatcataaaatagctatgggcttttcaaccggggctaaagatgatttttagtctgggttctttttggaaccggggctattaattgtggttttcggctaagccaacaaagattagttctccagtagggttgatagcataaactttagatggcacatgtgttatatcgtggtcaatattatattatctggttcttattatgcatgttggcaaagtattctcagccattatccatttctttttattgctggtgtcagtttaaattaattatattagtgctctttcaccgtgtcgtctattcaacgcgtgcaagtatatgaatatcaaacaattaataacaacggataatcagttcattaaaactcatatgtgctcagcttctataacaacggatatctatccaaagatcaatataattaatttacagtaactatgtcatatatatctgaacttttcatattggtagttaattttcaatatcatggaaaacatgtctatttttcccctgccagctgagatttaccagcataatatataagaagtttcttaccatccacggtaccacatatatttttatgataatatgtccttag

SEQ ID NO: 54967 - DNA, 1539 bp, Oryza sativa
aattcctgcagccctggaaaaataaaaccaaccacctacattattttattcatgggaaaggaaacatctaattagcgtaatacttattttcctttcccatttctacgaatgcgcgcttgatcttagcgcacaaaccgcgactaagggtatcgaaattatttctaatttcagcaagctctacccctagctccgtgttgcgatccctaagctctatattctccttgcggagtttcttcacttgcacggcgagcttatggatcgagggctctgacgacttcacctcatcttcttgatattggccgggaacccgtcctgagatataccagccatgggtgttcactaggacttggatcaaaggtttttgagggtgaatgggagattgaatagagaggcttttgcaaaggaggaagaaagagaggaactagctcaggagagtgatccgatcgctctacctccaaactcgcatctaaacagactcaggacgggcgggggagtctaccatccaaaaatggggccgaacgggtgccgccctggttcggccgaaccctggtgggtccggcaggcctccattttctttcctaagcctactaatttctaagctaagcacaaacatgacaattataaagggttttaagcatgcataagatgagatcatcatggttcataattgattaattcaacgacatccacttcttcatctaaagtttcatttggctaaaggaaaatttttaagcgttgaccgtttaccttgaatatattacctgaatcgttgcggagagtgattgccccgtgcgaagaggtattgatgacgttgaacggtccttcccatttactacgcaattttccgtgaccgaaaagcttaacctcggagttgaacattagcactttgtctcctggcttgaatttcttgatttttatccttttgtcatgtcagtgcttcgtcctttctttatatatctttgcgttgtggtaggccttctctctccattcttcaagttcggtgatttgcattttcctccattctcctgctccgtcaaagtcccatgttccagtttctgatggcccagtatacttgctcaagttccacgggtagtcgacatgacttcctgtagattatctgatatggggacattccaatgggtgtctcatacgctgtccggtatgcccacagtgcgtccgacaatttatccttccatcctgtttccattttgttgaccgtcttctacagaatattcttaatccgtttgtttgatgtttctgcttgaccactggtctgcggatggtaaggagtggccacattgtgtttggctcccatctctcgtaggaggtcttggaaggttttgtcaatgaagtgagaacctccgtcacttatgaccattctggggataccaaatcttgtaaagatgatttctgtgaacatcttcttggcatgcctcgcatcagcggtgttgcatggcatagcctcaacccacttggagacatagtcaactgccaccagaatgtactcgcagttgcgagacttatggaaaggtcccataa

SEQ ID NO: 54968 - DNA, 827 bp, Oryza sativa
tgagcttttccatgaaatagctcctactgtgagggtaaatacgtatcccgatgttgactttgtattatcttttgcaaagtcagaatctgaataccccactgtctggagcgattctgattttctgtaagacagcatgaggccttttattccttgcaaataacacaagactttctataccaatttccagtgctctgggcctggattactctgaaatctgccaagtaacccggtaacaaatgccaagtcaggtcgtgtgcacaattgagcatactgtaggcttcctacaactgatgcatttggctttgttttcatttcattgagctcacactgatttctgggacattgcgatgccccatacttttcgcctttgactataggagcaggtgcagcactgcatctgttcatattgaatttcttcaacaccttttctatatatgccttttgagaaagtcccaatgcatactttgttctatctcggtgaatctctatgcccaaaacatgtgagtcctcaccgaggtctttcatgtcaaagtttgaggataagaatttctttgtttcctgcagtagactaacatcactactagcaagtagaatgtcatctacatacagaattaggaaaataaatctcccattcttaaactttgaataaatacagttgtcctcgacattctcttgaaaacccaaatttctttattgttccatcaaatttcaagtatcactgtctcgaagcttgttctaagccattgggctgggcgcccccaatcagggcgcgggtcaaggcccccttgagccgttgggctcaaggggagggagatctatctaacagt

SEQ ID NO: 54969 - DNA, 4143 bp, Oryza sativa
cattgggaaggtttcttggactacaattcacaaaggggtttttaaataaatttaaataaaggaaatcatggtaaaaaaggaagtatcaaatcacgatataactgaagataggttttaaataaaagtcataaaataatttaaataaacgaagaagttttacgcaagttagttttaggaggtctctctctctctaattatattttcctaggtttagaaggttaataagaacataagaaccggcatgatcaggaaattcttcccgggtgcacacgagtgaggacaaagtgtgcagaaaagacttgtgttagtctgtgagggcattctatgacctatgagagctatcagatgtaagcggcccggcctgggagaggcggaacgttacagtcaggatcaagtgtgggcaaaatccatagaatattcaagtggtcgaagtggagcatggtgaagttcatgcagaatttcctgaaaaaggaaacaacgtttcccaggaaccgttattggaagacgctagtaaaatccagtacaccggccaagaagctagagcaaccggctcagaagaagccatctcccgcaccaaaaccaaagagggtgtggaaggaaaagccaaagacgcccgctccatcacctccggagacgggtggaaaatctgcgaactaaactgaaaggaggtacggtcttgcacgtcggacccaaaatgacacgaccctcgccaacaggtaaattggtatgtatccgcatatttattttcatcaatttgaatttttgcatcaacacatgtttgcatcaacacaggtaaattaggtttactaacctcttgcagagaatgaactcaaaatggaggagaatggacatcaaatcagacgatcaatcaatcggacgatgtcgagaatcagacttatcaatgaataggccaagaactcagaaatgacacgactaattgggccaaagttcagaagtctgtggaggggagaagtccaagaagccagcagccaaattatgggctggttgggccggcctctggttcggccgaacccccctcatcgccgttggatgcagggtttctcctggacggtgtagattggcccccaatgccggttggagggtatttccgaccattccaaccatcacaaccgtcattgggaggctatataaacccctcactctctccatttcaaaacacactccaagcaaatctctctcattttctctcaagtttagtttagtgttcttaagctagtagagtaggaatagaatagaaatcagagtccgaaagccttcgaaagagttcgggtatgactctagtagctctcctttcctcttttgtaagctttgtactttatttagaatactcttctttatacatttcttgtaacaaacccaaattgtagaaacttggaaattcaatataatgaaaaaaatattattgtggtgaaaatttgttttaggtgtttttggatcttctatgcatcatttcattttgcatatataaattaaattaaacaaaaaagggtaatacgattagtgatgagtataataaacaacaaatttaattagttataactcagcttttgcatctcaattaaaaagatgaaggcaaccacaattaatttaaattggaataaaagaaggaaacttgtttgaatttccaaaaaataactgcacatgagaaaaatctcaaaaaaaaaatcaccaaatggagttcaccactacagtaacttgcagtaaaattggcgcatgcttttgagcagtgtagtcattccaaaaaaaaaaaagaattcgtcagaccctcagccctctctaaaaatccctgggaagaaatgttcctcacctcccctattcctgtacttctctgatcaacgggcccaagcaccctggaccccacctgccagtggcccagcaccccatcccactctccttctctttcccatctctttccttgcagatatttcatcgaacacataggatgcgagccgaaagtcgtcgcctccaagccgcccattcctcctctgcccgcgaatctcactgcaaggctgtgcaaagctgacgacgcctctgccccgcctctgcccgatgccctgccgcgcccagcgctgccctcgcagccgctgcgcccaaccgacgccgtccctctgcccggagcgacgagacgctacaaactcgaccgttgcttcctccgtctgcaaagccgccgacctgcgtctgccgtctgcaaagccgacgcccctgcctccgtgtctcccggctgcaaagccggcctcgcagcgcgcctcgccaacccggagccgccgccctctgccaaagccgacgcccgaagcgacaaggcgagaccgaccgcccctggcttcctctgactacccctgcactccctctgcaatccctgcgcaaagccgacgcctgctgcccgccgtgttccccgccgaccaccgcctgcgcgcgcgagagacgccgaacgcgtcacgacaacctccgcgtccgcctctcgctcctccctcgcctataaatcgaaccctcgcgctagctaactctccagaccaccttcaacctccactcctaaagcggaagccctaaaccctctgattcaccgggaacggccgcgccaccgtcgcgccccgcgccggccaaacagaacgccgccgctgagcccacaccatcgagccgtcgcctcggtgagtttcctctcgattcctcgcgccatcaggctcataggacctccataaatccattttcgaaatctcttttatgacccctcgaccggagagccgccgccaccattgccgccgccgaccgcctcgggagctcgtcgccacgccacctcggaccgcctccgcccaaaaagaacgcggggtaagccaccacatagtccctaggtgcttccctgtcctttaatcgagtcgccgttcgccatagccgccggccgccatcataccgaaccactgccgccgcttgccatggccagccgcctctagccacccccggccacgccaccgccactaggagatgcacgtgaacctcctctagccacccctgcctctgccctagccagccccgcggccgctcgccgccggccagcccatccggagccgccctcgtgctcccctctgtctgttgcgaacggaggaagaagacaggacctgttcgtaaataagaaaaactctagggctcttgatacaaagcgccaatacacttacatgttggaccgagacctagatctcaatagccgcaagattagggtctgttctgtgaaacatcgagacacttacatgtggaccccactgtttaaagtggatgcgcgctaccgtaatacgttttgcatgtaggaaagcgtactctatatagtacgcttcagccttttgtaaagagaaattaataaatctaagaaaatggtttcggttaattatttatgcactataaaatgctgaaactttgtaaaatcatagaaaattcattttaactccgattgaggtgaaccaaatttcgttagattcataataatgttgtctttaatactgtacactcaaattatcaccactgttgtgaaaattttcactaatttaaatttgaatagtaaacttcgtatttaccgtactttaaatattagaaacacgataacttgcacatacaacatcaggtttaggcgattctttctcatttatattaaatcactctctttacactgaacatgttcatgcaccatgcatcatattttatcttggagttttattggatgttcatttgaatgtacgtttaaatttaattagaggacgaatcgattgttgccgttggcgagagtgtgcaggaccaagagttatttgaggaaccaactgagcaaggcaagtcctattcaattcctacttcgatcatgttgaatcctatatcttcgcaaatgctttattattttataaattgcatgcgatgttttataaagaaaatggggtattggtagaaataacctaattgctgcattacctaccttgatatattgattatcgttgaagccctaggctgagaatatgtgtgtgttgtacatgcacaatgtgggtatattcgagctgctactatagctacttgcttagccatgcttagaaaatttccaatggttatatatgacatggtaatcattctttacaaatggagggctgcagg

SEQ ID NO: 54970 - DNA, 2312 bp, Oryza sativa
  unsure (1)..(2312): unsure at all n locations
gagtccagcaaaacaacatggtaatttttggtgtcaaagtatgcaacaccgacagtcattgtaatgccacgctccctttcatcagcactctcatccattgcccaagcatatgcaaatgatcctttcccctggaagaagaaacgttatatatgaacagctcccaagatgcataaaaggcacatactgagataacatcaatcattaaaataagagaaccttttctttagcttccttctcatatttatgcatttgcttttttgaaatcctccccagggcatgtaacaaacgaccacatagagttgatttcccagaatcgacatggccaacctagcatgtttctggtntgagttattcataaagataggcagatagaaggcaaacaagtaataagcaaaatgatggatacatcaaatatatcgtgtatatatagatatgtagttgcttacaatagcaagatttaattgtctagggatgccttcatcttcatgctggagcatccatggttctggcttgtacagggatgaagaaactggctttttaatattggctttacttttttgtgacttcctctccaaactcaaatgctgtagctcatggtccaagcaaagtgtttcattttgactaccaacagaaacactctcactactttcaccgaattcattcgactttacaggcaaatttgagtctgcagttgtatccttctcaggtgtagaactatcattatccatcaccctcttttcagtgacatggggagcatctgtgtcaactgatgtgaatcaagttactatggaactatagcacgcactgcacaaccaaaattattcaagtgtggaaaagaaactttgtttagaaaactatcttagcataacctttcattggtaccaaccacataaattttgaaaataacaatatctataacaaggaacagttcaaatgttcaagtgtgttggcacacagtagttctctatctgaccagactaactcattcagcataaactctaatcaaactaattaactgaaaaggttccacaaagactcgcgcatagaaaagaaaataaaggtttcacatatagatgttaatgttaagttgttaagatgcatccttttcactagtctgagttagtctaactacatgggagtgggggaatgcagagataataccttttctaaaacttctcgacgattttagtcctgtagcgaccacgtcatccggagatggtgtatcaaacttgaaaggcactgtgaacatgaagatatgcagtcatattacagatttctccatcaggaagtctaataaataaatgaaacataagttcaacatatggatctcccattggaaaaacacgggtcaactgaatgcttaccctaattcaggggaagaactgaacattcataagtaggttaaaatttacactgactatcttcatatttcaaagttcaggtaaaccaaattatataaaaccctgtaaactcccaagacctgtaagctacctcccacatatgtgcttcagtttgtttgtttgcagaaggaccatggcaggctagctaagcttatagttcagacagtcacttggttttgaaacaggaaaattttacacccaaaatggtagtcacaccagatgcacaatgaggcaattgagagttaagctatgcaaatgactagcatatatagaatcatacaacattaaatatctggtttatatatagcagcaagtacatataactacaagaatttggataatgccataaattaaacaaatcaaattaccaaaagcgcttgatgtacaaatgcagtgtacctatgttaatgtggcgttctttacgggtcatgtatgtcttatgcagcgcatccacgtagctcgtgtacttcctgttgcatttctgctagctttaaagccaccagaaagaacaacgtcttttgacttggcactggatggtgagaaaagagttcttgccagtacagataccgcataatgcttgtctctccgtttagctggatgtcatgatagaaaaataaataaattaacaggctagaaaacataaatatatctaatcaaagccataagtcaacagtgcaacaaaaaactaaccataccagggaatggaacaacaaggaatacactatacctctgccatcaacttcaagggcattattgaaatacagcgagaaatatcgaagaacaccgcattgctcacatgattttttttttgcatcatttccgtgttcgcaaatggtgcattgccaaatgccaggatttcttgatggctcctgaggatcagaccggttatctaattcaggaataaactagaga

SEQ ID NO: 54971 - DNA, 1499 bp, Oryza sativa
gctattcgaatagttttactctggccagaggtgtaccactgtacccacaagacacaacctcaacatcatgtcaaccatgcatcacgatacttatcaagtacccgaatagagattgtgacaatacccttcgcataacacaattcaaagcagtgcaccgttcctggatcataatcaccccttataaaacaaggcatggactccccagcgacccccgtgggcttatctccgccacttctcagtctggtgctctacaaagaaccacactctacaaaaggtaaagccgttgcccacgctggcttgtggttggcacggttaatgtttcacaaccgaaactcgtgaaccggttcttaattgtcatgagcacgaccatcaaaaccatgtgctcacaacccaccattactatgttttagttggcatcttaattaatcaacctatcatgattaatcatcacgagctactattaagccatcattaagtaatagtgaatcattaattatcccattcatatgagctagtgtctctaagcatggctaagcatcctaattactttagctaaaaccatgtaatgttctagctaatccaattattaaccaagtgacaaagtataggtaatcaataacaaaaggctataacaaaggcaataggttattcccacccaatgacattcaaaaataaatgcaatagttgaatagaaacaataggttgaaacgggatcaacatgctcaaagggttgtttgggatctgtgtgacttgccttgctggccttgaaactcttcaaagtcttctcctgcaaaatcggactctccaagaacgtcggaatctatacataaaaaagcaaaatcaccaaaacagtacataaacaatcataaacaacacatgtggatatttttaacatatatatctcgattttacaaaaatttagagacttgaaccaactaaatctgagctaagatgaattagatatgaatttttgaagattaaaccggattaaatcatttatttagattttaattggattatgacgcaataaagaattatttttgaaaaggaaaaaggatttattgtgtcagcgggctcgggttcacggtggaccgggtgcacggaaacggtctacggaacgaaatggacggccgagatctaactgatctaccgcgggtctacgactgacgtggcgctgacgtcgacgatgacgcatcaccagcggcggctcggcaccccgtgctcatcggcgaacaacggcgtggcagcgcaaacggagggcatctacgcgtagagggtgacacggcgaactaaacgagggctcggccgacgacggacggcaaccgacggcgacggagggagttcgaccgatgtcatcttcgccgaagcatatgccaggatgtgattgcccaccgtagcccttaccccagcaccagcctcgcaccgtggtttcggcggagaagcagttcaagttctaggccaagcacaatttctggtagctttcggcacaggcgaaaaca

SEQ ID NO: 54972 - DNA, 727 bp, Oryza sativa
tttacaggaatcgtgaaaaccaagaagtgtacttaagcctttccatgtaagtgtgtactccttatggaaaaaacgaaaggaaatttcatcttctatttctttcatagtgcacagaaattgcaaagtaagcaaacgagaaccaagctcatctaccacaataaatctctgccaaccaaccgctttccaaatagaacgaaattcaacttcaatacctatctttttcagcagctccggtgagtattctcgcgtgtgagcatactcccggtcgctcagcatgtagtaggcttgtctcttccgatcactgacaaggtcgaggtcggtgtcgttcaggagtcgtcgcggagcttcggcgtcttccatcaaaacatctgctgatgaatgagtactagactcgtcatgacgacttgatgaagagccggaccccttgaacagacgagacagtcgcctcctcattctgcacaatggagcaagaacggagtaactcggcgggggttagagatgacaagaatttcacacgccggttagtttcaccaaagcaacttgtatacatgcaactaaatattttaatttgagggaaacaatcaaaacttgaatgaacttgagagcaaactttggagagggaatgaaaatgtgttgaaatggggtggagttccctctcccggctggctggcttttatagggtacccataacagtcagaaatgacatgtgggacccactagccgttac

SEQ ID NO: 54973 - DNA, 3097 bp, Oryza sativa
ataacggttcttaggcatagttgtttccttctccatgaaattctgcataaatttcaccaggctgtccattttgggtggctccacttcgacctcttggatattctgtgggttcggcccatactttattctgaccatggagtattgttccgtcctcggttgaaactcaaacttctcttccttgccgttgacgtggaacgggcgccccaggatgagcggcgtctcttttcccgtgtccatgtccagcaccacgaagtcaaccgggataaagaaatcccgtgtcttgactgacacatcctccgctatccctgccgggtaacggactgacgaatcagccagttgaaggcgcatcggtgttggtgccaacactgtgaagttgagtctatcgaagacgtctttcggcatgatgctgacactggctcccaggtcgtataaggcctggtcgaattgttgtgccccgatctagcaagtgatcgtaggacacccctgatttttcttcttctccgggagcttgtggagtatcacgttgctgcattgcttgaccacctctgttgttgggagcggtctcttgttgttgactatgtccttgagataacgggtgtatgttggtacttgcatagcatccaacaacgacacgttgatatggatcttctggattacttcaacaaaacgagcgaattgctcgtccactgacggtttcctacaccgttggggaaacggcagcaaccgtgtgtcgcagtattcctgcggcacggtcttctctggctgaacctctttgtcagccgagtcactagatggcgcttgttttgatatcccgttagttcctacagggttaggatatagcggatcacgagtggacttacatcctctcgtcgtgatcgccttgactttacctcctcacgagtcgggtcgccccagaatcctcccagtttcatttgcagggtttaaggatgccaactgagctagctgggtttctatcattttattgaagctcagctggttttgaaaagcagaagcgaagccatctaacttgacattaatgttttctaggatcttatcattggccgcaagctttttgcttaatgcatcggtggttttagcttgcgcaaaaacgagatccttcaaggagggctgttagaaaaattaccgttgttgttacctccttgataatataggcgtggttggttccacccctaacctccttgtgaacgatacccattgttgttgcccatgtacatcgcctcctcacgggtttccgggtagtcattcccagaatgacctgtgttgccgcagacctcacatgtgacgtgagagtccaaggccttgacggtgccttgtggccgtttctcgtggtcgtccaagcatttcatgaggaggtccagcttggcagcaagtaactccgactccttgacggtgtgcatgcctcgctgacgcatctgaagtcgttcctcgttccaacccatattggagaccatcttctctattagttcaacggctccttgaaccattttagagaagaaggctcctccagctgccgcgtcgaggtgatagcgggacatcggggtgagtccattgtaaaagttctgcaggatcagctagtcgtccatcccatgatgaggacaggcggccacttactcctgtagacgctcccatgcttcaagaatagactcatctcttgtctgctggaaactggaaatccttccatgaagggcattggttttgcccatcgggaagaatttcgagagaaatgccctagagcatttgtcccaggtgttgacagcagcacggttggcatagaaccactgcttcgctctctcaagaagggagaacagaaatagtcgtagcctgatggtgtcgggactgacgcccttgatggtgtacatgctacagatcttcaggaactgttgcagatgagcattggcatcctcattaggcttgccacaaaacgggctagcctgcgccatcgtgatgaggctagagttcaagtcgaaatccacgtcgcctatgttcacctgtggcccaatgaccacattgtcagcagagggagcagcgaactcgtggagagtcttgttagccatagtcttgaacgtcggtggcgctggtacggttggtttctttgtcggtagagttttctgcggagcaactacttgaggcctgacgctccggaagaaagcgtcagaaatgcttgttggtatttcttaacgacattactagaaatataatccccggcaacggcgccagaaatgcttgttggtatttcttaacgacattactagaaatataattcccagtaatggcgtagaaatacttctggtatattatggttacagagttcatccgcaagcgcacggatataccattgtagcatttcacccgagagtattccaagggtatcgtatttatttaatcccgtgagaagatcataatagagagaaccgtactaataatttatatattacttgtaataatcatagtcaaagcaggggttaatataatccaaagggtagaatgacacacaagaatgaagctactcattctcctactaaattatctaagctaagtggaaagaaaatagaaaagaatatattcctatacttctagtatacatagttgttggtgtttcttaacaacattactagaaatataattcccagcaatggcatagaaatactcctggtatattatcttttgggagatgaagtaagcacaaaggagtaacattttctttaattttcttcacatttccaccatatatcacagacacactttgcacgatcttgatcttgagtatgtttggtaatctattttagtctatgcttttgacttagtaataaatgtgaatgtaagtatgccatgtttgatcccttccaagctccacatatcaaaccttagagtaggaatcaaaaaggtaaaaaggtgaggaattcatattgatacatttggagagacatagtgaatcatttgaggaacttggatttcttttgcaaaatcatttgaaaacttccggaaaaaagttgaataaagattgggtgattagtgcgctaattgctattctgtctttcaaccgctcaaggcaaggatatgcaatgtctcgtgagaa

SEQ ID NO: 54974 - DNA, 1752 bp, Oryza sativa
ttgttaataactctgctttgatagaaatatcattttgagtaattaaggtttgctgagtgagaattacttcttgtttagttgctaattagcatacgggatcattgttcactatagtctatttatttatagtgattgctttagtgtttgatcggcactagagtagttattaattgcgtagacgcggtgtctgggtaattaatctccagtggttactgcgtatcccaaagtacgtttgaggtgggtgtagaggtggtgacagccctcaagagcacttaagtcctccctatccgggtatgtagtagagcgacatctgggaacagcgggttgccagtgcctgaagtattgcgttaggattaaacataagctttccctagacactgtttctcattaggaaatcctctttgccctctgcccacattagctttgtgtccttggatgaacctgacgaggagataaccacacacgttcccttggattcgatacccatggaatactctgtataggaagtgctacatcgttatatccgtgcgcttgcggattctatctgtgatcgtatgaaataccaacaagcatttctggcaccattgccggggaatggttgctgatcatttccgaaccctgttcatcctcgcatcctttttactttttttttaccttcacccctgctatcctagagaagtattcctgtcaaactcttctcgaccatggagcaactgctttttgagctgtctgctcctcggggcgaattctatgaaccacctccttcatcagagcccatttatacaactggctatgaaattcgtcccgaactaattagtatggttagggaaaaacctttttttggctttgatctagaaaatctctaccatcatctgcgatacttttaacaagtttgctcatgccttaagattcgtggcatgagacaagaaactgtgcggtggaaattgttcccgttctctcttcaagagagagcaaagcaatggtacacctctaccgttggatgtgtaggcggtagctgggagaagttgcgagacagattttgtcttgccttctttccagttactcgtattaccgcccttcgagtagaaattctcagttccagcatattaataaagaatcaattggtcaagcctggtccagattcactaatttagtgcagtccgaacgaaccttgtctatacccgaatatgtgcttttgcagcattttcatacgggtctagataaggagtctgcattttatatggacataactgcatgaggatctttcatgcacaaaactccgtcagaaggaaaaataattctagatcgaattctagaaaatacttccttcatgatgcaatgtgatgaaccacctccagaggcatctgtgtctaagatagaggagccatcgatagtcgaattacaacctaaaccttccacttcaaccaattcaactgacgaactagctcctgagccatcatccgttgaggacgaagaaatttggactccggatcaagctctagttttatttagggatggtttcgatgaagactacaacaacaccctgaattatttcagtaaaaagaaaccacttgttcctttgccacctcctgatcctacggcaacatccataatgagtgacgaatggctgagtaggtagagctttcatcggaagtaatttggataaataccgcccccgagtcattccatgtcatttggaaggaaacaatgtcggtattctttatagtccaactgtcggggctaatctcgttt

SEQ ID NO: 54975 - DNA, 1310 bp, Oryza sativa
atagaaaaaaaaagagagaaaaaaaatctaaaatattagatcatgatgagcctatattataacggttgaggttgattggatacctataagtattaaggttagacaaaatatagagagaaattaattctactcaaacttggtaaaaaaaattgctaccctaaaaaaaatagaaatcatgttggaatcatatccggacacccattcggacaatgtctcacacctcactaccacgtactccatgtttttttagagtacatgtttttcttaataatactataaaaaaatatttatgcattgtaacgggtgaatgttattataatcttattattgttatataatttagttaagatgaaattcaatgtggaaattcacttgggtatatactttttagaaaatcataagctgcaattaagagcctgatcatctcaagttagcatgcgagttttttaaaaatatatcttatacgactccttccgtatttccaaaagcgaacctaaaacctggctcaaatatagatttgtatttttaaaatcaaacggatttaaaaaccgactcatacattgtatgaataacgtatcaagatacactatacgcagcatcaacatatggcctcatatgtatagttatacatgtctatgaataaatatatatggtgggttgagaatatatattattagtttggttgattgatggtcgatcaatccatcaaagttggcacgtatatagcagcctgctattgcacgggcaacaatttttgaccttataaaatctgtcaatatttaatgccattatgttagctttatttttttaacgaaccgccagttagatagcgtgaagtttcattgaatatagtagtaaaaagttaaaaagaaaaaaaaaactacaccatgcactggtatcgatgtcccacacaaccgaggaatgtttgctttacaagttgaaaataggaaataatccgaattacacccctaaactatagcagcggtgtaaattaccatcttaaaccataaaacagacatcattcagtctcaactttttaaaatgcttatattttaggatggagcgagtagtaatgatattttttaaaaaactaataaattataatggcatggagcccactaaaagaaaaactccaagtctaaagcaagccggtccaaccagccgtcgacctaaccaaatttcttcctcgtaatttcttcctacgccgccaacgccatctgtccgtacgctgctgctgccgccgtcttctccctacacaacggggagccgctttcctatccccttcacgacgctgtctccctctccgtcgg

SEQ ID NO: 54976 - DNA, 1363 bp, Oryza sativa
aaacaaaacacatccgaatcccgcagcaaaacaaaactgcatttcggaatgtttccaaaacaaaacacatccgaatcccgcagcaaaacaaaactgcaaaaggaggctgcatctgcgcaagggtccctacgtggcgaggcaagtgagcgcgcgtgtttcccctcttctctccaccacacatgtttcaagtagcaaggagggcatcctcctttttaaggaggtccccctctcctagaataagcaaggtggtactaaactccacatgcatgccatcccatgaggtgggcttttgagattttccaaagaattaatcttcgaatgggccttagcccatctattaattccaacactgtatccggttttgcagtcaagatatccgaatgtaactaagactcatacttgaggtatctatagtggacattttcctttttttatctatcaggacacccaacgacccaaagcccatgcctaatttgttctgtggatagcggcctattcctaaattaacttgccagttggaatcaggcctgataggtggcccacgtctggtgacaatcaagtaaggcccattgaagagtgaaaccggagttgtcgctgatatgggccatgcctcacgggccatagcccataggcaaggagatccagttgcgtctcacacgattcacaaacatccagagcctagtgacgtgttgctagatgcaaatgccacaacagcatatgcatcagttcagttggcctcgtgcgtttttgtggcgcgtcgagacaaaacgttgagttgccgagaaggcagataaaacaagattatgttggtgccagccatgcatatgctggagcaatatgcagagtttgctaccgccaaaacacaaaaccctctttcatatgctcctactccagtatggatacaaaagaacatcgggaaatgtcattcgtgtacgggctctcatctgatcaaactcgttgcgatcgccaaaaaatctctctgactaagctgggaaactaaacagtttttatttaaaaaaattgacaaagtagattaatactatgtaatatattattttacaaatatacatattaaaattcgacttctacaacttataataaaaataataatttttatatatacgtatactagtgatttatttatacatattaatctactgtgtatattttttaatattttttataattatatagttaatacggaagaaacgggtgaatgtctattcgatatattagaatccaccttggactaatctggtatgtagctcgcctggccaccaacccgaatttactctcgctgaaaccatatgtatgcatcatccaatccagacgtcacatatcgaccaacaaactttgcaaaatt

SEQ ID NO: 54977 - DNA, 2523 bp, Oryza sativa
cggcggccggggaagccaggctggccgcctcgccgtcgccgccgcagaggaagaggtgcacgtcggccatgcacaccctgccatccacttcccccttcgtcccgtcccacacggcgacggcagcgtccggaccccggccgccgccggcctcgatctcggcgatggcatcggcgacggtggaggacggcggcagccacctcaccggcggcttgccgatgcagagatccgatacatcgtgagattgcagcaccatgcaacgatacacacgtacagcgacggctgctgctagtctctccaggatcttggaggaggaatcgagggttttagtcaaaaaagcgtagggaaaatcaaaagcgcaagaatcatctgtagctggtgaggactggagtctgagatatgcgagcggcgctaaatatatacaaggcgtcgtggcgacatcatcatcgagttaaatctctaccagcgttttcttcgcccaaacggttcagtagtagaaaacaaccgtttatctcataaatgattgaattgtttggatttatttatactaccaccaatattaaaaagtattattataaaataagtatagagggatataattgtcttgtcatagtgaataaactttatttttttctctctttttcggcttttgtatgaaatacgaattgtgctagcacacaatggatgatcataatcaatttaacccggaaaaaatataaatgcaaaataactcctaattattttattagtaaataactattttattcttaataatattggtagcataatagtaataagtggagtgcacccgctcgttttcggggatttcgttgattgagccgatcaacagaagcggttatgtatgcttaaacggtcgagacgtcggcgtcattcgtagacacgtctgttgcgttgttaagctgaagaagtagctagcctacttggacgtggcaacgatacgcatcgcccggttcccttgtgatcggtgagaaacagtaatgacgtgctagcgtgagaccgataataattagtttgtttaattacgactattaattaattaattaattagcctttttttgcgaggaattaattagtacgactaagcttaatcgatctgctgtttataactttacatcatcgtcagcatgtcaaaacagtatagttgggattgcacgtggcaagtgcatgaatttgaataataaacttcataatccatatgcttcacatacatatatacgtggtgggtgcttactactttagttgcttaccttgccagtgcgtccaacgaaagacaaattgggctagctgtgtattttttgtagtctgtacaattggattgaaacgtctaaaggtttcgtatcagcttcaggacagtaccaacccataacactagacatgatttctataaactccacatcattaagaaaatagtactagacactactctttcaatgcaaacaccactattccataacttcaatttaatgctacttatctcacatgatgtattggatattgtgtaggaaccatgtctcatgcaagacatggtttccttctctttcctcatttattcacttgtcacatcattttttttctaggtggcaactcatttaatgctatggacaccattctagtcattgggttgggaatgccctcataagttaatgggctaaatgatatagattagaagtctcaccaattctaattatttgatattagatcattctataatatttgcgtcttttttttttacaatttggttgtaggaatatacagattgcatatgacagcatgtttataataagcatgtttataatagtatacttaaccattttatattttagctaacatgtataataaattaaatataagattagctttgttttttctcctatttctttctcacactatatatgaatttaactgatcaccagctagagggcgtggttgtcatatactccctccgtttctaaatatttgacgttgttgacttttttaaatatgtttgaccgttcgttttattaaaaaaatttaagaaattattaattctttcctatcatttgattcattgttaaatatacttatatgtatacatacaattttatatatttcacaaaagtttttaaataaaacgaacaatcaaatatgtgctaaaaattcaacggtatcaaatatttagggtttgttcactttgctaccatttcaaccttatcaagttttggcattgccaaattttggtaaggttaccaaaattttagcaaggttgctaaattttggtaagactttatatgtacttactaaactttgacaataaattaaatgtagctattttttataactttatctaaaaagataaggttaaaaatggtagtaaaatgaacgatccttagaaacggaggtagtacaatctgtattatactcccttcggtttcattttaattgacgctttggacaatgacacgctctacaagatatacatttgaccttaattttctattataatatatacaataaataaatgcatgt

SEQ ID NO: 54978 - DNA, 2569 bp, Oryza sativa
tgaaagttcatctattgtttaggtgtggaaaaggagtgaagtgaagtttgaaaaaagttgaaagtttaaaaaaagagttgaaagtttgaaaaaaaagttagaagtttatgtgtgtaggaaagtttttgatgtgatgaaaagttagaagtttgtagttggtggagaggaactaaacatggccatagtacccgtttttcgattcgaaatgtgcgagtattcattggtagtgaaacggatgttcacctccaagtccagtgaccaactacctgaaaaggaccgtcactaaactagctggcccaaattcgatcgagcaggttcagttctcaccttgagtgacctttatgcctactcatcataattaaagaagacaaatgtactttaatcgacccggtaacaaacagcaataaaaagggtcgccacactctcgatcattctcttctttcttttccacgagtcgtgtcccctcaaaatggacgctagctagctagtagtagtactcatcacaattcagagtctagaaagcaaaccagtagggtttgttatcgaaattaaccttattaaaatttagtagtgtgaagggcttgcaaagttggtaatactaaaatttggtaaagtgataatggtaagagtttgtttagtttgttaccctactaaattttggtaataccaaaaaattggtagggttgagagtctttgagataactgtggatcctgcacgcaaaacaaacattgatcaatgctaactgacaccagagtgggtgaagaatgcaacaagttttgggccgcaactggctgctggccactttttgggccagaacgttagccagtcacttcaggcccattttatctgggctgaaactgtacagagacgaaaatgcggcccattatatacgtgccggataaacaggctataaatggaaggaaggcccatggaatataattgcatgggcctagaggaaccgggagttcgcaccaccactgcactcttcctttttctatctcttcatcactgcaaaagataacacaaaatcacccatcgacaaaaataaaaaatgctttacttcaattcaggtactctaacagatggacttactacgctttatttagtttgaaaactggggacttacaaagttacaccggccggtgaatggggatgacgtaacagctgttttgcaaccactcaatctaatcattcgaattaataatagcgaaatctttcgctaatacatgcactaatcatgaatggagaggaggctacacgacgacaagtaggatatttttttataatccggcagtttgcgctctcaaacaagttcataaccaccgattacgagagtgacaaatgaccgtaacaccgcaccaaccttcttctcgccgtccaagttcaaccgctctgtgcacctggaccatacggagtagtagaaatttggaatagactacaaacaattttttccaactacggcatgtggtgcacaaagtcgtattcttattaattaattataggtaggagccttggtattcaatcaagacgaaagaaatgtccacaaataggtatgttttgcagatgatttctcaagtgtacatcaacagaagttgaacataaatggattgatgcctgaatggtttttcaaacgtatcctctatttgaactagattctctgtttttttttctattattactatatatatcgtctggtgtactactactaaccaaaaacggtatataagaaaccaagtcataaattatggaccaaacttttctgtttgtgttttctgcggtttaaaagttagtgttgaataaaaaaaatcctaaatttaactcaaaaccaaagttttataatttaaattttaacaacggcttataaactgtgaggcaaatgattggaagcttttacctccctgttttcaataaggatttggaaaaacctttttaaaaaccacatctagaagaagggatatttaaaaacaatcacaaaaaagttcttaatcgttaaatcgaactatatgaggagcaggagttatacaaaaatctaaatttacttgtaccatgccacttcagcgtttgtaagatttttttttcttgaagaaaattgtacgaatcgacttttccactttcaaattcactgttcaagccgccgtgcaaaattcgtcaacacccttttttttctccaaattttctccgtctcattccctaaacccccactccccccggtcgtgggtgtatagaccaagctcacgtggccgcctcgagcgtccaaccgtgggccccacgaggtcactccacttttccccaccgccatccactcccacctcgcgcctcaacccccaccgacaggtgggccccaccttaacccgaccccacctgtcattcgaaggggtaaccacacacctacgtcgccctccacgcttgggccccacctgtcagtcagttggagctttttatctctctctctctcctgggacgcgtgcccctctctccctcctcccgctccgcgcacgcaacgaatagaagcagaagcagaagcgaagccaagaacaccgcgaagtggaagacgacgaagcgggcggc

SEQ ID NO: 54979 - DNA, 1734 bp, Oryza sativa
ttcaagtttgcatatgtcagtgacttttttttaatctaacgatttttttgttcggcttcgtttgttcatcaggtttatgtagatggaacgaccaccttgtcaactcatgaaaggaaagcgagcattagggaattctatggtaaatgctctaaaatgttgagctgagattttctttttctttttcttggttcacaattgagaggtgtttactgtctaaagtgttaacattagcctgcattgttttcagctgttatatttccctcactcatgcaactccacaagggtatcagcgatgtcgatgaccggaggcagaaggcaatctgtactgagagatacagaagaagagatgaggatgagagcaagaggcatgtttctgagattgatgtcgagagagaggaagagtgcgggatttgcatggagatgaataacaaggttgtcttgcccaactgcagccatgctatgtgcatgaagtgttaccgtcaatggtgagaatcaaatccttccatcccaaaaattgtttgtcatgttcatcactaatggttaatcgatgccgtattggtccttggtaacagtctgagatgtgtttagttcttcaattcaaagttagtttagtcaaaacacgagtaaaactctgtccagatatagtggaccattttggttctgagaggttaatagcagcacgctgttttactctgtatgaatggctctgcacaataaataagatggtgctatgctgcaacctcattaatagatctgtacctgattattacagcaagacattgcatatttttcagtcattgcagcaaggttgtcagctttgtgcttaactcttactggtctttcagagatcactttttctttgacactataatttagctcctgtgaaatcccttctatggcataaccccactaagcaaatgatcccttgcaaagggaaaaacagccttaagaacatcagttcagtttcataatttcccaaacttatgtcaatacatagctctgcaaaaactctgccaccaaagcatgtagtaccgcacgtaaatgacagtactaatgtttatgtataaaataccttaccagttacatgaacataaggaattcaaaggacatacatatcaatttatatcttcagtacatgaacttaaaaatagcttctctgctatatgaataactatgtggtcactggttacgaactctcttaagatattgctgcattctttgaaccatgtgctatccttgttgcaggcgctcaagatcccagtcctgccccttctgccgtgacagcctcaaaagagtaaattctggtgatctgtggatgctcacagatgaccgagatgtcattgacatggcaacgattactagagagaaccttaggcgcctgtttatgtacattgagaagctgcctcttgttgctccggacaacatcttctatgcctatgattctcatgtaaaataaccagagctactcataatgacctactcataattgttttcggagagtgacgcatgtcttattcattcatgcagaggatgttccttgtcgtaggatgtggctaaccccaggagcagactgaactttgacaagagaacttgtgaattctgactagatccaatgctgtggtcagatgttgtaaatgcttgtacagatttgtaatttgcagtgtaaaaaaattagtgaggaaaaaccttgtgttccacattgaactcctagtgtgaaattccaagtacatatat

SEQ ID NO: 54980 - DNA, 1787 bp, Oryza sativa
gtacatgctaaatatctctacttcatagagttggctcctggaagctcgtcggaagtcctgattacctctgcagattcaagaatccgtgttgttaatggtgatgaactcgttcacaaattaaaggtaatgcttcattcactgtacttgtgtatcctctagacgttgacggatgtagaacacctagaaggaacctggccgatttaaagtagtaagtaacccaaattcaagtgattcatactttggaaaacccccacatcccacctatttacctcagttcctaacatgttcacagatcaaatcataggttccatttccccaatttcccccgatgggtgtgtttagttcacgccaaaattggaagtttgattgaaattggaacgatgtgacggaaaagttggaagtttgtgtgtgtaggaaagttttgatgtgatggaaaagttgggaactaaaccaggccctaatcacaagaactgtgcacttgattggtgcattagctcactcagtaggccagtatttatactgtttcacttacattttatttgatcttttcaccagggttccgaaatacaagtagccaaatatccgcttctgtagctccaaacgggaaatatgtggtctgtgccagtgaggactcccacgtgtatgtctggaggcatgacaatacttcccatccgagcagaagcaggagtgcagttgatgtaaccaactcatatgagcatttccattgccatgatgtcactgtggctatcacatggcccggcgctgaatcccgtggctcattcgggtcccgtagcagcagaaacagtgattcagacgatgcagtgatgaacacgggtcgggatgcccctgtagagaacagtgagcatgatctgaatggcactgtcaatagatgcaccaagcgcccagtttgtgaaggtgttgcaagcacaagcaatcctccagcggatggagtatcaacgtcctggcctgacgagaaacaatcgtctgccaagagcagtcctggtcactgctcatccgacctttgcattggagctttggatgttcagcgccggtcagcttggggattggtgattgtcactgcaggaaggggtggtgaaattagggtgttccagaatttcggcttcccggttcaagtgtaaagctagtgtgagaatattcagagatgtccgtttgtttactgtatagatatcgttagttttttctccatttcacctagttcttttactagctaaaagatttccctgtttcgctgtcaggttgggagccccagtagctcaatccaacttgctaagcaccacactattttttaccctctgttgatacaaggctttgtgtaattgtatggttaacaaccaatacatcgatttgtttgttcatatattgtttcttggttatacactgattgatatatgaagataatttctaactccatgataatccattgtgcaatcttccctcccagtatggcttttattgaactacactgttcagcattctacagttcatttaattactaggagcacatgctagaatcttgatggcaacaaactcttattattgtcattaacactgcacatacgtaaacacatcttccagctacagatcacgattcactgatcccaatgataatcaccacatcattgtgcaagcgtatgaaattggtgagagaagaaaactgcaaacaccacgttggataattgagctgcttaattacattcccaataattatatcataatccctagctcagcaaaatatacttcataccgatcgaagaacacactacctg

SEQ ID NO: 54981 - DNA, 1605 bp, Oryza sativa
tttttttcgtgaacacgcaaaaaagattacacgtagtatattagaataaaaaaattgtagttacacaacacaatcagtcagaccgacttatgccagagaacggctaaacacaaactctagaaagtagaaagagcgagccacgctacattctcaacaaatctccagaaacagcaacactagctaaaaaccacgtatatccctacacacttccacagctaatatgcaactgcatctgcaagtgtaattaagtatgtaaccgagtaattaactgacctggtgcggcggcgaggcgtcggaatcggccgggcgcttgttggaggcggtggcggcggcggcggagagcacgagtgacggggaggaggcaaccgcaggagccatttggtcggttgcagcagcagaagggcatgccgcgcgcggtcagactgctggccttaataacctcgcgctatctacaatctctgccgcttaatctgcagtttctgtgggcgcgtgatctcgatcgtctctctcgggagaaggaagaagctaaagctagcaagcagccggctatttgtagcaagatcctagtacgagacgacgacgaggaggctggggtatacgtagacagagacgtagcagtcagtccgacctggagggcggcaaagcaattatgcctgagcagttggtgatgtgttggttttcgtcgtggaccggctaggctaggcgagcgagcttggcatagctgctatatatagacggaggcgcgaggaaggaaggaatggaaggtggcgggcggccgccggtggagcccgcgcctgacgcagcgagatatactctccttgtgcgttaagctttcctcaacttgtaccacctcgctaagctagctagccctgtacacacggttcgcgatgcgtgcctcttgcctctggccacacgagcagagcaacgcaccgcaccagacgtacatgcgttcagggatgaaaacggtcggaaggatagcatttctactcaacaattgactgagtatgtttagtttgtgaaaagaaaatttttaggtatcacatcagatatttgaccggatgttggaaggatttttcggacacgaatgaaaaaattaatttcagaactcgcttgaaaaccgcaagacgaatcttttgagcctaattaatccgtcattagtatatgtgggttactgtagcacttacagctaatcatggacttattagactcaaaagattcgtctcgcgatttttctcctaattgtgcaattagttttttcatttatccatatttaatgttttatgcatgtgtccaaagattcgatgtgatgtttttagaaaaaaaaattggagaactaaacggggcctgagtgcgtagcactctttttttctactaatatattggcatgcaattcttttgcgcgttcgaaaaaaaactcaacaattctcggtcagttgaaaattttcatatccgatttagctatgggaccaactatacatttgtcgacaaattttctactaaaaatttgacagatgtaattatagtacaatcgtaatgtaattacactgtaacttgtatgtaattacactgtaacttgtatgtaactacagtgtaacttgtatgtaa

SEQ ID NO: 54982 - DNA, 5224 bp, Oryza sativa
aactacagtgtaacttgtatgtaagtttcacgtaattgtgaatcgttagatctgttacaagatttgttctagtgaggaagaaaaaaatcacagcacacacatatgtgaaaggatttgttcccacgacctctattttactgaaataacatgttatcgagagattcttcgaagttacattataggtacagtgtaattacactacgattgtactgtaattacatgcaagttacactacaattgtactgtaattacatctgacaaatattagggggagaaatttgatgataaatatctagcaaaatcgtttagctattggttagcgcaatacgacactaaaaaaaactggagaaaaaaacagaatttacacatagctagaacaaaacgataaagaaaacgttacagtactacttttaacttaacgagatacacgattggtggggattttgatcgtctatcattttcacccgagcaatctacatgtactactaggtaccaacaaaccagtctaccagcatgcatgcatgctcctagtgtacgaagtacgtggaccgtggacgtactgctcctgcctctagtagtcatgcagaatacagtgtaaatcgtacagtgatcttggccactgggattggctggcgtggatccatcccggctggatgaccagccagctcgatcggtcagcagcacactatacggtgggcacgcccgtgtcacgcattcctgcgtctgcgtgcgtggcagccagccaggttcgctcatctcctactacggccctgttcgaatctccaactaaagctggataaatttttagataaaagtaatacttttcaaactgctaaacggtgcgtttcgtgtaaaaactttttacatgaaagttgttctaaaatattagattaaaccattttttaagtttataataattacaacttaattaatcacacattattatcatctcgttttatataaaaacacttaatttacatcttaatcctcatgttcggcaggttctagcgctcgctcgatcgatcgatcgatctctcggcgcaatggatggatggatggggacgcgggcggaggaggaggacgggtgtgcgtggctgggttggcgggcggtggagttggggaaaaaggacggatgcgggtgtggggtcttggtcggtggcggcttttccacgggacgggccccgcctccgcgaaatattgcgctgtcaccgtcgccccccgccttgcattgcttctcctactctcgaatcgaatcgaatgcgttgctcgctcgctcgcttctctgcagtgcagtgcagtgcagcgcgtcggctgctggccccagctcgggctgcccgctgctcgccgcgcggggcacacgcgcaccgcgacctgtcggccgacgcagccacggtgcgtgcatacgtgcagtgcatctcgtcggatcggcgcatgcatccgtggtttggtttgtcatcagcgcgctgccgccctgtagctcgtgaaaagcagtaaattggaatctgaattctctgcggctgggatttctgaccgggtgggttgatcaattatcggcaaccatgaagcgactaaacttggaaaataattaacctgtcaacaccccgtcaactgatatgagtctactttgatacttcggccgccgtatgtagcccatagtaaattactagaggatgttagtttcaaattagaatcttattttttttttggcttggtttgtttactgagagcgcggtttctccatacgagcccgaacaattggactgatatataattgtgttttttatcctgtgattgccatcgcctattgtgaatgctgcttattcgtgtgaacgtaacgatgtcgttatgcgagagacacgcatcacgctctcccttgtatgacgctcggcccgcgaaacaaggtggtgcgtgagcgtgcgcgtgcggctgatattttttatttaagttcttatgacttaattcattacatactgaaggctcttcaaacatacttcctccgttttacaatctaagtcattccagtatttttagattcattaacatcaatataaatatgaaaaatactaaaataatttacattgtgtaacggatgaagcaacttactctctccgtccaaaaaaagacaaactctggtttccgtgcccaacgtttgaccgtccgtcttatttgaaaaaattataaaaaaaattaaaaagacaagtcacgcataaaatattaatcatgttttatcatttaacaagaataaaaatacgaattataaaaaaattttatataagacggacagtcaaagttgaacatggaaacccagggtttgccttttcttgggacggagggagtatatcttttatattttttgaaaaataaatataataaatggttaaacatttataaaaaatttaacaacgatatatacaatatatttaaaatagaaagataaatatatatatttagaatagaaagatagtacttgtgtcaatacagaacatagacggcacgcactagctttcggtggatatagagtacgcacaacgtgctctgcctggctgccttgtctgtcgtttgccgatgcctgaccaccataccatgcccgcgcgtgcgccttgactcgagcgccgtggagccttccaattctactggccacgaatgcacatagtccgatcccaattacatcagttaggattagcacatgtcatgcacacaccaacccaacaatgttcagaacttgctcgatcatctagcttttattcctcgatcgctagctaaaagttcacaagttgctgggaacggaattgtattctagtagcttcgagcattgctgacccccgagaagtcagtcagagcttaatcatagatcatcagctagcaattagtaatatgctcctacgggagattgaacagcgttttttttggtagcacctgtcactcttacacacaatatactccaataattaacacttgggtgttgcttcagaaaccatcaacatttttaaaatccggtgtcctaccgaccaatgttaccggcgacggcgacgcccagctgatggatcgatcggaatcgcggccgcatgctagctacagtagctaccagctcgatcgatcagctgtaatatattctgaattaataattatcatatgaacaactcgcaagcttctgcatctgcatgcgtctagttaaacattttaagctgaaccctggtctattgttcgtggacacacgcatcctacctctctcgaccaagcacgcctcttcgcccatcatctcaatttaattagcgctacaatacattactatagtacacaggatctcgcatgtatatgattagttggatcaggtcattttggtcaaacgataaggacgagtgtgctggtcgatgtccatcatcagcagataatcacattagtatgagcgtacgacggtctataatatcatatagtaaattatgtcatgcttgctaagattgatgtgaatgaaaaatgtcatatactgatgtaggtaagttggactttccagcgagatcctgatggagaaggaagctaaaataggcaccgtctgattaggacgataacgaccagagggcaactcgtcatgcatcttggttgaatctctgggttgaatggcctcatgggcaattgggctttatttgttgtgggtaattagcccaggtttttgtggcctgcatgaggaagtgatggggcccatagcaatgggcctcctggaaatgaaacgtattgggcttaattagaagatttgcttcattttgttcattttgtctctcaggtgttcattttgttcgccgagagacagcttctggatcgaatagccttatcatttttgcttatgcttatatttgtaagctaaaatttaaatttaaatttttaatttgatatgattttatgatttttcatcgtatttttattttatggcgtttgcttttaaattgctatagacacatgtataaatttttacttataatatatactatttggttgttaataaactatgcggataagcataaccaaaaagacaatgcactattccgcacaaccgcatcaagtacttgctaggccttgcatgattgagttggtcgcagctgcagcgcaacacaaatgcaacagcgataaccatcagcaaaaactctcttgtgtttgcagttgtgaccaagtaagctgagcatgcccttaacttcacctagaaaaaagtatacttggcttaactgctagtaagacatttcagaactgagactggtgtacgcatttcatgcaagccattaccactttacctgacattttggacagagattagaaatagtttcgtactacctgcaagttgcaacttgaaaagtgaaatttgttccttgctaatatattgacgtgtaattcttttatgcgttagcgtaaaaagttgaaatttgggtcaagttactggtcagattaaccagtaactggttaaagttgaaagatggtcttttagtaatggagggagtactacactatcctcagctgatttaaatcttattccgtcggtggtgatttcgtcaatctcccaacttagtttttcaatatatttataggatagagtgtgcatatgtgtgtttatagggatgagtctacgcgccttatgaacacctacttttgtactgtatttgtcaatgaaaagaaaatcttaccaatgctgcgatgctgacaccaagaagaggcgatgaaaagtgcaacggatatcgtgccacgtcggttgccaagtcagcacagacccaatgggcctttcctacgtgtctcggccacagccagtcgtttaccgcacgttcacatgggcacgaactcgcgtcatcttcccacgcaaaacgacagatctgccctatctggtcccacccatcagtggcccacacctcccatgctgcattatttgcgactcccatcccgtcctccacgcccaaacaccgcacacgggtcgcgatagccacgacccaatcacacaacgccacgtcaccatatgttacgggcagccatgcgcagaagatcccgcgacgtcgctgtcccccgtgtcggttacgaaaaaatatcccaccacgtgtcgctttcacaggacaatatctcgaaggaaaaaaatcgtagcggaaaatccgaggcacgagctgcgattggctgggaggcgtccagcgtggtggggggcccacccccttatccttagcccgtggcgctcctcgctcctcgggtccgtgtataa

SEQ ID NO: 54983 - DNA, 2525 bp, Oryza sativa
attcctgcagcccattgttgaattctgtcaaaaatggatttatttgtgtgaagtttgtgcattttgaacaagtttttgattggattatgtgtgacgactgatcagggtaacttgagcgcggtggtgaaggagccggggttccttagcgtgagccagaaggccaagaagccgtcgctggtggtgagggcggtggcgacgccggcggcgccggtggcgagccccggcgcgggcacgtcgaaggcggacgggaagaagacgctgcggcagggggtggtggtgatcaccggcgcgtcgtcggggctcgggctcgcggcggcgaaggcgctggcggagacggggaagtggcacgtggtgatggcgtgccgcgacttcctgaaggcggcgacggcggcgaaggcggcggggatggcggcggggagctacaccgtcatgcacctggacctcgcctccctcgacagcgtccgccagttcgtggacaacttccggcgctccggcatgccgctcgacgcgctggtgtgcaacgccgccatctaccggccgacggcgcggcagccgacgttcaccgccgacgggtacgagatgagcgtcggggtgaaccacctgggccacttcctcctcgcccgcctcatgctcgacgacctcaagaaatccgactacccgtcgcggcggctcatcatcctcggctccatcaccggcaacaccaacaccctcgccggcaacgtccctcccaaggccgggctaggcgacctccgggggctcgccggcgggctccgcgggcagaacgggtcggcgatgatcgacggcgcggagagcttcgacggcgcaaggcgtacaaggacagcaagatctgtaacatgctgacgatgcaggagttccaccggagattccacgaggagaccgggatcacgttcgcgtcgctgtacccggggtgcatcgcgacgacgggcttgttccgcgagcacatcccgctgttccggctgctgttcccgccgttccagcggttcgtgacgaaggggttcgtgtcggaggcggagtccgggaagcggctggcgcaggtggtgggcgacccgagcctgaccaagtccggcgtgtactggagctggaacaaggactcggcgtcgttcgagaaccagctctcgcaggaggccagcgacccggagaaggccaggaagctctgggacctcagcgagaagctcgtcggcctcgtctgagtttattatttacccattcgtttcaactgttaatttcttcggggtttagggggtttcagctttcagtgagagaggcctgtcaagtgatgtacaattagtaatttttttttacccgacaaatcatgcaataaaaccacaggcttacattatcgatttgtccacctaaattaagtaattaaccacttgtttaggggagccaaaataaaccttaccaaattttggcaatttgataatattgtcaagttttgacatgatttattttatatttaccaaagtttggttaaaaaactaaatgaatgcgtatctttgttaactttacttaagaaaatagtatggtttgaaatgacattaatacgatccttaattaatccatacgaaaattagaaacaggatggtgggctccaggccggatgcaaggcccagtacccaatccaaccggcccgtttcttcatttaaatgggccgaccagcactggcccattaagccacttctcacgccatgagcgctgtcacaccgtattcgtcgccggaagtcgtcgacgtcgaggggacgaggagcccaccggcgagcggtggcgccacgggggaggaaggcggcgagctgggcgtcggcgagaactcgaggagaccgacgagaggccagtccaccaccgcgcagccacacaggcacggggaagagtggcgcgcgcggccgccggagaaggctatggcgtggatctggatgctcatggcggcgggggccgtgctcctgtgggcggtttctctggggcgggtgctctcctcctcctcgccggcgtgtctgcctgccaactccaccttcctctcccctcctcgcggcgacaggatgagccggaatgtcctcctcgttctcgcccaccccgacgacgaatccatgtactgcttcttcctcctcatgtctcttatcgtttgcgagcctcgctgtgtaaatcgtggggctacagttccagtaaccgctaacaatgaagcttaataggctaactcctgtgcacggtacctgctcgatgaaattcctgaacaagtgaacagtttttttttttttgagctaagggagcattctccctccatttccatttaacagaaatgaaacaaagttcttacaaaagcaggatgattacagaaatgaaactaagtgaacagctgaactttttattattttgtggaactgtttaggggaaatcttgtttatagtatttgttttggttgattctgattgattgtcatgttgctgatacaggttttttgctccgactattcttttcctcaagtcaaaaggtcacagcattcatatcttgtg

SEQ ID NO: 54984 - DNA, 3482 bp, Oryza sativa
gcttcgagctttactgttctgaacaactttaaaaataaaaaatatagtgaagaaacaggagcatcaagtgcgcctatctgtattatatgccatttaaaactgtattagttaatctgttccaaatctcagtgcggtgttgctgcaaacaggtacccaggttgagtacatcatatgattgtgcaagtgaaatgcctttttcgtcctgattttctagacctcaaaatatggaaattttgcattttgttcattccgattcccctatttactcctgcaatatttgttgtcattttagattgttgccttcgattcccgaggagtatcaggccatccaaatcattgcgatgttcatcatggaatctggttagttcaactttgttgtttagcatttttagaataacaactgtttgagtttgatgccctcttgtaagaaaaattttctggtactgatgtattttatattgttagcttgtccgcacaagcttctataatatctacatagttgttaagttacatatcttgtcaagtcacaacatgttctgccgaaagaaagtgtattacctaacttcaacataactgtggcctcccctttcccatcaccacacccctttgtaagggttctctctttctctcccatgatctcatccctttcatgcatatataatataagttgttttggggtcacactttaattgaacagtttggctaattcatgtatgtcatgactatggcctgtagctcttggttggtgatgtgcacttattccatctatttaatgccggatttgcttacatttctttcacttatgacagtctagattacacatatgtagcatatttctgcagggtgtttctagcatttttctttggagtcttaataaatctatttttctatgaacagcaagcttctgcgtgacaacgggcaaggacacattgaagcatgggagcttgtaaaattcttccctgatatcctagctttattttcttcacgttgccatatactctacttattccagagtctaaaagagcctgtgcattgctttcttgaatttatgaattgcgtgcttaaatgcattgatatcatcattttcgttggaagtaaagacagaaaacaataacactacacatgccttctctgcatagatttgaattgcttgatgtgtctatctcatttgatggctaatttctatgatttttattggcactaggctagttaacctctaaacaattccctgtgaatacattaatttgaagaagctaacctggattatgcctgtttatttggataggtaagcttgaacatttttcgcaagtacagtggtccagttgacatttggctatcttccaccctctcctcaagctcaaaacaaccaacttatactcttgttaataatagcccttccagaagctttgaggcaatggcttcacacaaaagccagtgggtttggtaagttgaaaattttgttttcactacttaaatgttgtctacttctaggaagtactatatatattgtgtggttcaaaattatcacttaaaaagaagtttctaccttgcaatatagacgtagtacctcataagaatcatccctttgacacccaaaaaaagtcatggccaacatatacaatctcaattgtttctttgactactgtaagactggttgtttgtatttttgagaactcattgttagacttgttttttgtgtgatactgcatgatgggaaagaaatgaagcatttaaggggctcaaaattctcaaaacttgtgtgttttacaatatattcaggaaactgacattttgcttgtgtttataggttcaggagattgtttgtcctattctcaagctacacatacataaatgtgctccaaaaaatttgaagtttgttgtcgtgccaaagcaagcaccttccggctcagattgtcaaatgcctgtacatgcagagtgccagagtgtaagcgggaagcttctctgaagaaagacaacaatgttgacattggatcaggaattcgaaagatactgaaatgtgatgatgaaatgcaacagtttaggaacctttgtgattatatgccctttatacttgtgttgtaggccatcgattgtgttcatagagttagattggacctctgtatcctcagctagtttctcttgcttgaagagttattgccgttgttggacgatcaatctatattgcagtgttacacaaggtaactgatgaactgatattactatgctgtcgctcaagctgtattcaagccagacaattttgtcttctttttgagctttatggacttgattgctaactactacaattgtagattgagaatttgagttttgatcaagaagagcggtaccattttactcctgaaagatataagctactcctccgtagcattttttttcctgtgaaactaatgcctttgcaaacgagacctacctttttgtgccggcaggagtacacaatctcgggccctgtgatttagatgactgattggatttttgtcacagattatctacttacttaattatagagataaattaagacttctataacaagtggtctaagcaatgcatagaagatttttttttttgaagtgtgaagtaaataatctgtttcaataatccggtgagtaatacgtaatatcaaaagaacagaggccggcgtgcaaggttgttcagaaccatctgttcatccatgaagtgcaagtactgcccagcccaatgccccaagagcccacagtacccttgtcagaaatcacgagtagtacaagggcttgaacacaaaatgacccatttgaaaattcgacctcctccgctttggcgttgaacagcaaatcgcgtgtcaaaactcaaaagcggacagaattagaaacttataaaatctctctcgctgcctccacttcttcttcctcctcctcctcctcagatccagcaatccgcgataccaccattagtaccattcgaagcgccgccctctactcgccggagaggaggaagacggagcaaagggagcgcatcagataagcagaaggcatggggctccccggcgccgagccgccggcggccagcggcggcggcctccctggattcttcggcggcaagagcaagtacgtccgcatggacgacgtgctgccgcaggagcaggaggaggacggcgtcggcggcggaggcggaggcgtccgcgtccgccggagccacagcagcaggcgctacgtcttcgcctgctctgtcttcgcctccctcaactccgtcctcctcggctacggtaactaatctcctccgtttccacatgaatctctctcgcacgtatatgtgttcgtgttggctgaatcgatggagaatttcgatacgcgtgcttggatcttggcaagttcttggtgatcctgcacaaggagtaggaaatgttttggccaatcgcgttgactatttcttcttcattagtcttcggtctttgatggcgactctccagcttattccatgtctgttacctt

SEQ ID NO: 54985 - DNA, 4487 bp, Oryza sativa
atgctaatttcagtcaacggcagctagctcgtagtagctttttttttttcgacagcattttagcaacacactaaaaatttgactagaactaactttttcttttaagataatggaattgatttcattaagatgaaattgcacccgggcaaaaattaagtttaagataattacacacaaaatgcatatataattcaatttctgtgtggtaataaaccttttgttcccagatgttggtgtgatgagcggctgcattctcttcatccagagagacctccacatcaatgaagtgcagcaagaagtgctcgtcgggtgcctcagcttcatctccctcctcggcagcctcgccggcggaaggacgtcggacgccgtcggccggaaatggacgatcggcctcgccgccatcgtgttccaggccggcgcggccgtcatgacgctcgccccgtcgttcgaggtgctcatggtcgggaggctgctggccggcgtcggcatcgggttcggcgtcatgatcgcgccggtgtacatcgccgagatctccccggcggcgtcgcggggctccttcacctccttcccggagatcttcatcaacctcggcatcctcctcgggtacatctccaactacgccttctccggcctcccggaccacgtcagctggcgcgtcatgctcgccgtcggcatcctcccgtcggtgtccatcgcctttgcactgctggtgatcccagagtcgccgcggtggctggtcatgaagaacagggccgacgaggcgcgcgaggtgcttctcaaggtcaccgacagcgaggacgaggcgaaggagaggcttgccgagatcgaggccgccgccgccgtcgcgagcgccggcaagtacggcgacaagacggtgtggcaggagctgacgaggccgtctccggtgatccggcggatgctcatcaccgggctaggcatccagtgcttccagcagatcaccggcatcgacgcgctcgtctactacagcccgacgatattccgggacgccgggatcaccaccgagagccagctcctcgtcgccaccgtcgccgtcgggttcttcaagacggcgttcatcgcgcttgccatcgtgctcatcgaccgcgtcgggaggaagccgctgctgtacgtcagcacggtcggcatgacggcctgcctcgtcgtgctcgcggcgacgctcgccgcgctcgcgcacgggtcggcgtccaggagcgctggcatcgccgtcgccatcctgaccgtgtgcggcgacgtcgcgttcttctccgtcgggatagggcccatctgctgggtgatgagctcggagatcttcccgctccggctgcggtctcaggcggcggcgctcggcgcggtgatgaacagggtgaccagcggcgccgtggccatgtccttcctgtccgtctgccgcgccatctcggttgccggcgccttctccgtcttcgccgtcatatccgccctgtccgtcgtgttcgtctaccggtacgtgccggagacgagcggcaagacgctggaagagatcgagctgctcttcggcggcggcggcggcgacggcgaggcggcgcggggagaggtggagctcggtgacggcgagcacctggtgcacaagggatgaggatcttgagttattgaccaaatggatcaatgtgaacttggccatttttttaggtgggttttaacagtattactagatactggtgttgcggtgaatgcaaattgcaaaccaaattgttttgttttagagcactaataggaaagaaaatatctcatactcttttccaacttcagaatcctctgtagcatcaacgaatcatacagtgtaaatgttggtgccactgtgccagtcaatcagtcacagttggtaatgctagtaagctacacttgcacatccatgaaaccattacagtgaatgtaaatagattctgaactgaattattcaaattcattgaaaaagagcgaatttccagtgagttatatgatattttagcaaatagaagaaattttatgccaaatggaagtttgacatctaaccacatggtataagagcaattatctcgagtgaatattcagaacaaggtgatacctcaagtttaatactctgcaattcagcaattgtgcaagttcatgccaaaatgactgaccacagctccaaaatttcactctaagccttactactgaatacacaataacacaaccatgaaaatgtgggcagattcctgatacaaattttgacaatttgactttttgcaaaaactatttttacaaatgaaccgctgccaaaacttatttcaaatctgacccttttgctcaatgccaaatcatgtggcgctgaacttagacatctcagcgccacgttagctggcgctgaatgcggtgccacgacggatgggagactaagtcagcgtgccaacgtacattcagcgtcatgctatttggcgctgaggtgtctaattcaacgctacacaatttggcgttgagcaaaagagtcagatttgaaataagttttggcaacgattcatttgtaaaaatagtttttgcaaagagtcaaattgtcaaaatttgtggattcctgactccaactcttttaagctgaacaggtagtcatcaggttaccaaacatataaaaacgcctcattagtcttaaacaaatggttccctccttgtttcttcctcctcctacagtctcctccttcctccagatccaattgctagtccttttcccattcacaagccacattcttggagcttgcaagaggagagaagaggatgagccaaccatagccagagcacagcacaagaaagacggtgagaatggggcttcgtgccaccgaggcggcgacgggcaacggcggcggcatgaggagccttccggatttcttggggaggaagagcaagtacgtgcgcatggacgacgtgctcccggatgagcagggagatggcggcggcggcggcggcgtcgttcgtgtccgcggcggcggcggcagcgggagatacgtctttgcctgctctgtcttcgcctccctcaaccatgtcctgctcggctacggtgagcccctctcctgaatttgactgttcttgattcagatttggttgtattacacataatcaggggtttattttctgattaaagcaagatttgcagctagtaaaatatggggattgtatgtcatgttaatatgcttttagaagatgaagtgtttgaaaagttatcatcactgacagcccactctgcttcagattcagatgaaatgtaaattttgaccggtaatttggttcagatacttgttatggttgttaatctttatctgagtctctctctcagacagccattgacattgtttgtctcgtgaacaatcgatcaaactttcaaatggatgaaatatctttgcacaaattgtcaaatcctgtgttacatcgtggctgttaattttcagatgttggtgtgatgagtggctgcatcatattcatccagaaggacctccacatcagtgaagtgcagcaagaagtgctcgtcgggtgcctcagcttcatctccctcctcggcagcctcgccgccgggaggacgtccgacgccgtcggccggaaatggaccatcgggctcgccgctgccgtgttccaggccggcgcggccgtcatgacgctcgcgccgtccttcgccgtgctcatgatgggccggctgctggccggcatcggcatcgggatcgggatcatggtggcgccggtgtacatatcggagatcacgccggccacgctgcgggggtcgtacgcctcgttcccggagatcttcatcagcctcggcatcctcctcggctacgtctccaacctcgccttctccggtctccccgaccacatcaactggcgagtcatgctcgccgccggcatcgtcccttccatctccgtcgcgttcgtgctgctggtgatcccggagtcgccgcggtggctcgtcatgcagggccgggccgccgaggcgcgcgcggtgcttctcaaggtcaccgatggcgaggacgaggcgcaggagaggctcgccgagatcgaggaggcggcgcgcgtcacggccaccggcaacggcaaggccgtgtggcgcgagctcctgaggccgtcgccggtgatccgccgcatgctggtgaccggcatcggcgtgcagctcttccagcagatcaccggcatcgacgcgctggtctactacagcccgacgatattccgggacgccggcatcaccaccgagagccagctgctcgccgccaccgtcggcgtggggctctccaagacggtgttcatcgtgatcgccatcgtcctcgtcgaccgcgtcgggcggaagccgctgctgtacgtcagcacggccgggatcaccgcgtgcctggccgcgctcgccgcgtcgctctccctgctcgcgcacggcgcgctgccgcgggcggcggcgatcggggcggccatcctgacggtgtgcggcttcgtggcgttcttctcggtggggatcgggccgatcaaca

SEQ ID NO: 54986 - DNA, 4390 bp, Oryza sativa
gatcacaacaggccttggaatgagatggaactacctcgcaacgcaaaagatgtacaactattctaggcttgcactgaaattgttattggaaacgaaaagaaaatcctattctggaaagacaactggctacaaggaatgtgccctaaagatatggccccaaacctctttcaacttgcaagaaggaagaacaaaaatttaataactgaacttgatcacaaccattgggtctactcattcagagaaattgacaatggtgaagtaatccaagagcttgtgcatctcggcagccttcttactcaaacacaactaacgtcagaaaatgaagactacataatctagaagagaaatagcaaaggtatatattcagcccaaagtgcatatcaattccaattcattacctgtcaacatgatcagaccttcaaagccaactggagagcccaggcattacccaagcaaaggttcttcggctggctcatcctgcacaaaagagctctaacagctgaaaatctgctaatccaccattgggaatgtgattggatatatcccctttgtagaagcgcctgtgaagacactgaccatctttttagggagtgtgatttcattagaaccacttggagcctagtggcggtagctcagggcatgcaaactgcgataaattcaaactccaccgctgaatggatgatggctttagctcatggaaccaataaggctgaatcaaaacgaagagtgggaattctgatcaaaacctggtgacacgtttggctacaaataaatgctaaggtcttcaagcaacaagagccatatgcacaacaagcggcccagcagatcggggaagacattcaagaaaatgagtttgtttttcagcctccttgatgaagtctgctctactgctttctttctttctctattgcagtctacctcctatcgtttgtctgctttctttttgcttgctgaaagttgttccgttacgtctctaataatacgctcctaagcgatttgtaactcatactccctccggattgataataccttgtcgttttggacaaggacatggtctctaaaaaaacaactttgatcattatttaaattgttaacaaatatatgatcatattaaagtattttttaagactaatctatacatgtagtcatcatatttgaaagacaaatattttaaaaatgattcataatcaaagattgtaaagtttgacttcacccttgtccaaaacgacaagtattatcagctcggagggagtagtaaatttcaccttaattaaactatataacaataataaaattaaaatagccttcacccgttgtaacacacggacatcttttccagtaaaaagaaaaaaagggaaaaataattctccgtattgggcctaacgtatatgaggcccatgctctctagtagcacctaaaattaagcccaaaagggaccgatcagttctattacgaacggattagcgaccattaattaagagagcgcgtgacggattaagcgaagcgaaccacgcaaataatactacacacgcgcgtcacggacaccacccagtcccctccccacaccacgcgccgcccaaaacctccgccgcgtttcgcaccaccaccaccgccgccgaccatggcctccttcttcgccgacgacggcgccgacgagctcccccgcaccgcctcccaccccttcgacgccgacgacgacgccgcgcccgatgcatcaggaggcgccgccgccgacgacaccggatacggcggctacgcctccttcgtcgacggcggcgtagaggatgtggaggaggaggaggaggagatcgccgtggagtccgagggggtcccgatcggccacgtctccggagggttctcgccctcgcccttctcccccgacccggagctggacggcggcgacggccctatcctcccgccgccggcccagatgggggcggaggaggggatcctcctccgcgagtggcgcaggtgagcaccgcatctgatctgtccgggcctttgccgtttcggctactgcttgcttgctttcgctggtgctagggttccgacgcatcgagcgagatctaacgcttagatctgatatttcgcctaattttcagctaggtggggcggaatagagtttgtagtgaggctgtattatcgtattatatgtcgattttagttaggatgaaacttgaacttgttgtttaggaattgcagtgattgattaggctgaggcttcaactggttctgaattcttagctagtggtactgaatttagttagtgcaattgaatctggtttggcaggagctgttgttaaatgcctttgcttgtgaggaaagtttgttagctctggtactggtatatgtacaaaataatcgctagttagcttctactcatagaacaacaagatgcttgatcagtgttgcacacactccaaaggggaattgatgtctttgcatgtgcattaaaaggctcatgtttcttgtttagtgaagttaaaacactttaagtacttgaaccattcttctctatcatcatggtgtggaaatgagcataaggccaatctcattttgcaattcacccatggtctgttacatgtttcaactttcaagataagcctcaggcttaagcaataatgcagtacacgtaacagttttctgagttaatgagcaaatgcttagtttatcttgagctatcttacatgtttcttggtgaatggtgatattaatcctaggtcttaccatgatgatggttcgcacccttactccttttgatgcttgtcttaggatgctttaattgatcttaaaatcagcttgatttgccagaacataaatcaccatttttagtgctatgccacatgggcatggaacgtgctcggcaaaggtgtgtgccaacaggagcaaactggctacttgtttgtgcttctgaaatttgcattttgtctgtcatgatcttatattctgcacttgcacgctcttctgcacctgtcaaatttttagtagtttcatgtatatccattctcagctcaaattttgtaaggtggtaatgttagcagttttactaccagtggtatgtgtttttgtgcctaatttatcctgtgcttggtataatctggtcattacaattgcaacagtatattttgcattagtatatagcgcaggtgagccacatctgatctgtttcggctatgccatttctgctattgtttgtttgcttccgtgggagctagggttccaccccttcaagcgagatccaacgcttagatctgctatcttccctaattttcagctagggagggcgtcatacagttgtagtgaaattgtcgttaaggaaatggcaagtgatcgattagtttgaaggtacaaccaattctgatctggttctcatgcccctgcagtatcgttcttcaagagctgctgtttaactgcctttgcttgtgaggaaagttttctagctctggtatacgtacaaaataatcattacttaacttttaccgatggaacaacaaggtgcttgattcattatgcgcacactccaaaggggggctgatgtctttccatgtgcaataaaaggcttatgttgatttgtttagtgaagaaaacctaagtacatgcaccgatttcttttttcagcctggcatggaaattagtgtgaggccagtgtcattttacaatacatgtatggtctattacatgtttcaactctcaagataagcctaaagcttaagcagcactgcagtaggctaacagttttgtgatttatgatcacaggcttgtaaggctagtttgtcttgagctacattatctgttttcttccagttggatatcttggtgaatcctaatatttatccagaacttactcctttggatatttatgtcctctaatgtatcagatgctttatgtgatcttaaaatgagtttgtagtgccagaacataagtcactgcttttagcgctatggttggccaaaggtgtatgccagcatgagcaagctgtctacttgtttgtgcttctgtaatgagcactttgtctggcatgatcttatattctgcacttgcacactcttctgcaccagcctatccagattttttgttagtttctcgtatatccattctcagctcaaaagtttgtaaggtggtaattagcaattttactaccagtggaatcgtgttatgcctaatttatcctgtgcttggtatgatctgaacattgtaatcacaatattatacatcttgctataatgtttttgctttggctgttctctagtaactgttttccttatcatgtaaaattatattatgttcatgatctatcttttgaacagcatcactattgtttcaggcaaaatgctatagttcttgaggaaaaagagcggaaggagaaggagctacgggcccagatacttg

SEQ ID NO: 54987 - DNA, 1634 bp, Oryza sativa
ttcttccctgtggatactctgtgatcataagttcagaactgaaagcgcaactgagtgatggattatacacgatttctctctcctgtgccatgtctacagaagctgttctgttcaattgcccccaaaattaatgtccaacaagcagcgatcttgaattgctctgacgtaaacaagtcaggatcaacctactactatttacaagatctagatgccgcaatttgcacaaggaatggaaagaaacaacacgattcacaattggcacacatctaaacgtgtgccctctatgcactgtcactcaactcaacatgcaaaggtaagacaagaaacatagacccagcatcagcatcaatcagcctggtgatgttttccttccattttcaccttgggctgatctcggacaccgtgggtggcaccaccgtgctgaacatgtcggaggtgtcggacgccgagtgcttgaacctcgagttgctggagttggtggccttggagaccgtgccattgtagtcgtggatgtagcccggcgccgtgagctcgcgctcgttgatgcggatgggcttggacagcatcgtcaccacctgcggcatcgacggccgccgcgccgccgccgcctgcgtgcagaagagggccgtcttgatgtaccggaggacctcctcttcagggtaatctcccatttctgaatccaccagctccttgagcttccctacctcatgtagctcccatgcctgttaattgtgaaagctaggctgagtttggcagcaagagttggtaactcatcccccacacgcacgtaaaacggagcgactcattagtacataattaactaactttttttttttcaaaatatggattaatatgttctttttaaaaacaacttctcttttgcaaaaaaaaaatagcgtttaacagtttaaaagacatgcgcgtggaaaacgatagagatgagttgggaaatatagctgcgtaattaacacggccttaattgatgcagaggctggaattatacttccattctctaataaaagatttagatggagagtccagcgattacggcttaattggaatgtctctagagcaaatgtctgaaggtgaaagcaaatctctgaattttggatagtaaagatgatagtaagactgaccttctctaggagaatcttatcgtcagccaggagactccttgaactactcttgccacttacgatctcaagtacaaggacgccaaaactgtatatatcggctctcttcgtcaattggccatgccatgcatattccggtgcaaggtagcctctgcattgaacaaatagatcagttcagttactgcaactgcaaggttactttctactcaaacaaactgctaaatgctgaaatactcacgtcgttccagcaacacgggtactgatgtgggtgatattatcagggaataacttggctaaaccgaagtccccgatcttggggttgtaaagcttgtcaagaagtatattgctagccttgatatctctgtgcacaatcggtgacgcaatctcttcatgcaggtatgcaagtcctttggcgattcctatgcatatagcagatcttatgctccaagtaaaatttgcaggttcgctattagaacctacagaacacaagataaaaggttg

SEQ ID NO: 54988 - DNA, 2368 bp, Oryza sativa
aattactagttcatatcacaaacttacaaggaatgtaaatgtctagatgtttatatggtaaagtatgcatctagtatacagaatagcacctttgacatcctaacggcaagaaaggtatgaataacagcccaaattaattggagccccactatggtgctctccattggcattagaaagcaatctgaaccgttaatctcatttgatcgaagggtttagatctatttatactaccatcttagttagcagtaatagaaatgtggaggggcattattgtaaaaaaaaaggtgcggagaggtataatcgtcatcggtcctgcttgtttctgcatcagattataacttaaaacaatttcgaattttaaagcttgatttctaaagactagttttagataggtttttcagctttccattttagcaattactatgaaactagagccagacaagaaagtggcgaagaaaaccactaaaattagtcctaaagtttaaaatctaatctgaagctcagccaagcaggcaccaagtctaggaaagcgattgtccaacccaaaaattattcgtttatctccttcgcaagtgctatcgcccaaccagatccaatcaactgtcgcatgtcccttttggttgggccatccattgcattaagccattgcgtcatgctccaatatggccctagctacattgcagccgccacctaaatttttggggtatgattccaaaaacaatactacttcatggtgatcacctcaaccaccgaaattctctaaattctaacatccactacttttcttccgcatcactgtacccaaatttggagcaatagtggtatgctgagccgagtattgtccatcacccatcagaaaaagggtaaactttaacttccacaggagaaaaagagaggtgcttgctttttcctttgggtggtgggggtgggttcggctaacacgcaatttccaaacctccctgttcttgcacggaatcctcagataaactgtatagagaaaaccattttctccaatgaaacagtatggagtatatgcattttgcttcgacgaattcgtctcgaagtttcgcggaagcaaagcatatgggacagttagcagttagcacagggttacacgcccagatcaagaaacccaaaaggggggaaaaactgcaatcgatgtagtgataaaaaactaaagcagagattgagaaggcgagagagtagtagcagacgagatccgagttggggaggaggaaggagatgggatgaataccatgggaccgggaggcggtagtggaggtcggcgacgtccctgtaccatgcgcggagcatccagagcgcgtagaggatgacggccatcccggcgagccccagcacggagttcaccgccttgagccccgtctgcacgcagctccgcaccaccctccccgccatggccgcgccccacccgcgtctctcaccaccaactccggctactcctcagctcggtctgcacccccaccccacctgtgcagctgttctccgcgcagcctcgcgtgggagcaaagaatgggaatgggagaccgctgctgctgctgctgatggcggaggttgacggcggcggtggcgtggaatattggggaagaggaggggacgtgtggaggtgggagggaaagaggaggcgatggatggatgggtcgctggagaaatggatgtgggaattttgggttggattgtttcggcacggatgtgacatgagttaattgctgcctgcttcatttattttgtttttattttatatattacttattattgtttttccgtgaaagattaaatgattgttgcttctactctattgtattttgtactaccgtatatacttgtggaaatacgggtttgccgtgacgctgctgtaccttgaaaagaagtgtacttgtagttttttttcttagtcaaacttggttaagatgattaactaaatttatagaaaaatttagtaatatcaaaaataacaaattagtttaataaaatccagcattggatgtctgttttatgttaaaaaatgctactatattcatttataaacttaattaaatttaaagaagtttggctagagaaaaaaaataaacaacttataatatgaaacacctagacatagcaaaatgacaaatctctcggctcttcgcaagacgaacaagaggactaagtaagtacacccataatgagaaagcattagcgtatgatcaattgcgtttcaataattacatacttcaaattatatttatttgatatattttagaggaaattcttatatagaaagttttcacatagaaatgtactatttaacaatttaaaaggcatatcttaattattaaaaatgaagggagctaattagggctgcaggaat

SEQ ID NO: 54989 - DNA, 2307 bp, Oryza sativa
attcctgcagcccgttttgtgactattggatcgtaggtttttttatttgattgtattaggaaatagtcagttcatgtaaaatttcgtgtaaaaaccatcctttccaaagtagaaaaaagaaaaaaaaaacaaattctatattactccttgtggtagcatgtctaaaaaaaattacaaagcaaaataggcgtaactaaaatgattatcctgtgatagaactagctcacctgagtttaaattctaaacttgacattattacttgtatttgtggctaattattttttcggtggtagacgatattcgtcaacaacaagcttctgatgacagtctaggatttgagaaagatgtatttgtaaaacccaaagatcgaactactcctatatgctaaaatctggctgccaaccctagtttcttagtataatcttactattaattctttaaacaggggtagtgcttggtatcggtattaattgcgtgacagtcggcaagtatcagtttcattttcgtattgacttttgatctgaccatttccagcttcaacttgtccgccggatttttttttcattggttcgtagtacttggtagtaggaagtagtacaggaacaccatttcaaaattccaactactacttgtctacttaaaccacacatgaatttccttttagcaaaaattcaaaaccacatgtattgatgtataaatttggagtttgacgtcgcagcagacgagtgctcggcgaaagtcatgtaacgcgcacctttggttttgtgtggcgaggaagattttaacacggaaagcgatttgacacgtacgtgtacgtcaacattggtgatgtccagactctagacttgtaaattgtcatgttggtgccagtatacctgtgaaatgatttcatttttctagtacattttatttctttcacatggaaaaaaaattggacggctaattgacggattgatcctggaaagtacgagtacggtactgaaattgaaaaaaacgagcaaatattatacacgttcgggggttcttttcatcagattttagttaggataggaaattgtagttaggagtatgttaagcacgttcatgggtagttttaaaataaaagcacattcatgggagcgtgagcgtgctgtgtagttatgcatgagtctttcgtctaaacgaaaaaaaacaagaaaaaaaatataaataattatccatgcatggacaactttgaaacacaaacttgccaatgggccaaaatgggctagggttgggtagcccaatcctttcattcaagaggcctgtagcccaatctaacataaaagggaataagttcacttcgtgaccctcaactgtgatcgaaatctaatccataaccctaaaccacaaaaccggatatttcgacccccaaactcctaaaactggtgcaatttaactccctcggcggttttggagggcggttttgctgacgtggcgcctacgtgacgatattgaccgagtcttcgttccacgtgacacttaggtggcattagaattaaaaatatgtgtggaacccattaatcattcacagaaaaagaaatgtgggccaactgacatgtggggcccacatgttagtcctcttccttcttcctcctccctctctcccttctctctctttctctccccttcttccccaagaagctaaagcggcagcgccggggacctgcagcatccctcggctcgtgctcccgcggtacgacgccgcgttggccgcgcccaccggcaacgtctggttgtagcagtcgccgccgccagatgaatccatcgatccagacaaatcacacacaaacaatctcacaaacgaatccatcaatcgttcacgccatgtatgactatgtgtttgctagctagcagcttataggatctggatcttgtcgtcggtcatccactagcggtgggagttgaagacgaggacgtcggcgcccttccagaaggtggagtgcttgttcatgggggcactgcggatgaggcggtcgtcgaggacagcggcaccgtcagagttggactcggcgagcatgggcgcccagtataactcgatggtggcgtcgtagtccttggccctgaagatgttgagcgagtccaccgtctcgaaggatctggacccgccggcgccgggagcgccgcggtggaggaggcagagcagcgaggcatacagcccacagagcagcgagtcccgaacttccaatcttgccgccgccgcgtcagcttccaccgccgccgccgccgccgccgctcgccgccgctccagcccgtgctccccgcggccggccgaaggggagagaagag

SEQ ID NO: 54990 - DNA, 1735 bp, Oryza sativa
agatgctgtacgtgtcggcgccggtggccgctgcggccatggaggagtgggtgctcgacgagtacgccgccaagcacagggtcgccatcgataggctgctccaactgagggtatttgtcgaggtgcgcgatcggtaaggcctcatccatctccaccagcgctgggtgcttcaagtgcgccgcagacttgcaacttcctctatagatcagaagtcgatgaaccaactgtataatttcaatccagaatgtcagatttctggtgctaattttgccttagtggtttgccagcgctgtctttggcatgccggggggcctgatatgttatcatatatgtcaacttactgaaattttggtgtaactgtttggccctaaggatgctatgcaactagtaatgcttttatttattgtaaaaaggaaacagcaatatatttggcatgccacatttggtctgcaaagtgcaaactcttaaggtgaaatatgcaacagcattaagaattatgaatcaatgttggcatgagaagaaaccatcatgatgattatacccttggacgtgaacaagttttattcagctctagttggggtagtcgattatttttagctaattatactgctggaacatcaatttcatgtgtactttgtcacatgttctgtttcttgcatgtgcagaggcatagctaatatgaatcttatagcttactcagtttatgaattactttaattttactacatagtagactatgtttttctacagaagaaaggaggtgagctacaagatgaaccagaagttccagggcaacatgcaaaagtatttggttgatgggtaagttttagtaactactgagctacttttactgaaagccacatacttttctcatattttgagctaattgccttttccccgtcgaaactttatgatagtgtaagcatgtgctttatttccttatatatattatgtacaactcttaatattgtagagtaatccttactatatactccggcatacgttgcatgtatagaaaaatttctcctgcacacattacatgtagaaaatgaaaaagccacaatgtggtagcaatagggtggaaatagttcacaaatttaccgatgattgcactgaagaacagtaaaatcaaattgactaatttgtataaaaataaattactgtatgttacatgtttcatgttattcagttatttttcctgtgtgggcagcctgagctaataattaaagctttattgccatgtattttgttctgcgtgttgtagcatatcaaactagttgacgacattacagttttatttttctgcagtggaagtttaccaagggaacctataccatcgagtgtcactgcaaggttgcctacattggcagaattagagtcttttgctcttgagcagtgggaggtcaggatgacaaaagcttatgtttgcatgtatattttattttagggaaacactttctatctttttttgctcatcagatcgtactgtttgaatgctaccaatgttcactcccctagtaaaggaactcattcttttctctatgggaaaatagtgcttcttgctgcaattgatcaactcatctcaagtcgagagagggacaagtttcagctcatccatgatgagaacttttcagcgaggtcttctgagttcaaggtccatcttatttcctcccttgcttttggcagtgagttatgcataaaatacggacaatcaaattttgtaacaacaacaaag

SEQ ID NO: 54991 - DNA, 1022 bp, Oryza sativa
ttggccacatccatgtgtccagtgctagcgcatgtgccatgctgtgtaaccactcccagtctacaccagccatgcccaccatgcctgcgcaactgcgatacacgcgcccgtgaaaccgcgagagttggctctgataccattttgtaacgtcccgcctcccccaggcctgtcgcacccgtgaaaccgcgagagttggctctgataccattttgtaacgtcccgcctcccccaggccgggcccgcttacatctgatagctttcataggtcatagactgtcctcacagaccaacacatatcttttctgcacactttatcctcactcatgtgcacccgggaagaatttcccggtcggtcacccatcccaaattgctccaggccaagcacgcttaaccctggagttctttggagattggcttctgtaaaagaagttgcaacttgttgatatgagtattctattaatcctattaagccctagaccgggatgttacaaataagcataagcacaagagtttatcctatcttactataaagttatcccccactaacttcttaagcttaacatgcaaagatgccacatcatcatccactaacaagatgccacatcatcattcactaattaacaagatgttacatcatcatccactaacaatcatcacatttaaacatcatacaaacatgatatatctttacagtttttataatttaagagcttttcaaatacaaacatgttaaattatcatccaacataattacataatgtttcaatgtatatctttattatgttttatgatatcctatatacttatatagttcattctcacttagttcttaaatgattaatctatggtccaaattatctctctctttttttcctctaattaagtcatatcccatcaattgtttttagcctttagatgattaatctacggtccaaactatctccctactttttacgtttgaatcaccattctacatactatttaaatttaaattatcataaaccacattaatttacttaatc

SEQ ID NO: 54992 - DNA, 807 bp, Oryza sativa
atgatgtcattatcaaatggacagaccagaacgtattaatgattcatctgtttttgtgaagtcatgaaagaaagttctgtctcaaccaaacaaaagaatattatattcacaatcgccgagaacattttacattgcttatctaaactgattatttattgttgatgaaaaagcttatgcacagtggagtacgatttattcaaatgacttatggttttcttggtccatttattactccaattttttatatggttgtaggatgcaaaacaaaatggtgcaagggttagtgtagaaacctgtcctcattacctggcgttttcagctgaagaagttcctgatggagatactcgctttaaatgtgctcctcctatacgcgattcaaccaacagagataatctctgggaagctctgcttgtacgccattcttcttattatgattggtttgttgaactttactaaactgttataggctaactggccaactattatatggctaacattaggatggacacatagacatgttgagctcagaccattcaccatcagctcctgatctcaaactcatggaggaaggtaacttcttaagggcatggggaggcatatcatctttgcaggtaagttttttagtgcatatgaataaatgtaccgtgccaagagtgccaagtaacgattttattttcccctaatcttaatacaaattggtcaacgttccaccgctggcccgtgaaaaacattttgagtaaaatcataatggtgaagtgtgaaggcctccagattgtgcttgcatagtagtaattagtttggtatgaa

SEQ ID NO: 54993 - DNA, 1239 bp, Oryza sativa
tcctgcgccccaattatctaaccgcacaaaaaggattttaacagtattgggcaatttcgtcgtgagcaatttttgccaaagcaaaaaatatgcctaagtccctaaggatcacaaccagccacacctaaagtgaagttgggctgaaaatactgttaaggcccaggcccattagtatttcccgataccctagtgaaataatcgcaaaaatagaacgctacttcgtcttccccgccgcgatctcatccattttccccacttctcgctacagtgccaaagttgcgccggcgaaaactagggttcacaaacacacaccaattcgcctcgtccgaagcttcgtgcttttgcgaaaatcttccgcacaaccaccgcatcaatctcccttccaatctccgccaccctcgctccaaatctcatcatccatctcgcatctatggcagaggagagagaaagctttgagagtcaatgggcaccctccgatgtcacagagaagaacttgaaggaaatggtggcgcacggcgttctcccggcgaaggaaatcatcggatggcgtccagcatatggcgaagccttcccgacccccgacactcatgaggtcgttgtattctcccactacttctatggtggttttgcccttccaacttcgaagttctttgggggattcttgaattttatggaatcagtttgcatcaccttaacccgaactccattgtgcatattgcaaactttgttcatgtatgtgaagccttccagggaattaggccgcatttcgccctattccgtcgcatcttctttttgaaaccccaaccaaataaaaacaagccggctcccatcatatggcctaaacagccaaagaataagccaattttaaaattttcaaacttaattttgagattgattttgagatattttcaacgtagtttctttaacaacattggtttttaaatcaccaagaacacatataaaagttttacctacaaattcatttgtatttcctaataagccgttttggcttattatggataaagccaaacgatgggggttgcaatgtgttatcgggggagcaggtttccaactacggggtaccttgagccaaaaatacttctccatgccttttaaaacatccaacaagggttggcacgcaaactggttctatctccaaaatcctgaaccggcgcttcccgagtactcttgtcttcccccaaaatatcaggaaacatggaactcactttcaatgggaga

SEQ ID NO: 54994 - DNA, 4049 bp, Oryza sativa
ttgttatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaaggggggagaaagatagagcaagaatgagtacaaccacagtactcagcaagccacaccggcagatgcatgattaatgtaaggggggtacaaggggataataatataggggttaagttttgcagtaaacagcatttaaaagtcacttagttgcccaaagctattttgtaaacacgatcctagagctatacaatattattaatcaaggtcgtgaacccgcacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaataggttttactctgatcagaggtgtacatctttacccacaagacacatcttcctcacgtgtaaccacatgccacataccaccacggtatacggacggaagacgtgacatagttcccaacccatcctagccataaacaagagtaccgacccaaccccacctacggccggaacccccgggacaggcaggcaggattgagccccctagcagcaggacaccggccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccagaaaacaggttttaggggttttgaaagaggaagagaggtgtatgtccaattccaccataatccaacaattccatagtgtccaaatgatatgagaattcccaaagtctaaagttataaaaccacctaatgttgcctaattaatcagcgaagcatctacctaaatttatactagtggaaccacgaatagagtacccactagttggggttttgtttattctagggtgaacaaggtaataataacaatagcaataataatgtcttaacaaagttaaataggcatggctaaataaaacagtgataacgcgggaatttaaataaagcaataatgcaataatttaaatcaaaataattttataaactgggattcaatatgttcaaggatgatgtgacttgccttgctcagagagaacggccttccgaaccttcagcgacgaccgcgaaccacgcttcgggaacctccggaacgacgaaagctacgcgaagcacacaagcaaagctacaagcctataaagaagcaataacaacacataaaaagaaagcacacagttctttaggttataacaaacattaagagacttgaacgggtcgattcggagctcgtatgaccaagatatgatcatccgaagtttgatgctgttatatggagatttgcggattattataattaagctttgcaattataaaacatgtgtaagcgctagcctggaagagacaggaaggctgcgctgttgacatgcggaccccacatgtaacctaaaggaccacggtagaccgagtacacagagacggtccacgggtcgacggaagcggaccccgtgtgtcaaccgaggcgagtggccaacaaacggactccactagacaccacacgggctgcacacgtagaaaccacgcggctaccgagcgggcacactaacacggtcaccacacgcacaagcgaacgactaccgacaccggtacacgggtaccggtgtcgacaaccgcacaacgggtacggggcgacaccgaaaggacgagggcggggaagcgagaggacggatccttaccaccacgcgacgaggcgtgggaacgacaacgacgaacgggcgcggcgaagacagctcgggaacgacggaggcgaacggcgagggaacgacttcggcggcgatccttggacaaggcttgacgacgcggagccgaggacgaagacgaggacggggctgccgcggcttgcttgacggacgcggacgacggacgagaacggctcgacggagggacgaacgccacgacgaccgggaacgacgagaggacgacgacgacgacgacgaccgggaccggcgagtaggcgacaaggacagccggcagcggctgcacggagacgaggacggtgtggaacacgccgcagcgatgatgatgacggaggcggtgccgcgagacgacgagccgggcgaccgacgggacgtcgatcggcgaggacgaacggtgacgaggaaacgatgatggcaggcagcagcggctgagcggaggaggggacggcgtggaacgcgctgctgcgatgttggagaaggtggtggtgcagcggggcgacgagccgacgaggaggaatgggtggttggcgcggcggcggcgttccggcgaacttcgggcgaggaggaggtgatgctggggaaggagacgatgccacggtgtcgaaggaggagacagcggcgtcgatcggcgcaccggcgacgaacagcagccggctggagggagtgggtggcggcaatgccaccggttgccggcggggacgcgcctccggtggtctccgcgcgaaacggaggcgacgccggtggaggggaagtgtcacgcccagaaattcccgaatagaattccaagcagaatgtgtattaaaacccccgtccaggaccagccggggtacacaaacgacaatgttgacatacagatccacgtcttacaaacattataaaggtcttacagaaatgcagcggaaaacaaaagataaccggagctaatccttgacttgaactgcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaatagaggtatgatgcagggatttaacaagggatagctaagcaggttcatttgcataaatactggcatttataaacaggaattgaatgcgaaaacagttgtaataattaagcagtattaaacatccgctgtccaacgctaacccacgttgcgacaggcccaaccatccacctaaactatccaaattcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacatcccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttaaccaacaccagagcggtggtattaaaccaacattatcacataaacctatagtctaggttttaaatgagatccccaatgtgtgctagttgaactaagcatggctaagcaattcctagtccaaaggggctgcaggaat

SEQ ID NO: 54995 - DNA, 1188 bp, Oryza sativa
aaagggggagagggagccgaacgtggccgggagcggcgggattcgacggccgacgtgggggagtggggaggagagagaggcgggattcggttttcgaatcccggccatctcgggcgcgggcgcgaacgggagggagaggggaaagggcgcgggagacgcggcgcacgcgcgggcgtggccgacgtggcccgggagagacggaggcgtgggcgcggggcggtttcggcgcggcggcgcgccgggatcggcgggaggtgggggaaggacccgacaggtgggccccacctgtcggcgaccccgagagaggaggcgggcggcggctgccaggctgggccctcggcctgcggccggcccagcaaggaggagggggaggaaggaggggaatgggccggcggcccatccgaaaagaaaaaaggaggaaaaagggagggaaaagaaaaagaaaaaggaaaaggattttccctggaattaaaaattgcactttagtgatttttttttaattggttaaaaattatttctagagctctgaaaattccactaaaaatcctgttaatgaatttcgacatgtagaattcaagaaaaattccacatgtcaaatccgattattatttgcattgttttcttagggttttatcttgatttcctctgcattttcttggggtcatttgaaatttacaatttggcttgggaggaaaacttcggggtgtgacaggaagcagctgcgacgctgctggcggcgacggcgcgaccggacgacgctccggcgaggagggagaggcggctggaggcggccggcgtggaggaaagagaagggcgacggcgggaacgtgcctccggcggtcaccgcgcgaaacggagggcaggccggggtggaggaggtggcggcgacgctggaggaggcaacggcgcggccggccggcgcacggtcgaggcggcacaggcggctggaggcggccggcggcgtgggagagagaggagggcggcggggagagggctagggacaacggggaggctcgggatggggttaaaacgatagaacggagtgaggggatcccattttatagcggagggaagcgaaccgagcacgggagagggcggaacggcgacgggaatggcggccggcggccatggttggtggccgggaaaagcgcggccgttcccgacgattgggggcgccattcaaggggg

SEQ ID NO: 54996 - DNA, 1583 bp, Oryza sativa
  unsure (1)..(1583): unsure at all n locations
ttttattgtggaacatcgtgatgattcaatcggctcggttgaaattgtgcccttgactttattcgttgatggatcggtttgtactcatgattgtggtatcagcttggttataatctctcctcggggggcaagttttgaatttgcttatactattaaacttgtttgtatgataatttggcttatagttagtgcatgtgtgaaggacagattggtttagaattgatgatacaactgtcaaatgattcacttggaaaatctactccgtttacaggtgtaggaaattgtgatgcatcggtcatatgtgatagtattgactaaatgaatatagaccgatgtagtttataatattgtggcctgtgcaagctgattacatatatatgcatatgtatatttggtttttatgcaggctacagaagctatacagggcgtggtcacattacgttaatcacggaggcaggtgattatccctaattgggtgattaagtggcaagggaatccttcgttgctcctgcagatggaaagtcaggtgtcgtatttactgagccaaagagtctacatcgtcatcgagcgagcaggggctcagacgtgcggctgtgatgggagtgctgcttgcatggatgtgatggtattcgctggatccaaccatcacgtggcatctgcgttgagagcagggctgcggcgaccgagccaagccgcgtgcgatattatttatctagttagaagataaagagtttgttggatcgaattgtttcaaatattccggtaaaccatcattgcatattgcgtgggaccgagtagacatgccaaaagatcagagcaattagctatatatattggtccacggtagaatagaagggaacccaatttcaatctaatattcatctcttttactttttagttcttttctattttgtttttatggctgagttctagcaaccctagaatttggttaatctttgccgttttgcgctgaaaaacggtcgtgcttctccatgaaagcgagaaggttatcctttgctagtttgctcggaaactagtcgttcgtcgtcacgtaagtacgatattatcttctttactaatttgctcgtaaattagtcgtgtgattccacgaaagcgaattaatctcgaaatcggtttcactagccaattttgatttattgattttggcgactctgtttaatgcaccgcaaatcattaggtgatcttgtgttggcaaaaaaaaagcatcaacaaaaccttatgcaactaacaatcaagctaagtacgaagcagttctcaaggggttgcagttgcttatggaagttgaagcccacgccgtggagataatgggggattctttgttggtgatcagtcaattggcaggggaatacgaatgcaaaaatgatgcgttgatgatctacaacgagaaatgctgggaattgatgaatagttttcggctggtgattttgaagcatgtctctcgggagcagaacgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgcaggaat

SEQ ID NO: 54997 - DNA, 1279 bp, Oryza sativa
aaaaatctttcaagcaaattacgtccaaataaaaagaagtaacagaaccggccatagaatttatgcattgcatcattattagtaattacaaagtcatcagcacacttcaatattcaaaatgccagagaaaacacatctttactggattcatccaatagcactttttcatggatattatgaagctatcgtttcattgtctggagctccaaaattggttggtgcatacaaaggagatactccacttaatatcaagcaattgacaaaattaacatattttcaaaattatggcacctcacaaaagggaaaattgaccttctgctgcagcctacataacacatatcagcagcacaacaattgcagttcaaagagtctacactgatgaataaaaattgatttggttgatagaaagaaccacccaagtactcaatacaaatagaaaattgcaataattgttcagtatttacagcgaaacctaaatctacaggaaataacagcctcaatctgccatggagaaacttttccaatatatttccactaagttaggcactcaggctagcaaaatgaatacaagattccaactaatcaatttctgaaataacatggtgtctagaaatgctaatcctaattttagtgctgttctacttaccctggagagatcttggtcgatgtcaacgattatcatgaccatgttggtggatggggacaaggctctttgaggcggtcttcctcctttcattggcaatgcaaaaacagttctgcaccctccaaatcctactctgagtgggcctcacaccgccggcggaattccattagtatataatataattcaatctgcattcaacaaagaccaagagttattgagccctcccaagtatttgcaataaaaatggaagataactgcatgaataattgtcactctaatatcaatttacaagttcacattatacctctttgtcgacaaggccgaggaactcttgatgctccttgctaacagactgcaatataaggaaatcagaaaaagataacatcacctgttgttttctcaacgcaatgttagcgctcctttcataatataagcattcttcctagagtaacaacagtattcatgctcttctctaattgaatatgcaaagaacactgatttttccttatcaaacaaaggatgctaccatataacatttaaaatgagtagaatcatcaatacaaatttatcaatttatgtgccaattatgatcatcaactaataggcgattagcctaatgaaatactctacatacca

SEQ ID NO: 54998 - DNA, 1253 bp, Oryza sativa
tgttgagcaagtcaagaagtgcgaaagctgtcagcgcctgtagccagtcggcaaccttaaaaaccttatagctgcggccgtttatcactatttcgcaataaacaggccgaaatgggcatcgcaccgttggcaaacccttcaacgccacaaatttcttgtttttgcttcgccgaatacacaatttttggcgaacaccctgttaaactgtgcagaaagggcaaaagacgatttgtatagtaagaattggcgaaagaagaggaaatattacataatacgaaaatgacataatcatatacgccaaaggcatcgaccataaaaagtggctaagatagagtcatacattccaaatacccaaagggacgttttcggctacaataaggagggaagaggccgaatgtacattgttcgcctttcccggcaaacgcaaaaaagaagaagaaaaacttcaaaaatctaaggaaagggcggagggcctcacacctctaggtgatcctgggcatcgcctgcaccccctccagctgctgcatcctcttcaaggtcgatcgcaagggcgatcgggtagcgatcaattcaccccccccccctccacctggttttcttttttggcaccgcattactttcctattttagtaaatttatgcacctaaagtttatacacctcaagtttacacatctaaagtttagagaccaaaagtttataagtcaaaagtttatatatccgattcaaatttgaatttgagttcaaatattttttatatatagtatttctatatatctaaagtttatacacctaaagtttatagacctaaagtttataagtcaaaagtttatatacccgtttcaaatttgaatttgaattcaaatattttctatatatagtatttctatacatctaaagtttatagacctaatgtttataagtcaaaagattacatacccgattcaaatttgaatttgaattatatctgattcaaatttgaatttgaattcaaatattttctatatatagtatttctatacatctaaagtttatagacctaaagtttataagtcaaaagtttatatacccgtttcaaatttgaatttgaattcaaatattttctatatatagtatgaatttaggtagatgcttcgctggttaattaggcaacattaggtggttttacaactctagactttgggaatactcttttcacctggacactatgtaattgttggactattgtggaattggattcacacctgcccctcta

SEQ ID NO: 54999 - DNA, 2353 bp, Oryza sativa
attcctgcagccccgaatagccgcgccctcggttatggcaagccgagcaatgtacccaagttagtgttttaattcttaaacctgcttaacaactaaaatgtggaatggttggcctgagttggcttgggacgagctgggacccagggtcgggttgccagttcggtctgaatcatcgtaggccttgggttaaggcaggttcgtgtgggttgacggccttgtttaataatcttgtatagctctagaatcgtatttacaaaatagctttgagcaactaagtgtcttttaatgctgtttactgcaaaccctaaccctttatattataacccccttgtactcccttgcatttatcctgcacttgtgggtgtgtcttgttgagtacggtggttgtactcagtcttgctcaatttttcctaaactcagaagaggagttcctggaagatgaaggctttggtgtctagctcgtgcctgccgtcaagcgcctgtggtcgtcgccctagtcttccgctgtttgtcgtttgtcttctggtgtgctgggccttcgccgcccatgtaataaattaactatttacgcttccgcttgttaaactctgaattgtatcaacttttggtgtaccttgcctcctgggacaaggaataatgcacgcacgtaaggaacgcctgttgggttattcccggtcgtgacactagcaatgtgaataacatgtttaaactcaacacatggtggctctactatagaactaacatgttcattaactagttgtgcctaaccaacacatcactgggccaaggagttagttgctaagtcccaagaggaagcccagtgctagggaatccggtgttaagagcgaaatttgacaagatagactcagatttggagatgtatatcgacacataatcaaaggagattgaatcttgccaaattcagaacgcgcattggccggaaacagtgttggaaacaatatcgccgaaccatcgaggtgtatcgtcccggcttcgtcgtcgtccaacattgcctaggcgaagtagtcctgttcgctcacgatgtggggaggagtcaccagcctcctttgctttgtcactggctcagcaagggtcacatgctgataatgtttcctctctttgcacgataaagttgatgcaggattagaggcactgaccaagctagctctagatctttaggggcatcttccgcgttctctagggtagcgtcttttacatcgatgatcttggttgcagcgtgtgtcttagcaatcccaatttcaggacaggcattgcgccacctttaagagatgcgcaaaaaccatgtctagcgcagcctcctccaagtcatcaggttgagtttgagtgatgtccataggactggtatagagccaacaccgtcagctccactagttcaggatggccaagctatgatggtggaagtcgttgtcaaccatgttggcatcaaggccggccttgattagcctgtatccagcagcacctcagtccagacttccagtttctttactgtgtcaagggtgaagaggactcgttgtgggtagttctgcaagacactactatcaatataattcccaacaatggcgcagaaatactcctgatatattatggttacagagttcatccacaagcgcacggatataccattgtagcatttcacccgagagtattccaagggtatcgtatttattttatcccgtgggaatatcatgtagagagaacattgactaataatttatatatgactggtgataatcatattctaagcaggggttaagataatccaagggtagagtgacacacaagcgttaactactcattctcatactttataatctaagctaagtggaaagaaaataggaagaaaatctattcctatacttctaatatacatagtatacatacattctagttaaccgacattctatccgatgccctcctggtacttcgagaagccacccctgactgccgagttccttacgacagcccgtcatgaccatacaatcggggctaaatacgaaggaataccctccccatggaattaacttaggattatataccggcgcggaggaatacccgtactgagctgtcaccatcagtggcccacctctcatccgcaatatataaccccaaataatgatatcccgtaatctagacaatacgtctaaactaccagatactactctaatatcatcgttatgacatagagtaattgcataagcaaacattatatccacaccaaagcatctcccagataagctagccgtatatttagtataacatgaacataatgtaaagtaggtgctcatattctcggaaagtatttcaataccataaatgtatttagaagagtatt

SEQ ID NO: 55000 - DNA, 845 bp, Oryza sativa
  unsure (1)..(845): unsure at all n locations
attttcttttcgtttccaataacaatttcagtgcaagcctagaatagttgtacatcttttgcgttgcgaggtagttccatctcattccaaggcctgttgtgatcnnnnnnnnnnnnnnnnnnnnnnnncagtcacaaagccaatgaaaatctttccaaatcaaggatccccagtcctcccaaatctctcggcatgcacacggtctgccagtttactagactcgtccccggtttgacgttctccggttcctctcccttccagaggaaagtccttctcattttgtcaatcattttgatcacccactttggggccggcagggcagtgagatagtgcaccggcattgccgtgaacactgacttaacgagagtctcccttccaactgatgagtaatatctccccttccaacccgggattttagatccaattttatcaagcagtgggacgtaatcgattttcctcgacttgcgcagatgaaggggcagacctaggtatgttgttggaaaggatgataaggtactcgggaagtgctggattacattgggggcattcaaatgcgaacatgcaataggaagaatctgagtcttttgtagaaatatggtctttaagtggtgttcattaactaagaaatcatatcgaactctatctttgtttatgcctaaagtttgtgttaaaaaaaatctaagtagtactagtcagatttctatttgtgttttaaatttatccaaaatcactatagaaaaactcaataaaactggcagaaaaacgtctcgtgcagcaagcaaaaatggcccaatgccccaatccgattcgtggtgcgaccttgaaaaattttgctggtgggccgt

SEQ ID NO: 55001 - DNA, 3951 bp, Oryza sativa
tgactgctaagttttgtgcgcggccgtgggcgggtgttcaacatattgtcatgttgagtcgatgctgttgcacgtcaggagttccgaaaagactcccccacacttgttttgtaccttgactttattcaacaaaatgatggaaagcaaaatgggcttccaccggggtaaaataccggtgagccaaattttattcaagtaattctaggcgcatgaagtgcctaaaattacttttattttatttcacttttattttgtttttatttatatttatattttatatttttttatcattttttatggcagcaatagaggtgatgggtaacctagcagggtggacatatgtgacgcaatgatacacagggtgtttcgaattcttactagataggacttaccaagctttgattcggatgcaagaatgcaacacaactttgcatttgctctgcctggttccctgagcatctgtcttctcatagtccaaggagcgtggtatgaatgttgagattattatacacttccccttagttgtctttttatttcctgcagaaggtcagtggacaacaaataccggagggaccacaaaaagttgaaaagattttatcatagcctcaagattagttgttcacattcatgctaaaaaggaattggattgaaaacttaatgagcatggatcccataaatttgccataattttatttttgtcattatttttactttttactcgagagaaaaatgtttttttttccgagagacatttcttttattcttgaaaacaatttttatcaaacttttatttaagaaaaactcatatagggctgagataaagttacataacatagcaaaggagcatttgacaataggtcacggcagctaaggcgggagtagaccttgcaaagcagggcgaaccgggcttccatggcgccatcgacggtgaccttgggcttcttgttcggcgcgatcgccctgcgccgccatcggagagctttcgccgactcagacccggcctcgaaggggatggagtggtaaaaccacttcgacatccagtggcgagccaacttgaacatggcggcgttgaccggccaaagatcagagtgctcggggcgaacattgaagttcacgctcccgaacgctgtcttcttcgtccctgcgggagtgaccaccgtcttcgagtttacgttgcgtaaaaaatggtgccgtaaaaaatggttcgaacccagcggtccggcacgcccagtcgaagatggcgattcggacgagagccgatgggcttagttgagggagctccacctaaaaaaggcgaaggatctccgaaaacaacacgttgcacggaaaccgaaggccgtctcgaagaacacggcgaagaccaccgtccggctatcgccgggcttcggcacaacagcctttcctgggggaggcctgcttctccgccagcacgccggaggtgaccagctttgccaactcatcctcgtccacaagcgaagccccgagataggcggtggtgtcgtcatcaatcctgccgggatcagggcccgtcacggaagctgggttcggcttgcgaggagccatggtgaaaagtgtgggccgtgacgaaaagaggaacagtcgaaaggtactagtgactcaagaggaccgtgaagtgagagggcggaaaagagagagctcgcggtgaaaatgacgggggtgcggcggtgaaaagggggggatatataacccacccaagcgtcaattcgccttcccacccaatcgtaagccgccatgtgtcacgagggtaggcaaaatggtaaattcccattcattgagctacacagtgctaagcccatgaagggaagcctgtcactgtttattgcggcccacggaaaaaaataaggacggcttcgccgtttgcaaaaggcgaaagctaggaaaatttactaaccgtaaaaatacatatgcacaaagtgtacacatttcctgtaggactgtattataggtttcggcaggagcgtcggtcgaaagggggcgcctcataccataccacatggtttgcacggtctcggccgaagctcctaactcacccttgcccgtgaggggcttgttggcagtatgtcatgagacccttcgaccagacctgccgaaaccgtgcaaccagcgaggactatgaagcaaagatggcgaaggccgaagagtcgtgctggtatccggcaagaccaaatgcgtcttgggcgaagggtgtatgccgaaggatggagacttcgcaataacaagcccaactttgaggaggctcaaggggccatcccggccgctcaggcctgttcgccaatcggcccattagaggcccatgtatccaaattacactgtatacccaagcaaacgtccctttcataagggcaaccatgtaaattcccctgtaaagcctaaaccctaaaggggtgaacctgtaataggattataaatagtcctctagggacatgtaaagggggatcccaaagaaaaatcttaaattaatacatttactgtttccaacactgtcggtgacatggggccgggggtatcgtgactagaggcttgggtagccgcggtcaccctcgtggcctgaccccctcgggggggtcgggctcgaaggtgacgtggccacccctccctctgtctccccgaggggtcgggccgctcccgtttcggccccgagggctggggtgccccgaccccctgtggttttggcgccacgtgtgtgggttaggtgagcacacagggctcacctaaccgcatttatagcaggttggacgagcgcgccacgccgcgtttaatgcggcgcagcgcacgcttatccggtccgtgaccggtcgcggtgagtgaccggtcacagacaggtcaagatcgcgggttaggtggcaacaggcggcctgtcacacgcctcgccccgtcccgtcggaatgatgagagcttcctggctctcgtccctagccggagccggcatgccaactccaggagtgggtatgtcagtcccggtcagattcattccaggcttcagcgcaagcatggcaaggaagtcgctggccattaaatgaaggttgaaatgggcgtccccgggaaaagcgggcgagcggggcaggaggcgtgtgctctgcttgtcagatgtcacttccggctgtagactagccctcattgtaaaaagcatgtttcctttcttaggcagcgagaggcccatgtggtgacccctgaccaaataaaaaaggaggcccaggcctaaggagaggggaagagaaaaagaaaagaagaagaagaaaaaaggagaagagggagggcctgaactctccctggctctccggctctcggtattccttcactcacagatccaccaaaacacaggagtagggtattacgcttctcagcggcccgaacctgtctacgtcgcctgtgtcttgtgcactttctcgctcgctgacgttcctcagatcgagggcgaagaatctcacttagcgcccccggccgaaccggcaaaggggggcctgcgcggtctcccggtgaggagccccacgctccgtcaaacactgttgagtaaccacgtccttcgacgtacgcagttatcgcttcgacaacactccattaaggaaagaaataaaaaagaagaaataaaaacaaaaatacgaggatgacctagactcgaataaattagcaacagttccctagcaacgacgccagaaatgcttgttggaatttcttacaaccatagataaatccgaagcgcacggaataccactgtagcactttacattcggtgtcatgccctgaagtttccccgttcttctttctttaaaagttggttgaataaatcgtccgaagaaattgttctaattaacctagagttgaatccctaattaataaatgcaattaatagtcagaaatagcgtggtggaatttttcttgagttccccatgtcctaatgtattaacaagatttttagtggaattttcacag

SEQ ID NO: 55002 - DNA, 2445 bp, Oryza sativa
ccggtttagccatagccattgttgagtcgttcactcgttcgttcgaatgaggtgttccccgtgcttcattcgttcgtccgtgttgagtcgtcctttaggttagagccgttcagagccgctggttccgttcgccagtttcagttgatcttttgggtggtcccgtgtcacgtagaattgactcgttgagtcgatatctcgtgaggctcgcttgccagatcaatctaagccatccgatcttggtcgacttggtcaagattaatctcagccatataaatcctttcctctcttttcaatggcatattattcattttactatatgtcatctaccaaatataatctaatattttctggaggttgttttaatcttttccctcagttataaatcatttgtaaattgtttaattaatttggaatagtcttttctttaataggtttaattggaattaaatcttgtaaaattcataactaattcatatgaaatcggaatgatgccgtttaagtctctaaattcatctaaaattatgatctacatgtttgtttactttatatgtactgtttatttggtttttattagtctttttctttgttttgcgtgttagcttgtcgtttccgccgttgcaaaggttcgcgtgtgcatcggaagtattccagaagacttattaaagaccgattattgctaggcaagtcacacagatcccaaacacaattcctttgagcatgttgatcctatatttaaagtctctatttatttcaactgtgcatttattttcgaatgtcaccgggtggtgtgaacttattcctttgttatggtcaatttgcattgattaccctatttcttgattaccttgggttattataatttgactagttgagctttatatattggttcagctagatgttagacataattgcttagccattcttagaaacattagtacacgattgggataactaatgttttactattacttaatgatggatatttaatgattagctcacgatggtcaatcgtgattggttaattaattaatatgctaactaaaacttgataatggtgggttgtgagcacatggttttgatggtcatgcacatgacaattaaggaccggttcacaagtttcagttgtgaaacattaaccgtgccaaccacaagccagcatgggcaacggctttatcttttgtatagcatggttcattgcggagcaccagactgagaagtggcggagataagcccacgggggtcgctggggagtccatgccttgtttataagggggtgattatgatccaggaacggtgcaatgctttgagttgtgttgtgcgaagggtactgtcacgatttccccctttgcagtgacgtggtggtacttcagggcatggtaacatgtgtggaatcgtgtcttgtgggtacagtggtacacctctggccagagtaaaactattcgaatagccgtgcccacggttatgggcgggtctaacaatgtctttcatgatagtctcacacttctcaccataatagatgatgctataactggtaaaatttgattagctcctggtttggaatggtatattcctggtttggagatagatctgtacagccgggtatggttgtttaggtttggttgggcctgtgcagcatgggtgtgatgttcagtgttgattaaaattgatgattaattgctctactattttacttctcttaaatgtttgctaaatgctgcttttgcaaatgagcctattgttaacaaccaaatttggtaatatcaacatcggagatgaagatgaaatcgaagcggactcgaagataaggtttttttcggaaacagagtaagaatcggctggagtccggatcggctacgactgggattggctaagtctgagtcagtctggttaagtgatacagccgattccgataatacgacccatgtgcgacattgggttcgagttgatgtgtttcaagatgattgccacgcatagatagagtcctgggaaggcaattgtatctattaattaggatattttatgtaaattccttagagataaatgtgggcaaaagtctgccgcaaagacttgtggtatcttagagtttgttagagataagagtcgtgtccaatatggacatatcttgtatttctcgggtataaatagaccccgagccctatgtaatgatgaacacacacgttcaatacaatttcggcgcatcgccactctttttgctttcgttttatttcaacgagttattgctttcgggttgagctgcatcggttttgatgttcaacaagaggtaaaacttgttatggcggcttgtgttctcgagattagtgcttccatctttatgatactctaatcttgtttatgtagtccgtcaagttatcatatatcttacataatccttgacaatatcgtcatttaacctacaatcggctaacatctgctaccagaaggcag

SEQ ID NO: 55003 - DNA, 5021 bp, Oryza sativa
ttcctgcagcctacacgctatatctatctgatcggctatgctatgaatatatatataatctcattattaatatatatttcgatgtaagtgatttatactgtctcggcaaggtgaccgatctatcccaattacttgattcaagtatacatcgatataaggattatgtatcattgatatttacagccgatcgagtagatttagttctgatttgttttcttaacaattgccgatcgatttacatataacatcggctcaaagataaatgatatgtcatcggcatttagccgatcggctatcatttatggatttaattacggtttctttgtctttgtttcttgttgattgcaggatcaaatcaactggcacgctcatacatccaaaggcgagttttggacctgcactggagctaagcagatctcccaggcctcgtgttttctatcaacacctatattatgccattctttggtatccttgtgcacttgcatatttgttgtgtgccttgctgagtatgtcatatgctcaccttgcaataatcaatcaaatctcagttgaagacaagtcgcaaaggagaagacgtttggcttataccccagttgagctgcctgtgagagtggagccggagcttcgctagaccgtaattccgcagcagttttcttttcttttgtaagtatgtaacgttattattatgatgaatctgtatattaaattgtcagtttgtgtacctcggctgattcctggacgaggatttcatgcacaaattagttcggaaattactagggtatttccgggcgtgacaaccgcaatatttaatcccaggagaatcctttccctttttcccttttcttttcctccctatttcctttgttgggccgtcggcccaaccttccttcctcccgcgtcctctctccctccttgactagtccggcccatcaccccactctcctctctgggacgctgacaggtggggcccacctgtcaggtcgtcccctacctccagtcgcccacgccccggcgccaaccgccaccgaaaccaccgctcctcatgccgcccaccttccccgcctctcgctcccgcaccttgcgcccacgccacccacctcctccaccttccccgcatctcccccgcgcgcgtgcccgcaagtggtgggggacttgaaatcccccaacaccctctctctccccacctcccccacgtcgtcgccggcgccaaccacgacctcccggccatgttctcccctccctcgcctataaaatccctccccggagtcccctcttcctttttccgcgctcgccgctctctcccgtgcctcctatcgcgcccgcgccactcgccgctagcgccgccgcctaccaccgcctccggccgtgcgccgtcgccgctagagccgccgccgcgccaagccgccgccgccgctagcttcaccgccgtgtgggtcatctcggccaccacctcgcgtcgccggaaccccatcggaaccccatctccctcgcgagccggtgagctatccattcccctccatctccggccggcgtttaaagccgccgtggtcatcgtctcctctcctaactcctctcctcccctcctctaggtgtcgccgccgctcgtccgcccctcctctcaccgggtggtcgtcgccgccttcgtcttccactccggccgccgtgtcgccggtgaggcctctcccccccccctttcctccccatcccgcgagcgccgagccacgctgctactccggccatgcgccgctgcctttcggccgtcaccgccgtcggtggccgtgcctcgccaccgcctcgccttggtcggccggtcggccttgaggccaagccgagcccggccggcgcctccactccctccactttgagccaccgcccgtggggcccacatgccggtgccctttcctctctcttgagtcgctgacgtgcggggcccacctgtcggcgccccccttgctgacgtcagccctggggatttattgcgccataattaattaaggccttttctttattagtaaaaacacagattatcttctaaaattcataagtaattcatccgagctccgtttaagtccattcaagtctcaataaattcataaaaatccctagaatctattaaaaatggttttgttctctgttacagtagtcttatagcgtgtttttcttttgtgctttgtttgtcgcgtagatttcggccgcttcgtcgatccgcggtttctcgaagacgttgctgtggtctcatcagtgcgagagcaaggcaagtcatgtattacatttgatcgtattgtacccaatttacaaatatcccgcatttctattaaatgttgcattcttttacaatatcatatgggatgggtcctattattcagccatatattgtttaccttatgccattgataacttgggtttcaaaatgattagatgttggtttaggaaatgcttagccatgcttagttcaactagtacacaaagggggatcgcattattacatagactttgactattagcatagctttggattggttccaccgcaatggtgttagttaattaaaatacactgaatggtgggctgtgggtgcatggtttcgctggtcgcacccatggcagttaaggaccagttcacgggaaaccctgggagacttaccgtgctgaccacaagagggagtgggtaactgcttgatctgaagtatagctcgacactttcctaggcaccggtggcgatggtgggcgtgatggagttgggtcggccggggtgtccggttgtctagctgccggattcaccgcggcgcaagaggggaccgcccactgccttttgaggggtgggggtgaaaccttagcgtggtgtgaatggttaggggagggttatgcggagggtcttgtcacgatttccccctttgcagtatcatggtgatacttcggggcatggcgacatgtgtggaatcatatcttgtgggtacagttgtacacctctggccagagtaaaactattcgaatagtcgtgctcgcggttatgggcgatcaaccagattcactgtgattagtctcacccctagtttagtttaatgcacattcagcttagaaattctggttcatgaatttctaggcgtgacattcgggtaaccccaaacggatatcgaactcagggaacgtgtataatctatctaaggctaagactatccaagaacaacaactgaaggtaggctaggcaggctagagaggactttctatgtttttaattatctaagctgagtaaaacataatttcctgtatgatgctccggacaccgacccctgctggtctgccaacgtggttccggctatagctctatgatttatccgaatgcggaggattactgggacgggattcagggctgtcaccacctgccgtctacctctgacaaatctgtgggatacacaataaacaattactactctaatacttgcgtaggaacttccttctctatccggagtcctagtactagagcacttagtacgaatactaaataatgaacccacaaagatggaaatatatctcacttagactaaataattaaataataaaaaagaaaggatcccaaatgcttactttatagaagaagtttctgcgaacccggagtaaagtgtaccgacaactccggtactcctccagaattcctactatgaagctacactcatcgtggtagaagtcggatgagcaccaaacttccgggcattcctccagagcttcccctcactctctacctatttttaatgtacaaaagatacaacagagcctcttgtaattcagctcaaagttgtgtgttggaaataagagttagctcctccttttataggcaggtatgacggttagagcctatgccaaatgtccaaaatgccccggaaccgccattaggatgtaatcagggccatcgatgtaaaatcaggcgatcaacggcctccaaatgggtttggctaaactggtggttcaaccgaacccgggatggctccgttcggctcatttttcctcgtggacactaattttgaggcccttagcccattggcatggaggattgggccatctggaggcgtttaattgggtttttgggtccaaaactccataagttggtatatgtgtttgattatcctccttcatgtatatttcctctcaactttgttagtttgtcacctgcatccaaatatataccaacactaatagaaatgattagttataaaccctaccactaagttgaataccatattttattccattatatgcaggtattgatagtcatatattatgatttaaggaccgccaatagatacgagcggcacgagtgcttctaaggcaatcatcttccaggacaaatcagagatttgtgcagccttgaggtgaggtttttggcgatttcgagctgggcttttgtggaggccatgggatcggaaccagaagaatctggtaccaagatgtcacgggctagagagttggaatgaggattgcgatgcagttgatatttgaacaaagtggatgggcgtggccctggacctcgtcggcgcaacgtaatttgcgacatatgttggaattggacatacaactcctcgtcattcaaaattcccaaaatgttttagattgcgctcggggtgcatggttttcatagtagcacctcggccatcataaggatcggtcttcgggcttctgtttcaaagcactaccgtacttccacatgtctaatgggtaaggcttagtttggggctcaacctggacatgaacaaaaggacacggatacagatgtcgtggtagtcgagatatcgtggcacaggacgggcatccgggtggtcactcctgagggatgtcctgatgccatggggctcaactataacctacctgtccggggagccctgtccgtaggcgggtgttcagtcggtactcttgttcatggctaggatgagttaggaactatgtcacctcctccgtccgtataccatggtggtatggtgcatgcggcgacacgtgaggaagacgtgtcttatgggtaaagatgtacacct

SEQ ID NO: 55004 - DNA, 3517 bp, Oryza sativa
gagtcaatttttggcacgcccggtgggacacaagttttgcacccaacatgtctgaagaggaagtcaataccaagaagtagcaatctcgcaagccgatggttgaaacacttcaagatacagttgatgaagcaattcatcgcgcattgtttaatcaatctggagttttggcggatacattacaaagtttgatcaaggtaacagttgatgagttaattattcaaaaaagtcagctcggggggtagattgaagaacaacatcagcatcggctcggggggcaagcacatcggtgtcagcatgatgaggcatatcaacaatatcggccagaaggaattcaaagatatcattatagggaagatttggccaatagaattgcaaaggtaatagaggagcagtttggaatcaatcttaaggaacatacttctgtgtatcggctgccatatgccgagtggtttgatagggttccattgccacaccgatagttccaaattactccaaattttcagggcaagatgatatatctacaggaacaaatcagccaattcttagtgcaatgtggggaagcaacggctgaggaagctctgagagttagattttttccactgtgtttgactggatcagccttcacatggttttcatcactaccatcgaattctattggaggatgggccaatcttgagaagcaatttcatgactatttctttgctggcatcgatgagatgaagcttttagatttgatatcagttcagcagcaagaaggagaatcggctatggaatatattcaaagatttcggaatatctgcagccgatgttatagtttgagcctgagcgatgagcagctagcagatctcgcatttcaaggattgtcagcacatatcagagagagattcttttgctacgagtttgatagcccggctcatctaatgcagacagtatcggctcatgaaagtcgactgcacgaagcaaaggaagatcagttttggagtcaccaagacaagaaatgagataagattgaagcatgagctttcatactccaaaatttggggcatgtgttaacgccaaaatttggtaagcccaaagtcatcatcggcctaaagttagtatcggcttcagagtcttagaatcggccgatgggagtcatcaaatcggcagcagttgtgttcttgatggagtcggatcaattgaaggaaatttatccagaagagtccgagttcaaggaggatgcggcatggcaagtgtatctattaattaggaatagttcgttagtttccttttatctttatgaaagtgtgtttagtgttcgataaggactttgtgttttccttttatctttaggaaattttctttattgacctacaaggactaatatctacccatgggtataaatatgtacacccggggtcattgtaatctatcaatctctcaatcaatacaactactctcggcgcatcaccaccctctttactaaggttttacttgtcatctgacgttacttggcacctgacgcggggctgcatcggctttccatctctggcgaaggggtaagtcctacgttccgctggccctggtgaatctaccgactacattggtgttgttcaagactgcatcgcttcgatctcttggatcgctctggtttggttgatatatttgcctacctgatacctcaattctatccctaattgcattgtgtttagagacacatcggtttagttgggactgtctcggttaggtctgatcttttgtcttagccgatatatctctacaatcacaatgaagttctaaggccctctttgtttaggcttaggcttattggcctagacttttaagtcagtttattggcttatatgatttataagtcagtggatttaatgtcctaagtttagtggtggagtcatacatctatctcatataagccaaaaaagcttctccaacctagcttttggctaatagtgttagagtggcttatggcttcaaaaaagccaaataaaaaagctgcttgtttgttttggcttagacttttcgacttataagttggcttataagcctaaacaaagagggcctaaatagatttgctatatccatcatattagatagatctatcggcttaccgagtattagattatcatatacaatctcgtgctgcattggtaggttcgacctactagattgttgttgataatataaatcttgctaagtcgataggttcatgctaatgttttatcggggtgctagccgataagttatctggatgttgcatcggcttataaggattgcatatacatataagttgtatttagccgttgacaacaaaggtttcattgatttatctaatcttgtggattttatgacatcggacctccagccaatgcatgctttaaccatcggatcagtacttgttctatcatatcatcttgttagccgattagtttctactggattatattgttgtatattgcatcatcatcagccgactgcctttatatattatctacatttgacatattgccaatagctcaaaaccctatcggcatcggctaatatcggctatcgactgaaactactccatcggcttgtcagccgatcggctcattaatctactatttgcatatctaccctatagttaaacaaatgattttattcatttactcattcatcatatcacatatctaacggtgtaaaatcatccgatgtgttagatcggacgtcccacatgggcgcgtgtcggtcctcatcctctcccgcacccccccccccctctctctctctctctatttgccgcaatcgacgcgcctcctccgcatcggcgcgaccgcgcatcctctcccgcatctccctctcttccgcattcgccgtgcctcctccgcatccctcccctccgcgtcaggatcgagcgccgcctcgcgcaggggttcaccggcctgctgcaggcgcagccgccgcagttcccgtggccggcggcgtcgcacaagcggattcccttcgagatcgacctccccgtggtccccttcggcgcctcccggggtgcccgggccgggaaggagttcttcctcgccgcggccgtcgcctccatcatcgacatcggcaggaggccaccggcgccagggaggtgattctgccactccgcgcctcaccggtctccactctccatctcgccgccgccaccacgtccgccctctgccgcagatagaggtacacatcccctcacccatccctaatatgtcagctctcttccaaataagtccccccgccggctatatttcaattttattatgctgcaagtaatccgcgtcgtcacattcaatactatggtgatcatataatttggagtacatgtttagaaaaaaaaactaatgcactaaacacaatgatgatttgaatgaatcaattattgctgacgatcgcatctgaatcaatggtagtttacccttgaatgatttgtctctgttcttctatgtttggtgggggtggcattatatacatgtttagacaaataaactaatgcagtataatttgcatatgt

SEQ ID NO: 55005 - DNA, 965 bp, Oryza sativa
acttatgtggagaagccaatccatatcttggagacagataagagaagaaccaggaatcgagttatccgtttctgcaaggtccaatagagtaatcactcggaagaagaagctacttgggaacgagaagatgaattaaagtcagcccatccgcatcttttcgccagctcttctgaatctcgaggacgagattccgtttaagggggtaggtttgtcacaccctaaaaatcttaaattcataaattgttgtttaaatggaattattagaaatgattttaaaaccctagaagaaaagatctaattttaagtaataaattccaatataaaagtgggccagataaaattttattaaatacgtcacttgattctatagctcctagatttttctgggatttatttgagccaaggaagtatttttaataaatggaattgcatttcatgaataatttaaaaagaagaaggttttaaaatccttcttttggatttgggccgaaagtgggcccaagtctctctctctccccggcctgtgcacgcccggcccaagccggcccagtccgccctgctctccctcctctgttccactgacaggtggggcccacctgtcagggccgtgttcaacctctcgccgccagccgcgccctagccgtgcgcaagccgtcgccgcccttccaaattccatcgcccctttcccgatctgatcaaattgatagaggggaaatgatccctttgatctcctctatcttttctcctatagaaacttcatctaatttcgtttcgaaatcgttggattcgagctcgattcggattcgatttttccctccaaccctaaaccttccatcgccgccgtgggcctagccgtcgcctcctagcccctataaaaggacccccgagacctcttttcgtcgccaccttcgccttagctcgccgccgctcgtagcgccatagcctctagagcccgtgcgttgccg

SEQ ID NO: 55006 - DNA, 2036 bp, Oryza sativa
gcatgtcctggaggcatgtcatgttttgtcgcatggtttccatgtcggcttcagcctgtgtttcagagtcatggttgacttgtacagcagcaagcgcagtcgaggccgcagccggctacgacggggcggcttggggcaccagtagtttgcttgccaaaaggatctccgccctggtctggagtgcccttgccaccgcgactgcttcgccatgtcagccgtgttcggcacctggccagaggcggcaggagccgaaggtggcagtgatggcacaggcgcggaggcagacggcgctcctccatcttcggcgatgggcaccgaaggctctgctccctcctcggcagccatcttcccccagcttcgctttccttttgccttgtaaccttctccttcacgaccctcttcggtggcattcgctctcagtggtttcgctcggaggtccccacggtcggcgccagctgttgtcaaagcgacaactgcatacatcgaaagacatgattactcaacagtatttggaaaagaagtaaagtgtattaaattgagaatttttcttgggatccccctaatacatggccttatgagactatttatagcctcattacatgttcttactactagggttttggttatacaggggaatttacatggttgcccttatgaaagggacatttacatgggtatatagtgtaactgtagttcatgggcccctaatgggccattaggcgatcgtcggcccaatagcccctaggcttgatgggccaggatggcttctttggtccttgcgggaccgaacttgctatggcgaagtcgtctcccttcggcatatactcttcgccctacacccttcgcccaagaggcctctggcttggcgaggtacccgcgcgattccccgcctctcaccgtccttgttccatagtcttcaccatgggggggcttcgccttgactaaccttgacgtctcaggcttgaatccccattggtcgcatggtttcggcaggtttggtcgaagggcctcatgccataccgccaacaatacccgaaggtgcataatatcctaaaaactggttcttgcttttattggaaagaaaacttaccaagataatctggggtgtctcccggcagtgctttgtttatggtcacaagctcgaccatggagacatctcgctacaagattagtgccacaaatacatacgagatttgcaatatttatgataaataaaagcatccacaaccacacttctaatcattttagaaatgaggaccataaggtggttatggttctcgcacaagtaagtggtactaatcggacaaaactctgaggattctttatgtgagcatgattctggaggaaatttgaaagagaaaccttcatgctcaaaagtgtcgttctcatcctccaaagttgatgtctcaaggttgtccatggcctgcaggttctccttctcaagagatgcatcatgcaagaacaaggttgtttcttgacaaatatcgagaacaacattttgatggccagagggacaaggttcacgctcgataagaggttgtgaaggtggttctttggagtgcaattcaagggtctcaccagaatctttttaaatgaaatgaagatcatcctcttctagaatagacttaggagactcatgaagcagaaccgccattacttcctctatcggcgtattatcagggaggatgcccatcaaggttttctcataatcggtatgaggatcatccctgaatttaggagcgcaacccggagcttgaatttctttggaatccggcgatggctccacggaggactctttagtcagacccgaagatgttgaaggcttgggttcagtcttggcaaaagaaggttcctcccttcctgacacaaatgtttctagatggagttcaacatactacccgacaaatgaggtattttttgatatgcgatcgagaatttccttgccttcagcgggagttttgtgcatgaatgaccctacagcagttatgtcaaggtagagtgcagcctccatatctaaacccgtatgaaaatgttgc

SEQ ID NO: 55007 - DNA, 1291 bp, Oryza sativa
cagtagaaaagggttgatttccggggggctagtactgttccaaccgacataagactgcccaagtacttgtgaagaacgaacgagtacgaccgtagcttttagaatggggacagacctagatattatgttaattaacaatgtggtacctctgtacagtggtttcttttgtaagtcctcgcgcaggaggcaaatttacgccgcgaagggcgattgtaatatttaccgagccgcaggtaaatatttgagataaattatgatgactagtctgtttgtgaaccctgattgcgatgacatggtgtcatacaatcagttctctctaaagaccccgggagcgccagaactcctctcgctgctgataacgttacgtttagagcgcatggggactagagttcatggaacaggtgccacaattgttaataacgtaatactaggccatgactaagctaataaatattggcaactcgtggactgtgggtaaagcgtacatctactgtagtagaatatttatgaaactattcgaatagccatgctcacagaattgagtagcgggactcatatggtatttggttagaaaccaaattcaagattttactaaatactgttgcattaaagtcattacaggctttcttcttctacatcctctgctttctgcaattaaatctagccttactcaaatgctactatttcatacattattgaatataatagcttgctgagtacgttgtactcacccttgcttcaacctcacctttttcagagtcattttggagtttgtgcctaagctgggagttcaatcatataagttagtttcatttcaacctaattctcaagtctagattagatagatggtttaagtctatagccaaacattagagttaagtcattctatagcttctgttgtattagtttgccacaagtttgtaaatacccatatattttgtaataatatatcctttggagccttattcaaacgtatgcaatgaagatctagattgttgaacctatatcaatttactaatccagggcttgatacagtctaaacatgtcggtttcggaatcattagtttcgggacctgacataatcgtaggacaccccggatctttcttcttctccgggagcttgtcgagtatgacattgctgcactgctccgtcagcttgaccacctccgttggcgggagcggtcttttattgtcgaggatgtccttgagataatgtgcgtatgttggcacttgcatagcatccaacaatggcacgttgatgtggatttttcgggatcacttcaacaaaacg

SEQ ID NO: 55008 - DNA, 1277 bp, Oryza sativa
attcctgcagcccgcttgattgccacccccttttcgtattgccgaaatcttggttcgttatatgactttaaatataggcatttccacatatatacaaggcaacatcagtagaagagaaaagtagagatggagaatattatttattctatatggatatcccatatgcatataagtaccttttgttatcttctttggaaaaggtacgaattaccccccgaactatcatggccgaccgaattacccgaccccccgcaccacaaaaccggatattcttcacccccaactatgcaaaccggacgaattacccctctcgacccaatccacggtggttttggtttacgtggcgtacgcgtggcagtccattcagtattctatttataaaaaaaagttggacccacctgtcatactctctcttctctctcattcttcctctctctcttctttcagcgtggggtttagcaggccggcctctaggtcgatgcaggaggggtgccagtgtccggcgggatcgagctacagtaatgctttaagtttctttagtgataaatcatgctacagtaaaaagaaagatgttttgagtaagatggacagtcaaatatgatgtaaaagtttaacggtaaaataacgaaggtagtatatttttggacaaatgcagtagcttatagttaggcaagcttgtaagaatttagaagcagtggtgtctttctcttgggaaggaagcatcggtgatattgttatgtcttccgatgataataagctactggttcaagaaatctatttattttctgtcgattctccttcatgtctacatcaatctctacaaacaaataaaatcctagtacaagtggagatagattattctaaaacaaaatatgcattgcaagcatacctagttctactttattccgggtatattgacggtcgtaattggtttataacaaccgtcaacgcggccatgtatttcactctattgtaatcttgaaccgacatgtggggtatgagggattaggccgcccttatcttacttgttaagtaaaacgaagatagcgactaaaaccaaacatgaagttaatttaaacaaatagactaacttgctagaagaatattccttatttgttttttatgacgtcattgatatagcgcggtacaccttttgggttagtattttttaaaataaaattattccgatgacaactatatcatcaactatgtatatcaagcggcttctgaatataatttgaacctatattcaatgtaatgactactagaagtccctg

SEQ ID NO: 55009 - DNA, 721 bp, Oryza sativa
attcctgcagcccacaccaaaagcacactttgttggattcatctttaaaccatactttctggttctctcaaaaactttcctcaaatcggctatatggtcctccacctgctttgatttaaaaaccacatcatcgatatagacctctaccaacaagccaatcagatcatggattatgtaattcatggccctctgatatgtagcttcagcactcttcaaaccaaaagtcatcacaacccactcaaataagccgattgcaccaggacatctgaaagcagtcttgtgaatgtcttcttctgccataaaaatttgattgtaaccagcattgccatccataaaacttataatcttatgtcctgaagcagcatcaaccaattgatcggcgatcggcattgggtactcatccttaggtgtagccttatttagatctcgaaaatcaatgcacaccctaaatttgccgttcttcttgataaccggaactatattagaaacccactcggcatatcggcacggccgaataaaaccagcatcatataatcgagtaatttcagccttgatagcatcatacatttgagccttacatactatatattcttatttctacataatattagtaaacaattatgaaatcaaatataacattttgaaattaacatatcatatttaacaaactagatgatgggacgaccacatgacatcaaagagtatacataaaaccaacaaa

SEQ ID NO: 55010 - DNA, 1183 bp, Oryza sativa
taggaactaaccaagagataattctcacaagataaatccaaattactcaagaagaatattatattgacttcagagtaataaataaaataaaagaaataggagaatattaccgacaactccggacttcttccgactccttctactctactctcttcctattctagtatacaatatagtacaatagagcctcttataattcatctcaagcttgggagtgtgtgttgaagtgagtgagctgatgtccttatataggggtaggtacgattggcgaaggggaaatgtccgaagtgcaatccaaccgtcattagggatgcatctgggacgtccacgccaaaccccacatccaacagtggaggtggtggttcggccgaacctgggctgggccctcctggcctggccatcagctcatgttccccccggtcctcctctattcattcttcggtattttgggccgatttactgatgttttgatgaagttcacaacccatccttgcaggggtaacatttctcctcactttagtctgattttcctcccatcatcgaggtttatcatttgcaaacaaatatataccaacacatatggaatatgtgagattatgtacctatcactatgttggatgttttattatctgaactttatgcagatgttggcggtatagaattgacatttaacagccgccaacagttttctaagaccttgtcattagcagctcgctttttgcctaaagcatcagtggttttagcttgcgcaaagacgagatctttcaaggagggttggttacagaaattactgttattgttacctccttgatagaataggcgtggctggttccaccactgacctcattgtggatgatactcgttgttgttgttgcccatgtacatcgcctcttcacgggtttctaggcaatcaatcccagagtggcctgtgctgccacagactgttggtatttcttacgatcacggatagaatccgcaagcgcacggatataccgatgtagcacttcccctacgaagtattccaagggtatcgaatccaagggaacgtgtgtgtttatctcctcgtcaggttcatccgaggacacaaagctaatatgggcagagggtagagaggatttcctaatgagaaacagtgtctagggaaagcttaactttaatcctaacacaatacttcaggcactgg

SEQ ID NO: 55011 - DNA, 4486 bp, Oryza sativa
tcttacgtatgaaaaaacttgtctaaatatctctaattttattttgaaacaagccttacttgtgtggacggagatactccctccgtttcgaaatgtttgacacttgatttttagcacatgtttaaccgttcgtcttatttaaaaacttttgtgagatatataaaattatatgcctacataaaaatatatttaacaatgaatcaaatgatataaaaataattaataattacttagacgaatggtcaaatatgtgataaaaagtcaacgacgtcaaacatttcgaaacagagggagtagtacaaagcgagctcatcagtgttcactccaaccgttttaggttgtgtttagtttagcacaaagtttaaattttgattgaaattagagatgatgtaactcgcgagctcatcagtgttcactccaaccgttttaggttgtgtttagttcagcacaaagtttaaattttaattaaaattatagatgatgtaactgaaaagttatgtgtgtatgacaggttgatgcgatggaaaaagactgaaatttaaatccaaactttagatctaaacacagcaattagcaaataagccaaaacgaaccaacccaaaaatgagatgtgcatagccaaacaccatttactatcatgggcaattataagcaacccaaaaaagagaccgaactggattgagtgaagcaaactctttcttattcatcattcatagtatgtaccatgacatgccacccgcgaccgagaatatacattgccgagaggcgagagcccaaagatggacataaaaatttaaaaagaagaggtgaaaattaagtaaaaacaccgcagaaaaatagattggcgcgcttcacgctagctgcaaatatcgctctaataatctgcatgcttcggacggagaagcacatcggatatagagaggaggaagaagaggaggaagagatgagcggcggcggcaaacggcgaggaggccggcggcgagggcaggcgcacggcgacgagacgacggcgtacggagcgccatcatcaggcggcagcgtcgtcccaggtggcggcccagttggtggcgctgccgacgcggggcatggagttgatcttggtgaaggtgtcgaccttgaaggtggcgccgcacatgacgccctcgctgtccacccgcggcatcgccttcagccggttcatcgggtgctcgaagctcttgagccccccctcgctgtggaacatgcaccccaccgggaacggcgcgtacgacttgccgcaccctcccttcacgatctccctctcgtcgcagatcaccaccgacccatccgccgcgatcccccaatacaacggcacctccccatccgtactctgcatcgcgcaaagcgaatgaacgtcaatatataagaaaaagaaaagcagaacaatcagaaactgaagcttaggaactactacggcggctaaacacaactcctaacagcgggaaggggacagggccacgctacactcacaggaagttcaatttgaagcacaaattcatcaattcgattcagaaaaccagtctagtagtggtttaaattaccagggcggcgaagacggcgccggacttgttgtcgaagacgacgaaggcgaaggagccggagagatccttgacgacctggtcggcggggtaggggccgcggtcgcggagggtgcggtaggcctcgatgacgagcagcgcctcgttggtggagcggctgcacagcccgtactgccggatcaggctgctcaggttgtccagcctccccatgaacacgcagtagatgtcatccagcccacagaacatcctgtgtacacacccatttaccattattatcgatcccctacgttttaatcaccttaattattcggattcattgcctcatcgattaaattgatttaatttacctctcgtagccagagaggccattgcgggcgtggccggcgacgcaggcgagggcggcgccgccgccgaaggaggtggagaaggcctcgatggggtggagggcgtggaagtccctgaggatctcgtcggggttcttgggcttcgccgcgctgctccgcgggctgttcagctccgccggcgcgtgcgccacctgcttctggaatatggccaacattttcttcttcctcttgctagctagctccgacgaatcaaactccggcgccgacgaagacgaaagaacacgtagtactttagcttagcttagcttgagctgctgctgctgttcgttgcgtgaagatgagagacgtgtcgggttggcgagtggaatggaatggaggtgaggatagagatgtgcacggctttatagacgggatttaggatggcacgaacgcgaacgaaaatatcctatccatccctcgctcgcgcgcgctgtttgatgagcgtgttattggagtcagtgctgatgtgagaagccaaagcaagcagcgaacgggataaagacggcgagacgacgaggataagatcatcacgtaataccagttgccgctgccgatgtgacaccagtagtagtaaccggccaccttaaccgtgacgtgcggtgccctcaccccctacggtaccctgcacccaaagcctacataagtaattgtttactacttccgttttaaaatataaaaaaaattaaatagatataacacatactactaatctacatagaaaatttgtttaaatttatagtattaaaatttatccatctatataaatcttttatattacaaggcgaaaggagtattacacacctcctcgtgttggttgttgatacggttttcttccgtttctatcgagtcgctgcacgagcactgttttcttgtgaaattcctaccctgcacaagtgaggatgctgtacatggtctacacaaaacgtgattaaaaagaaattcgcaagaaagaaagagcaaagtagaacaaaagacaaactagtaaactgatgtcgtagatctgtagaacttcatgtttttgccgccggggtagccgagtaggatgaccggaggtgagcgaaaaacggaggaaacagcagcgagggacgccttttccgtgggctgccgccgttagtttggcgggagcggtttattatattaccccgtaattattgctcgctgaaccacctgtcggacacgtcatcgcctactcgaactgcgtgctcacgggggccacctctctacggcctccgtggacgcggcgtgccacgtaggctcgcgcaccgccctcacagcctcacccaccgcaactgccacgtgcgcgccgcctccttcccgtgggctggggaggtaaacgccggtgagcgccgagccgtacactgacagggtggggcccacaccgagcgacgacaaaagtgtgggcccggattggggataaggctggcacggtatggtcgctcggtacacgtcacccgcgcgtcggaccggagcgataaggtccgcgcgagcaagcggttgagccggacgcggcaccaacgtgttgtcacgtgtccgactcggcagcgagtcaccttttttttttctctcttttctctctcttgtcagggcggcaacgaacgtgtttatactagtagtaatcccaagtttgtggtcgctgttacgcgtgttaattatggtgattaaaaactggtcaggtcgatcgagcggcgagcgatgagcagttgagcacatgcattggatcaggaggcgtgactagagtacaggtcgccaggtcggtagcgctgatcttggatggccagtagattggccagacgcttatccaggccagagttgttaataatctctatattgctacttagatgtagcttacggctgacagaatcctgctgatgagatctagtatcctctaccggatcatgacagtccaaactgtgtgtttacataagcagtatggaagatgtcaacagatgctgcatcgcaaggagccaaggaacaactcgcatgaaattgttgtactagtgtaagttactccctctgtgtttcatgttataaggcattttgactttagccaaaatcaaactgatttaagtcaataatttaatatattttcataataaatttgtcttggcttgaaaatattattattatttctataaatttaattaaatttaaagtattttgactttgatcaaattaaaaaaaaatcttatgacttgaaacagagggagtactgctaagggatcgagtgcatgcaggttgccagttgtaatagttaggaattaaaaacatatttattgttatccgatggtattgtagaaattctatatctatagccttttgcacgcttactactgccacacgctcatctcatgctcgacagctccaggaatactagctagtaagtcagaaacggtcgctttcgtcgtcatactttgtaattatgccattttaattttgctccaggagtacatttctttggcatgtttctatcctacccccgtggattcttgatacttgccaactttccgttctgctttactcgacggagacgtgcgtttcacaagctct

SEQ ID NO: 55012 - DNA, 2349 bp, Oryza sativa
acgtcgtgcacgcgcgccgcctgccttgcccggcgaggcgagcgagcgcgcgcgcgcgtgtttcccctattctctccaccacacatgcttcaagtggctagtagggcattctcccttttaaggaggtccccctctcctagaataagcaatgtggtactaaattccacatgcatgccatcccatgaggtgggcttttgtgattttccaaagaattaatcttcgaatgggccttagcccatctattaattccaacaatccccaaccaaatctcaaaatcccactgagatttgccttttccaatgtactgtttatataccagcggttcgatggagaccgattaagattgaatatccacctagaactccaagctacacttactcacaacttgaacaatggactacgccttgaattgcaagtcttgtgcaagcaagtttcactcagagtcttatctggtactagaccgtctgtagactacccctcgggtggagcgtataagtcatactcctaggtctttagtaagcttcctagaagattcacccaaaatctccatagactgcgaccaacagtcaagcttacaaaggtgagttctttcaagactgctctgcaggacaacatcttcactaattaaagccaacagaactcattaaggcatagccaacctgccttgcaactcacaagagtacatgcatcttcacttagagagggtatagattggtactctcctctagtttactaatggtttgttcttcccaggttctaattcacgggatctccgatcacatagactgggttaccaccatagtataactcatatgggtctcaaacccatctccttcgatgcattatctatcacatttcgtgataatccctttcgtgaatggatctgccaggtttctagctgtttggatgtaatccaacgttataactccggagtttctcaattttttgacagacttcaatcgtcttttcacatgtctagacgatttcatattatccttagaactattcactttgacaattaccgtttgattgtcacagttcataaggatagccggcactggtttttcaacaataggcagatccattaatagatcgcgtagccattctgcctcaacagtagaagtatccagtcccgtcagttctgcttccatggttgacctcgtcaaaatggtttgtttgcaagacctccacgaaacagcaccaccacctagtgtgaagacatatccactagtggctttgatctcatccacatcagagatccagttagaatcactatattcctccagtatcgcaggatacccagtatagtgaagccccaattccatagtacgttttagatagcgcattactcgctcgagcgcacgccagtgatcatctcttggattagaggtaaaccggctcaacttgctcacagcaaaggagatatcaggcctagttgtactagccaggtacatcagcgagccaatgatttgggagtattccagttgattcttagcaattcttttgttcttgagaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaaggtttgtcccaaatatcagtatgtcgtcaacatacaagcacagaataactccctcacccccatcatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaaactgtcttaacgtccatttgatgaacgaaaagaccatgtgagcctgttagggaaagtagcacacgaattgtggtcaatctagcaacaggtgagtaattgtcaaagaaatcttcgccttctttttgagtatagcccttagcaacaagccgagcattgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttctagtagtctgcatcaggagatgcatatgcttctgaaattgacttagga

SEQ ID NO: 55013 - DNA, 1538 bp, Oryza sativa
ctcatccccatttcatgcaaataatcattttttattcagtcttacccctattaaatgtgcatgacacaccagtgaaacccccattgtgactggccttatagcccactattatccttgctcttagcagggatgctcggggatatatggtaagatatggttggatcgccatcaacgctgggaggtcagcagcggcgaatcgatcaaaatgttcaacgaatcaccattgccggcctccgtgggaaggcggccggccggctacgttaccgcaagatgattcgttggttatacgtctcattccactgatgattattgattggggctatccaaatctgacaacagttttcttttttaagaaaaaagaaaatctttagagcataactatagtatggttacagtaacttttatttaacttataaaaacagcgtgtgacacagttgacctgtagacacgtgtttgtgtcttgcagatcgtgcattctatacccaccttccatgcgcatcgtacatttttttccccttctccctgaacaaattttgatgcaatatgatactctagaaatagaaaatcttttcgacgaacaattggcgatagagttctagcaatttcattccaaattttgatgtaatctagcagttcagaaatcaaatgtttttttaataaacaattggtgacaatacttctagcattttcattctaaatttccaacaattcatatgtttaggagttatttttgaacataggaattttacaggatttttatagaaattagttcatttcataaacaaaatcccattgtattcattttagatgaggcttaattgagggtttgtaaaagttttcgctctcgcgcgtgctgtaccaatggatgtaatgacaaaggtagtgatcaccctcacttaaactgagtagtagtaaataaaaaaaacgttaatttcagactttaagatacgattgatttatgagaaggatcaatgacatgcattatcatttcgtgctcgtggctggtgacaacctgtgacgaaaggattaggtcacgctgaaaagtagtagtttggcacaacacaacaaaaacacaacaggagagaacacataatactatttttatacgatgccgtcagagatatggagctcttcgcttctgacgagtcacattagtcttatacagtaacaacaacaatagggcaattggatgatcgtggcgtagactccttcaaaacaaatcagatcacaccagatggacgtgtgaacatcaacagtaacagagcataattggttgacaagaaggcagcaatcatccaaaaccaaaacaggaaatagcagcggatgtcagtcgttgactcgtcaccagtccacctaagccaacagcaagaaaacacaggagctcacttaaaacgaggagttaaatcatgtagtagtattaattaacttgcgttaattaactctaattagggcttgatttttgttcgggttagatgaatgattttgtgaccacatagagttaaaatataaatttaaagcagtttactttcttttcatgt

SEQ ID NO: 55014 - DNA, 1558 bp, Oryza sativa
ccatctctacccagacgggagccactaacaagattcctgtcgatagaagggacatgctgcatgttcttcagctgcacgatctttcccgaagtaaacttcagaactaccgtgccaacaccatgaacagaagcatgtgacccattccccattaggacggtggaaccccgtgcgacctgataagaagaaaacaatgagatgtcagcacaaacatgtacattggccccaatatcaacccaccaattagtagactgattaactgaaaaaacagtaggtaaattaccatacccacttccatctccagtgttgccaatggtcacattagcagacttagaagtctgcgctgcaggtgccttcatccccttgcgctgtggacacttcctagccagatgaccaggttgcccacacacaaagcaagtcctctcatcctagttaggattgttgttgttcttcttcttcttcttcttctgcttcttgaaattggtggtttgttgagctttgtatttccccttactcttgttctgggccttgtgcacaacattggcacaggactgcccaccatcgcccttagacgcggcgtctttttcccgagctttctcctcaacatcaagagacgctatcaacccctcaacggagtattcctgtctcttgtgtttgagtgcagtaccgaaacttctccatgatggaggtagtttcgcaataatacacccggccacaaatttgtcgggtaagacacacttaaggagttcgagttccttagccatggtttgtatctcatgagcctgttcgactatagaacggttgccagccatcttgtagtcatgaaactgctccatgatatacagatcattgctaacatcagtagcaccgaatttagtattcagtgcatcccacaactccttagcgtcggtcatttgcatatacacctcgaccggacgatcgccgagaacgctaagaatgcatcccacaaagagagtagtggcttcctcgaattgcttctgctgatcagcagtaagaattccttcaggtttgccagtactcacctagaagcatttcatagacgtcagccacagagtgaccctgatctgccatctcttaaagtgcacaccggtgaatttatccggcctcagtgcttcggcaaaaccagccatagtaaaatcacagcgcctataataaggtttttggattgttgaaattataagcacataatgatttaatttattccataaataaatcatgacattgcagatgtaaactagattgaacgcatcattagatctacacatgtaaactaagcaataaaacatgaacaaatcaaatatgcgcaatatgtcgaatacgtaccgaggtggcggaaagtccggttgctcggcatgaactactcgcagttgcgagcgtcaacgaaggcgcaaagcacgcgagcgaagaggaaggcgagccgtcgcgaacgaacagggagcagtcgcgcgaagcgcttcccaaaaaccttattgccgccttctcccggtacaggacgtcgaaggcagaggttctggagacctgctctcccgatcgccggtgc

SEQ ID NO: 55015 - DNA, 874 bp, Oryza sativa
attcctgcagcccgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcggccatcagaaatttctctcagtggattgagaatgagcctaaggagaagtgggctctattgttcgacaccgatggatctcggtatggcataatgacaaccaatttggcagaggtgtacaactgggtaatgcgaggagttcgggtacttccattggttgctattgttgaattcatccttcacggcacgcaagcctactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcagga

SEQ ID NO: 55016 - DNA, 3412 bp, Oryza sativa
caactttgctttgttttatacttatgtttgaagtttgctctatacaggttgcggcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtcgacggtgtttttgggtggaaggaggatatcactgcgcgcttctagcaggtgatgcgccttccacacctaggaccgaccaccacccttcctccgtactctacagtcgggcctagcaaggcttggttgctccagttcactgtaagtaaataagttgttattatcatacgtgcttatttgcgaccggatcagtgttttgtactaacatttcattcttaactgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgtcctatgttgcttcagctttgggcagccgagaggtttgccatagggcgaccagtggtggacagcgcaccctacggggttggtcgcagcgcgcagtggccagaggacggtcccacgatggggacttactggtgtcgacgtggggttagtgcaacttcgctgcgttataagtttatcagtcctcttctttttttttccttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactggccgcagcgtgtgatgagacagttcggacttaggcaggtgtttcccggcaacgtgcagccgaccgtcccccctgccgaccactcgtgagttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcactggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgaacagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgttttaactgcacgtttcctcatcgcaggacctcgtatgccttcgagcgcgttcgcaggcacgaccggcgcttccgcgagctccgcaggggcgttcgccacctcttcaggcgcgttcgccagctcttcctctcacggagcgtcgatccctcgcccacacggtactttactttttattaatactgttaaatacctatacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatagaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccaatcttggagattttaatcttgtatagttttcaatataaaaagatttgataactattgatatttatataaaaaaaatatagagcacagtacaaaatcgccctcccccagggcggcaagggggccgcctgcaaaatccatgccccctcgccgccatttgca

SEQ ID NO: 55017 - DNA, 7747 bp, Oryza sativa
aaggggcccgcctgcaaatttcgttgacggccgtcgcccgagagcgaacggccgtctgccacgtcattttcgccgccctctgggagggcgatttttaaaaatcgccctcccagagggcggtaggcgactatttccgtcaattttcaaaatggaaaattatttttgtaaaacttttaataaaaaaaattataaataaaaaaaattcgccttccatgtctctcgccctcttctagacttctacatgttggttggtttgttggcccagctcagtatagagcacggcccacttcccaggttggcccatattggtagatgaacagcccatacaaggcccagtaatatatttcccaggcttgtgtccggtcagatgtcactgtgttgctctgttttctttgttgttacatggcacatcatcccagtgcaatttaatcaaaatgaatcaaattcttcgtccacaatgaagatatataaattatttccatattttaaagctgagattcgagtattcgtcggtccatctgtaagttccaatcatggacaccgaatatcgcagggttaatcatcagttcatcatggaggggcccactcgtcaaccacaggaggaaaacttaacaaaatacaaagccgcgggaacggggtgaagtgaaacatgtcacgtcttcaaatgtcaacctcacggatagctgcttagcagtagcagcagcatcgcctccagctagctctgatcatttgattctctcgtcctaatccacattttgtgctgccgattaaccacaggaaagtgagctttgcttgcaccacaaaacctgcaaattgaactatattcgaagcttagctaggtgactgattcttgctgcgattcgatgtccatggcgtccataatcatcctggccgtcgtgttcgtcctcgacgtcctcgccttcgtcctcgccatcggcgccgagaaacgccggaacacggtgagagctctcgaacgcgttgatgcatacatgtgtcgtcgccatcgccgtcgccggagacgaagccgatcgatcatctgctgcgtgctgacgatcgaggaggtgtgtgttgattggatgatgcaggcggcgtacgtgaacgtcgaccagaacgcgcggccgtactgcgtctacggctccgacgcggcgacggggtacggcatcggggcgctggtgctgctggcggcagggcaggcgatgatcatggtggcgactcggtgcttctgctgcggccgcgcgctctcgccggggcggtggcgcgccttcgccggcttctgcttcatcacctgctggtaagtagctagcatcactttctccttccataatcccatccatggatgcatctgattcttccgcgctggtacaattgcttccgtgtgcaatactgcaaccaaagcccctgggattaagattctctttcgcataattaacctgcacagagatgaccaattattagtgcaacttggactgaatcatgataggcttcaaagccaattgcatttgcatatatgtacatttggataagaccatacgtaagtaggctgtatacagtggctgactagctgtgctgtagtgctgtatactgaagaccaatatgtatggcctatttggagccttttttgtcacaaaatatactagagttgtggagctgggtttagacagctccagaactccactccagactcaactcttggagctaaatttaggagttggagctgtaccaaataggcatttggtaaaactcctactcctaaatttagctttagaagttgggtctgaagtggagctttgaaactgtataaattcagctccacctctggtttattttgtgatagatcttcacccagctccgctccaattttaaatgaagttaaaattgtttggttgagcgacgaagctgaagctgcaccaaacatacctcgagatcgatgccactggaaagaggacgggtcggctctttggatgcagcccatcttctagatgcttcctgagataatgggccgagttttcagcccaatctaaagaatatagactctcttctggcccattaagtagaagaagctacaaagaaggcccaatcaattataacattatgctctgagcttttcttcggtacgaaacaaagtatagtagcaactagcaagcactaccaccggcatccttttttcgcggtaagaaaagctgaaacgaggtggatgtttggttgtccggtgcggtcagctgtccctgtgttgctcttactttctttaattacgctttatttttggtgatgaactttttaattatgttatccctggtttcaatcaacctcttgttagttggccgatgaacgcaaacactagtagttaattgcccgatgaaagcaaagcactactagttaattgcccttcttagcaataggagcgctcagctttgcatctgtggttacaccctttcttatgcgtgtagttggaactacctttgctttgctagcataagctcatcatttgcctttcgaccaccgttaaaatctgaattttaaaacttgatattagtgttgatctgaggtttttactatggtttatcttttaaaattggcttttaaactgcaaatagcatatataaaaaagttttaactatgaagccagacgatagggacttagacgttgtgacggtcgaacacacagtactggtttcgattttttttaaggaaaaaaaaacgtactcctacaatgctactgcctccgtcccaaattagtggttgctttaacatttttcttgtaacgtttgaccattcgtcttatttgaaaaatttatgtaaatataaaaaatgataagtcatacttaaagtactttagataataaagcaaatcataaacaaaataaataataatttcatattttttagaataagacaaatgataaaaattacaaacaaaaacttaaagcgacaagtattttggaacggaggaggcagtgcttaggagtaactggttaatgtccgatcgcaggtagaggtaaaacaaatattcctccccactaagctacctttactgaccttggtgaaacacaaattaattactcgcccacgtagatggaatgaaaaatatttcctgtacctgcttttcagccaaaattattcggacgtgcaattttacagcaattatcagctgcaggccatacgatcggaacgaattctattggccgtttcactttatcgccacttttttcaaatttggtatggtaataaactaaacgctacctcaccaacaccatataatcaaattctagtagtttcaaaaccattatcttataaaaacgctaccaaattttgaaaatgcatcaacgctactaaaatctaataaaatcaggctgaatttggtaataaagcgaacaaaccctaggtttcgataataaaaaaacataggtgcctagaaataactggtccagttaaaggaaaaacaaaatattcctcctgcgccaccaagcttcctttactgaccttggtgcaaaacaaattaattactaacccacattaaaggggaaaaatattttccacacctgctttaataaaagccaaaatgcgagtacatgagcatatgatagcacatccaaatcccactcccactggcctaccgtttccaatcatccacgccgaatactttggtggcgagccgggggggcccacgcgtcagcctcagctagaggccggaggcaggtgccagtggaacagaaccaccaaagtcgcgagaatggttagagtgaaacatgtcaccttcaccggctaccaaagcagcagtgtacgtggtgcatcgcctcatctccctcgacttgctgctaagctttcctctcgtctttgacgcccccatctttccctagctcgcttgtcctaatcctcctctctttctgcaacaagaggaaagtgagagctcctcttggctcgctcgctgcacgaatcagtagtccaagttggattaattaagggaggtacgtaaattagttcgaatccatccatggcgtccataatcctcgtggtggtcgtgttcgtcctcgacgccctcgccttcgtcctcgccatcggcgccgagaagcgccggagcacggtgagctatagctagcgaaatccatactatgggtcgtcgtcgtcgtcgtcgtctgacgagagggagctggttgggaacgatgcaggccacctttagcgaggacacgagcggcaggcagtactgcgtgtacagctccgacgcggcgacggggtacggcatcggggcgctgctgctgctgctcgccgggcaggccgtcgtcatggtggtcacccgctgcttctgctgcggccgcgcgctgtcccccggccggtggcgcgccttctccggattctgcttcatcgtctgctggtaatttaatcagcaattaagcatatcacgctagctagctagctccccttcttcgttgcctccgtagcttggattaactagcccgtttgcaattaagcccttagaatttaggtttttctgcagtcgcgtccctaggatgatcaaccaatttgttattagtacgagacttggtttcagtaaattactagtactaatctgcaatggattaatgaatgagcaattttatcatccaatatttggtacctcgaagtaccatatttaccatattttatacacgaaatttgggtacctatcaaatttaagtaattttatcgtccaacatttggtatctcgagttactacgaatgtttggtatctcgaaatattttctagtgttaaatttgatatttctaatataaatttggtacatgataacttgagataccaaatgttggaaatgttagatgttaaaatttcatcaaattttacactacaatgtatcttgagatatcgaaaaattgtggtatcttgagatatcaaatgttggatagtaaaattgcttttattgaattgatgagctgatgatggtgggtggatttatggacaggttcacgttcgtgatcgcggagctgtgcctgctggcggggtcggtgcggaacgcgtaccacaccaagtacagcacgctggtgattagcgggccaccgcgctgcgcgatgctgcgcaagggcgtgttcgccgccggcgccgccttcaccttcctcaccgcgctcttcgccgagctccactacctcttcttcgccaaggcccgccacgccgccgccgtgcccccgcccattgtcggcggcatcggcatgacccgcatgtagacagagtgacagacagcaccttggttctcaatccatttgccatttgcatcccccctgacttcgacgcccgcgttgatacctcgattgctctactctgtacatttcattctcattgctcagtatctgtagtatatggagtatatctgtaactgcgtggctcatgtctctgtattttggtattctagttgagtgcgttcatggtcattaattgatcggccacctgacctgaagtttctgtgtgagatcggccacattgacatgaagtttttctgtgtaatttggggatcgatgtgttgtttgtcttgtgagccttgtgaatcctttccctgttcttgtgtcagaattcagaaacggaacatacgcacgtaccttaactttttttccttactttctgttcataattcagagactgatctggatctgttcttcatcgtgttgtgttgatcctgcgacacaaagacctgtaaacgtaacatatactactctgccggcaacacgattcgacccgtacggaatcaagaactttcaggctcgccatgctttgcctcctcccggcgaaaccacagctttgtttatggcgaaaccgcgacgcgagcaggaggcagacgcaggatagccctctgcgtgcggttcgggagccaggagaccgagatgtggtcggtgcatgccttcggcctcgccgttcgtcaggcacaacaacaaaaagcttctcacatcctctctatgttcagtgtttcagagctcaagttcagttataaaaaacagggttggtttatgatgttatccttggctgtccctgccacggaaggccgcatctttgcctgtccctgcacaatccggcaagccattgtcgctttgccctttaagtaatccaatctactgctgctactcacccttcaggtaacacatgtgtagtagtagaagaagagggtggtacaattacacagaattcagtactttttctgccggcgacaacggcggcagttgcggccggccggccggcaagatggaggagaacagaatagtgtagtgtgcatactgtcatggatgcggccgtacgccgggatgtttcttttacctggcactaaattactagcagtaggctttttcttgtttgttttggtctcgatctgacgtgaccggaggatcgatctgtctgcatatctgccaatctgcatggtcgtggtcgagcagaaaagctactattatgataatcttcataggttggcggctacggagtaaatcgcacatgatgaacgacgacttcctctcgtctcgttctgcaatagccaataatcctccctgagattatgcgattatgccgcttgtctcctttgtggatcgaagaccttgtgctcagcaaatcccggcattgtatcgatatcgattggtctgaaactctgaataatcccggtcatggtcgtcgattgaatttgcagtagcagtatgttatgactgtatatgctcatatggaaggcacgtcgagacgatctgctagtgctagctataggcgatggattatcccatggacacagagcttaaattttttgtctcaaactcatagagcttaaaattctgagaatctgctggttaatagccagcttctgagaatctagagaagctgggttttccagcttctgagttctagttcattttctggattccacaactatatattcttagaatatggatgacaatatggactgtttgggggaagctggagattttatgagaagctacagcagctagtagctatcccaaacagaccctatatacatgaccccagccatgaacatgcttgagaagaaaaggccatgggactaactagtgaagggactggacctgcatcggagtactgcattgcacgcctacgtggtccatccgtccatggatggctcgcctagcttgctgcatatcgcgtctctgtcactgtggctggcacatgatgatttttcaccaccatggcatcgatcgatcgttcgttcgatcgaacagggcgtaggtaaacgtaggtccaggaacaagacaagcaacatgcttgctttcttgctgtgaccacgctctgattattagtctgaaaagccgaggactatactgaatcatgcatggagattgttgagtggtggtaggcctgaagaacaactgctcccgctggcccctgcctttctagaatctagaggagctaccacctctgaacaacaactgaaagatcttggatctgtactgctcctagggagcaatctaacccataccttagctgctatttgactactgtgctaataatcgaatcagtactggtgtaaaatccgcaatcagggcattctgcctccacttttctttacaggtaatcaggaatagttgatattccgaaacctgcaaatattccttccgttgctctttgcatcaaattttgttttctgcgtatacatacgggtagtatttataacaagaaattaggtaatcagtgtcgtgtgttttgctttgcttccacgctaacctaactggatgtatgtataatatgtatgccacctgt

SEQ ID NO: 55018 - DNA, 4146 bp, Oryza sativa
gccaacaccatgattgattgattcctctgaaatctgaatctctgctggtttctaggtaacgcgtgaagtgaactgctctccacgtaattccatccgtcgatctcgtcctacgtgcgggcacagcaccggagtgcagcatacagctaatataatgttcttaaaaaaaaaactaacaaaggaggtgtttagatatagggatataaagttttaaggtgtcttacatagggtgtcgtatgaggtgtttaagcactaataaaaaaactaattacatagtccatcattaaaccacgagatgaatttattaacctaattaatccgttattagcagatgtttactgtaacacaacattatcaaatcatggaggaattaggcttaaaagatttgtcttgcaaattagttgcaatctgtgcaattagttatttttttagtctatatttaatatttcatacatgtattcaaacgttcgatatgatagggtgaaaaattttagggtgggatgtaaacatggcctaaggctgtatttagacaggggtataaagttttggtgtgtcatatcgggtatacggacacatatttaaagtattaaatataatctaataacaaaacaaattacataatccgctagacgaatttattaaacctaattaatccgtcgttaataatgtgtactggagcactacattgtcaaatcatggcataattaggcttaaaatattcgtcttgcaatttacatacaatttgtgtaattaattatttattttttatttttaatactttatgcatgcgtccaaacattcgacataacatggtgtaaaattttgcgaggggatataaacaagccttaacataacacccctaccatgaacctttgcgccttcgatttctccgacatccgctgctagctgcacgcaatgcaattattttgcctaatccatactacagtatcataactctgattcactgtaactattatatatactctgatttttcttttaaagaaaaactctgatttcaatcttcacaggtacagcacctaagttttttttttcttttcaactccaccacggaaatatgctactctttccgatcaacgtttaggataagatttgattgaagttttcccaataagttcatttaatgtggggagtacaaaaccctcccatcaaaacccgtcgggtgtgtttagttcgcgaaaagaaaatttttaggtatcacatcaaatgtttgaccggatgtcggaaggggttttcggacacgaataaaaaaaactaatttcataactcgtttggaaaccgcaagaagaatcttttgagcctatttaatccgtcattagaacatgtgggttactctaacacttatggctaatcatggattaattaggcttaaaagatccgtctcgcgattttcttcctaactgtacaattagtttttttaatttatatttaatgctctatacatgtgtccaaagattcgatgtgatgtttttatctaaactggaccttcatctgaaaaatgaaattgctagtggtacaaaacgtgcggcactgtgagaggcctaagtgcacagtagaaacgatgtgattggttgttggagaggggaaaattactggcaaccacacaaagagcgatactactactccattgatactacacaagagttaacctaaccacgaacaaattcttagcatgaaacattattagcatcacaaaattaataatgtcataaaccaagacatcttgatcctaggcaggatatgtatcctatgttccatgcctcaaaatgacgcatgcacatttcgcattatctaatcgagcggtccggctaattttggcccgatacctccccgggggccccacctgtcattgtccccagcccccggcaaggatataccctccgatccccctgatactagggatcagcagcaattttgccacggcggcgcctccatcatcatcgagtcgagtcgagtcgtctgcaaagtccaaagtcgagggagatgagagaggagacttgttgatccaaatggcgccctcgttgttgtcttcccaactccaactgcacgccgacgacgtcgcaccccgcacgaactagacaaacacccacaccataatccaaaaccaaaacctcctcgccacatataaatccccatttgcgcgcggccgcctcgccggaggggagggtgtcgcaatgccggaggctgcggcggcggcggcgggccacatggatccggttggcgacgaggcggcggagaggagggagatggaggagaaggaggaggaggaggaggaggaggaggaggatgaggagttctacgagtcgctggatcggatcctgtcgtcgtcgtgctcgtccacgtccgcctccgacgacgacgaccagcagcaccggcggaggcggcggcaccacccgcagccgcagcagctgtcgtcgtccgcgacgttctccgcgtacgaggtctggatctccgagccgacatccgtcgaggagcgccgccgcgtgctgctgcgtcggctcggcctcgcccacgactccgagcccgtgccgcacccgtccccacgcgtatcatcctcctcccctcgttcgccgaccccttcccccccgtcctcgtcgccgcctcggccggctcccgtggtggccgccgcggaggagcccagatccagcggccacgggaagccgccgcttgcgaggaacccgagcggcggcgcggagcaatgccggatccggaacctggacgacggtacggagttcgaggtcggggaggttcacgatgaggtggtccgggaggtcggcactggccggcagctcaccttcgaggagttcgagctctgcattggccgctccccgatcgtccaagagctcatgcgccgggccaccacagccgcatcatcctccacctccgaccacgccgccccagcatccaagccacggaggaagcctggaggctggctgcgtggcatccggcacctggcgggaagcgttgcatacgggcgcagcagcaccgatgagagggacaaggagaaggagaaggagaagaaggagagggaagcgcggcgcctgagctccgccaccgatgacagccttgacggcaacggctcgcgcaatgcagggagggtcagggtgcggcagtatgggaaggcgtgcaaggagctcaccgggctgttcatgacacaagaattggctgcccattcgggctcaatctggtgtatcaacttcagcttggatggacgataccttgcaagcgctggcgaggaccgtgtcatccatgtgtgggaggtatcagagggagaaagaaagggagaattgctcggggaaggtacggtggcaagggagaacggtggtggctgcagcccgtttcttgcagctgttgggaatggatcgccggagctggcaacattgtcattgagctgtgctgacgggggttttgtggagaagaagaggaggccaaggatgcaaagcagccggaagtctgttggctctgatcatctagttgtgcctgaatgtgtgtttgggttcagagataaaccagtatgctctctattgggtcacgccgccgatgttcttgatctatcatggtccaaatctcaggtgcgaactttgtgatctttcgattgaatgttaaactgttaaatcataacttttggcactctggcatatgttctaaaaaatcacaataataaaccatcacactgccttgttcttcagggcaacaaggaaaaagttatgtttcgttttagtgttgtctagatagtaggacagaaaagaagtcgtttgttgttttgatgatgtttagtacggcagtaaggcccgcattgttaaaaaggctaaagatcaaatcaacgggctatttggaaaacaatgcattttgtcattttgccatagtaattgagcgtaggcttcagcatgcaacatttggctacatcttgctgatagaaaagtgaaattggttgagtggttgttgagcactacagttttgcactggtgaaagattcttgcactaggcgtgaatttgtttcaacttgctaggatggtctattctttgacttcattggcctgtctgtgaaatatgtatcattgccatgcctcgtaacctgggaaacagcactcttacttgatcctaatcttttcacacttcagctataaagat

SEQ ID NO: 55019 - DNA, 866 bp, Oryza sativa
caaaaaaccaggtaacaagcatttatttcaagcctactacccagtagtaagcattgtgggaagaggtagtagttaatacctgatatttgtgctattgccggtaacaaccaaataaaatatgaagattctgacaggatccaggtaatggagggttgggatggatggattttttcaggtggaccccaccttgtttaccactacactcatataagcattgtgagaagagttgcagcttactacctcctggtcatgggcccatcttatttactagttgggtaagatacattgcgcatgccctaacaagtaaagaacccaatgcttttgtagtttgggcctttttggtggaaaattttagacgagatgattttcatttgcgttcctcgacgttgatcttgacaagatacggttcgatttgccatgtactaagtgttatgtagacgttacaggatatgaagacaaagttaatatgttacgtaagataaactatcttgcagttaagcaagatactcaatttatactggttttgatggtcagcggatgctctgtatgttgaaattataagcacataatgatttaatttattccataaataaatcatgacattgcagatataaactagattgaacgcatcattagatctacacatgtaaactaagcagtaaaacatgaacagatcaaatatgcgtaacatgtcgaacatgtaccgaggtggcggaaaaaacggttgttcggcaggaactactcgtggttgcgagcgtcgacgaaggcgcgaagcacgcgagcgaagaggaaggcgagccatcgtgaacgaacaaggagcagtcgcgcgaagcgcttcccaaaaaccttatgccgccttctcccgg

SEQ ID NO: 55020 - DNA, 13379 bp, Oryza sativa
  unsure (1)..(13379): unsure at all n locations
aaccttctccttgttcaaagctacaaatcagcacatgttacttcttataaagttacatcttaaacagatttgccattgttgatgaaattgtcaaacttgatgttttgccatttgttatcttaatgctacgaattgtagcttatatgttactgttgtttttctagatgcnncatgccctctaatcctattattgcggcatcggaagaaattatttccttccatgatgtggatatcgtaacgccatctcaaaagctattggctacccagttatcttgtgatgtatctcaaggaaaaagccttcttgtgactggtacatcatctggcagcttttcgtcctagcttttatttactttcatgtttacattatatgttctaatatctatcatgctgttttcttaaggcccaaatggcagtggcaagagctccatttttagggtgctccgaggtttgtggcccatcgcttcagggaggcttaccatgccgtctgatggcatctttcatgttccgcaacgtccgtatacttgtctaggaaccttgagggatcagatcatatatcccctctctcatgaggaggcagagttgaaggttctttcattatacaaatcaggttagtgccagctaactttgaaaaggaaaaaatatctgcctattttaactaatgaatttttaagcactcctttattttgattatggcttttaacaaacttctatgttgaccatttcctgttctgttatgagcaatgtatttgttggtaatgtaacatcacacccttatccttgatgatgtaggtgacaaggcaataacttctgggtcactggatgatcacctgaagacaattctagagaatgttcgattggtctatcttctagaaagagaagggtgggatgctactcctaactgggaagatattctatccttgggagaacagcagaggctaggcatggtcagtgattttgcttcagcttatatttgttgtctaactaatttccatttgttttttatggatatatacctttactaagtgggtaataaatgctttctttcgttttttatggatatatacctttactaagtgggtaataaatgctttctttccaggctcgtttgttcttccactgtccaaaatttggtatcctagacgagtgcaccaagtatgtagcgtatagttttttaatgttctcatttccattttttaccaataaatgcacagctcttataaagcatactcattgcagtgccacaagtgtcgatgttgaggagcatttgtacaagatagcaactagtatgggcataactgtcatcacctcgtcacaagtaagtatcatctagatacccacttatcctaactcttcaaatggtgaataaaaaaaaaacatggttttcatttctatccattttgtttctagttgatggtattttgcatcttaagcttacatctttgtcagaagtgaaatttgggttgatgatgcctttctctcatttattcatttgcagaggcctgctctgatacccttccattcgttggagctgaaactcatcgatggtgaaggaaagtgggaactatgtacaatcaaccaataattgatgtggccaacttgaatttttgacgagttttcatcaagtgcctattcaccagtggctgcctttacaagccatgaagaaaataccaattcacattaggagacttgcatactttcacgcagcatatgcgcttatacgagattcttttttccttggttagaggtttgagatatagcaaaacaacatacaggagttgtagagtggaaaggtagatattgacttgtagcccctaagaagatagatagcgtagtacataatttgtccttccagcctaattgattggcttgtagcaattgtaacacggagcacgaagtgtgcccttgcaaatgttagctcttttatatagaaaaaatatcttttattttgttatttcggtgttatgtttttttgttccatgtcagttcagctatatactagtttgaagtttgaactttaacttgtccgattccagcatctggtacatatctagggcctgtttgggggagttttagattttagattataagaagcagctgtttggtagccaacttctgagaatctggaaaagctctgaaacccagcttctggctttttagttcatttttttcagaatctgtaattacagattctctgaagctgtggactgtttagggcagcttctagcagaagcagtttttgagaaaagctgtagctgggataagctcccccaaacagggcctgagccatacacgaaatggaacaggaatataaatttgaaaattgctatccatccttcgcccgatctttctgataatcgtcggttgattttgtgagaattggacgcaacgtagtgattcgtatgcgctccggcaagcttatcttcttcagtaatgtagtgattctgattcacgatttcgcatgtactcctgcaggctgcgtttgatttatcttattggccaaggctctgtttagatctcaccttataattttttactctgtcatatcgaacgtttgaacatctacgtgaagtattaaatataggataaaaaaactaattgcacagattgcgtcacaggacgaatcttttaagcctaattgctccatgatttgataatgtggtactacagtaaacatttgttaatgatagataaattaggcttaataaattcatctcgcggtttacagacggattatgtaattagtttttttattagtgtccgaacaccctatgcgacaccctattactatataatatttgatgtgacatgccaaaactttatatccttggataaacaccccccaactattccatcgtttttatgagtactatttctctaaatactaaatggtttgtgagctctgtttctcaaactaacgttttgtacaaaagatatttataaggaggtttattaaaaaaaccacataaatttattttttttaagtttatagcaatcaatataagtcctccctccgtcccataaaaaatccaatcctggagagaccatctgttactactatctccgtcccagaatataagaagttttagagttagatacggtattaaaatatgtaaaattaaatgaggaaagattgtgatttgttaagaaatagaggtcgataagaaaagtgaatggtttagggttgtgattggttgagaagggaatgttggcgaagaagttttgtattttgggacaaattttaagtgctaaaaaaaatcgttatattttgaaacggagtgagtagcaccgaaaataagctgtttttgtcacccgtgagagcatctcgagaaaaaaaaacatgactgtctcaaattcgattttgagcgtttttcgttagaacttggtttttgtagccgacgattaatactacaagagatcgtgtaaagtccgaatcacagcgtattaatttgcttcacttttcacatggaaacgaacgaacgaaacagagtttgctaaggcttttgctgagagaggagcacgagcaatccctgtgggccgacgaggatctcgctggcgaagctgacgaggccgaaccacaccaccggcgtgacgtcgacgccgccgagcggcgggatcaccttcctcgtcacggcgaggagcggctccgtcggcgcgtacgccaccacgtaggggaactccctcacggggagcctcgggtaccacgacatcacgatccgggcgatgaacaggaacccgaacgccgacagcgccggcccggccaccccgatcgccgccttcgccgtcgctgggtccagctcccctaccaccgccaccgccctgcacacccactccgccacctcctgccactgacgctccggtgcagcagcagcagcagcagcgtggcattggccggtcatggccgccgccgtcgtcgccgcggccacggcgagctggccgtgtgaccctcgctgctgcttcacatcgttgcttcttctccttcttcctccttgtgctatctcgatgtcctgtagtttggagaaatcaatccatgtcgatgaagatgaacaaattaaacagtgcatcggcggtgatcgatccagcaaccaagaagatgattaccttggcggcgctggcgacgatgcacctcctggcggagaagagcatggacactgtcctggacatggaggcttccatggtcatggccacgaggaggagaggccttccttgctttgccttactttggataaggcgaattgaagagccaaggtgggggagggaagaagacgacactgcccgccacgttgctctttctactgggcctccaattgagacggcctaagcccactggcgatgcgaccaaaaaaaaaaacaaaaaccctacggcccaacacaagcaatcgtctcccaacatcaccgcggcggcggcggcggcggctttccacctccccgccggcttcgcgctcccaacctcgccgtcgttcgtcatgttccggctgcgctcctccgctcgcctgctgagagaggtgagccagccaccggcggcctgctacttctagttctagggtttagcgggtgcttctcgcttacgatttcagtatggcttgtggttcgcgttgcagctacgggaggcgtcgcggtcgtcggggcgccgccgggaatggctctccggcggcgcagtagcctccgccgcgcggacgacctcgctcctgcaccctctgcccgggctcgacgtcccgcagtgcctccccgaccagctcggcgtccagcccacccgcgtcaccacgctccccaacggcgtccgcgtcgcctccgaggacctcccggtattggatactctatgttcctctgctgtgctgcggcggcggcggcggcggcggcgacgaggctgacgctgtgtgagggtttctggcgcagggcccgtcggcgtgcgtaggggtgttcgtggattccggctcggtttacgagacggcggagacggccggcgtgtcacacctgctcgagaggctgtccttcaaggacacggcgcaccgcagccacctgcagattgtgcaggatgtggaggccaccggaggaaacatcggggcgtctgcatcaagggagcagacggtgtacagctacgagactctcaaggcctacttgccgcaggccatcgaggtgctcatcgactgtgtccgcaatccattgttcctccaagacgaagtcgagcgacaggtgctggactcatggatagactagcctctaagatacagcttattactagctatttgcagcgcactgattatggttgtttggtttatcaggtggcctttgccagagaagaagttcaggagctacagaagaaccctgagagatttcttcaggaatcacttaatctagttggatacacaggtgctcttgcaaatccactagtagcccctgaggagagtctcacacgaatcaatggcagtattattcaaaagttctatcacgtaattctcttgcttctgtatcacatttgacttataaattactcataaatgcgactcaattcatgctgttcgtagtttccaaacgatgctaaaatgcaagtgtagctctatctctatagctcagtgcctcagttaacaaatttatgaaaaaaaaatctattactgaacaggagaacttcactgctgatcgcttggttgtagcagcatcaggtgttgatcatcaataccttttagatgttgcagagcctttattgtctgattggcacaagggctccccagtggaaaggccagagtctaagtatatcggtggggattttagacatagagcagactcagaggtaatatacttcccatcaacactactttgcctattcttttggggtttccttttgctctaaaattgaaaccctgctcattcctctccctgcagatgacccatgttgctttggctttcgaagtgcccgggggctggcttgaagagagagatgccacaattatgactgtagtacaggtatacttaatgagtgggtatttactaaaaacaatctggcctatgttgacatctgcatcccaactgcactttctaacatatatccatgaatatgccaaaatattttgtagactttaatgggcggtggtggttcattctcttctggtggtcctggaaaagggatgcattcacggctttgtaagtaattatctctcgacaaccatttgactttagtaggattgcaaattgctacaatatggaataatgaatatagattagattgtgcttttaatagccgttgttgtgtaattgctgcttttattttgccgttttagttatttcagttcctaaagttttttttttaaaaaaaaggctataagttgaactgttatttctttgcagatctgaatcattctcttgacaaccatttgatagtaggattgcaaactgctacaatatggaataatgaatatatatttgattgtgtttttaatagccatttttgtgttagtgctgcttgtttagtaccctagtttttttggccgttttagttatttcagttttttaagtttttttttgaaaggctataagttgaactgttatttctttgcagatctgcgtgtcttaactaaataccacacggtcgaatcattttcggtatttagcaatgcatttgatagaagtggcctctttggtatttacttgaccacggtaagctcatctttatacattattctgtgcctcgaattaaatagtgaattatatgaaacatgttgcagcttctaccttgagttgttacttcgtcattttatcaaattgtgtgagtaggacttcaaaagggactagagctggcaaagtctgctttttcaaaattttgaagtgccattgcttcagttcgtttttgagtactagaagtttgaaatactttttttttgtttttttattggtccagccttcagattttgttgcaaaggctgttgatattgcgacaaaagaactgattgctattgcaacacctggacaaggtatatatcatctcctgcttgccaaaactgcttcagcatccactgaagctacctgatctgaaacttgatgcgatttgtatgtatacagtgacagacattgaattggcacgagcgaaaaactcaacaatttctgccgtgctgatgaatcttgaatccagggtaattttggaacccccatccccaatacacacacgcgcacacacacacaaaaatctttctgacccttttcacaggtaagtaacctgctttagtgtacttattttaatttgcaccaggtaattgttgcagaagatatagggaggcagatattgacttatggttgcaggtaaggcaatatctttcacacttcattttttagaagtcttccgcacagaaatcattgattcttttctattctgtcaccacaggaagcctgttgaccattttcttcaatgtatggacgaaatgactctagatgatataacagcttttgccaagaagatgttgtcttcaccacccacaatggctagttggggagatggtatatatgctttatgaatttgcgaaaaatatgaatgacacaaaataagaattaatgtgagttcattgactctccttctgcagttgataaagttcctccatatgaatttgtttgcaagaggttttgaagttctccgacacaatgatcagtggtggacatgaagatgggattttgtttacaatgttgtataatccaattctcgctatatttgggccttatcttagaaattgccctcgttatacacatcacctgatgagattagatttttgctatcatcttcaaacagcatatatcttgtgaaagtccaggtcaaacggaggtgaaagttttgcaatatctctcgaagcaagtttagcgattcctcgtcttgttatgcaaacatgcatatgcacttgtcttattgagtgctctgtaaacaattttcacggcgatgatatataggggttacggtgcggaaattgacaggataatggcatggccttgtttcgacaggacattatgttctcggactgactggtttgacttcagttgctaccgtatattttgtgtttcttttaatgtatggcaaagcaaatcttcagaaaaaaactagtacgaaatgttgcgtctttgcttaactacagagttggataataatggatgaaaagcaacaacactgttgagttcagggaaattgagctccccatcatctgaacttttacaaaacttccaacctgaacttgtacaaaattttcaacacttgctgcaccgacaggtcagtttgcacgtttgaagtgacaaaacaagcagatggtgcatacaaaagctcggcttgcaagtaaagccaaaataaggagttccaacattccattaagcattaatcgccagtcatcagactcgcagctcattacaactaatcccatcctgacagtgcacctgatcctacctccggcacagatgatagctgctcaagagctgacgagccaaagacggtgcctttggctttcttcttcttcttggtgtgatcgattaccaggccaccaaattttccatctcgggcaatttcctgatttttgcccttcaactcaagctctggattgttgccttcaccggagaacaccaagtctgcaaatggcatttctgtgtcatcaattccgtcggcgttcttctcttccttcttggcagattttgtcctcttggctcccttactaacctttttatcagtatgatcaacagaagagttgtcatccttcctctttgatttcttgttcttgacatgttctacagccgctttttccttcttcatttccttgccatcaagcagttcagatttggctggggcagcaatggtgacatccgggcgagtactttgtcctgcaggttcttcagggctcttaatttgttgctttgagtgtttccccttgcctttcttttttgtataaatgtcagtaggaccatcatcaggcgtatcagcatcattgattggtagattctcttctctagaattcttactcttggagctggcctccatgggctttgagttaaatatgcgtaggttgggaactaatttcttaacctgagaaaacatccagagttactccagaattgcatacatacagaaaggcagaaaataaacggtattaccttcttggctagaccgtctttctcagcaataggatttccctgcaagtttaggttcctcaagtagtgcaattcagaaaggacctaacccaaaaaaaaagaaaaagaatagaaaaaagatagactgagacagtgtaaagatattatgaatgtagaagggtgggagaaaattaatcagatgcaaacctccaaatctgatctcctctcaattaagttgtttcctaaatcaaggttcaaaattttgacattttttgccaggtctgatggaattgtctgtgaatcagacagagttcagcaagatgttacagagtgaccaagtggaatgtaacatgctttcgagcagaaaaaaaaaacaatgtgcaaaagagacccagacatatgctatccataagtccatatacatacagtgatcttgttgtgagcaagtctaagttccttcagttccacacacgcagtgagagaagaaccaattttttctatctggcagtgagataaggatagctgaggaaggtaatgacaaaacattagtcatgtaaaacaggaaaaagtgcatattaaagctgataggtcttttttttttgcaaaactaaataatacaaacctttttcatggcctttgccttcatcaaagcatcaccaatagtgaaaataggattcttggaaagaactgcagcagaaaaacattcagaagtaaattaggtggagggaacatcattattctttgcctgttccaaactggactgtaaaacaactcttttgttgggtgatgggtttgtactacaatatgaaaactgaatatggatgatttataagaaaactggtattttacatgcagaaagaaattgcaatgggcaaggatcttaatgttaaggttcccaaacttactatacttacaaaaactattaacatccttttggtttatcaaaattatcggcacaaatcaagaccatatcatttaatcattccaaggggaaaaaatgaattctacaggatgaagccactcagttcattctataattaattgagatctcactatgcataccaagtgtgttcaactgatgaagctggtcaagtttgcagatggaagaaatgttgttatctgcatgagaaattacagagatccagtcatcaagctaccagcagaaacaaaatacaactgacaaaacatagcatttgtgcatagcattaccatttagaatcaatgctcccaggcttgtcaaagatttgacctcatccattgttttaagtttattcttgccagcattcaatacctgtacaacaggagaggagcaactgccaatcattgcaagtgaagtaatcaggctaagatccttttgcggggcagagaagtaactcacctgcagctttgagaggccttcaacaccttttaggctcacaagcttgttttcaataaccgaaagccacttcaaattggcacagtttgatagacccttcagcattcaaaaccacaatgtgagtggaaaaaaaaaagatactctgatgaacacagccacagcaatgatttaatggaacgattagccatcaattctctacttcaatgaactcaaagaataatccagaccgaatgggacatcaaattagtccattatatgactttctaaaaggttattacgggattcatccttttaactattcaatgtttcagatggatttacccagtgcctatgcttgtagagaacacagtaacaccgacatcgcatatatccatacaggtgaaattcaccaagaatctacaccgatgctaaatttgttgtataaacatgtgcatttctcactagaatactgtgttttaacccgtagtacattgactagttacctcgagagtgaggaggcagttgtagccgaggtcgaggcgctccagattcacgaagctgctcaggcacgacacctacacaaaaaccaacacagcacagcaccgcacaacacaaggatgagaaaacatggcaggaaaaaaaacaccaatcgacgaggcagaggctacacagcaccgacgtcggagagggcgcggtgggagaggttgagcgacgtggcgagcgtcccggcggatcccgcctcgcgcttcgcctgctccaccgtgagccgcgccatctcctcctcctccggccgccgccgttgaggagggcgaagcgaagcaagcgctcgttgcggcggcaggcgagctgagctctcaagtctcaaagacttcaagagagaaaaataccctaacctaacaagggcgatatgcagctgacatgtggggcccactgtcagcctccacggagtatttctctctcttctcgttagagaggggggtaaagcgcaagagactcgcaacgcaggtcagagcggaaggggagaagaaggaggtgctcctctcgagtttggagaaaatttcccccgcagaggcctccgcttgctcgcggagatggcgatgaccgtcgaaggtgagggtcgctctgagtttccctcccccatctaagatttgctcaattgctagtctggttctgttcccgatttcggcgtcgtttgggctctccgattcgagtgtcggggtggcgggggattgggcggctagggttccggttcgagtttggtgttacgattggctggtgcgtgctttacggattagggcgtcgggttcccaattcatcgcgcatggtttgttgtaatgcttgtgaagttaaactttcccagatttagtcttggcattcggtgaacacgattatctgtttatatgtcattcatagaatcagagtgaattatccctgcaaaaaaaaaaagaatcaaagtgattagatcctccaagttagcaccttgtattgggtcttatgttttgccagtagatattgtagtccggcttacctacaattgtgcatgaaacactatcctgtatttcaactcatctgcatcctcccgagtttccaacagaacaaggagcataagccaaaaatatgcctgcaaaaatgtgaacttaaccatctagctcaataacaagtgtccctcagaatcgcttaactgatacccatgagcatttactatgtgcatttggttttgagttctagctctaggatataaattttaccatgtgcatttaaattattttggttgtttgctaccaacctgaaactacactgcttctgagatgtatttggatatcactttcttcaatttattgctaaaagcatacagtgatactgaagcatcaaactacatggttttgattcaaaatttgtaaccaaattctacttatgattcatggaactggacaatttgaagttaacatggagctctgcacatgcttgatgtatgtttagtccatcaaaaaacaacatcccagatcaacttatgttcttctttcgacctttatttgtgcaacctcatgttcataaaaaatatcatcgaacttgttcaaaagcacttcgaaaaccatgtcgtctttagattagcctttatgtagcacaacaccaaagatgagcatgaccatcctctgaagaaaaaaaaatcatgctgaactattaagcctttgaagtgtttttagctaaactgggaggaagaatatgcattaaattatggttatgaaattcagaccagcttgttgattttatagaatagtatttcatttgcatagagttacctttctgaaaatacagttcattttcactatcagctatttgttagactctagtgctccttattaggtcatgccatcatctttgttctcctgcaattggtttgaaagtttcactaacttaatgcttcttgtctttgcttttatacctttctgctggatgatgatgatgatgtcacttatcattgatgtgtgtcttgacagtgtaagtatattattcagattcttttctgaccattcttttacatttaagataagtgttaacaatataattgcttctactacaggctcgctggacttgcatttatgttctcaacaagtattcttttgcaaatactggtacataattctcacttgtttaaatctccacctagcctcttttatttgctaaaattcaggcttctgggtgctttgtttcatgacagttgctatttatttactcactaactatttcattactttgagaagtgagaacctaacagtttgatttggcattttgtttgtacaattcattcatgcacattactctgtatgtctgtcatgctaattatgttgtgaaattcataaaacttagagcaatctggagcatcaattgctgtccagaattactgtagaagagtatgcgtgctagaaataatacttcacagtca

SEQ ID NO: 55021 - DNA, 2397 bp, Oryza sativa
catagagtacgctggatgaagattggtaaaaggctcgaggcacatggacacaagaaggtaaatctgtttcatggtttgcttctcagcacgtacaagagaaattccttagtggacactaacatggacatgtgtacaaagaagcaaatatttgagttggcgtgactgtctgtataaatgctcaaagatttgctgatctagcgacaatgccaatgttctatgtgcacttttcatgtgaatactcctcacatgatctatgggcaacctgtcagccatccgtgtgaaatgcgatcaaacgagcaggcaggcgccctgtttaattcccttgattggttctttgcattttgaagcatttggccaccgtgcggcagctcgtctcctgctgcatctctccaccgtttcgcttctctcatccctatcccgcgccaccgctcaaatgtcttgggctttaatttttctgtgttatactgttctcgatcaatgcgattaattttagacatgtgcttgttctaaaaaccaattcatcaaatcaatactggacagtttttactacttgggtttgaagatgaagattttctttttggaggggttcgattcagaattgttcagaattcctaacctcttctccctcttttcaaaccatctttttattataagaaaaaatactttaaaaattatattaatttatttttcaaatcatgcgttaattcatcgctccgttttttatgtgtatggatgaagttaccaacttcttcaaacggtgcgttcctatatgatatttgtgctgtaaaacaagcagagatatttcacatagcaatcgagcattcagaattttatttaccggccaaaaacaggtaacctctgtcctcttctcagctccggcttgtttttctttttagcgtttttaaaatgtctttatgatttataaataacaatccgcctaatcacaacgaagacagtttggccgagtggtctaaggcgccagatttaggtctggtccgaaagggcgtgggttcaaatcccacagctgtcataatttttcttccttctgattgattttgatttttaatcctctggttttttgcgttcccagatatataggttccgtgctcatggattttcgttctggtgaaatttgcaaggattttcaaatcgtttaaaatgttatcatctcagcgatgaggtaataccgcaatacatcgagcacaacaacccggagagaaatgcagaacgtcagtgtgtgtagctatccagtgaagatgagattttcagtagttcggtcagaaatatattctagtggacacggttttttcccctcccttttcctttttgttcttttttttttgggggggggggggtggggagtggatagagttcagacagcaaaacaaataaaaaacaaaagaaaatcacaagaggattttgttgacagactgctgctgaaaatcagagtccatggtcaaaaaaaaatagtttttctgcaggaagacccctgaagaagtgaagagagaagatttagagaagaaaaatgtacgagagaggagaaagacagaaacattgggagggtaggcaaatcaggaggcgaggaagtagaagaaaccttttgcaaagtccatgggacaagcaagaagtcttatgaaaatatgctaaatgatgcttagctggctcaaatagattcttcaaggtatattatggttgcagacagttccatttttttttcatttagaaccttattttgcataaatttacattaccaagtcaaacaaactaagtcatgctgaaccttccttaagctggtatgctccatgatattgcaacaaagcaaggtctaaatggaaactgaccatcctgttgaagtaaactaagtactgaatgcttagaaaactcctgtttggaccaatccaagcaagtttcattacttttgtactgctgggtcaccacgccaacaagttaacaaagtctttcacacatctcacatcgccatttggccatttcctctccaatggtcatggccccaataccccagccatggcatcagtggccctttctcatcctcttcttccttgtacttttctcctgtgaatctaatcttccctgcaggaatggtgtagaggccacacagagagtcttcctctatccacagtctccaaaggtctcctctattgtcagcaagggatacagaactggatatcacttccagcctccaaagaactggatcaatggtatgtctgcatgttttccatcagtttttacccttttgactttggctgaatccaaccagaaactgtattatccaatttggtgttccttttgtttcttgattcaagaagaaacagctgccctaattagttagtatcttttctagctgcagaagttaagccgtgtggatgagcttaattt

SEQ ID NO: 55022 - DNA, 15552 bp, Oryza sativa
  unsure (1)..(15552): unsure at all n locations
ggcaaatttgtggcaattcaaaagatccaaacggtacgcatcttcttcacataatatgcatccaaacaaattgtagaataaactgagacattgcgtgcctaaattatctcaaaatttacagggccaatgtactacaatggcatctaccatgagttctaccagtataacccgaacggatcagtctggggtaacatagtttggggccactcggtctcgacagatctcatcaactggatccgtcttgaacctgcaatagaaggaaatactccgagcgacataaacggttgttggactggttcagcaacaatcctcactggtgatcaaccggttatcatatataccggtgccgacacggagaagcgtcaggttcaaaacattgtgctaccaaagaaccggtctgatccttacctgagggaatggaccaagccaaaaaacaaccctttgatcgaaccggtcggtccgggtttgaactcaaaccaattcagagatccgacaaccggttggataggaccggatgggctatggagaatagcagttggggctgagctgaatggctacagtgcagcacttttgtacaagagcaaagactttatgcagtggactagagtagatcacccattgtattcttctaatgcatccaacatgtgggagtgcccggatttctttgcagtattgcctggcaagaacaatggactggacctctctgcagctatcccaaatggcgccaacatgtcctcaaaatgagcttggatnnngtgacaagtacatgattggggtttatgatctgaaacatgacatgtttgtgccggatactgtcttggatgacagacgattgtggttgaggattgattatggcaattactatgcttcgaagtcattcttcgattcgaaaaagggaagaaggataatatggggctggactaatgagacagatagtacgtcagatgatgttgcaaaaggttgggctggcatccatgtaagaaaatcagcctctaatctcctccttgagtaaattgcatcgtcggtacacaaacttgtcaggtgggtgcaacctagtgcacaaacttgtaaaatgctcgttttggtgcatgaacttgtttggtgcgtgaggaggaaggtgaaaaggacactacaatactacatggctaatcttatcgatttaggggccgattaagatactatgtaaacatatatctaaaaaggttgctattaaacatacacctattcaatcaaaaataaaaaataaaaaatagaataggatataatgatagtagaaaatgatgaaaaagccgagcactgatttaagggttagaaacatataaaattcatcaattccatgatgaaggataaagtagagaccaaatttataaatattgcatgtcttatgcatactcactagatgtatgcacgtcacatactaatcaacatcagcattataaaattaacattgtcaagttattttggtcctcgttcgcacgaactagacaagttcgtgtactgaaacgagtattttacaagtttttgtactaaattgcatccatctaacaagtttacgtaccaccaatgcaatttactcctcctttaattttatactatggaagcaatgttttagccttagcatgtcagtgtaacatactgatcctcattcgtcatttcataaaggcaatccccaggacaatttggttagatggtgatggcaagcgattgctgcaatggccaatcgaagaggtcgaatcgcttcgaagaaacgaagtcagccatcaaggcttagaactcaagaagggtgatctgtttgagatcaagggaactgatactttacaggctagttccaatttacctcaacaaaagtattatgttttttttttgcagacactgtagctaatatggcacaccattttcttgaagcaggcagatgtggagatagattttgagctgacatccatagatgctgctgatccttttgacccttcctggcttttggacaccgagaagcattgccgagaagcagatgcatcagttcatggcggcttggggccatttggacttgttgttcttgcctctgataacatggacgagcacactactgtgcacttcagggtttacaaatcagagcagaagtacatggttctcctgtgctctgatctgagaaggttaatgctttttcttcatccagattctgttgatgcttaagaactccctatttgcattgcactgataaaagtgaaatgatatttgtagaaatctaacctttgacagtaaacactaaaaaaaagaacgaagatatctgaaaagtctgaacttgctcttttgtctgacagttaattgtccaacattgtgttcatcatttttacttgtgcagatcatcgttgagaccaggactgtacacaccagcatatggaggcttctttgaatatgaccttgaaaaggagaagaagatctccttgagaactctggtgagtgaatgaatcagtgactctgcatctgcacgatcaacacaacacatctaggaagtgaaatgaacaaacagtccgaaacctgactcgccggcgtgcgtgcagatcgaccggtcggcggtggagagcttcggcggcggcggcagggcgtgcatcatggccagagtgtacccggcggcggtcgtcgacggcgccacccacatgtacgccttcaacaatggcagtagcacggtgaaggtgtcgcagctcaaggcatggagcatgacgagagcacaggtcaatgtcaggaagggatgaactgattgattaatcaaaatggaaacaagagagcaacatattacatgctaattgtccagtaagtagttaattgactacccattcatcagaactcctttggtaggaataagaaggaaatccagaatcaaaatttttagctgctcacagacttgttgatgacatctacttgctttgtagcaatatgtttttacttgtagaaaggagatggaaatcaaatcattgttaagaaatggttcgcaattggtaacgagatactactcttcgtgttttacagtcgaactgtaaaattcgttgtccgtcagttaattatcctgctccaactctcatccaaaatcattccgtttccacattgaatttattacttacccaaatgatgttttttactgagagaattcatttcagcatgaagcctatggatcatggtttcatgcttgatgaactgatgaaaaaaagtactgacttatcggtgatgttattgttggtggaggggttcggggaaaaaaaatctccgaacccaaaagaggcatttgggccgtagtcgtaggacagattcgatggcctttcagctgctcctcagcctacagtgtattcttcttggcaaaagaactctgcccaatcagcgaattaatttggcaagcgaaggcaccggcaagaatacgtttcttcatgtggctggctgtaaaaggacgctgtctgacagctgataatcttgaaaaaaggggatggcctcacgctgattgctgtactttgtgccaacaagaacctgaaaactgcttacatctgtttatcaactgcgactataccatcacagtgtggagactgatgcggcaatggatcagcgcttacttccccatccctgggagcgaaaacacatgcctgacagagtggtggttgcaggccagaacatgttttcggaagtgctacaggacaaacttcgacagcgcttgtatgctgatttgctggcagatttggaaggaaagaaatgcgcgtgttttcgaccaaagatcgagaagccctaaccagttagcagaggctatcaaagaagagatcttagtgtggaaagaagcaggctatttcgagatttgcagatcttagttttttagttttttagtgttgacgttccagttctttagtttgccgggctgtggttcctgccacagtctaattcgacagcctcctgtcgttgcaagcgaaaactacttgtactttgattttattcctcccaatcttaatgaaatttggtcgccggttccttcggccgacccggcagattcgatggcctaagtgggctggcccaattgctgttgcatatacggcccaaacgactctttggggttcggagatttatttcccgacccctatgtttcctgttttttgaatcagcgtgtgttgtttttctgagctgaatgttgttgtcgagagctgttcttggacggattgcgaaagaggatgtactacatctgaatgaaatggaaggtttgctaagtttttgaattgatggactatgtagtttgatacgacgttgctttgacgatatcatcgcatcattgttcacaactggttcacaatcggtaacaagatactcgacttgtttgatctgcagattcgctgtccgtaagttaattatcctgttccaactttagcttctcccagacctattgatgacatctactagccttgtagcaacatgtgtacttgtcagagttaagaccgttctctcccccgagtcggttctccccaggggcggctcgggaggcgacccggccgcccctcttccccctaccccaccccccgaagccgcgcggccgcaaggacggcggcggcggggcgctcctcgtctcctcgcgctcggacggcctggggagccacccggggatgggctggcgacggggtaggcggcggtggcggcggggacgggcgacggtggctgctgaggtgagtgcgcccggtggtgtttgtgggtggcgacggcggtggtggaggccgcggatccggcggcggccggcggtggcgtgagcacgcaggcaccccgcggcggccactggcgtcctccggcgcccctctaggcgtcggccggcgttggtggtgagggggacggccggatctggctcccttgcccagatccggcgtgtcctcgagtggggacggggtggtttggcgtccggccgtcgtgcaggtgatgtgcatattgcaggtaccctcggtgtgtaggtgacatttggtagctcccgtcgtggatgctatagttgatgggtgctccaaggcgaaagtcttgctccgctctcggtgctagcaacggcgacgcccttgggcgccgttcactttcttgaaggcgtttgctactggagccctcgttcaactccacttcaagagttttctctgggtgaaaacctagattcgttaggatcggacgatgacgtcgttctgtcggcgtgaccttcctgaaggcttcgttttaggagtttatctcttgttggacaactgtacttaggttcagtttgtcaatgtcggggttttgccggttttcctttaattaaccgtgctgttgtaaggtttttgggtccggtttcccttataaactggatcaactctcttcttctatagtgaattgcaggagctccctgtctgtcccatcgaaaaaaaaacatgtgtacttgtatagacaggagacgaaaatcaaatcactgcgataaagaactggttcgcaattatggtagtacgtgcgataggggaagaggctcctctgacataccccctctgatgtgggtggctgacatgtgggtccaccagctgtgaggctcatatgtcatcctctcaaagttagagggcaatacgttagaggatcacgtttcgtgcgataggacttaggagcggatcggagaagaaatctccgaaccagagacatttgggccgggggtggatggtgattgacccagttcgtactaaacggctggcggcgcaaatgcctcttcggggtttgagctcccatcggatggcaaaaaaaaaactaaattttaaattttcaaatttgattttgagatatttttaaggtagtttttttttcagcattggcttttaagtcaaaaaacatatatataaaagttttacctataaatccatttttattccctaataaatagttttggcttattatgaaaaaaaccaaacgatggggctctcagactcttctacaccgaaccccacaaatcacacgtacgcccgtgcgagactcaacgacgagtgcaggtggaagcccaggttttcgtgcgatgattgtttactccatgaatttgcttaatattctactgagtaaaattgaatcaatgtgtttctttttacagaaacacaaacgcagacgtccatattgcgcatatactcactcttataaatacacaccctacctctataatcacctttaaaaagttgggttggcgtatcttaaaattgatgaagtcatcacgaacacattgttgttgagggtaggtagtctatcactaaaaaaataattagccgtaaatgcgagtattcatatcaaatctaagttttgaattcggatgagctggttcaccgtaagatgaaagatgtttttcatattcttggaatgcgatgcagtttatatagcccaacgtaaaaggctgactaaattttgcattggttaagtacatagttccatatgacgttgtttttaccctaacatcacaacattgttcaccagtttgctagtagttaaataaaggtaaatgaattgaggaaaacaatgtaaataagatgaggtaaaaaaaatcgtaaatatcacatcttgttcaccagtttgctagttgaataaaggtaaatcagttgaacaaaaaaatataaatcagttgagttgagcaaaataatgtaaatcagttgaggaaaaaaataaacataaatcattttggagaggatgggctcgaaccggagaaaaaaaacgattttgctatatctcactcgaaagattttttcttatctctcactcgattttcttactcaaatttacagtgcattttctggtaagttacagtgtaatttatgaaacttacactgtaacttttgtaagttacactgtaatttttgaatcttcgcatgtaaattttaaattttgtattggatttggtctttttattgaggatatggtaatttagtgtccattatggtatttcttaattgctttttgctttttattatatctatcggattttaatctaaagattaaaaatctgtgtgatacgattataaaaatctttcgaaagatgtataggtactcccaaaaaaaaaataaaaattcaactgagggcccatccgggttcgaaccggagaaaaaaaaataaaaattcatccgagggcccatccgggttcgaaccggagacctattgatctgcagtcaattgctctaccactgagctatggacccttgatgtttccaaaccaaacagtttattacttgatttccatatttagcaattagccgattcttaatgataaaaaataattaaaatctaaatgaaaaatcacatatttcctatagcagaataatgcgtgacacattttatgagaaatatttttatttatcttatacaatattatagtatatttttttagcaattagcaaacacatgcatttagctagccatctaaaatgcacatactccctccgggttaataatatttgttgttttggacaagagtatagtctccaaaaaataactttgaccattattttctgttataatatgtataaaagtattaacaaatatatgattttattaaaatactttttaagactattctatacatgtaatcaccatatttgaaagataatgattttaaaaatgattcataatcaaagattctaaagtttgatctcatccttatctaaaatgacaagtattatcagcccggagggagtagtacttttagtcaaaatattcattttacctatcgtgaggacatggtcaactccaatctataattatgtgtgtagggtttattgcgtgtacaaattaactgggggaccgaaatttcagaaagaaaatatttgaagtttgacaaaaaaaattgatagaatttgaacagatgttactaaattcacaagtattgaaattttcggaaaaatatagtttcgtaccgggggttcaaaattcccgaaattttaaaaatttcaagccgaaattgtaaaccctggatgtgtatggattggaccaaaccatatatatatatataccccgatcgagtacaaccaaattagtgttgaattcgtattatattaacatgaattatctgtaaacacgtacgtttggtacgactccaattccgagattcttatctcgtgggagctaaagctatatcaagcacttccaagatcttggataacataggtaaagctaccacaccgcttccaaaagttacactacaagcatggagcggcatattcccgccgctttctcagctcctctccaccatagtagctataccaaatacacccttaatcgatttagtaatctttctagcgatagaacatactagcacacagaagggagtggattttaaactgacatcctctcgttatttacatatcatgcaaataactacaagaaaaaaaataagataaattaatatgtgatatatcactccaccaacatgtaagttaaaatttaaatttacaagttgcaacataaaacaaattaaactatagatagtttacgtatacaatcaaatttgcctttttttaacttgtagaaattaaatttgatgttgcttatttatgaagtaatatatcacaaattaatctaccttaatgattctttctttaagttttttccataattattcgagtgacacttaaacaataagaggagtctccttaagagtttagaatatttcagatgaccaggtgcacacacaaaatagctagcctcctgggtatacacgtatgtttaacacgaattgttcgacaatcttggacaaataatttagtatagttcggcaagcaaacatcaaacaagacaactatgcatagatatactactctcgtgctttgactcaatatatacagcagcattagttaacggttacaaaggcacacgtcgacacacaacacgtaagagtaagagacgaactactaatccaataattccatgcttaattagtacagacaaaaccaacgcgtcaaaatgaaagccatctgaattaactggagtatcttccaactactaatactaattaatctaaccactaaagtctctttcattgcatgagataatccatggcttttcccacaaattcattcattcattaattccatcactcactttgcatgatggctgctagtggccgtcgacgacgacgacgacggcgccgccatctccacgtagttggtgatcttctcctcctcctccggcgacggcggtcgagtggcggcagagtcgtcgtcgccggccatgttgtggatgcggaagagctcgcccatctgctcgagcgtgcgtccacgagtctccgggaggtaggtgaagaagaagagccaagcaagcgaggcgacgccggcgtagaggaagaagctgccgccgatggtgatggccttggagagggagaggaaggtcatggagatgacgccgctggtgacgcggttgaggccgacgccgagagcgcagccgagggcgcggaggtggagcgggaagatctcggagctgtacacccaggtgatggggccgaggccgatggagaagaaggcgacgaaggcgaggatggaggcgatggacacggcgatggcccagccgccgccggtggcgtcctcaccgatgacggtgaggcctaagccgagggtgacgagggtggcgatcatgccgccggcgctggccagcagcagcggccgccggccgaagcggtcgagcgtgaacgttgccaccaggatgaagagcgtcttggtgacgcccacggcgcacgtcgtgccgagcagcttgttcttgtcggtgatcccggcgctctggaacacgcgcgggctgtagagcacgacggcgtcgatgcccgacgactgctggaagaagtggatgccgagcgccgacaggagcacgcgccggacggccggcgtcggcgacaggatcagctccttccacacgcgcctctcgccgccggccctcttcggcacggccacgacgtcaccgtcgaggtcggccgggatggccaccgcctccttgatttccgcgaggcgggtggcggcctcctccgccgtgtccgaggtctcgccgaggacgaccttggcgtcggcgaggcggcccttcatgacgagccaccgcggcgactccggcatggcgagcaccatgagcgcgagggcgacggacggcgccgcgccgacgccgagcatgaggcgccagccgagctgcaggcggaggcgcgagaaggcgtagttggagacgtagccgaggaggatgccgaagttgatgaacacctccgggaaggaggtgaggaagccgcgcgacgacgccggcgagacctcggcggtgtagacgggcgcgatcatgaaggcgtagccgacgccgatgccggcgacgaagcggccggccatgagcatggggtagttgacggagaggcccatcatgatggcgccgacgaagaagatgaccgcggcgaggatgatggtgaggcggcggccgatccagtcggaggtccggccggcggcgaaggagccgacgagggagtagaggttgaggatgccgagcaggatctccacctcgacgtccgtgatcttcatgtcctccttgatgaacagcgacgccccgcatatgtaattaatgagactgcatatgcaacatgaggctctctggagactggagagagcgtgtatatataggcagtactggtggctgtgtgtgtgatcgacggtcagagtaatcaattgatgacagtatgacatttggagcgtgtatatataagccatactggtgtgtgatcgacggtcaaaataatcagttgatgacagtatgacatttgcccattgcaacttgtttacttgtaaaggttggaacttggaaggcctccgtgccgagcccagctggctcgtcatccaccctatttggaaggcctccgtatcaactttgatcctgctaccatcaccatcgacaggtacacccaaaatatttcaaaaattcatatttttaaaaaaaatatttcaaaaaatcatattttctttggatccctcgtgggtttggatcccatgccactcgacttcattttatcagtttctcatggattctcctttccttgatttcccttttaccatcaaattaaaatctccattccttgatttttcctgtgcacttttgtttattttatgccatctagttacgaattaagaagcgggaaagctggacacatgtgcacatattgcctcataacaattcacatactgccatactgcgatacaaggcagtgcttctagcaattcagaaagtgagaaatcaacacaaaacataaccagtcgagttccaaattgtcttcagctaatatattgatgattcaaacagatgctaacgatgcaagttagaagagaggtaaatccataagtcataacaactccaactccaacactcaactatcaaatatagctgattctggcccagttctcttagacaaaggcgtttggacattgctaagagcgacgtagcaaagaggcaatcctcgacacaagactatatagataactcatttcgggtttttgagcacaatgatgaccgagtccccacgtaggaacatcttgctgatgaacctgtccttgttcactggaagagccttcttcttgcctttaccagtctttggtacctgcagcaagagtaacacatgttattactgaaaacagcactacactcaactggaacaaaagttcaaaacttcagataacgccttgcatgtacctcggtccacatctccctgacattctcaagaaccatgttgcaatggctatcaaatgccctcacacgacctagtaacttcttgttgttctggcaattgataagcacctagaaagaagagcatacacaatcaaaacaatgcatatctttagaagcatcaagtgtagtcaggagaaccacttatggtcggctaattctataggtaactcctaaagatacacttattaatataaccgcactgctagccgcaacaaagatctgaggtcggacccatacaatatacatcaagcagatattttcagagtttttgcctagtgtacacaaaatacagtagcagctatgaagaagtcagcacaaatttgcaactatggcttgttttcccacatcatacaaatgaccaaaattgacaaatggttacacatagcacagcatgataaagttgaggtatctaaagaaaaagacataacaccaagtgaataaattcaacatcctagtaactgaaagcaagatagcatatcaaggtatctaaaccaaaagatatcgcagggaatgaatgaattcaacatgcagtaactcaatatccatgacaaaatggcatatttcaaggtgtaaagggcaaagataggtgcgtgaattcaatccagcaactcatcttgctattgcaccaactcaacactccagtaagtaaacagactcagaaaatcaagtaaataatgaaatactaatcccacaacccacaacgattctggtcgccaaaagttcaaattaggactccatacgatacacaaacaagagcagtagagcatgttaaggtaatagcatggcgagcgcgaacctaagatatggacatacctagacaaaccatagcacaatccaagactactgtttgaactgataaaagtgaacaaaaagtaggtaattaagaactacataactaactaaaacagaaaacaaccttactgaagaagtgaagatagactaccacgttgcaatcaactatgtttcagaaaatgaagtggcagcccagatgcaacatttacactaacactacatgaaaagatgttgactatgaccaattattcagatacatgagaaaggctccattaatttaacatgacttacagagcatccttattggctaagagagttgagagaactacagttcattcacccgttaggagaagggtacttccttatttcagaaatccagatgttcatagacagttcaattgcaaacgaatcagcttctaaggaatatcaccaaacattcaaggcaaatcggttgccaaaacttttctaaggaaccccaacccatgagccagtttacaatctgtggctacattgtccattgctctgttgtaagaaattaaacttcttttgttctttgcattagatgcgataaagcttatcttatagtcattgagttcgcagatattagagttagtagaattgtctgatgtatccagttggaggatggagaaagctttaaagaaaaggataattacaatactgtggtgcccccacacttttaccactgtagataaaagtgtaccagctgtgaattattatttaacaaattcttgttttgccaaaaaatagcccaccatcagagatcgcacagagtaatagttagaactacctttaattcgtccctaggagtctgaaggccacctcaactccatcttatacttgcaaagagcaattcctgtaaaggggttatatagcaagggtgatcactttcgtactcagcaagtcaatagtagcaaaacatagatgcataaatgatacctttatatcctacatcatggtcattcatatttcatcatcaaatctaagtttattttgtaaaagggtttccaaaagggacttataaaaactaaaatacactcataacattgacaaagtttgtagcaactcctcgtacaaaagcatgaatcacgatttaatttagcactgtgcaggcttgtaccgctttacccacagctactctgatttttagggcctttgcattccattcgattgctagacttatcagagtacaagactttttccctcatttccatttactacactccacgacaccatatacgccgggtcgtctaatggggtttatatcatctcccatctatcactatgcattcgatggggttttatatcatctcccatcattgctacgcatttgatggggtttatatcatctcccatcctaactactcatagatggggtctatatcatctcccatctgaatactatgctcttgacggggtttatatcatctcccatcctcctacaactacatacccatgtggagtataataaacttaataaggtactaggcccagcccatcttgagacagatccatggttgatcggtatacatggttctctggtacaagtgaggatcaataatctttatatgtatatcaatatctccatcataatcagtctagcaaataatatcatctatattatatttattttatatgaataatggtttgatgcaatactaagagtaaaaaattttataaaataggtttttaattagagggagcgtatcctatgcacacaggccctcacgtgtacacaccgngtacaccaactaaaaattatcaaaaaaattctaggaaaattcatacatatactttcaatagtattacatctacgtgcaaagtcgcatcttcaaattcattctacatagagaataacaaaaaagataaaattctgacaaaattgcaacctcaaaactgtcagattttttgtttttttgttacagttaaaatataatgaatttgacgttaagattttaaccctaggtgtaatacaattgaaagcatgtgtatgattttttctagattttttggtgacattttttagttggtgtgcacgtgtgtacacgtgagggcctgtgtgcataggatatgttgccttaattagaatagaaggatcatcatctatcaatatgatcaaagagagacttgcctgagtttctatagttttttaattttttgaggttaataactgcctagcatttgccgagcctgagtatctgtagttgaaatcgaaattatctagtgccgattgacccattttccattctagctttatgaaacttaatcatgatgtcattgttttccaactaattgaaccatgtgccatgaattaatattaatgatttctatttaggatttaattaagtgcgcgtcgtttcaaatatgcacataataaccctgtattaagctgatacccgatgggtgagagggggatctgactattcttatgttcttatgtaacaggagctctaaggtagtttatcccctcaattcagtattcaatttgtcagaacaagcaactcttagtttatcccctcaattcacagaacaagtaaagatgtaccttctaccatcctcgaacagagctaaaagagcatctgaattaatacttttccaccatccctcggacagagtaactgagttaacttaggctgagtttgagtaggaggagattaagaagattgggaagatacgcaaaacgagatgagctattagagcatgattaattaagtattaattattttaaattttaaaaatggattaatatgattttttaaagtaactttcgtatagaaactttttgtaaaaaatacaccgtttagtagttcaggaaacgcgagcgccggaaacgagacaagctcactcacaatcttctcctgccgaacgctcccttagactacttttttcttttctttttctcttctcttctcaacgtctcagttctcacgcctaggcaggaagatgcaggtgtgcggccgacggcggagcgggcgcggctgccggcgcagcgggcgctgcgacgcgcggggaagaagctggagagggggaga

SEQ ID NO: 55023 - DNA, 6410 bp, Oryza sativa
ctgcagccccgccgtgcgtggcgtcgcctccgggtgcgggacggagaacctcggcagcatagacaactccttcggcctggtcggcatggggagaggcccaccgtcgctggtgtcgctgaagaagaacgtcttgcactcgtccaccagctcccgcgtcgtcagcttcctctcgcgcccccgcgctcgccttgttccctcccagcagcagctacagcaggtcgttcgtcttcttcctcccgctgcagccgctggtgacgccgcgactcgatgatgtcgagcaggagcgcgtcgatctcccgccccagcttccacgcctcatagttggcgcggcacgccgacgaggcgggtggagcggaacagcatcgcctgcatggcctgcagcttgtggaagaccccagcgccggtggcgtcatcgtcggtgccgatgccgaagctggccttggcgatgatctcggcggcgttccagaccacgcccttctcgatgtcgatgcagctctaccccgacaccaccatgtcgctccactcgcccagcatcttcgacgtcgtctccggatggggagaggcgggcgctagccgccgctcccgccgtcgcgggcgttcgcgccggccgcctcctctccccctctcccgcttcttccccgcgcgccgcagcgcccgctgcgccggcagccgcgcctgctcagccgtcggccgcacacccacatctgcccgcctgcgcgtgagaactaacaagatgagaagataaaaagggaagaaaaaaagatgtgggcccacatcattttctctcgctgacatgtgggccccatatatttattttattattttttactgactagtatgccacgtcagcaaaaccagtcatctatactgccttggatccaaattagacggttttgtatagtttaggggtgaagatttctggttttgtggttaaggaaccttgaaatcttgatgttaagttgagggaacttattcctatttacttccgtttgaattttaaatacacatgtactaatatttacagagttaacagtttcttaaagaaagtcttgttttatagaagtaattttataaatgtatttaataaaactaatttcagattatgacttttctgggggatgtcattggactatctttattaataagaaaatatagttacatcatccacgctcataataaagctaggggctggttcattgatccatatacatgattttcttgaaaaaaaaaagacctagccaattcatgagttacctggtttgcctctctattacaatactcaatagaaaccctatcaaaaccattatgtaaattgttgcaatcttcgtatatggctatcgatgccattgtcaagaaacctccatctaacataatgtcaacaacctacttacaatctatctgaataataaacttattccaaaccatgacttggtgctgatggaaaactaatttcacaagtaatattaaatgggttcttgccatgtacaatatttataagctaaagtatataagttgaaatccgtttctatttcgactttagaatctcaataagaagacctaagtaaccatactctatatcccttagctctagctttaaatactatgctttacatatcagatgttttaaaaaaattcttgctactaaaaaataccaaaaagtatgtccattgaagaatgcagcggcggtgccctgaaccatatctcccgcacattaaggacacacgttattctcctcctgctctaaacaaatcacagacaataaaaaaaagcaatggttgagctagtaggagctccgcttgatccggtaaatgagctaatatcaatctatcatgtgtctatgctcctaccctacctcgatcattgttctccttccgagaggctaagcggtggacttattaaacctgattggagccatgtttgaaaacacaacatagatttttctttttaaaaaaaaaaaagattttgatgccaatgagaaagggagatattagctttgaatctccctagccatctatacatagaatattctatgttatatggttttgaatagaatattctatgttatatggttttgaagtactaagttgaataaggatcaatatttaccaattcaagtactatgtacacttacgaaacaattcaaagcaacttactatcatagaggttctattttatagatatcgtgaagtatatttaataggaacacactgtctggcaccgtttgtaaaaaaaaaaatcctctatatctatccttgtgaatactggcacactgaaatttcagtttaagaatttatacactgataatccaaattacaaccacaagttgtggcgatttggacagaattttgttaatcccaagctaggtgttgaccatgggtcaacaatctcccatggtgcccgtggccgtggtgtacgcaacttgtccgcagccgcgaccccgacccgacccgaccagactcggcacccgctttctcattttttttttctttttgccgacttcccccctcagccgccacacgccccctcgccgccggcgacctcgagttctagggttagggtttttgccccggctcgccaatccactatcgcccaaggcttcggccccaattcgacgcccgcgggttcaattccgagcgctcccaagtcgaattgtccgcctccaccggtggaattcccatgcctctgagataaggattttgggggagacgcggggtgagccgggcggccatggcggggagctcgaggcccgacctcggcggtggcgggagcttccgcgagggcccgcagctctccggggcgggaaccccgagggcgctggcggagccgcccccgctggcgcagtacctccccctggagtcgttccccgtcggcgaccacaagcagtcgcgcgccacggagcttcggcgggtgctcggcgtcaccgtggaggcggagcagtcgttcgggctggtgcagaccaagccactcccttccatagcgtccgaggaactcaagcggatccgtgggggcgtcgtggagtcgtcggccaaagccaagtacatgctgcttactagttactgcacactactgcttcaatctgcattgctcattaacccgcaaccggtgaaatgttgtgcagggagaaaaccaagtcgctgcaggattctattcagaagctggataagtacaggaacgttgtcacgcggaggcggcagaggagcgaaggaggtgcgactgagaggtcatcagggagtgggtcgggttccctgaggatgggggctcagaacagtatggataatcctggccagcggctggaggagagggctaagagtgcgaccacaagcaagcgtgtccgctcatcgctagcagcagatgcacgggtttgtacttgtgctactctaaagattcatccagggatttcattttgctcgtttgccactgtctccatcaatgtaaatagttacgtcgatactacaggattacagaattacaatcataagctgctctgttactgtaatataacaaattagtttgaactttcaactggtaattgggcatatgccgcatatcagtgtgcgttggcagttaacatggagtagcaatttaaattttattgcatgctaaaaaatggattccaaatgcaattggacccaattacgtggtcatggttaccaatttgagtgaaggaatacatcctgtgagtagacgtagctgatcaggttaatatggaatgtacttaagcatcctttttgcttattttgtaaagagcagctgaagcttatttttgggtcacttttatgtctttgtatctctttgttgctgtggtatccatgtgagcaatattatattattatatatgagagcacattttcgtcattctaaattcaacttagagctacctatgaggcatggtatttctttttgggcgttatcgtacttgttatgtatttactgtgcttccaattttccttttctttgactcttgtgatatatatttcagttagaagggcgtggtaatgttcctacaaggcaaggtcctctggcggacagtgagaaaagttcctctttggagaaggaaaaaaactctttgaggaatgtcaatgctgcatcagggttttctgaagacaaattacggggcctagctcctggaggtgaaggttgggagaaaaagttgaaacgtaagcgctctgttggaactatgctgaacagaggcaatgacgtagaccgagatgttaaaccgttggttcaacatagaccaaacaatgaagctcgcatgcgatctagtgatggtcttccaattaggtaactttcatacattgttgttacttgttaaccttgttatatgagttagtttctgtacagactttagcttcaaatgaaaacatcattgaaacgagacaatgaggtttactatgccacacactataatgacatcataggtggtactcctatgagcattgaggtctgtcatcatccctttaatgctgtgttgacaggcatggagcttctgctggagcattaggaggaagcaagatggatggaggttctcaacagagtaatgcaggttcccgttatctactgaaggcagacatggactccacttctcttccaaatgaaagaagagagcgccatttagggatagacaaagaacgggttttggtgaaaggaaacaagtaagcatagtaattggtggcattattttagcaatatatgctatgatacaagcacactgatttgcattttggaatgcctttaactctttgtgtgattggttacactgatactttgtatacgcagtttcttgtattttatgagtactccttttttgcggggagatgagtctgttgaagtgttgattatttctactctataccatgaatgagaaatgatgtactgaatcattcttctcttatttagggcaaatacctctgaggatatgcaacctggaactttaaatcctctgactaagggcaaggcatgcagagcaccaagaactagttcccttgttgttatgaattcatcatccactcttcagcgctcatctggaggaatcgatgaatgggaagaaacaccatccaccaataaatcctctcctttgggaggcactgcaaatcgcaagcgtcccatgactgcaagtgggtcttcacctcctgttgcttgggtgggtcaacgtccacagaaaatgtcacggacaagaagagcaaatgttgtttccccagtctcaaattttgatgaaggcctatctgaaggatcaccacttgatgctgctgttagaccagcggtagagtcacctggccttttgcttccaaggggtgtagctagtaataattcacaagttacaccaagaatggataatatttcatctccagctggtctgtcagaaagcgaagactctgctgctacggaaaataagaacaaggataaaatcagtaatagtggtgattttgagaacgagggcgcaaattcagcccataattcagcagacttaattatctcatcgaagaaaagcaggatactgttaaaagaagagcttgaagatggaagtattcgacggcaagggaggagcggaagaaacactatgcatgttaaagggtgtgcatccatgccaagagagaagttggacagcccagaaacaagaaagctgctgaagagcggaagacctgtatctgaaaagaatgaaaggtgcttgatgattggaacttattgaggttgttagttatatgtatcctaatggaactaattaatttctaaattgattcagtaagttgggccgccctccaacgaagaagggttcagaccgcaaagcatcatctcgacactcggagatcctaaattgtgggttaacagatatatcaggtttcctgaaaggcacctttattatccacctaatgccttcgaattctataaggagttaaggatgttaagagtcttgacattaaactgtgtgtcataggtgaatcagaagatgaccgggaagagcttctagctgctgcaaatgctgcgcgcagtgccattggtgtgcaattctgcaaatcaaagtttcctatatgatttgcagagagctgtaattttattggctcatgcttaataggttccttatcctttctgcagttaatgcatatgctggtccattttggaagaaaatagaaccgatgcttactttcatcagctctgaagatttatctttcttaaagcaccaggttggattctgtttgcccttttgactttgcataagttgctttacatttttgcctgtttgggatgaacttccacttaccagaatctctggtcagattacatttttggaagagcttgagatgggcatgtctaagtcatccgatgaacataatttgaacacatcaactaactacagtgggccattatcaatggtattttgcctgaattactccactacagaatttcaacaaaat

SEQ ID NO: 55024 - DNA, 2489 bp, Oryza sativa
  unsure (1)..(2489): unsure at all n locations
aaaatttatgtaagaggtttcaggtatacaggcttacttccagttggtgaagggcgagagggcactcgctgaggaacttgatggtgagcatgatgagaaccgggacggagtccttgcgggtatcatgaggtcgatcatggagtcagagatgagtttgtcggtgagctcattgctgccgtctccgatgaggacatcgatggcgtcccgcggcggccctccttgccctcttgtcctggatgatcctttgtatcagcctcgccatcttcttcttggcctgaccaccaccaccacacacacacattncangttcagatttcaaaggttaacatgtaacatctccaattcagtgtcaataaggttactgctgtaagcaaacatgtatttttccacacactgtggttgaaacaataatacaagcatttatgttttttcaaataaagtcctgaaagtaaaatgagcaatgcaaaaagaaatccagatgttttctatattgaaatgttctttttgcttcaacatgacaggccttacatcaagaaagttaacacaaagaaggtaaatatgccccaaaaaattatatttccactatggtaaaatttcaattaaataatgtcaaaggttaatcagtgaaacatacaaaatcataaagattcaacctgtgaaggtgaacttgcccttttaccaacaggatgcctttgtctactttgtattaaaatacaaccattgtttaataaaattttaaaaaatgtgctactgaaagtataacaattcccatatgttgataaacaaaattgaagcagggactgccaatataataatccattcaattaatggtccaaaaatggcagcaagccagcaacgcatgccgctgaataaaaacattaaactgaaggcccagacaaaatgagcacctaagaaaaaaagaccatatgcggataatgaagaaccataagactgaattacttgggatgcttgtgcccacaagaaatctcggagccacccattaatcgtagtggaactctgtgcaaagtttccccctgtgatatgagttaccaccccttgatcacttatagtaccccaaacatccgattgcattttccaactgaaatggaaaatgactaccgaaatggaattgtacatccagaatagacataagaaaacatgatcccaggcggatacttgatatgttccccctcgcccaagccaatcgcaagggaagcgaaaaccaagatttgctttatcgggtatcaaacggaaactgcgagcaaataaaacaactttcaaaagtattaaactcaccgcaagttatcttgctccaattgttagcatacactgtgaccaattcaccctacaatgaagaagagcgactcatcaaattaacatgcatagttcctaggtgtaattactgccatagtaaaataaccatgtgtctgtggtgtggataattctgtttagaagttcaagcccatgaattaacaacagatttcaagcacactcatattatcagtgcacaagcacatagtacaattatttctctgcagaaaaataagaataggcagacattttattcccatgaacatacactgacatatgcataacaattaatcattagcagatcaatttttctatctatgttgtccttgagacatgtgtgtaggtgaacatacactgacatatgcataacaattaatcacagcatgatgtttactgtagtgagatttcaattctatgtagaaagatctacattttcatcatattggagtcaggaagggtacaataacagcagcatatgcttagataaatggataaattctggtacctagaccaacattcaaatatactagatactgggacgcgccacctatacacaattcttgttattaattgtttatacagttaaataacatataacaattagaaatgtacaaggcgagagacgaagaaaggaacactcacaattttgtgctgaacttattgaagaaaaaacatatagatacaaaacaaaattcacgagtccagcctgacgttaaaccatgtaagcagatgcattggcttgaaccctccattttcaaccaatttgtagtgatatccttttgggtggggttgggtgtgggggggggggtgcatgctgggccagccagtgtcactgacaaaacacaagtaaaatggcttgcaacaaaaaatatatttccacattttccttcttaagtagcttgcaaaaatatactctagtcagtttatctggtttactgcttcaactataagttaagtcccttaatttgtcaacgaatccgatttcatccttcaaactgaaaatcagatataacaggtatgtggcatatgaagcaaaattaacaatttaaaaataaaaacaaaatatttagacccacatgtcagtcaaattataagattaaaaataatggaccccacttactccacttcatcatctccctttctcttctctatctcctccccttcttgcccagatgcgt

SEQ ID NO: 55025 - DNA, 4155 bp, Oryza sativa
ctgttattaaccataattacaaaaggtaattatttcaatcaacatgagttattgttggctgtgtacatccaatctgatttaaaggccaggttaatcccattttctaaaaaagcatgagttattgttgcatgaaactaattatcagaagcatatcataagagaatatatatgtaaacaattatgtatgtcgcctgagtttgataaattccttctcctccctattagatttatcttttattccactgatgggaagtcttcatatatgtaacattctgaagatttgttcttcatatatgtaacgttctaagaacaattacctctaatcaagagacagcataagcatatgttgttcaatttgcagtaaacggtatgctaccttgacgccccagatgatgaggcagaagatggtgaacaggaggacgaagcactgaagcagaggaatccgaggaggatctggcagcggcgggagatgccgctgtcgccagcgcggtccttgtccggtccctcgtgcgctcgccggacttgcgggccccgtcgcggagggtgccggagaagcggctgacggaggaggaccggagtggcgacaggatgcggccggcgaggacggcggagtggcggcgtgcggatggggaaggcgaggacggcggcggggcggcgcgatgtggaccgggaggggcggcctgcagcggggcgacgcggcggatgggaaggcgaggacggcggcggggcgaggaaggagaaggtagttgcattttttttacttacgcggacgcggaggagacagtcagagcaatgtcgtccgttggtaaaataaaaataaatcagtactctcttcgtcccacagggattttgtgataaaaaaataaaaataaattagtaatcccttcgtaccacaatacaagggattttgagtttttgattgcaacgtttgatcactcgtcttattcaatttttttttacaaatataaaaaagggtgaatagctaaaatggtccaccaagttttatctgaggctcagtttagtccttaatattccaatctatccatattagtccttcaagttttcattttaattcaaacttatctttgaaccaacaactctctttataaatgacacttatacccctcatcattcacatatataagagaaaaattgcatgcttaatttttttatagataatacacagtatattatgtaaaacgaaaaaaaattatgtactaacaagtatatacgatagcaattgcttaagttttatgtgcacatgttgaaataatgggaagtacatctgtaatgttgtttatttatgtttgctttctcttttctagtatatagatgtatacaaattaagggcaaaaaggacattttctaatagaaatattgactagaaaaagccatatgacatattaagtggacccaaggatgatttcaagccaaaacaaatatttgaaggacctatgtggacaaaatgaaacgtgaaggaccaaattgagccttcactgaaacttgagggactaaattagctattcaccctataaaaaacgaaaagttgtgcttaaagtactataaataataaagtaagtcacaaataaaataaatactaattttaaaaaaatttgaataagacgagtggttaaacgttgcaaataaaaacttaaaatcccttatattatgggatattatgggatggaaggagtaatccatatacgtagagattttttgagctggtagtgaaaagtggcaaaataaaaataaatcagtgaacccgaatggcaaatcatccaagtcctgactttgggaagatggcaattggcaaatggagtagtccaaaatcccacactcgtcaggcccgctagggtttcaggcttccgaatccgagcagctccattccccaaatcgcctcttgtctcgcgccctcccgccccgttgccggcgacgagcgctgcagggcacagggtgctcaggctgcagcttcgcctgtccccgccatctgccggacaccaagccccgccccaagtcctagcctgccatccgcccgccgcccgccagttgctgcctgactgtctcaactgttcaccgtgcgtaccctgcaggtatttgtttgtttcgtgtgtatacctttagtttttggcgcagattgtagtctgcagaatcgaccctacttgtcaatttcagggctaaaatttcattgttgagtcagtatgtgctatatttcacattgtttttttgcaccatagaataccgttgatgtgtcaggaaccaaatgattttggttcagacaaattcgaaagagattcaaatatggcaattagctaactagtaggaatcctaacacagcaaataattaaaattgtaatgctgaaattaactagaatggaaggaaatatatgtgtgcgccgcaagaacaagaggggaaattatattagggttcagattcgataaagagttacagccaaaacacggggcttatattgagtacgccctctgctagacgacaacgacgatgacgtccacagtacggcaattcttcccctctgtagcacatcgcggcgaatcagggccacccgatcttcataacccttccaatgaatcggtatctcacaatctcagccgtcgattctactacagctatcccccttaactctgaacttccaagtctgattcttcttcaggcctcacatgatgcgtgtttcttttgctgtaacagcgtagttaagatgaatcaactaccatggagtctttcactaaaatcaagacttctcttggtttgcgatgaaaatgaagtttcaaacatgtattcaattacttttgctgttctggcctgttcatggtgtgaatatcgcattgtaaatcaattgaatgacgatcattccatgtctaatatggcagacatttacccatgaatggctattttgttggtgctcgcaacgacttcctgggttatatgctccagtaatgtggaaacaagtataaaaccttgtctgccgtatgcttttatcatgttaacttgttagtagattctttttcttttttaaaaaaaacatggcagatatcaacagttgcggtagtaatttcgcttcatattattcactttcttcgattggtcatcttgagtggtttcctctttcttggttacattctgctactgtgttgttccttcatgcaagtgtactggtcatctttttttcccataatgatgtttgctgaattaactaggagcttagcctgttgtgttttgtgaatgtatgcggaaaatgaataagattttgtataaaaataatgaactgggtatttttttttcaaccttctgagtcctttcatgcaaacaacaataattgttttctcttgataacaaagcatgaactcctggttatcggtctgtaccttgttcagtgcctttcataattagtttaagaatttctaatacactggatgttttagaaccttccattactgggagttgcaaaagttaattggagataatctaaatgaatccctttattagtgttgttctgaaaatagaaatgataggccattttcttttctgcagtttcctaccaaagaaaggtgcttaacaatttgttgtcacaaaccagaatggccccaggcacatcaggtagtatgcccacctcttaaatatactgcatattttttaatgtcttagtattagtatgtacctttgcatttttgtgcagcacaaatggtgataatttaagcttccattagtgaaaatttcttgttttagagaattagctcgtatagaaaattataatgacttggttgtcattgaaactgaagttcttttaaaatttactttaggtcagccggagagcaaggggcagaaaaaaacggtacaagtctaattctacctcttttttcatataaaactttcactgaatatttttatctagcaagaaagtatgaatttgcagattaacattggttatgaactggcgcatcaagcatgggacttcaaaatacaacaaggaagttgcagggcaaaaattccttcaaatataccgcggcagtatgatcctatacagaaccttgattctgtgttaatttttgatttgatggataattcaaatgggcttcactgcttggagattatgacaaactgcctgcataagaacatattgcatgctccaattgttcaga

SEQ ID NO: 55026 - DNA, 8480 bp, Oryza sativa
ttgatattaacagcagagttgactatgtgctgtgtgtaagtggaatgtatgctcatgaaaaggagctgaaggtattacatgttttaagcaaataaattaacttactttaattaccttctggttacatgcttgcagtaaataaaatgaacttactgttgtaaattatagaccaacattcaggtcgatagagtcatcatggagagaaaccccggctttgctgtcgactataatatatgttaacatgactgggaggacttcagcagacatgataatccacactgaaggtaatgttttcaggtttctttcccaaacttgtaaaactgtagtggtagatgttcttaaaaaattcattatcagagcattgctcgattagtttgtttagcgggcatgggaactttgtttcacctatactttgtttctttcaaaagataaatatgatgggatcatttgcagctttgttgtttgcttgatatttgttgtgtaaaataacgtctgttgttgaagaaacgtcttgtttgtcttattctcaatggctcgagtgtcctgaggttatgggcatgcacattattttattttagtaacatatctcttcaacacagatataaccctgggagctgtgcgagaggtaggcatgaagtctggaacaatgggaaacagtggcttttggttcctacttgtctttgatagagctagcaggaggcgaagagaaacatagttaagttattgataatttagtatttgcaaaagagggagatgcaccactaaagatcttataaagattggtactgttatatttggtgctttcaatattttcttggtaatctatagtacaatgtccgtgcgttgcaacgaatgaattggcaattgcaattgtatttaagcagaaaaatgttaagagtaaaggtaatgtgcgacagagtgacattaagatgcgttcattcacatggttttacacaacactattagcatttcatctgaatatctctgtattattagaaaccgatccatcccaaacgaaaccaattgtataaacacacacacaaagttgctaatatatgaccatccaataacttggcaatgccaaaaaatgttagcaaatttgacttaatttgttttttttttcaacctgtagaaattgaattttaatttgcatgtttgtgaagtgatatgtcatatattaatttatcttgtttatttttttcaattttttataacaatttgcaaacaacgatgaaatgttagtttttttttttgagagcgatgaaatgttagtttatattataatccactcctaggaagaaaagatgcatgttcactgactgtagggctatcataatttttatttatttattggttgaagttcacgttttaattaaaaaaaatcaggtatagtactgctgtgggatctcgtcgtacgctggcaataaatacttttacttattcatcatgtgacatatctaagagcaggtacaatagcagactataagccagttataaacatattttaaagagataaaggaagagagagaagagcagcgggctacagatttgtagccagctgcagcacggactccaagacgtaatgtaagtatgacagatgggaccagatattaatagtatagtaagcaaatattgtatgaattggctattacgttggctatagatgatttggagctagtagtgggctatactattaaacttgctgtaatgatgcaaaatatagtttaacaaatgcttttattaatcattcatcatgtgacatatctaaggattcattcataatcaacggaatgaggtcgatccgacggctccgatcgatatcaaatcgcacacctccctcctccccaccagtatcgtgcaaaacacgtccccatccaactcgcggcgcagatcgcgcactctctccctctcgatcagatcgcgcgaagcattatccgagggctatctgccttgaaggccgggaggatttggagggttggcaatgggagcagtatagatatatgggaggatccttggatccctgctggagtcacccgaagaccgataactcctcgaagaggcactgtgctgaacaaggtagctgatcttattgacccagctacgggctggtgggataaaccactagtggaggagattttttgggagtctgatgccaggaacattctggccatcccggtgagattagacacaaatgattttgtagcctggcattttgatacaagaggaatgtactcggtcaaatctgcgtaccatgtcctggaagatcaaagggagagatcggcgaagaacaagagggcggttcatcctctggagcggtgaaccagcggaatttcgagtgggataaaatctggagtttgcaatgcattcctaaagtcaaacagtttatctggcggcttgcccataacagcctccccctgaaactcaacatcaaaaggagagtaccagacgctgaaactctatgcccggtctgcaaaaggtttgatgagaatggtggacactgcttcctgcaatgcaagcccatgaaactctgctggagaattttatgccttgaagatatccgtttaagcttgactcagcttggttctgctagagatgtggttcagaccattttgaagctggagaatgatcgaagaatggagtcttctttcttttgtgggtttggtggtatgcacgcaacaaggtgaactcgggggaggacgtaatcagagtggaagaagtggtccacaaggtgaaacagctgatctgtgatcatgcctctctgcgcaaaggaaaacatcccaaggtgaatgtgcaaagaaataagtgggttccccctgtagatggtaatctgaagctcaactttgatggagccttccgagctgtaaacaagtctggtggttatgatttcctggttcgtgaccaccgtggatgtgctgttcttgcgggtgccggctgcctggaacatgtacatgatgcttttgcagctgaagctgaagctggtttagcaggcctaaaatctgctatttcgcatggtattaactctgtccaggtggaaactgattcaccatcctagtgagagcctttcactctcatgagtacgctctctctccttgcagttctatcgtaagggagatcaaggatctcgtccatttaaatttttctagtgttgtgtttaattatgccccgtgatcatgtaatgtggctgcgcataagttagctcaaatgggtgtgtgctgggaattgggtcaagcaagtgtgtgggctgacctgtccctgacattgtacaaactattgtggatcgtggtatcactgatcctagtatttaataaagcgcgccggtttaactcaaaaaaaaaaagatcgcgctcgctcctcctctctcagatcgcgcctcgcgctccgccgctgcatctccgacgattgtcgcctcaaccggcatcacccgccgccgccgatccggtttcccgccctcctccaggtcgcgcacctcgcgctcgacctccgccgcgccacctctccgacgaggcgacgactgcctagtgcctaccgccgccgcgtcaaccggcatcgccgatccggtctccctccgctgtccctccgccgctgaagtctcctcagactccgcctcgccgatcccctcctccgctgcatgcctgcatgtcgcttgaccatcccgcggggcctactcgcccgcgagctcctccccgctgccatcggacctgcgcggactcccacgaccaccacggtgtgagatgacgccgctggcggcgattgtgttggccggtttctaggagctctttgattcagtccgccgctctccatcttttcccgtcccaggggcagcactgcagtattcctcgacgagcaggttctgcttcgagcgtagagcttccggtgggggttcaggggtggattagcatgtgccttcatgagtcgggatgtcagacggtaggaatggagcaggaggagaggagaacctgctgatccagtggagagatagcaatctcatcgggaacagcgtgctgagcaggtatacctagcatggacctcgattcctacaaggggcttcaagtttcgagcaataggcaattctgattggatcggtcttctgctttccttttggtgcaggctttgatcagaaccagcaatgccacagaggagaagacccaagtgagtacgtttggtcagtttcttgtttgtctttattttcctcaccaactgcgcaactgtaaatcttaatgctcttaattatttgatcccactcttaagtgtttttcatcggaaacttttgattagtgacacataagggagcttaaggatgaagtgaagctactcaagaacctctcacattccaaaatgctgtgagtacatactagataactacatatggtttgtttttcaattcgatgatggtgtttgatttatctggtatgctttgaacaatgatatattggaacagtatgggaggagaactcactaaatattctggtggagtttatgctaggaagatcaatacaatcattccttgggagggttgggccattccatgaggctgtaagtgctaactgttatatatgagcgtcctcttttgatgtgtttacaactaaagaggttttttaactgaatgtatttgtttatcaggtcatcaggaaatacgctaaacatattttgcatggtcaggagtatgtacaccgcaatggaatcgtacacatggataaaaaggcaagcagagtatttgaattttgttgaccctgaacgattttgttgcatgggctagaaagtttatatgtgagattactgtttttttaacttttcagggagcattctactgataaaaaggaaatgcaagacaagtgactgcagtgcttgcaagatgaatcatcatcataattgggtagttgctattcgggttgttgaactgctagacgaaatcaattgtagttgtagtgccatggtagtaatcagcaatcaaactccttgccatgattaatcaggtatgtcattttttgctagagaataatgctaaacaacattaccttatttactaattatctgctagatgtctacggttgaaattttctcttgagcatgattctaaaaagttagttgagttgttcagttacaattgatgattagcactgtctggaactattttttggtaccaacttatgtgctttacgtgaatagtattggtctttcaaggttgatatggtagtgcattactgttgtgaaacgagaagcttatatatcctgtgcatcttcagtgatttctgagtatttaatcctagaagattgcatatttgcattacattagtttccaaatttctaaagtattaaattatcctgttgatgctggttgcctgagtaaggagattgatgcagattgttaagttcataatatattagagatcgttatggctgcatatgaaattatgtatttgtgttcaaatgccaatgtcaggtaaaatctgaatgcatatatttttttctatataccttagtttagtagctcagatggtaagatttaaaaaaacctaacaactgtcagcaccgctacttgtaatagatttctttcatgctgtatggtggatttgattttgtaattttaaccattaaaggaacctccttttactgtgggtgggacggacctgtcagcggggtgctgttggtgatgacggggtgctctgaattgatggagctatgcggattaatttagctttaccactgttaagttgcttgcagttctggttctgaacagctttgtgtctactctctcctacagaccacagtttgatagcaccaccattactatatatgttgagactgtgagcatgcacagctctgaagccttttgtagttttgtatgacaaggatcaggagttcaggatgcaagtccaccatatggattgaatttggtggccatgtattttctgtgtcctgcaaaggacgttgctgttttttttacggctgctatgttgctaccttttcagagaaggtattgcaatctatattcgcaagtctttatcagttcacaggtatgttcttatcctatcgtccgacaaatattgttctttcatctttcatattcatgatgaaacatcttttaattgagccacagtgagattgatgtaaactatcagcatacaattaaatgtagtgcatggagtttcagaccaacatattctaacaaggaatactttaattgaaggttcatgttagacctcatagctctctctcatctgtgctattctaaaatgaaaggaaacgatgtggtttatgttctttcttgttagacttcatagctctttctcatttgggctatgatggaattgcaaaattgtggatgcaaagttgattaattgggttattcaaacttcaatctttttttttttgccattggtaaatggcatgcatcatgcccaccaattaattattagttgagctattgatttttactgtaagtacagaaaaggatggccaatttacatacatttttctcaaataataattaagaattgttcggtgttgtgcaaatagactcaaaataataattggaattgtgttcatttgtgccatgtggtgctattgcatctcttatttctctaccatgagtgaatagatgatatggctcttgttgattggaaatagaggatgaattttgctttgaagatctgttctttatgaacacctaaaattctgtaaacagtgcttgtggtgcatcattctaaaatgaaaggaaacgatcgtttcgaagatggtgactgtagtgctaatattactcctagatctatggaatttatgttcattatgtgttccattagcggatttattggtagtcctaattgctcgtttatttcaccaacttgatgtggtaatatgttctattatcatcgagagatggatttaatattgcacttgagtctccagtagagaaaacgaatggtgagtatgagcagaaatattatttctgcacatgactttgaagtccatgccacttccatttacatgactgtatcagtttctgtaacttgcaagaatcaaactggagaaggaaaaacaggagaaagatggagcaactgcaaatttgtgcagtactacgactatatatggatttgctgtgtttttttttttgtgatgtatgttgtaattgatattgtgaaatatttgttgactgtttgtataagaaatcaataatacatgtgcatgtattaattgtgttttagcgtttcagatcgcagcgtgatgagttgttaacaaccatcttgtttattctgaaattgaaaggaaaaatatgaagtagtagagaaaaaaaatgtacgtctcattttcttcttaatcagtttttgctatcgttaattaattatataataaggaaaaatatgtagaaactaagaataaaatatcgtcgtagcgttagcactcgtatctcatatttataagttaaagagaccagctatacgcgatattacaattcaaggacataattttaatggggaaattggttccataccatctaaagttaataaaacgagggacctacaatgggatccgatccgatataaggagtcaaattgaacttttttttttatcctttttccgccgaggcgaaccatcccgatttgcgatccgatttctcctttcaatcgagggttgcccgccacgtagcagtgcggtctctctcccttatcgcttcgcccttccttttccgctctctttcaccgtccccgccgcgtccatcgtgagaagacctaaccctagtcatccaccaactcgatcggagaggagatcggagaggagaggaggtgcggtgatcccgacttcactcggtccaggccttaaatccaaggcaatcgagagaagagatccgcggatgaaggaataaggaaaccgatctcgatttggttcgtcatggacttggagtgggttgcggaaaggggaggggaggggggcctcctcgtttaagaggaagaggaagaggaggacgaggacgaggagtaagttacttgctgccgccgagtcaaggccgagccgaagacggcgaggaggttttgtttggagcttttccgtggcgggaggggagggattcccgacgcaaccgtcaaaaatcttccacccaacactctccaaaggatccaacgggctcgagtggagagattctgcaggacgagcaccgcatagaggagaaggcggagatggcttctagtggagagaagctgcagaagcaccggccagaggagatagctcttagaacgggctcgagtggtcagacaacgcagaagctccgagagaaggcagccactgagaatcaccgtccaaaggagattggcccaagtggagagaagccgccgcataagctcctccgggcaaaggggaaggcgggcacgagctcaattggagtaacgctacagaagcaccgggcagagaaggcggactcaagtcgagggataccgcacaagctccaggcaccggccggcacaagctctattggagtaatgccacag

SEQ ID NO: 55027 - DNA, 1046 bp, Oryza sativa
tttgcaagaggcgggtgaggcaatcaaaaggctgaatgaattgggcttgggagagaatatcagctctgaggagttccttacatacattgaccagctgaatgaacaacctaaaatcgatacttcattgaactggacgatgcacaggtcactaccctctattttcagcatgcgcgctatcgcgtcagatactataaggtcggttcaatttccatcactgctgctaaataaatactaattaatcatcacccaacacatgcatgttttgtactatgtttcctatgtgaatattagatcaacaatcattgctttaatgtttatgtctgtctaatttcagcacttgtcacaacaacctaatactgagttggtagaggattcttaccacatgaaacttgttggggaagatgaactctccgatgagtttattcgcgagatggaattttttatgcgtttcgaggaagatggcacatttgattggtatttctaccctgattactgctggcttgctgctctgaacgactaccaacgtctagtaccgataaactgtgtacgtattacattatattaatgcatgaatagtccttcaattcttcagttgtgtcttggtgttctattttgtcagttgtttttgcaccatcacacataacaagtgtacagatcgtaaatctgatgaccacttagttagaatttgaaatcatcatatatacaaaatgaagatgtctggttggaaaatctacatggcattcaaaaggttaaaaagatgtgtttatttgtttaataatccagcttttatactgctttactattagttttgtggatgctttcatgctatatctactgaattatcgctgcgtaagacaagcatttgctttgttgttttatcagcctctacaagaaactggtcattttttctaattcaaaaccagagccaacccaattcatgttatttctgtttcttgatactctaggtgctcggtaccttttttctttcttcttccctttatggaacagtttctggcatttctgtaaagagtgctactctgtaattc

SEQ ID NO: 55028 - DNA, 7934 bp, Oryza sativa
cccctgttcaatcatgagttctactagggtgaaccagtggtgcttattccttgagagagagctgaaacaattttggtgcaaatctttgattcttgtacgaatgctccctactcaatattcttgcttgaaaaagaagtcctgacaattttcttcttccggtagccaaagctggatgatggagaggatgaggacattgataaagttattacggagctgcagaaaagactgtttgagcaggttctctctctctctctctctctctctctctgtgtatgtgtgtgtgtgtgtgtaaccttgtaaagtgtataacgtttctagattagcgaagtataaagaactatagaactagggattctaacttgacttcttattatagtgagagctatgattattcagaagtagtaccccatacaatcatcatcatcccacctcaatttggcctatttgaatgataagggcatggccaaaactactgacacaactggtcgtgtggtcttgccaacttctctagcaagttaactgtgttcagtaaaaatctagcatgatttggggtggattctcttgataggagaatatgtcatagctttctcagtgccaagttttcaagcaagcaattagtagaatagctgagtcggtcttgaaattacttatacattgtgcatcatctgggtatgttatcaccacaaatgagattttcgatcacagttcagggcttcaagcgatcctgatttttctgtatttctcatacttggatgatattctttaggcttcaatatcacataaaatttgtatgagaacacctacatttcattgtgatgtttcctggacagtatttcttttgttacttccagatgtattctgggaaattgatgtgctttttctaagagttaacacctatttaacacttgtgctcctcgacttatttcaggtgaatcaaaagaagtgccaattacataagttggacaaagcaatccgtgatactaaaaatatggaggagaggtattaaatattccacccctatacaactttccattataaacacatatatggaagttataacagcaactaaacttggatttcaggagtctggagcaacatgcaatgaacaagctagtggagatggcatacaaaaaactgatggtacttgaatattcttttggttacattaccacttacttaccttttataagtgtttatactttacacagcattataggttatagaaacagtctaatttataccagacgaataagattaacatcttttttgataatcagattttgggaaaatatgctatagagattcagaatggccatcttatacgatctattttcaaacacctaatagattcctagtagctcggttttgaaaggcattaattgttgcttgttagctttacctgtacaactgagtaaatactgttggtctataatgttactttgtactaatgaatacacatacactttcttaatgttgacctgtgcccctgattgcatgccatatttgttctattttcacagggtggccgtggtagttctagtcataagggtggtctcaataaagctgctaataaggctgcaaaacaagttgcattggcttttgccaagagaacacttgcccggtgccagaaatttgaggaaacagagaaaagctgcttcagagagcctttcctttggaatgtgctgtctgcacctttgccaaagaatgatgcaatagatggtaatacacaaactattgaacagccaaacaagttgcataaaacccagttgttatgttacattaccatcaatataattttctctatgcttcaggtggtctcccaggatctgcagataggccaaagcttttaaagcttgacagaagtccattgagccaaggtatttcactgtttctagcattcttcaacaaatcctagtggaatatggcgtgcagaccttaagtagggatcattaatgtactacttgatgtttgttagaactctttcttcaagagagatgttaagcttctgctgatccttttccaggtactacaaaatggaaaaagagtgaccgagaaagggatcaaaacagagacgcgtctttgaagaattctaattcgaaatcaggacgcaattcgtccggcaatgcaaggagtgagcgtaaaactaagataaaaccgaagcaaaagctagcacagttgtcgacatctggaaatgttcttggaagagttacggagccatcaaatttcgcagcacccggccagagagaatcccatgattggacgagtacgtcgagcacaagacctactcaaccagtcagaaacagcgcagctactgttgcccaggataccttagatgctccattggcaaatttgcctgcaatagatccaatggacatcttggacgtgcctgaaggtaacgacatcagttcgtggtttactgatggtcttgatgattccttacaagattttgacttctccggaggcctagaaatcccagatgacgatcttacccaactgggattcatgtaaactgaaccggtaaatatgtacatgttcatattaattttaagtgttgatcctatgttagcactggcattgcttggttaccgtggtaacggtgactgattagtctcttgtgcccctaagggcagagcttgcaagttgcaactaggaattgattcatttatatatagcgtaaaacttgtagtcgccttgtcgcatatctgcgaccagattattggtcgtatgatgttttatctttctttggccaccaggaaagaaagccagcgtttattcacaaggctctctggagcatttgtggcacacgtcttgatatgatacgagtattaaaactaattagtaataaatcctctgatttggcggagcggacaaagctgtccgagtgcatttctcaagcagttaacagctaaacataagatgagagacgatgggttgtccctccctaggcagaacatcaaatttttgaggtttttttttagagttgaggggggaatgtctgagtagaggagaagatacgcaaggcatgcaaaaagggaattgagaagacaggagaggtggagtagtggtgcaacccacgtctgtcccctctctcgctgcagcttaactgtatctccgatccattcgatcgacgaccaaccacctctccataatatatccactcgtcttaattagtctccaccaattctctctttctctctcaattagtctacgacatttcgttctgtcctcgatcgaattaggaggttcgttgaagaagagaggagagagatcgaggtaggatatttgatatttctttcagatcagtaggtggcttgtcgcttgagcttgacaatggacgtggccggcggcggcgaggaagtcgaggaggtggaggcggttgacggcggcgagcagcagccgccgatggagatcggttggcccaccgacgtccgccacgtcgcccacgtcaccttcgaccggttccatggcttccagggcctccccgtcgagctccagcccgaggtcgccggcaacgcccccagcgcaaggtaagcgtcttcttcttctccatctccggcggccggcgcggcggctgacaactgtattattattatggatatggaatattgcagcaagacggtgttcggcgtgtcgacggagtcgatgcagtgctcgtacgacgcgcgggggaacagcgtcccgagcatcctcctcctgatgcagcggcggctctacgagcagggcgggctgaaggcggagggcatcttccgcatcgccgccgacgacgcccaggagcaggcggtccgggagcagctcaactccggcgtgctcccggagggcggcgtggacgtgcactgcctggcggggctcatcaaggcctggttccgcgagctccccggcgggatgctggactcgctgccggcggcggaggtgacgcggtgccagtccgccgacgactgcgcgaggctgtgcgcgcggctgccggcggcgaaggcggcgctgctggactgggcggtgcagctgatggcggacgtggcgagggaggagcggagcaacaagatgggcagccgcaacgtcgccatggtcttcgcccccaacatgacgcacgccatggatccattcaccgcgctcaagcacgccgtccacgtcatgaacttcctcaccatgctcatcgaccgagctctcaacgacgtccaaacctgcaacaactgatccatcaatataattaagcccaccatgcatctcgattatatatgatcactttaattatagcacgtaattacattgtcattcattcgtagcagggttaattaattaagcttaatcaaaattgtttgttttagtttcattttactttcgtccattactcagtttaattactactacatgtgtcgagagctgacttcttgggtctgactgtacgtagcatcgagcaaatcagctctgtcatgaactacatgcatgttaatcattttattccattctaagagcgtacctgtatggttggttggtctgttaatttgacgtttgagatatttgtgacttgtgagtgcatcaattctcagcattactgttcttttacttgtacagtaatataatcgattttttctacgcctgtttcaacaagaacttaaatttttctccaatgtgatgagatctcgctggtttattatatagtttttgaagtaatttggtgcattgatggcaaagtgcgtgtcttggtaagggaattgggccttgcactcttgcagccgcatatgggcctgatcatcaaagaagacttggtataggcccattaaactcaactgaggcctatcccgggagagtgaaaaagagcgggaaaattagtgatgacgccggattagagggtggtcttcacactaatgataaaaaagaagtgctggtcaatcgtagttttaacaggcacagtgcacaaacagaaataattgccacaagccagctgcgtgtgtcaggactcaggagaggcaggagagggagagagaaaggggaaatcaacctgtccaggagagggctggtaataggaataaaaaaaaaaaaaccctccagtgttcgtcttcgagagagagagagagagagagagagagagaggggggagaaagcgtcttcttcgcctcttctgcgtcctgctctcctcgccgcatcctctcgcgttggtcgttcgtcgcgctcccgttccggaggtaatcctacccacctctattttttttttatttcggtcgatctgccgtgcggcggccgaggcggttgcgatagggatagggcgattctccgatcatgggggtggcaggccggagatgaggtcgccggtcacgcgcgcacccaccagtagcacggcaggctgagcgctaggcgccgagctcgagcaagactgcgcctatctaggctcgagttgggtatgttggggtcggtcggattcggctcgtccgagcttttctcgagctgtttttttttttttgggatttgctattaatcactagtgtgaaaaattttgggtttacactcaaatttctgtccacttgatctgtctcaagatctttgctgcatttgcgggttcagtccgtgtttgggccgcgcccgcttcgtagttttcgtctcaatcggcgcgtctattccttttttttttccttcttgatacgcggattctccaaacgatagctccgccggagaatctcgtcggcgatcggcaatgtctcgtggcggcgggctgtggcgacgccttggcgcttggtgagttggccgcccgtgtgtgtgtcacaagtcacaaccttgaatgaagttatcttccttggctgccggtgaggtcaagtggcaatggcatagacgccggcagccggcgagaaagccacggcgttctaggggtagttgacgaggtggtcggtttgctgctgtggctggcggcaaggcacccacgccatttgcagcggcaaccagtgaggcaaccatggaaacttccatggtaagtcacgttctttgccccccctgttgttttgctcttgttgacgaccatgagagcctggtagatctaatgattgtgtttttctccccctctaatctgttgctggggatggagttagaaggtttgtgatagctagctggataaaatgatttgtgtattctcctcagatctgcttctcagaagaatggatttgtggaggttgagagagtgtcagcagactagcatttcattttgcaattaccagaccactagatttctgatgtgaggaagtatcattatgtgaacggcaaagcattttgttgctgccccttttttatctttatgtcaaaaaaatctagtggaattgggcagcatacatgatcctaaacattagaacgttttgcatgttgaaataaatttactatcttgatttagatagggtgataatttttgggatcagttttctatacatacctttgtgtccctatattttttttcttaaaaaatatttgtttctataaggtttattttcttggaatgtcttgcctcactacaagaaacagaatgtttccaagatcaagcctttcatgcagcacttgcctgcaactaggactgtagtaacaagttactccctccattcttatttagttgttgatttgagctaaaatacactgaccaaagtagcacttaatttttagtattgtgacatgattacctctaattactctccctgctaaaatacacgttttgcatttgtgatactataagcacttgagcatggtttatttgacaaattaattctttgaactgcattctcccgatggttgtcatgttcatcgaaatttgttcagttcccaaacaaaagctttgttacatctaaactttctgttttgcttttgctgtttgccttctagcatttgtttgttctatatacgagcacttgaaacaactagctctgttagaatgttttgcagctaaaactagttaaaactagttctcgttttgttcggggaaagggcgaggggttgaggtttgacaatttctcccccttcgtagcttccttaatatagttagtattgttttctacgcatctaccaagaacaagaatacctagttttgtaagcaaatttgaattaaagttagataaggttatgttctgtttttgttattcattctccctttttatcttcctttgttaagagtcgagtgcacctgcatttacagaggttttgattgttgacattgtagtagttttgtggattgatttgttttgtttgaacaaaattagattgttttcactgaaacatgattagcaaaaacttgtttattattagagatgtgtacttcttctaatagtactttgtagcagcagaagtaggggatcaagttagtttaaacctaaaatttgttctgttaaatatttcattaacagtagaaatgtagaaatttgtgttctgtgatccaaacatggaattgttttgttatttggttctagttttacctaatgcagtggatgaagaaacatattgttttttttaaaaaaagttgcttagttttgtcagccactaaaattgcttagttctgtcagctcttaatctgaatttgatgagatcaatgattctatataatccatatacctaatttagcactgagcatgactacatgattactcttgttagcaaatttcagtcacgtggcataattttggggctgtttgatagccctatggaatcggcatctatgaaatgacacacatccaaaatttctgccaacagttcattttgtgaacaaattagaagaaaaactatagtgaaagggacttgcagtgggggatgaagcacaaaacaaaccattttggtatcccagatcacagcacaatagcagtcctactcaatcaaaagcatcttccaatcttgtaatgtgcattttgtgttctctcttatgtttcctgtgaatcagtcaccaatgatgcatatgcaagcgcctcaggggtgcagga

SEQ ID NO: 55029 - DNA, 6151 bp, Oryza sativa
  unsure (1)..(6151): unsure at all n locations
cctgcagccccttacaattgcaattcccttgtcagattactgcagtaaattcgatgtgccacacagttcatcgcccccacccatgtaccgcaccctgccccaccccccgcacggaggaaactgaactaactgacgccgcatagcagaaaactgcaaacggattcagttaagtcgtcgcacgataatggcggcggcgcaacagctcggtcgatgtcagctaaaaatttctccaagccgcccttttagcaaaacaagcacgctgcggctgcgcacgtaaaccaagcaagcaagcaatctgtacaagcccaatcagagcaaaccagcctcccgaattcgacacgcgcccaaatcgagcgaacctcgagaagggaggaggaggaggagagacgctagttacctcgcaatcgccggagtcgcccgatcggggatcgccgccgccgccgccgcacggagagcgagttgtgatggacgaaacgagacacgggggacgcgagcgctgacgcccgcggcggcgacgcgaggtaagaggaggaagaagaagaaaaatcggggaggcggggggtatagatagatacagatagatagatgaaaaaaaaatactcctaaataaatagaagacgagacggcgacgaggacgacgagaggaggaggaggaggaagaagaggagatggagagcggtgggcggcgaggaggtgggaacgaatcgggtctccgtctcctttcctggtctggtctccccactcccaccacgctataaaactctccccttcctctctctccctatttatttttggtttttgtttttctcgtgtgcgtgcctcttgttctgtgtgatgcttgtggcacgtggcctctagtcggatcagaaagtctcgtgtctttactcctccgcgtgtgagccacatgatcaacgccgtgtataacccttgccaagctttgggttgagtttggatttggatttgaattaaatcttttatgcttcctgtatgtattgctagtttattttattttactatgtacagaaccgatggtggactgactcttcaaacttgaccggtttgtatttatagtggtaataatacgttagcaatggagatacgtgcacgtccggacataccgtgtcgtgcacacagtggaaactagtatttggaatacgtgtactatgctaatatgttagtattattctgtgcgatggctttgttgtggcaataataatgtgcgtcaaaataaataaatttaggatatacttttatgtgtcgccgtataaattttgatcagtcaacgtttttttttccaaagtactgtagctaatcaaggagtagttaataatccgatctgccggtggccgtgagacgggtggtataacaaaggttgtccgcatgtttattttgcgatttcaaagtactataatcatctattttgcatgtcatgaatacggagcatcttgtctacatcttgtgcgcgatcacgaggggaaatttaaaaaccgtgctgctaatattaattgccacatcatatgatttgattacgctggtatttgttgggcggctgacagagggatttattattaaacaaggaaaaagctcatttgacttccttaaatatcggccgaatctaatttgtgccctttaaccagaaagctggataagaaaactccccgaactattaaaacagatacaatttgactccttaggtgggtttgcaagcggttttagctgacgtggcacctacgtggtactgtcgatccggtcttcgtcccacgtgtcgtcgacgcgttgcttatgtggaactagagtaaaacaaaaggcaaaattttgtaattttgtaggactgacatgtcactcacaaacacacacaagtgggacccatcgacaatgtgggccccacatgtcattctccctttccttcccttcttcctcctccttcccccctctctctctcccttatctctctttctctcccccggcctcttttttcaccttgccccgagcggcggtggggagcgatggtggggacggcgatagggagcagcggcggcctggccacctctccgtcggcctctttttctttcatattttcctctcctctcacctaaacaccaccggtgtgcacacctgcattggcaagctctcctaaacaacacatctgcaaaaaatggcacaagcttaataatttgagctgtttgtagattcgtaggagacaaacatgccgaattgcgcgtatgtattgatgaacatgcgctggtatcaatggcgttttacttgatggctggaggtggtgtcaaagctgcgggcgtggtggcatcggaggtgaaggtgtgcgacgtcgtcgtttgggaggtgagaaggcaaggcttcttggaggcagaggcggaagcggtggctgtggtaaaggcggttgcgggggaagacggggatgagccagtgagctgttggtgctcacggcggcgagcggtgggcacctaggtgctcttgacgtggatggagcaaccgaagccgcggcttttgcaacacgtgcggcaatgttggtggccacagtctttctttgcttggttaccgcagtcctagcacatcgccgcggcgccggagccaaacgatccgtcagcgatgtccagcatcgggagggggttcttgaggtaggggaaggcgctagcgctacgtgatgaagcttctctccgttgacccgttgaactacgacgacacccccatcgaagggatcaggaagatcctcgaggagttgtccggggagaggatcatgcggtcgtccaagattcccacggccaaatggtcaattggagcgggagccaagtgaatcgctccagaaatttatactcccttcgtttcaaaatgtttgacaccgttgactttttaacacatgtttgaccgttcgtcttattaaaaaaaattgtgaaatatataaaattatatgtgtacatgaaagtatatttaacaatgaatcaaattatatgaaaagaataaataattagttaattttttttaataagacgaatgaccaaacacaaactaaaaagtcaacggtgtcaaacatttagaaacagagtactagcgacttagcgaggtggagtggcgaaaacgtggctccacgtcctactctgaaaataattacagcgctacccgtcccctttcatcgaaattacaggaaatgccatcgcattaccttggatccagccgaaccgtcgcgccgcccactcgtcgactcgggccttatcgcgaggagaaaaaggggagacgagcgaggcagcggcggcagagccagaggctgcttcctccctccttctctcggtgcgacggtttaggcggcagcgcacggtgacggcggcagcacggcgcacggcaactggggcgacgcagcacggtgacggtggcagggttggagcacggtggcgagcagagcaggggaggggatcctggtgagcttctgattcatctctctctctctctcccaccccaccggggctacgtctgtctggaatttgcttgcgttcgttaacccctagcttcttttctagttctggaagaagctatttcacgagaaaatacaagtaacagtttattgtttgtttcccccaaaatttgggagttcaactgaaccccccatgtcccaagttggatccgcccctggcgctcttatccccctttgtttgattaattcacagcacagctcagtgctacaactccttctacttattacagtaatccatcacccattaccagattaatctgaattgcctgcatctacgctgctgttttggtgttttgcagaggacgcagattctgagagtacctcgaagttaggatgggtagcacggagaaattcagattctgcattgacaggggcggcacattcaccgacatctacgcagaggtgcccgggaggagggaaggctacgtgatgaaacttctctccgtcgacccgtcgaactacgacgacgcccccatcgaagggatcaggaggatcctccaggagttctccggggagaggatcccgcggtcgtccaagattcccacgggcaagattgattggattcggatgggcaccacggtggccacgaatgcgcttcttgagaggaagggtgaaaggatcgcgctgtgtgtcacccggggattcagggatttgcttcagattggtaaccaggctcggccgaacatattcgatctcaaggtgtcaaagccgtcgaatttgtatgaggaggtggttgaggttgatgagagggttgaacttgttggtggtggtgatggtgagagggatgatggtttatctgttaaagggatctcaggggaattggtcagggtggcgaagccggttgatgtagaagcattgaagcctttgttgaaaggtttgcttgacaaaggaataagatgtttggcagtggttttaatgcactcatatacttatcctcagcatgagcttctcattgagaaattatctcttgagatgggattcaagcatgtatcgttgtcttcatcattgacgccgatggtccgtgctgtgcctcgtggcttgacagccagtgtggatgcttatctcacaccagtcatcaaagagtacctatcaggattcatgtccaggtttgaagggggaggtgagcaggtgaatgtgctgtttatgcagtcagatggtggtctggcaccagagaggagattctccgggcacaaagcagtgttgtcaggtcctgcaggtggtgtggttggctactctcagaccttgtttcaacttgagacatcaaaaccgctgattggatttgacatgggtggtacatccacagatgttagccgctacgatggaagctatgaacaagttctggagacccaaattgctggggcaataatacaagctccccagcttgacataaacacggtggctgctggtggtggatcgaagcttaagtttcagtttggagctttcaaggttgggccagattctgttggagcacatcctggtcctgtatgctatagaaaaggtggtgagctggcaataactgatgccaatttgattctgggaactgttattcctgagtacttcccatccatatttggtcctaacgaagatttaccccttgattatgacgctactaaaaaggcatttgagattcttgctgttgagataaactctcaccgaaagagtcaggatccatcagcaaaggacatgacggttgaggagattgccctcggttttgttaatgttgcaaatgaggcgatgtgccgacctataaggcagttgaccgaaatgaaggggcatgacactaagaaccatgctctcgcatgctttggtggtgctggtcctcaacatgcatgtgctatggcaagatcccttggcatgtctgagttacttattcatcgctactgtggcatattgagtgcatatggaatgggccttgctgatgttattgaagatttgcaagagccatactctgctatttataatgttgattctgctgcagaggcatctcgaagagtagatcttttagttaagcaggtgaaagaaaagtaatagagcaggttttggagaggacagcatcaggacacattcatacttgaacttgaggtacgagggaaccgatacagcaatcatggttaaacaaccagagagggaatctggaagtgattatgctgatgagtttgtgaaactgtttcagcaagagtatggcttcaaattattaaacagaaaaatactcatatgtgatgtgagggttcagggagttggtgctacaaatatcttgcagcctcatgaactgacaccagtatcaaccaaacctgtgccagaaagttcatgtcgaatttatttttcatacggatggcaggaaacaccactttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 55030 - DNA, 3001 bp, Oryza sativa
tgcattcttctgggattaaaaacgctttttatcttgagacagtggatggaagactatgtcctgaataaactgccatcttctaaggtaaacaagctcaccatacaaaaatgattgaatgagcagtgttatatgttgtagtactataataactctgctgtacagtggggaagaatatgcagcagaggagcctaccaagcaattaagattgccacccgcttttccaagatcactgctgctttggcctataatgcctactatgtacgatccctcacacacactaattatttttaatagaaaaaaggtggtttgtatttagtaacaattccattcctttcaggattgtttacagcacatgcgcttttatgttgcttattgcaaggacatggatagcttgtactttgagatttggcagcgggtcaacatgcaaaaagttagtacttaacattgttatccaggttcctgcctatgtttatgttgtgtatgtttgtttagtaatgcatgcctttttctcaacaatgttcagaagagtttcagagattctttggaggaagtctacaacctcaacaagttcccttcacggcaagataaaatgaaggatgcattggagaataactgttcccacatggaaactgtggtaggttatttttcatggatgatctgagaatttaatgtggtttccaaatttttaattgtgctttaattttattatctattgtcatatcttttcagtttcatgtttgcacggcaagtgttaccagtgaagtaagtactgtatttgtctaatattagttgaatacgtggaatgtgatcttaatgttgatcatgtctgtgtgccttagattgcggaggataaagctctggagctgattgcaaaggcagttgaaagtcgggtactgtacttgtatggaattccattttgttagatggcacctatttctatggaacttcatcatacatgttttggcttatagcatactgaattgaaaaattcctctgcattcaaaaaagaaaaattgtacggaacttcatcatacatgctttggcttatagcatactgaattgaaattcctctacattcaaaaaggaaaatttgtgtggaagttcattgtacatgctttggcttatagaatactgaattgaaattcctctacatttagaaaagaaaaagaataatgaagtgaaatttattttcttctttttttttcagatgaacaaagcaaaattctacgagcagtatatcgaaaagaagatagatattgcccaagctattggattgatttccacggtattgtcttattgctgttgacaattgcacatgagccatgttttctcactgtgaataaccaaattagcttccttcaactaactgtcatttaaaatttacatttgcaggatgggactgaagcaacatgatgtgcttaacttatagtgtttttttttgggagggcttagcttacctttctttttatatcagtatcagtagatgtcgatgccccgccagcgcctgcagaaataaagatcccgaaccaatgtttttttagctgttatgattaattcggtttccaggctccggcccgatcgaaagcattgtaattgataatgttatgtgcgatacatttagcgtacgttgcaatcgtgcctcggagtgattcgacttgctgattcggaagatgaagtttttttttttgcatgaaattgggctatccaattagcttgttgtttgctttgtggtcgacatggatgaatgtgattgtatatagaggctcacaaccgtgtctttgtgctaactgccctagctagattatgcaagttgatatcagcaatttgctgctttataggacactgagaacaaaatacatctacaggagagttttttttttctttgaagtttggtcaagttttttcagttcttttttttctattaatcctgataagttgagacttcctttgaaattgaggaattgcatataagatctctgtaagaactgaactagctctgtgagaagtgttataaaattcttcgttccaaatgagtgctgggctccatatatatatcataaaatttgatgatttgacactttatatgttgccaatttgattgtatttacactcgtgaggatgacatgtgggattatgcgagtctatcacaatggctcaaatagtcagatttttcaatttttatgtttggctcctgataagtcagttgaggcttccttctaaatgaaaggaatttataattctttgtaagaattgaactaattttgaggaagatgttgtaaaaggaggccatagtttcgcttattaatggaataagcgaaacggtatatttataaacgaaaaataatttataaacaaaacttttatatacatgttcttagcaatctaaaagcaaaggctcgaaaataaattacgatgaaaaacccttacaatcaactctttttcaaaattcaaaattagcttataagcataagccaaattgttttgtttcaaatgagcgctgggctctaaaatctgcggtgtggtcagttgagctcatcatctcctccatcctgaggcggcggcgcaacgacgacgacgacgacgatggcgctgctccgcgcgcaccacctcctcctgatgaggccgcgcgccgccttctcctctcgccctccccctctctcatcctccccgtgccgccgcgcccttcccaccaccgccatcgcctcgcgcctcctctgctcccaccacgcctcgtcgccgcccgaagatgcctccgcctccgcctcgccctctatcgtcgccgacctgctcgactacctcaacgagtcatggacgcagttccacgccaccggtgagcgcccccaccacgctttgccgcttcgcatgcatggatgccctcaacctgttcggtcctattcctcaccgggaaggacgcgagtggctgctttgtctctggcatttctgcatgtcctggactgctcgagtgcattgacctttgtgtttaggcatcggtacagccccc

SEQ ID NO: 55031 - DNA, 2623 bp, Oryza sativa
cgctgctcagtgagaacgacgactgggacctgcagcctggtggccgctacttcttcacgcgcaacatgtcctgcttgattgcctttgcagtaggggaaaagtaagtcagcgacattggcttctgattatttaacttatcactaagaatctgcaacgaatgtggtgttcaaataccatttgaaagtcaatgcctttgatttaggtacttaaacttgctcaaaaggaacctctagtgtaaaacatggccaaagtatttaactgattgagatatttaagctagtggaagaggcaatcaatactatgaaaaattcctatgtatgtacggcagtcagcagggtacacactccagtaccttctcaaaaatgtttttgcctcttcacttcgttgcattcctttcaatttttgaagatatttaaaatctctccttgatatccatggcatcacactgataaatgatatatgcgtaagtgccaaaagtttcaaagaaaaaaaattatgataccgctctttctactccctagttgtaaatggatatttgaagtaaaattattttttggacgcaggtacaaattgggaaatgggttcaatataattgcggctcacaccgatagcccatgtctcaagctgaaaccaaggtctgcctcctttaaatctgggcatcaaatggtaaatgtacagacatacggaggtgggctgtggcatacatggtttgacagggacctgactttggctgggagagttatcctcaaggatgctgatggctcatttaagcatgagcttgtcaaagtgagcagaccattgatacgtgtaccaacgctggctatacatcttgaccggttatttctcattccttcttttactgatctattttctgagaactaggtggaatctatctggtagtatgttctgtattgctaagcaaatattgctagatgttctctctttcagtactgcatcatcatgtaaccctgtcaagttatagcagcttagtcttctttgaactactatttatatctatctcagtgtttggaagttatctctgaacactattgtcatgttcgtttagtgcatatctgaggatcacacaggctactgctgctatcatatttgactgcctgttttaagtttgactttctctatttagctgactgaattccttttgccttttagcacagtgaattctgatgggttcaagcctaatctggagaatcatctagttccacttcttgcaacaaaacatgaagagactactgcaaattccagtgaaaaaaatagttcaagttccactaaagttgtccatcatccactgctcttgcaagtaattgattttatattctgagcacttgctctatcatttaatcagaggtgtactttcaaagtactacagatggcttcaagttgaacttatagcatttgattttctcgctctgctccacaggttctttcagatgaaattggttgcaaatcaggtgaaataattggcatagagttgaatgtgtgtgatacccaacctagctgccttggagggggaaataatgagttcatttattctggtagactcgataatctcgcttcgtgttattgtgctcttagatctctcatggactcctccaagatgccagaagaattgtcaaatgagaaggctataagaatgattgctttatttgataatgaagaggtatgctatatctaatgaagtctcacctgattgctaaaagtatcatgattgataaaagcacatcaatgcgtgctcaagatttccattcccgtttggagtctgttttgatttgtaggcttagagtggctttagatgagaagtagtgctgctaacttatttactgcttgtcttcacttaaattatctctggtcactagtatttgataaaactgatttttttggtagaactatctacacggtattgtttcggtttatttcttgtacttggtcccttcttgttcatattataacctcgactctattcaggtgggttcgaattcgatgcaaggggcgggtgcaccaaccatgttccatgctatgagacggattgtcgattccctgatgcatcaatctatgggagagggtgctttggaacgtgcaataaattcctctttccttggtaatatttatgtatctgggagatcatcaccggcctatagtcctagactaaatagtgcacaaatttaattcttgtttcactttcagtttcggcagacatggctcatgccctgcacccaaattatccagacaagcatgaagagcaccacagaccagagctacagaaaggactagttatcaagcacaatgctaaccaacgttatgctactagtgctgtgacagcttttctgttcaaagaaatagcaagacttcataatcttcctgttcaggtattcaatattttacattttaaccctcaataccatctttttttattgcaaattcccattatgtttgaacaaataagtgtgcttcaagatggataagaatcaaatcatcgtctatctctatcattatcatctattgctagttatattatttctgataggaaatgttaaattcaagaaaaacaaaatcagcatgtgtcatctagaagtctttacttttgtaaagcgatttgtctttagaa

SEQ ID NO: 55032 - DNA, 8110 bp, Oryza sativa
  unsure (1)..(8110): unsure at all n locations
actgtggtattcctcagctctcaatgcacaggtatgcacagttggctttatccctttttttgacaaattgacccttttcaaaaacttatttcgaaactaacccctgacaaaaacttcaaccaaaaataggtcgtttgctcagcgccaagcgcattggcgctgaggttgggcgtgtcagcgccaacggtcgtggcgctgacatcgtgtcaccgtggcggccgggccgatcccccagctgacgtggcagctatctcagcgccgaccgctttggcgctgagatggccaatctcagcgccatccgcttcggcgctgaggtgggacttagccttttcggccgagtcccgacctagcaggccgtctgtctggctggcggggggggggggggtacctcagcgccagaagaaatggcgccgagactaggcacatcagcaccacgtaccctggcgctgagatgggacttagcaagcttggccatggcttagcccagcaagccttctggatggcttgcgggctgggacgtcagcgccagccataatggcgctggccctgggcacatcagcgccagggcacctggcgctgaggttggacttagccggctcggccatggcccagcccagcaagccttctggatggcttgcgggctgggacgtcagcgccagccataatggcgctggccctgggcacatcagcgccagggcgctgaggttggacttagccggctcagccatggcccagcccagcaagccttctggatggcttgcgggctgggatgtcagcactagccataatggcgctggccctgggcacctggacttagccggctcggccatggcccagcccagcaaaccttttggatggcttgtgggctgggatgtcagcgccagccataatggcgctagccctgggcacctcagcaccaaggcacctggcgctgaggttggacttagacggctcggccatggcccagcccagcaagccttctggatggttgggctgggagctcagcgccaaggcatttggcgcgggcctggagtatgtcagcgccattttgcttggcgctgaggttccagacctgctgtaataagcagcacagctctctgcccagtcctgcttaacacaaccacacatccaggcaataatttattcacatcacaggcagtattcaatcccgacgaaatccccttcgatttgagtggatttgggggagatttggtgaggggagaagagagggcgacgaaccctagcgcgcggggtggggaagaatggaggagaggctggctgggggcggcctcggccggcctctaagtaccaaaactcagcgccaggcccattggcgctgagattggccatcttagcactgtcggcgctgaggtagctgccacgtcagctaggggatcggcccggccgccacggtggcacgaggtcagcgccacgcccgttggcgttgacacgcccaacctcagcgccaatgcgcttggcgctgagcgaacggcctatttttggttgaagcttttggcaggggttaatttcgaaataagtttttgaaaagggtcaatttgtcaaaaaaacggtggctttatgaccatcctttttcgtatttctgaattagcagtaactgcatgtagacagtacttccaatcgttttgcaattcatattgagcaagttgactcctagctatatagggaataagaggtcagtttttttcttacatgtatcatccttgtcaaaataggtatttaattaaattgataacataggtaagaaaaatgtatgcttagatttcacttataccttccccatcgttgttctggccgtgggtgacgcattactgaacgtttaactgctattgtattggtttgcagcgtgcgagaaatgtgtggcaaagaagacgtagatacaacatacaagcacttcaaagctttcttcgagatgttctctgatattgaccggaaactcaacgtagactaacttttagatcttatcagttcctcatgttcagtatttgaatttttttttcctggatcagaataatgaccgtatatcagagtatcagttttttcttgtcccaacatcccaatctaattctacgcatgaccaagaggggtgaaatcattttacatgtaaatatggtgacacatcgccaagctcacttttgagaagatggccttacacatatcatactcagttactcaggcctgaatggcagttgagattgtaatgcttatattgaaattccatccaaccacagccggatcaacaaatgaaataaatggccatccaaaattgtttcgccaagatcacatcggtaaattccaacattctacaggtgttccagaatctcgccacaaaataacgtgcatacgttctcctacatacagagtgcaactgacctttcattatatatgaagaaattgacggtgcaaccagattggatatttgagtgttgcattacaaagttgatgccaacacaattttctcacccagtgacccttcgccaaaaatgtcgcaacaaaatctaacccaccggagctcagcttagctcaccttagtgtagtttatggcgtttcttgccccatgtatatgggaatcttgggatgcaccgccgctgcatccctagttgagaaatacatcagcagaatgcaaaatacaatatgcctcctctgctcaggaacgacacctcaagctacatggcgatcaatttctatcctttcttttaccggttaaggagccaccattatgttctgctcgcctctgctcacatccatgagatgcctcggtgggagatacatcctggacaaccccgtttgctgcaggagcttcatggggatgtttgcagtgccctgtcctatcaatacaaagccaaatcctagctctgtcatcaccagatttctcctccataggcacatgccaagatcccatctccgattcctacgatgaagattacatcagaaacaacagatagcaagctctaaagatgcctgtagcccagttacttacctgaatctccgaagaatatggaggtggcatcataagcaccgcctttcctttactaaaggtgtacttgacctaaacaattggaatgagaaacaaaatcaacaattaagcaggaatggtaatatccaatacgtgaagcagtatcactatgttacaacaggataaaggacccagcatctgtttacatggttttaagtttaacctggcactcaaccttttctaaatcagggttctgtggtaataaattatgcagaaagaatggccagtatgttaaataaaaagaagtgcagagcacacctgatgccgttgcttccacttggggaaaaaagatgaccccaagagctcaaatatgtgatctctcatttcatcattagtcacaagcaaacaattcaacctaatcgccgcatacagccaatacctgaaaaagtgcatatcgtactgttagtaacatcgatgaaatgaaacacaagtgcatcaaaccggagactgatgggtgaaatatccaacctattacctaattgcacatattaatcaatgaatgcacaaatacaatataaggtaccccaaaaaaaaatgcaagtgcacccaagactagagactgaagagcattaccagtcatcatttgacccaattggtgaagtgtacaatgccccgttcgctctccaggtttcaatcaggtgtctattagatgcattttccataagcttggcaatgcgtttattatgtaatacgacaagtggccatttaccattatatctatcccgtagctctgttacaacagcgtccagctgctctatattaaggatgacagataggaaaagcattagtaccacattacttcactgataacattgataggtcaaagtacattgaaagatggagttcagacctgagtcaaactaaagccaccctctgcaaaattttgttgataaagtgcaatatttgcaccatcaactatagcttcatatgctccatgttcttccaaccactcctataaagtcatagcactcaaacttgtaaggaagaaaaaacatgtgttccaaatttataaatggattatcacctagaggcagtgttctaaaagtcggctctaggcgccgcctaggcactgggtagcagccacaattaggcattagatgctgcattaggcggctgaactaacttgggtggtgctttattgctattttagggttacatagtataatttgtatgcaatatgccagctaatttcttggatttcttgtatgcgaactgcctaggcgctagaggcacgcgaagaaaaaataagtatctgaatcatattctgacttgcatcgagaaacacatgcatgaggtatcttacgttcttaggaaggtaaattcaatgcttaactcataagggaagttccaaataatgatttatctaaacatagaacaagttacctgggcaaggaactactgagcagacattgctcaaatacacagcagcatttaaatctctaaaaggggtgaaacccaatatagataaatcagctgagcactattaggttaggccacaatgaagcatcaaatggttttttgaacaaagcagggagacagaccgatgggcttacatctctgactacaatttttctatgttgttatgatcactgagcccacaaggccatgttagattgaatagaccaagcaaaacgagtgatcttcctatcacacttaatagtaaatcaattgcagtcagtaaaatcaactggttacatataccaagttagatatggatacaggttaacactacagaagggcagaggatatgcacctgaaactggctgaaatttattttggtctccctctgaagggccagactggcaacagaatcggcaaacctctgcgtctcctcgacgtcaatgtcaacacatgctagacggcaaccacacccctcacactggccatctcctccaactcttactcgctgcacagtccaagggccggtcccaagccatccaagccgatggcacccgccaccattggccacaatggcgtccttcaccttacaagcatcccactcggccttgcccgccattgccgccttaccgctccgaaaccaaccctccagcacctccgcagtctcctcgccgacacaatccacggtgcggctcagcttgtgcatatactcatacaccttgtctgcgtcccctgccttggcgctgacatcaaggagcgcggcgatctcgggctcctcgggggcaacagcagaggcctccatgtgggcatcgacggcgtaggccttcccggcctcccccgcgcggcggaacgcggcgagcacggggctgtacgagcggaggcgcggggcgacgccgtacttgtccctcatggtggccacgaggtcgaaggcctcgtcagcggccgcggggttggaggcatcggaggcggtgacgcgggcgagcgaggtgatggtggcctcggagggggaggccccggagccgagcatgtgggagaagacgcggcgggcggcggcggcggcgttggggagcgagtcggcgtcggcggtggcgaggaggtggaagagctggttgtactggtgggcgaggaggcgcggggcgtcggggccggagagggcggagtcgaaggcggccatgcggcggcggcgtcgccacggcgggtgcagtcggtgagggtgcgggagaggtcggagttggggcccttggagccacggcgcgggcggcggcgcgccggggaggaggcgccggcggcggtggccatgggtggggccgtgtgggtggtggtggggtggagtagtggaggaggaagaagaaccctaattagcgaggtgggtttggaggtggttagcggccataggcccataggccgcgttagcccatgcctcatcgtcacctcacctctagctccttcgccgcgcgacagcgggagaagggaaagcttcgcgaagacgcggaagccgtcgattcgagagatgggagccgtggatgtaaggatcgacggtccgtaccaagatgaacgaaaatcggagtcctttccatctataagcaaaatatggaaatacaaaaactctatatcacaatcttcttttactagatttttggaatttatattgtcgatgttttcttttagttgatttgtatggactccaaccatggggaggcaacactatgagtcgactagctcgttatcactttggttaaagttcgttatttgtaaggagtagaatgatggattagtgttttccaagctttcaaatggtgcggttttttttaaaaaaacttgtatgcacataaatttcttgaaatatagtttcaaatacattttcaacttgcgagagttaatttgttcgtttgtacatctcaataattatcacaaaccatttactctccattcatttcatatcataagtcgctttcacttttttttttcaaatttttccaagtttgatcaaatttgtagaaaaatataacgatatttctaactcaaaacaaacatattatcaaaatatattcaatgttatatttaatgaaactaatttggttttacatatgttactaatttttatataaatttagctaagtctaagtagtttgactagaaaaaaataaaagtaacttataatatgaaactaggagagtacctatttaggctttagccattcaatacaaaaggacaaagaacggatggattacatttgacacaatttcttttgttttcattgtttggcgctagagaatcgaacacaacagaaaatagtgaacatatgctccagtataattgtgtgttatttcatctttaacataaaattgcataaaatttgtgtgctctcagatatcaaataacatatcacgttggtgatctgtatatgtgtagcccctgaacttaaaaacaaattaacttattccggtgtttagctctattgctgtttaagaaattaatagatcagagctcccagcgatgaaggtcgttgaagcaagcttagttggccctgccagtgaccatggagatgccggcgcggcggccgaacctggcgacggcgcagtcggtggagaagatgtcagagacgacgtagctgggagcgccgcccatcaccggcatgctggcgctgacgctgagattgttgacgtagtcggagcggtaggtctggccgaggacgccatggacatcgtcggagaggtcgtagaacttgaagccgaggtcgaggtgggcgaggctgtcctcctcggtgacgccgtagttgtggatgcgggagtcctgctcggtgatgggcaccacgttggccatgatgtcgagcacgccggcgagctgcaccctgacggcgttggtggcggcggtcctggtgacggtgaggcctggaacggcggcggactcccagcgcgcgccgagctcggcggggacgtcgacgggcgcgccgtcgaaggcgagctcgaggcggtcgtcgtcgctgttccacttggcggtcttaagggcgcccatgtagaggcggtggtcggcgaagcggatgccgagggcctggatccaggtgaagtcgcggctcatggtggggttgcgcttgccgatgaagtgggcgttgatgtggaggtcggcgtcggagacgatgcagaagtcgtggtccttcttgccgtgaaagtagaagttgttgccgtcgccgccggtgaaccgcgggtcgccgcacgacacgccggggtagaagtcgcacactttgaaaaaatcaaataatttcacacagagaatcacacacgatgtcacgatcgatcagtagttcaaatgaattgcaactagctagtgatgcttactgcagaaggtcttgcagccgggacacatgacgatgcactggttggggcagcgcttgtcgcacttggccatgcagacggccttgttgccattggagtcggtgcaggagagctgctggtccctcttgccgaacctgccggggttgatgacgtggtagttgcttggcagcctggcgacgacggcgccgcgcggcggcgcacaccaccaccaacagggcagccgccgcagcaaccaccgcggcgccccgtgccatcgatcgctacctcgttggctagctnnnnnnnnnnnnnnnnnnnnnnnnnnnnnnnnnnnnnnnnnnnnnnnnnnnnnnnnnnnnnnnnnnnn

SEQ ID NO: 55033 - DNA, 811 bp, Oryza sativa
ctctcattgcttctatttcttagctagtcgtctcgcaattcgttgcctggtcatcatcgtggggtgtccatggcaatgctcatccccatgaacagtgatgcgaactctcgcggcatcccatttgacccccacacccctgccttagtcgactacgaccgtaatggtgctagatatcccatggttgcaagtttgcaacgagaaagcggtgctatgcttgaccatggcagatccagcatggatccattggctgtggagcatgagcggttatattaaggcttaggacctagcgaattcatcggtgtggcgatgaagcagcaacggatccagtggccagggctgaccctaacgagataatgggaaaagatgaaaggatgtgtgatgtgtcagtggcaagcggctcgccggctgacttaggcagtgtgggacacgcccccttcctaatcatgcacacacgcagggggatgaattgccatccgtagcgcgcgcgcgcacactctctctctctctctctctctctctgagatgttaggattgagtttagtgttgtgaaaagacacataacaatgcactaaccttttattactcctatttaaattttgatatgtctatccacatatttggtagattttagtaagctattggacagcttagatcgcataaaaattatgtgtgaacaatagccttattgtatccccccctcccctttctcccaggcttgcatgctcacctctcacccaacattgtggcctccccaatccccatcctcgcgacgagtacccctcctctctttcacaccctcccattccaagct

SEQ ID NO: 55034 - DNA, 2502 bp, Oryza sativa
ctgcaccccgaattcgcgaataaatccctccaaaaatttgccaaatggatggttaattaacaaatcctttctgtatgaatggctgctagcctggtacggtagcaatcctaccactgttcatagggcagcttttcttctctctaccggcaggccggcttaatttgccggcatgtaacgatcatggagaaattgcgggtagttgcgggcatgcatgtgggatgatatgcaaattaaggacaaatggagtcaaaagcggcaatgcgtgtgctctttgtgcatgcattatcctgcttgtttttcttcatgcacatctgtcacaatcgtttagttttgggttaactcagtgtcagctagcgaataatgccaggcgctaaagatgaacgtaacggcaatgtacagctaggtagtagctcttccgtcaataatgagatgaaaaggagatcagtggggattagtttgcatgtagtactggtagtaaagcaagctgccggtatctgattgaatgtaatgtcaagtctgaaactggttcaggttagtttggaaccagatgcactctggtctactgcaagggaacctcccctaaactgtcatttatactcacgaaagggatcgcgatttttcaagtagtcgagtgtacagtagtataatattgttgaggttctaatcttcattctgtgtaaaattgccaaaccatatagataaatcaaagattggaattgctttgtagcttcaaacaagctcaatatgttttgcagcaaatataagaaaacaaatttttgcaggatgaaggtgtgaaagcacaaacatcatgggtgtacgggtcctctgtttacaaacagtactccactacctgagaaaaaggtcgaaagcaaaaaaggctgaagcacgaacaaagatccaaaaaacccatatctgaactatgggcgcaccaacagcatgaaacgggcacgagaagaggatgatgagacatcaatcagttgtttatcccggggagaagaagagaacgcatgcagtaacaattacttggatccacaatataatttcgtgtcatggcacattggcatggagcatgaacctttttttctcacggcacgcacatgccgacatttcaaaacacaagaagcagcaccttctgttctcgttctcttctgagcctgatcggatgtggtttagctgagctaagcctccatgtcagtcaggcagtgaggcagaggcagctagctgagctgaggccagcctatctatctaccggccccaactatcatctgccaacttttaatacgcgctgccgtagcaagaagaagaagaagatgaggaagaggaggacggacgctgcatgtcaccgtgccaggccatgtgccgcggcccaacatggcacgttctcccctccagttcacttctctctctgctcacacacactagcctagccagtgtactagtgttgtagtgtacccacctcgcttataaatacccggttccgcactacggccacacaaaccaacacccccactcatctcacttcactctctttctcttctcttcacttcaccaccgccacctctctcatcggatccctgcagaggaggagagggcagtggcggcgaaaggcgacatgggctcgctgtcctctctcgccgccgcggcggtgtttctctccctcctcgccgtcggccactgcgccgccgccgacttcaacgccaccgacgccgacgccgacttcgccggcaacggcgtggacttcaactccagcgacgccgccgtctactggggcccctggaccaaggccagggccacctggtacggccagcccaacggcgccggccccgacgacaacggtacggcttgtgatatctttgctcgtttttcttcttcttctccgacgatctgctgcttctttccggcaatgtggctcacaaaatcttgatccaggcggcgcgtgcgggttcaagcacaccaaccagtacccgttcatgtcgatgacctcctgcggcaaccagccattgttcaaggacggcaagggatgcggctcttgctacaaggtgagtagagtactccaaactaatcaaaagattaaagaaagaaaaagaagcccatttacatggggggcctaactgtcaaagcagtgcatgccgttgcagtcttgaccatcggtccgcagggtgggacccaccgccgagagcatgtgcgcgtggccccctccaccccggttttcggtggcagtgattggcgcgccaaatgcattcaatgctaatgttttttcttctttttttttctttttaacattacagatcagatgcaccaaggaccagtcgtgctccggcaggtcggagacggtgatcatcaccgacatgaactactaccggtggctccgttccacttcgacctcagcggcacggcgttcggcaggctcgccaagcctggcctcaacgacaagctgcgccactccggcatcatcgacatcgagttcaccaggtcagtgaaagaaaccacattgtactgtac

SEQ ID NO: 55035 - DNA, 5751 bp, Oryza sativa
tccatttccggacaccggcaatggattgcacatgcatgtgcagctcagatgcaatgcagcaacaactttattaggtttaggatgtttttttttaaaaaaaatttcatcctctgccagactgcaacatgctcgtttttggctactagcagtaggcacgcctcccttctgcagccaaacgtatgatgcgtgccctgctattatacgccaccggccaccccatttccatcttgtagtaaaatgctttttatcaatcaatgggccccaatccgattaacaaaaaaagtaggacacgattattgtatttccacatgaccagtaaagcaggcagcatatgacaagattagcagcggagtaattctcacttgtgtttaattaacttaatggtggattcgtgtgatgtgatggtgcagggtgccatgcgagttcccggggctcaagatcgggttccacgtggaggagtactcgaaccctgtgtacttcgcggtgctggtggagtacgaggacggcgacggcgacgtggtgcaggtggacctgatggagtcgaagacggcgcacgggccgccgacggggaggtggacgccgatgagggagtcgtggggctccatctggaggctggacaccaaccacaggctccaggcccccttctccatccgcatccgcaacgagtccggcaagacgctcgtcgccaacaacgtcatcccggccaactggaggcccaacacattctaccgctccttcgtccagtacagctgaaccgccgctcgccggcggcgaccctcggcgccggcatcgccgccgctgctgctgctagtaatactactactgctatgatgtaattgtgttaccggttgggttctttgagtttgttggggttggggattgtgtggtcggtctgtgttgcgatttgcagaaaccgggcgagcgaaagaagaaaaaaaaagctgtgtgggaaatggaggaggtaggcgtacaaggttacgctctcccgcccactctcgcttttataatttatcattttcaaatggtgatgatatgatgattaatcaaaaggattatattgctacttaaattgtatggtactaccattagcttgctgtgatctgtatctatcctccctgtttgcgtacctgtgctgtgccattccttctcaaatctcatatcgctggagtaacacgcatttgcttttggctcacagctagagcatctctatgccgattgccgagaggaaaagcaatgccggtgttcaaagtaaacttcaaatttggaagtgcagaaaagcataactgaaatcttggatccctaccgtgtgtatcccaaatggttccatttcgcgcgcttttcgcggtatccagttcccgcgcgcggtaaaattacaaacatgaaacatacggttgtacactactcgtacctttgcttttctgtgattccgttggttagttactgacatgatttggttgccggtaaagtggtaaagcacgcggccaagattatccagcctcccagcattgcgccgttctataaagctcctgacaaggagtggcattttccgttcttttttatcctatcagcatagtgctgctactgctactacttgacttttggagtagtactactagtactgtgctaaaccctttttttttcttcttgaaaccaagaaatgtttggggctcgattcagagtccggtcaaacagaacagggtcggtccatctatgcagcgttacaatagcttgcagccaaaccatcccatctttgctgatgcgtgtgcttccgagttattgcggctcatcgatccagatctcatctccgacgccggcatctttatctactcctcctcctactcctgcgtgaacatgccacagtagcactattactcatcagagttgagaacatgcaatgcaatcatgcagcgtgcgagagcagcagcagcagccgagatcagacattcacaaccgagctccgatccacgcgtggatgcatgtattgattcctacacactctgcgagtgagtgaatgaatgaatgtgcgtgtgtatgtgttcattgatgcagatttggatggagcaaatgcaacatgccatgccacagcatcgaataaattgctaaactgaacacatctactcctactttaactctacatgctctggcttgccggtgccggagctcatcacggtgcagccggagctcatggatggccgacacggtgacattcgcggcgcctttttcccccttttctttttggccaatatggaggagtggtacatgtccgcggatcgagctgtttccccgcggtccgcggcatgtgcgcctcgcctacatggatggatagatgtgtgtggcccaacggagtcaaaagcctaacctgtactagtactactcggcgtcgacctgtacggcatctctctctcttcttttcttttcttttctttttttcagtttgtgcatgcgtcggtgctgctgaataatgttgccgccctgctctgctctacctgtttaattatccaattccatggagctacaactacaatttggtgagtgcgctacactgttgataggtgttcaactccaccctccaactctcaagtgtagaaagatgagttgcaaagggagaaatcatcactttgttggccagattgtgttggagcactgagagaagaaaaatctgagagaatatacttggggcagggagcagtatggagatagagggttttgggaggtaaaaagatctgcgaaaaaacgaacggttgacaagctaagctgggcatgattggtgagctgagctccagtgagtactctctacattcatttgccggcagacatgaacagcggagacgaaagtcagacaagatgatgaattgacccccacctggtccatcagaccaaagtgcaattgcttgcctctacaaaaacacagctgtacatgaccatctgccggtttatacaggtcaagacaatataaatatactgtgcacctctaaagaaaagagggtagaaaaatatacaccatgccacggttgttgtgacgccgtactatttcatatctaaccacaagattaggaatttactccctccgtctcaaaatataagcatttttagccgttgtccagattcatagccaaaagttgttatattttgggacggaggtagtaggcaaaataatattcagtgcaaatacaacaactagcattttacatgtactacttgtagtaagtaccatgtcacgatcattgtctggagttgcttggctggtcctgctgctgctgctgctggtggtttagcttctggtacattgccatcatccggttgtacgcctccatgccgttcggttgctgcacacatttgtgccaagcaattcgtcaggttccaagttcaggttgagatgatggcaaaatgcaagaacgattctactggagtactacatttacctgtgcgttttgctgcgccgcttgggaggcgaggaaggcggagaaggcgtcggaggtggcggcgccggtgggctgcggcggtcggtcggcggcggcggcggaggaggaggatgcggcggcgtcccaggagacggggaggaaagggggcgtgtgcatatgcatgggcgcgtatccgccggcctggcccatgttcatcatgctgaggccgatctgagccatctgggccatctgggccatgacggacatctgcagctgtggcatggccatgcccatgggcatcatcatgctgcccatccggctcatcacctgcacctgcgcctgcagctgcttcaggtagtcgatcacctcgtcaagcatcgacgccttgtcagtctggataaacgcaccacggtttacacgaaccgtcaaaatttagttgatataaatggtgatgtgtgtgtgtctatatatatatatatatatacatatatatatacatatatatatatacatatatacatatatatacatatatatacatatatacacatatacatatatacacatatacacatatacatatatacatatatatatacatatatacatatatatatacatatatacatatatatatatacatatatatatacatatatatacatatatttgttggagtgatatagtacgtgctaaattaatttttacaaaactccagctaataacgatgtcaaccgtttgatttaaatagttaaaagttgaaaattttcaagaatccaatcaaggtatgacacgtcagtgtttataaagcttctaagtttctttttgtatttatatatattttctcccgtttatttttttttaccaatgtacgtggatttaggtttgtttgctgtcgtcgtctcaccttgcttgaattgggaacgagcttctgcaatgttttcatcttttggttgatcctgtcccgtcgtttctgcaatcaacagtagaccaaatgattttttagttagtcgaaattagcaaacatcgtaatagtaatattctagatttattttttttccaaaaaaaagtcttttgagagagaaatggagtttttagcccatggatgggcaaacaatttttacccacgggcggttgtgttctgttcatacttcatagcaacaagctggtcatttttagtcctgatgactagttaaaagaagcttaaatttttaatccatccggtcctgttcggaactgcaaccggcaaatgagactatcacgggcacagttcccaagctctgatttcattaaaaactttgttcatcaatatttttttctttaaaaaatactttctattttttatatgcaattcattcgtctgtgcccttaaataattttcataaattcagtttttgtaatccattagctactcctaattcaaacgggacctaatcaatttcagttaagtaaacatatgcttcaaaactcacaagagtcaggtaagcatatgcatggcgacatacacatcagcttggaactgaaagtgatattggcatcctcagaaagttgcaatattgacgaaccttccatcaaggcgaggccaaaaaagatatcaatgaattgtgatagctatctaaaacgtatcctatagcttgtgatactaattaacaaacgttgagttttcaactggctgctgtctaggatatcattggtctaaaaaaacaaaaaagagaactagttggcatgtactagctagtagtgacctttttcccacaaaagaaaatgaaattcttaaatcagttgtggatgcttggaccagattctcagttccgacaatcacaaaaaaaggaaaaaaaaaaggagctcaatgcatgacatctccaggggaaaagtacagaagtgttggttggtggctcaaaacagtagagtggatacttggagcaaatttagccaagaaaactcattatctaggtagtagaatcatgtggacatccatgcttacgtgattattctttcgcacaaaccttaacttcatatttgatgcgtggaaatgtgcagtactgtataaactatacctccttccgtctaaaaaaaatcaaacccagggtttgtgcgtccagatacaaaccttgggtttgaatttttttccggggaaagaatttttttttcagaatgaagatatagtactagtactagatcggtaagcaattttagatgtataatacacctagatcatatttttttttaagatagagaggctaacctttgcgtttctattaagagaaatgaacttcagctacaaccggatagaaagaaaaagaaagacttggtgcatcatttttgcttttcctgtgatgaaaaaagaaag

SEQ ID NO: 55036 - DNA, 1192 bp, Oryza sativa
ttaaatatacatattgatctatcttattcatattttttcaattttttttataaccatttagatgacatgcaataaacgggtggacatccactcgagctattaaaatagtttcccctgggtagagtgtaaaaatggaggtaggtcgatcgcttacacgctcagattcgttatggatggcagcggctcggctcctcttggtagaaatagacgatctcatcgccccttcccctctgatcacgacgtgctcatcctcgtcgcacatgccacctctcttttaatttttcaatgcaaactctttcagcgaattattgataaatacaaacgcaagcaaacgaaatctgcgctctgaatacgagagtgaagatgagaagctagctatggtactcgacgtgcatgaaaaagctagctactatctgtgcttgcctgcgattgcgagcgacggctgaagcaacgcgagtcgctggcgccgccggcgatgctggtgttctccgtctccggcgagcccttgtcctccgtcctgtcctccagcgaggtggagttgttggtcgtcgtcgtgaacccgcacacgtcgtcggccgcggtgccgcagcaggcgtcgagcgtgagcagcgtgctctcgccgcggcgccccggcgcggcgctcccctggctggcgcacgcgcgccgcccgtcctcgccgaccacctcccgcggccgcttgctccgcccctccgccgcgtcggcgtcgcacggcaccagcgcgtcggccgccgccaccaccccgacgctgccgagccatggcgcgggcacgggacgcgcgcgcgccgcgaggtgcgacgactacgacgaccgcgcggtcgcctgcggcaccaccgtctgcagggtctcgcggtccctgaccacgccgccacctcctccccctcccatggcagcctgcagctgctgatgcggcgggaacttgggcggcgcggggcggttgagcatcaggccatgcgaggagatgttgcccttctcccacgtcagctccgccacctcgttgtatggtccgacgtcggcaccgccactggcatgaaccctcccccgcctcccgacaagacgcggtgcccgccgccgccgccgccgccaatcccgccgccacccaccgggtcgtccagatcccagctcggcacgccctggttcatgatcgatcaacggagtgcacgagtgaatgggg

SEQ ID NO: 55037 - DNA, 2856 bp, Oryza sativa
atatttcataaaattttttgaataagatgaacggataaacatgtgctaaaaatcaacaatgtcaaatatttagaaacggagggagtacacgtcattcaaatggttataaaagatatgaaaaaaattaacaagatatagtaatacgtgacaaaccactccacaaatgtgcaagttaaaatttattttttataagataaaaaacagattaatctatgcctcgttaatatatattcacaatcaaatttatttctttcgttgtaacatgtagaagttaaatttaatcttatatgtttgtgaagtgatttatttgattaatttttcataactatttagattacatgtaaataacgagggaatatccctcgagaatttagaattgtttctagtacatttatccctgtgatcattttggaacatgagctaattagtggtacatgtgtatacatatcggcggggtttatttggtaaaactttataactcttaaatttaactttatgagcgtagttttaagtgaaatgtgaagcggtctaaaccatactccacttctctagtgtattatttcctcactacttcaatccgctcaatttgctttttttttatgaagctgaaatcagcttaagttctagactttaagcctgtgttcgggagggaaccctccctccccggcacgcaaaataaagcagcatttagcgcgtgattaattaaactttagctattttttttactaaaatggattaatatgattttttaagcaatttttgtatagaaacttttttttttaaaaaaagacacacagttcagcagtttgaaaagtgtgcgcgtgtaaaacgaggagagggagttggtaactgctgggaacgaacgcagcctaagagtggagctgaagcaagagaccatctatcatatgatacagcacgtacttagcacttagcagggtttacattaccgtcggtaaccgcgccggtacggtaaatagaaaaaccacggtaaccttctcaaattcaaataaatttaaaaaataatatacatttttgataaattttatacagttacgtacggtttttcacggtcaccgcgcggtaaccccggcttcaacggtttgggaaaaccttacacttagcaggagaaggaaatggttttgtacgcccatcgtcctctcccttttgttagaacacttgcattttttttcttttccttgcacagagaaattgttagattcgaatgcgtccaatatataagcgacataggcattctcctctcctcgttagttattggcgcgggatggattacagcaattaccaaaattaagacactgcacctttgcccctcgtggcctcgtcgttagttgtggatgctagctgcttaatttctgtctttgcgtcataaggccgacgcaaatcaacgatcagctgttgatgagctagtatatcggtcatctcaatcgcatcgagaaatcacagtcgttcaagagtggtgtttagttccctaaaaaacttgaaagttttgaaaaagttaaaagtttaaaaaaaattagaagtttatgtgtgtagaaaagttttagatgtgatgtgatgtgataaaaagttaaaagtttgaagtagttagaagtgaactaaacacgatccatccagatagaaaaagaagcccttttttttcccgatggcccgaatacatcacgaactgtccttgacggcttgaccagcttggttcagtgaacaactgtcaaagaagataagaaccttacgcaactggtaatttaggattggaaatttcttgaaccacttgcaagtcagattatttctccttaccgcaggaatttggaatttgtttaccacacctcttcgaagaactgtataggaaggagtctacggggcgtttgaatcacatgcagagagcaatgtaaccaaccaagggaccgagaacggagatatgtaagagaagaatgaaagggttgcaatctgagttcggatgggggagattggaatctaacacctactcacagaaaacggagcggtacattaacacgtgattaattaagtattagctatttttttaaaaaaaatagattaatttgattttctaaacaactttcgtataaaaactttttacaaaaaacgcaccgtttaaccgtttgaaaagcatgcgcgtggaaaacgagggagagaggatgggaaaaggtgcatgcgaacacagccgaataattgacggaggacagagatataattgtgttttggggagaattgacggagagaaatggaatggtgttaattttggggagaagagagcgacctccaattttcatataatcgatgaaattatacaagaagtgagaacttggagcacgggtggagcaaagcgccaaatagcgtatcacaacattattaggataagtttttcgtaagcgctgagtgctgtgtgatttagccgcgtttccctgtacataacaatgatttttcgttgtttttctcattctctctcccctatccataatataattaacgtcggcaatggctgacttttcgttcaaaaatgatagcatcaacctgatgaaaccactgaaaacggcacgcgagaagcaacatcgctgcatgtattatatcattgctgacgctggagatattaagctccattgcgaggccaagattttgcaggccaaaggaccacacatcacacagttcacacatgcatgcaaacacatggacaacttctaactttctgtcgagaaaattacctgcccaaaccaaaaagatgtcatcgcgctgtgcgctacccagctgtatggaccacgacgtccgtttttatgcattgatgagtttggggtgaatccaagctggtcgatctgatatgatctgatc

SEQ ID NO: 55038 - DNA, 1651 bp, Oryza sativa
caagattcgtgctgaccatttaacctaactcctccgcctcctctccccggttccagatcgcgccgccacccttctcctcccgtcccacgcgtgaccgccgccaccaccgccaccgctcccccggccgcctcgccggcgccgttgaccttttccagccagccggcgaggcgggcggcggcgcggtggcggtggtggcggcggatcacgcgtgggacgggaggagaagggtggcggcgcgatctggaaccggggagaggaggagaggagttaggttaaatggtcagcacgaatcttgaagcacatctaatgatccaaaattcaaattataggaggtgggattttctgtcacatgatatatatatatagatagccccaaaaaaattggaaatatgacctgcacggtgggcccaccgggacagagagacggcccgactcatcaccgaagtgccaggcggctgggcctagctgtcagtgacacgtcagagcgccggcgtaggggaaggctaccccacccgaccacgacttccaccgtcttcttcctccacgttcctatccatggcgccagttcatctcgtgacgtctcccgctcccgctcgcgttgctcccaaaaccctagcggctagagccgttgctgcccgatcgcgcagcgagatcgatcgggcgcaggcgccgcgccacgccgcggccaccggcaaccggtagtacaaggaaggatggatgagagcggctgcggcggcggcggcgacgacggcgagtgcatcacatctctcccgtccgaaccctagccgtatgcggaggaggagccgccacgcggcgccatcggattcgctgcgtccgctcccaccattgcgcgagtcgcacaccggccggcctggttcctctcgctcgccgaaaccctagcagacgaggcgagcggggatgttacgaggctacgccatggcggctgcgggctttttggtggcggaggcgagcacctcgagcgcttcggttgtcaaggtaagggtattcctcaggtggagtcgtggtccgtggaccttgaggggtttggggaatttgtcttcctagtgttttttgttacgagggtaatccgtgattttggttattcgactcggaatttcactggttctgatgcgatatgcttgatcactcagttgaattatggggaatctgctctggttttgatgaaatctgcatggcaataaggcgattttggagattgcgtcggttaattgggtcatgctgttggattcccaggaggttgatatcaggccacctgaatgtcacgaagcttctagagcgagatagaagttcggggaaccatggcttggatggagccaccacaacttcacagctaccgtccaggttgcctgctacagcgatactcaccttgcggtggtaaggactcatggaaactttgtcgcagttaattttaattgcactcattttcttaatgtgtcattgtaatcatgcaatcgtattgttctggtctgtctgtgtatgggcatatcactttctttatgacatctctaattttgtgtcggcaaggatttgatatatcgttatctacccgtggaaaaactatattgtgatatgttcaacggttctgctactcttttgggtccattcgtgataactgaggggatcggggtgc

SEQ ID NO: 55039 - DNA, 3086 bp, Oryza sativa
ttcctgcagcccagatcgtcgatcgtcgtcggctacgtacagatcgatcgttgacccagtacaacaagatcgaggaagattatacaattgggaaactctaatcagatgattaattgtcgtgtcaggaattgggggttggtgctgggttagccagggtaggtagtaatgtcgacgctgccgtaccagcaaccgaacattgcatatgcctgcctgcatgctttcttctacactctctgcagctagcagatgagacttcaatttggaagcaagtttcctgtcaatatatctgatggggatttcctgtacattttttcagccaagtttatacagaatccttttaatttgctcccagcaagtttaaaaagcatctagcatgagcaccatacaccaattagaaagatgtcaaactagagtggataaattaataagaccaatccctaattaatgattacccccattgacaaagcctagatttcatcatccaacattacaccatgcacgcaccactgaccaagtgagatcagacagtggccaccacacttccaaaaaccttttatatttccccagttgcatgttgtgcacgcgacgacgacccacctgtgcgacagaattctattctccaatttgccgccgagataaaatacatcaatcgatcgatcagcaagcaatcaacaccaccacctgatatacatcgatcgtggattaattgatcgatcgagatgcatggctcagcatgcgagagaaatctctcatgacatggtagatctagttggcaccgagccaccatgcatacacgttagaacttagaaatgtaagtgaaccgacacgtgaatctacttatataaataagtgggtaacttgtgtgttcccgcgttatagcctgacttgttgcacatagggatacaagtggattaactctatacctacttatagatcaaattatcaggtgatccgggatcaatacacaagttaattatccactaattttacctataaatcgattcacgggtcgatctactctactccctacgcaagcatacactcgaatgcatccgcccaattgagattattgacatgcatgcatgcgacttacctactttgtccaccgaatcatcggccgtccaactgaatgatcggacgtacgaactccgtccaaaagggaatggggcccaccacgacgttgaccgggttcaatcttgactgccaccgtggcagcaatgcattaggcatggcaccacacccctaaattagttggtctccagtccatgggtgaagtgtacgtgcgagtcaatgtagaagatccccttattaaggcctaactaaacgtcaaatctgtaatgtgtgtgttggaagctatggctctccacgggaaccaagccaagtgatcgctccactgaaaattctgaagaaaaaaaaattctagaagatgagatcgatctgcaatgcatggtagaagaagattcctactgctactgctttctactccctccgtcccataaaaagctaacctagtattggatgtgacacattgtagtactatgaatttgtacatttgtccagattcgtagtactagaacgtgtcatatccggttctagtttcgttttttatgggacggagggagtatgtgctcacactacactgacatttcggcccacccaccagactcctacctttcactgagatgatactagtagtaatttttcggaccaaaaagataaatatagaactaaatgtgacatattttactacaacgaatctggatatgacagaggtatgtttaaattcgtagtattaggatgtgtcacatacaatattagattgtttttgtagatggaacgagtagttacctagtactagttgcctgatttgcatggttgatcttgatagaaaggtgagggagtgtatgaagaaccaaacgaaaaggagcaaaatcgagagtcgcgctagctaggctccaaagcaacggcgagcagttggcaagctcatctgagccactgccagcccgggcccactggcagagccaggcttccatggccccaccattcatcgtcacgcccgtgccatgtgggccacacgccctgacacgctggaacgaacaagtactagtgcgagcaggagagccttttttgcattggcagccaacagagacaggcacagctgctctcctgctgcctgctgcccagctgcatcagagtatcacagaagcaaagctccaaccagctaaattctagtttaatccactaccactaaccaaaaaaaaaaagaagctaagataaactacaacagctaatctctcactgacattgtggggcccagtgcaggtaccgggccactgagcataattaagtgaagtgtgtgcacagtgcatgactttgtgattcactatcgaacaaaaaaacggtgtggcatgagcatgagttgtgtcatgagtgatggggtgtactggtgttaggcaaaaggacagtgtgaccaccacctctggaaacatggaaggcacagagaaatctgagctataaattttggtttttttagtacttatcaatgagcattttttaatctgatcaagttagaggaataagtaaactgttactggtaatgtgaagttcagagtagcagaggttaatggtaagacaggttaagaaacgaatgaatgcgttcaatgagataaatggagcaaaaatatcaatttgatttagatacagagcgcccaaaatgaaaaaaagaattttcagctgctcaactgaattttcagctctagcaatagcagcaacagcaacagtaactgaagcttaagcaacaagacagagaattctccatgatctggtattctggttcttgcaagagatgcagagcttcttacctcgaatgaatccatccttgcatgcagctaggaagcagtttgtcctaccgatttcttggtgatctggagttggcagccatggatgatcagctggttggtggtgtgtggtcactgtctcgtgctggcgaactcggcgtcgtacacggcggagagctcgaagtcgtcctccattgtcgccggcatgttgagatcgatggagccggagctctcgccgcatttcgccgg

SEQ ID NO: 55040 - DNA, 2284 bp, Oryza sativa
cctgcagccccacgcagccgccgcccttgcctctcttgaggctcgcgcggtggccgccgagcgcctggtacgaccggaacaccttcctgcatgcgccgcactggaacctgctggtgcggtggcgcgccgccgccgcctcgccgccgccgtagctgagctcctcgtcgtgatcctcgccggccacgtcgcgggcgtcctcgtcttcttcgtcgaacacgttgacgacgttgttgttgttctgctcggcctccgagctcgccccccggtggtgggtctcgtgctcggatctggaacgcgtccacgagtcccgagacagcatcaagagcgacatggccacgtcctcctccgtcgtcgcgtcggagacgctgctcgccggttcgggatccggcgcgcgacgccgccgccgcgcccgcttcgaccgcctccggctcacggcgaagaacgaccccgctccgccgcgcggcggggacgactccgtgtcgctctcgccgtcctgcacgaccgacgactcgccgccggcaccaccaccaccaccaccaccggagaattcaccggcgctcaccttgtagctcctcttgggattctcgcgcaacacgtacgacgtcagcgtcttctcctgctccgtcttcttcgtcatctccttcttctcatccatctcgatctccgtcgacgacgtggacgccagtgacatcgccggcgacgacggacagtacgcggcggccgcggcggcggccatgacatgggagcgcatgtggccgccgagagcgcggccattgtggaatcggcggaagcagagcttgcaagtgtgcttgtccatcaccagcaaaccgatcgatcgatcgatggatcgatcaagcaagaattcacttacttgcttgagctgagctgagcagctgcttcttgcttcttgctttgctttgcttgcttcttttctcctccctttgctttctcctcttggttggcttttggctccaaagatgataatagttttatggggaagagaggtagaacaagtgtgaggagagtggggaactcaaaaaggagtaggtgacaagcatccttccaccaaggaacaagatcagcaaacaagaagaagaaagaaagactgaaagaaaacaagtgggagaaggaggtgacagacaatgccacttaaatacacagcaatggcagggtgagagaagcagaagttgctcaagggttttccctgagatttgcaaaaccgaagatccaaagtaattaactgctaaagatggggtgggcccacctgtcaatggcactgtttcagaaacggaaaattggtctgtaaaactggccacaattcaatgcaggatcaacctggcaaatcttcaggtcaatatactgcaaaatggggctagtgggagttacttgcaatttcagagtttgatgcattgccttttctttagcagggaattaagcaatataggctgtcacatgcctgttggcgcaaacaatggagggaatttataaagtaatttgtgtgatgcttttgtggaggtgcattggatttgaccagtgggagattatgtgctcatggccaattgtgagccattttttttagataatgtaaattttaagggatttagataatgtattgtgagccaataaattggaagggattaaacattgagatacgctcaaatctccatttcaatgcctccttcaattgatcagcaactcttatcttggtgtgagaagattaatttagctagggggacatatatgtaaagcactaaagcctatcctgatctccccaacattaggttccattttgtggaaacacatacttgcacagtgggcaaagaagtactgcaagatgtgactgtatacaactacacatttcctggaactaccacagtagtagaatattaaattatcgatatcatcttgttttactcaaagaaaaaaacaaacatgttgctaattagggatgatcccatatgcaggggtatgttcaattgacatggatgtgcgcacgaattagcatgccctttttctgtcggtgtgctgattatacacagaccaaaattttcagaaaaataatttatcacagccagatgagatcatgagataaccaccggttgctagctaatacatccaaccttggttcagagaaaattgtagatgggatggaaggaataatggcaatgaaaagatggtgtctcccttgctttatttctccaattcatcctcctttattttctttctttttggttgtatcgaccacaccagaaagatgagcacgcagcagacgtgggctgcagga

SEQ ID NO: 55041 - DNA, 927 bp, Oryza sativa
gctgtgatccggatattactgtggccatcaacgcctttcttcactcgaatcatgtcgataatcttgaattgttgacagtggctgcgctatttttggaacatatgcaagcagagggatgatgataagatcggtgaaaattcattgcacatatattaatatatatactcctacctctgtaatgatttattctaattcagttgcctactggagtatatacatttttacacgtgcatatcgatcgtattttcagcagtaaataattatttgctggtgctaggcactgccagcagggagtgttagttagcgtgttgatctgcatttggtgtgacctaatcgatggaggaggtaattactagagcattgatcttcttcctttcttttccttttagttgtaggttcacctggatggacttggttgtttatggttattcatcatgttgttcctcgaattatttgctccatgcttctataaaaattataatatttatctactgtatttattatgttcatagcatataatatttaattattgctacaatcaagtaaataatccatcacttttggccgatgaataaataaaagagtgaattacaacttgtgccactttttgttaccacggtttcactttagatcactcattgaccaacatttttctttgggcaaggtatttttacctttgttgtaatttcgaatactctaaaccacttatttaacgcatcaatgacctcaagcatattggtttcgaaacaccggcaaactcctccacctctctgtagaccatatcgttacagggagggagactagacatggctaaagattaaagaatagagttgaatagtccaaagtgcaacaaaattaaaaaaattagtcttaaataaaaaaattagataaaatgtgattcatagtgaaacttaaacagcgcaaaga

SEQ ID NO: 55042 - DNA, 1138 bp, Oryza sativa
tccatccgtccatgattttctccctagccatgtgacacagctagctctctttctaccacgccggccggtggccacgtcgggtgcaacgaccccttgatgccgccgtgttgctcgtccattacatttggttcccttcccctctcgttttgccctgcctataaatacaccggcaatggcctccgattccaaccatcaaaccacacaccagacaatacttactaccactactactgctgctgctgccagttctagctagcctactgctcttctccgagctgaagatttttcgagctagctaggatggcagccagaatgggcagcaaggtcgctgcaatcctcgcgattctgtccgtgctcgtgggcatggctcttgcaaggggcatcctgtgaactacaacgtctccgacgcctccgcctacggctccggctggctccctgcccgggcaacctggtatggcgctcccaccggcgccggccctgacgacaacggtgcgcattttgcagctactgatgatgcttgtggtgctcatctgtgcttttgcttggtctctgaactgacgcattggcattatttggtcggttttaatttgcaggcggcgcttgcgggttcaagaacgtgaaccagtacccattctcgtccatgacctcctgcggcaacgagcccatcttcaaggacggcaagggctgcggctcatgctaccaggtacgaaaaaactagtcaaattacttcaccatggcaccaattttgcaattagcaatcatttgatttgattggtcaggacgtactactactacatttttctatacgcatgcatgtaggagtaacatgcagtgcggcacattttgttgaccatttgtttgacttggttgttacagatcaggtgcaacaaggacccgtcgtgctgggcaacatcgagacggtgatcatcaccgacatgaactactaccccgtggccaggtaccacttcgacctgagcggcacggcgttcggcgccatggccaagccggggctgaacgacaagctccgccactcgggcatcatcgacatccagttcaggcgcgtcccctgctactacccgggcctctacgtgaacttccacgtcgaggacgggtccaacccggtgtacttcgccgtgct

SEQ ID NO: 55043 - DNA, 774 bp, Oryza sativa
ctgcacccccggtggatttcgagagatctgatgcggctacggtggctagtgggagcgaagccgaacttccctttgcgtcgcggcaccggccgcctggtcagcctaaacggagcgggtttttggggaggcgccaatggcgagctcgtgggggtattggaggcggagcggtagatccatgctaaagctggtggtggccttgtgcttctttgctgtggcatctccatgaccatgtgcttcgtctgcttcagctcgatcggattgcagtggcagtggctgtggctgtggattcaggtggcacactgtgctgctccgtttaggtaatgagattctgcgcacttgttcactccattttggtagtctccagctcagtggctagttctgggcagaacctacttgtttggtgtttcatcgccgttgatttcattgctgtgaccagagaccaccgtccagtcgccgtgcgcggccgaatcagcctcagcgcaggcgcagcaccgcagcggcggctgcgagagagaaatagaagggaggaagaagagaagggaagtggggctgtcaagtggcgccgccattttttaatttttacctctttcacttacacatgggacccacttctatttttaattcatttaatgactgggctgccacgttaatatatttggacaagtcaacgtatcacgtcagcagaaaccgctttcataactaccaaaggagtcaatttatatcggtttttcaatttaggggatatgttatacttggttttgcggttgaggatac

SEQ ID NO: 55044 - DNA, 1817 bp, Oryza sativa
  unsure (1)..(1817): unsure at all n locations
gtattacgctaacacatgctagtttcttgtgtaattagatactaatatatatattgatctattagtttattaaatcaataatgtgaataaacaatatgaactacacacagtcaagctcggtaaaagctcgagttcagttcggtagagctttcaagcttttttctcaggctcaggttaggctcgtttggagctcgatccaagcttgaatcaagcataggacgagtcaagctcgagctgcttgctaagcctcaagcttttttgacagctctaatcccatagtacggattacgggttatcaaagaaataatcaatcctattgcatggatatatgttggtaatataaaatgcgaaaattaagatttatagataaatagaggggtataatcagtattgtacaaaacaaactaaacctagtcattgttggatgtcactaacattgacactgcatctaccttatagttcaacaaatagttttactcattcatcattcatcatatcacacatccaacgatctaaagtcatctgatgatttacatccgatggcactggaggcgcgcctctcctccctcccagatcctcttgtcccacaccttcttctctcccacttcgcatccatgccgccagtattgccgcgatttcctccccatcccctccaacaacgcgatctccgccaaatcccccgcaaggccgcaagcccgcaacacatcccctcgcatcgcgttccatctctcgctagatcactgtcgcctcgccgccctcacggtcgcactgcataggccgattcgacgccgccacgagtcgctgcccgtcttccgcggccacgccatcaccgcctggccgatcgatccccgtcgaccacgaccacgccgcccgccgattgcccattgccacccgccgatcgtcgacctcgaggttgattcccgaatatgtttgtttcgctcatccctttttccaatacttgcgttgccgactaacttccctcgatcagccgtacacgattcaccgccaccgccagtcgccacattgctgtcagatccggttcttcgccattgacatccaccggtcgtccactcccacaacgccgctcacgtccttgttcaggtattaggcatatttgtggcatagtactcgttctcagttaaatctaatgggttttctttctaatttctgatgaaatagatttgctgtgtagtcaaattgaaggggagagacttttatatcagatcactgccggcatttatcttcatgcttgaatttttacagtcattttgaaatgagattggctgattgggtgtgttctttctgggatatattaggctgtagctatagtagttggtcattgattaatacacctcctatgtatgcatttggaagctttatgtgcacttccaccaactaaaacttggccagtaactgactaactgccgaaaagcagccttgttaaaagaataacttttctgcatttgctttcagggtaaattatgattttctttttgttttcngccgtaaaattctcttccagggactgtcgtgaagcttctcccctgaatttgttagctgtagcatgtgacaatccaattattgtggactgtttaaagaagaagcagtacaagcttttattaaataattactttaggaaaaacagagcagcgttttccatgttgtttcagtgtactattatgaactgtggtttctaggagctaattgggaggctgctgatttttaattgtttaggtttggatatcatgaaagatcccatattggagattatttgtatatagcatacatgaaacttatcaaacaaacctgcagtttat

SEQ ID NO: 55045 - DNA, 7537 bp, Oryza sativa
  unsure (1)..(7537): unsure at all n locations
cccacggatccgctatagcaaactccttcgggccggaacgggatttctggtagcctatgaaggcaccggaaaatatttgggagaataagtttgcattaggtccctctatttgtcgttttcgtccctgaaccacaaaaccgggtacaacatgtcccccaacttacgaaaaccaggcaaacgaggtccctcgatggttttgatagcagttttggctgacgtggtgcctacatggctaattggactcgggcttcatccgacgggggacagacgtggcgcttacgtggcaatttgatctaagaaaaataataaaccctgtgggaccacatgtcagtttcacacataaattaataaaaaaaatggtgggacccacatggcccccacatgtcatcctcactcctctccttcctcctctctcccctttcttcatctctctcccctctcctctctcaggcgcgatggagagggagcggcgcacgccctctgccgcaaccagcctccaccaccgtcgcctcctcacgcttgtcgatgccatcgggcacagcaaagcagtgtgctgatgtggacaaagagggaggggaaagaggagaatacaaccttcccgtcgctcctttctgtttcacccgcaccagtttgttagcggccgcccgtctgagcgaggagcttcccctttccctttttccactcggacggcaccatcatggccccctttgtcccccgacacgccgccctccgccttcggcccggtcctctcccgcgacgtgccgctngacgcttccctcaccacctccccaaccccgtcccgccgccgccaccggcatccaagctccccatcattctctacttccacggcggcagcttcgtcctcttctccactgacaatgtcttctaccacgcctcgtgcgaggccatggctgcgaccgtgccagccatcatcgtctccctcgactaccgcctcgcgcccgagcaccacctccccgccgcctacgtctctaccgtgctctggctctgcgacgcggcggcgggggacccatggatcgccgcgtcggcgagggaggtcgcgggtgtaggggccgtcgccgtcgggtgcctggccctctcttccctaccctactccggccgccaccactcctcccgccgccaccgctccgccccgccgctcaggctgagagagagaagagggagagagaaggggatagagagaagtggtagtgaggatgacatgtgggtcccgtaggttttattatttttgatcgaattgccacataagcaccacgtcaatgccacgtcaaatgaagaccgagtcaaattagccacgtaggcgccacctcaaccaaaaccgggtcaaatactaccgagggaccttatttaaacggtttcgtaagttgggggacctgtcgtacccggttttgtgatcaagggatgaaaatcagactgggtgacaaatagagggacccaaagttaacttattccgtatttgggcctacgtgggattctcaacattcgtcaagccagcaatttgtgtacgtgatgcgccgcgagttgggctagaacatgtgatgacgccctgatgtgatgacgcgtttccgatcccacccaggacctgcattcttgtgggccgaaggaaagaattacacggacctcgtggtggaaaaaagttcacctgaggttcctcgtattgttgccaagttacaaaatcgtccataaataaccccggttttgtcttatgtggtagctgagttaacgtaagacccatatggcagcacctcaatcttcttcgacatctatcctctcttttcccatctcaatcaagccttcgggatggctggcaacgggcggggagaaccggggtcaatactgcctaagcacctataatgatccggttatataagtttagggatgccatatatctgattttcggttcaaagacgattttttaacttcgtgacaagatgggagatcttaggtgaacttttttcctttgcgaatacatcaatgtttgctagcctctcctccctattgtgttggttcattttgcaatgggaaaaaagtccacttacatccctcaactaatgttcggtttcatttaaccgcgtctctcaattacaaaaccaggtacaatgtagccctaatctaaagaactggtagagaaagagatggggtgtttacatccaaatttggcacctaggaataaaatagagaaaattaccaaagtttggaagtctgccggttttcctctgagatggccggtctgaccgccgtgcgttggtcggtcagaccgccgccagtaggtctgtcagaccggcggtgtgtagccggtctaaccggcagagtccgatcccgagtctgtttcgtcgggtttcgagttttccttgcttgggaagtcatgtttcgggtttcctttggtttctatcctgagttggacgtggaggagggcctgtagagggcaagaccaacccctatataacggacaaggccggttcaattgtcaagacacaatcaacaatcaatcaatcgaatcgtttttcacattgcttttagtttttacttagtttgttcatctttgtcgatttgcgctgtaaatcgtccgccgccgctgcgagagtacgacacctctttgtaggtttgtcctgaaaaccttccatttttcccacgagacgggtagttatccatcattctatctagatcggctccgctagctggtttagtttatcaaaacccatcttgatttagcgtttgctaaattgaggtggttggcgactctaggatcaccgcaaagctttaggtgttgcaattgtgcttgtcaacttgtcataaaaggttgccaacacagggatagggatttttttttcgtgtgtgtctgacatgtgagtctcatcgtatttcatttctttttgttgaccataagtatcatgtactccctccgtttcacaatataagtcattctagtatttctcatattcatattgatgttaatgaatctagacatatatatctatctagattcattaacatctatatgaatgtggaaaatgctagaatgacttacattgtgaaacggaggaagtaggatcttgggattatatttacatccgttttataagatgaggttcccggtttttctggttgagggactcgattgaaactcaactcttatataagggacaaaaggtggactttttccttcagcaattaacttgttcctccaatgttaccacggccacaggcaaaggccagcggccagccgtgggccatccaaatgcgagcgaccacacaacagcatctcatggcgcagacagagagaaagcgaaaactcggtccatccatccatctgggtccaagctgaagaaacaccaaatgatggagcacggtcttaccgatcgttaaccggtcgttgttccacgaaacaaaccgactcgccgccgccctgccggcccccccggccagaccggcccggtagttagtggtccagcaatgtccaccagttttttgccccgagactggattggacggcccacccgtcatccaatttccatcgttgataattttgctacttttttaaataatggaaatggattacatttccggcctctacccgtaggcaaacaaccaaaaaaatccaaaaataaacagaaaaaagcttaaaataagataagatgggacaaaccccccaacttctaccaataatatgatatactaaaataatgcttctaaaatcacgtagattctatcacaaaattgctactatagtttggttatatccacagacatgtcgcaatccgactaatccaagtgtggctttaatatggtggccattccatatccttcccttggtataggcagcataatgattcatcaacgtgtgatgaggaaccggacgaggcagtgcacatggggggagctcagctgagctgctcccttgccgctttcaccttttcaatgcccctgcctccttgccaaagctaggccaatcacaccaacaaaccaaaaaaacaagaacaaaaaacgtactactaatgtcaaatgtggctgcgtagtgtaccgggctgcctctcaacgtgggcttcattgtctcggtattttgctttcctctccaatcctcctcactccgggtcaaattggagtgacgtctccaacagttgatcactggcatattgtcatgtgaggccggatgaattttcgtgtgttttttcttttcaacgaacctgtcacgacaaaggccgacgtgcacatcactccggtcacgttaatcacgggatatacactcgggtcagtcagggccggactccctgaaatccgaacagaccacgtctacattattccgcccggtaaccaccacttgttcccctgatcctcccataccataccataccacactgcaattctgcaagcaacgcgaccatctgtatgtgccaccgtgcaaatggcagctcacgtgttcacttgcttcagcttgtaagcaactgcaaaatatatgaaactacgctgagttcctgtcattctgatcacgttgcaagttactcgcaatcgatctcgccgtgttctctgcaccgatcagcctgacctgcatgcatttcaggatggataccaaaagttcaaagttcaaacattccgtctgcaggataacaatggataaatagcgtgccagacaacaagaacaaaccgatgcctgaaaagcaggccccaaaacctgcaggtttgttactactcctactagtactatccacacatcataacacactgtacagccattggtcgaggagtgcacggttttctctttctttcttccttttgcgtgcagccgtagccgcgccgcagcgagaacgcggggggcgcggcgcggcggcagacggggtgcacgagcgcgaggcgggggatcggccggcgaaagctcagtggatggatggatggcgacgcgaggacgggtagagtgagagagagcgcgcagtgggtcctggaaatctgctgcaacagcgccgttttgcgtgccgaatagccaaaaaaacaaacaaccaaccggagaatctgagcgagcgagcgagagagagcggtcatatatgcaccggtgagcagcagcgtcggcgtgaatccacattgtctcagcccgcacatgcgccgtcgcagtcgagcctgtttactttgtcctctttttcagtctgggtaactgtcaggtgaacgtgagatgtgcaagggtatcgttcttttttttcacatatctcacgtaaccaaataaaacataaaaaaatactagagtatcgatatttttatcgaatgtaatacttttactttatctactgccaatacatttatttcatatttttagaaattctgatgtacttcttccgtttcatgatgtaagattttctagcattgtccacatttatataaatgttaatgaatctagacacatacatatatataggagtaatgattatttagaaatgaacttatttggataagcgggagagaaaaagaaataaacttagtatgaaatagagggagtaattagagccttatttggttccatgggctaatgtttagccctcaaggatccaaacaggtgggctaattttgagctaatatgaattagccccctcaaaacattagcccctccaaggggtactaatggggctaattttgtatggggactataaaaaaaacagctctctctcatctctttctactctctctctaccttttagccttgaattagcccatggatccaaacataccaccctaggctaatgtttagcctaccaattcatgactaaatattagctctcaaaattagccctgggctaatcttccaaacagggcctaggtgcagtggaattcgagcgaaaacttttcgaattaagcagagccaggaattgaaccggtttatggtgagttccaaaaaaaactattgccttcgatcactgatgtgaagcacaaaaaaacaaggccctgattgattctatggactaattattatctctcaccttttagccttgaattagcccccaagaattaaatatgtgggctaatttggggctaaagtgaattagccccccttaaaacatcagtcccttcaagggatgctaatggagctaattttatattgggactatcaaaaagcagctctatctccctctctatctactctctcttcaccttttagtccatggattcaaacatgtcactctagactaatatttagcttatcaatttaagactaaacattaggctaatctttcaaacaaagcctaaatcctttgcaggcttgagctatggaatgaccagtcatgtttctctgctggcacgcatccagagctgcagaaagaatcaagcttcacggaatggggctaactttctccatttctcgatgaccgattcatcgttgacaagtgtttattacagtagaaaagagacaagttcttcagcgtgcatcacggttagtactcccatttatgacctcaagccagtcgcatctaagttcgataggcgtgcagacactgaagttaaccttaattgtagtcaagagtcagctttgcaaatataagagcgatggtttaacgccagtaattccggcgagaatgcagttggtcggcaggtaattttgaagccggcgtcgttgccgagcctagctcacataacttaactgaagctaccaacgaccatgataacgatatcttggactgatagtataccagaatgctggggatttgtatcatttgggttcaatcagcgcagtgatcaccgtaattgagtatacttgatttgcacctcgcgataacaattatgctgaacctttccaggattgccaaaactagagaaagataaagttaagcttttcgctctgctgcggcctagcaagcagtacagttctgaaaaatggtatattccaagtcagcttgagatctgcctgcactttttccctttttttttcttgatctatttgtactaataaagtaccaatccctgactcaacctctaaatttaattcccagttgctagtgtgggtttgttagcctcattaaacctatctattggtaatgctgaccaaaactgactgtttggtttataatcagtacatgaaaattcggtaaccatttcctaatgaaattgaaaatttggtaaatccaatggaatctaaagttaagctgggggcaatgtgtagtaataatatcagtctgaaaattgttaccagtttttagcctttttttttttccaaaacacatagtacaaagcaaacattcatatacgcacacaagcacatcctatttgaaaagaccaaatcaacatatcttacaattaattctcaaaaaaaaaacatatcttacaattgatggaagttcttatctgaggtacgcccaattcgcttcgttccatatatatatatagactttgacaatatatggcagattttagtttggtttgctgggagcctaaagtcacctcaaactgggagcgtaatggtattctgcagtacagttctccaggtattagagaatggcatatttttcagagatctgctcctccggtatatgcatacattgtt

SEQ ID NO: 55046 - DNA, 3033 bp, Oryza sativa
tcctgcagccctgaataagttgaccagacgttcctcaactttacgtcaagttcgtataacatccctataaaccacagtaccagaaagataaaagtacagcgaaggtccctcaacttgtcatcgagttacaaaatcatctcccaaccacaaaaccggataccggaggtccctcaactaacaaaaccgttcgcttgaggtcctctggtggttttgaccccggttttgtctgacgtggcgggtgagtcagcgtgggcctcacgtggaccccacctgtcagcattgccacatcagtcttctctcttttcctctgtggacccccgtttttataacaggaatcattcatgtaaacagtaccatttccctggatcaagtagtctggtacacaagttcatagctgaaataccaaaagcacatacacgagagtctagtgctaattattacatcataagcccgcaggcattgtcttaaatcatcggaccgagcggtccggaatacatccaacagaaatagataaggcagcggaattcaggcagcggcatgccattgccacaggcaacgaccgtactaagaccctcctggtagtaggcatagggatcctccgaagcttcatctcccgcttctgattaattttatatttgcaagggtgagtaccaaccgtactcagcaagtcaccacagcaacaatgcatatgaaaggggtatttcaaaggatggctatggctcttttgcgctaagccagttttgtaattcttttcacaaacctaagacctagcattgactgatcaaattttagtaccagtgtttgtatttaaacaacgacggttctgtccaccatccattgtgatcccaaggatagcttcccgccattgagtcgttatggttttctgaggacgcccaccttcccccttctcaagaagtggctccaacagcataaaaattcgtcatgcaacaacccatcccacacaagttaagaatttagagactagccaagtgtaatacatgtcctggtgctcaataaccgcgagcacggctattcgaatagatttggtttactcacactgcagtggatgtacactttacccgcactccgtgactgcccaacatatgagcttcgtcccaacacatgagacgcgtcacggcaaagcttttcgataacctcgcattggcagtatccgctccatgaacttaaatcctcatgcactctaggcgtccatgtttctagcagtgtgaggagttctggcgctcccgggaaagagaagtcttacacatattaaattatggttcaagttaagttctctctctcacacactcatggcagtcctaccaatggcgacaccgatgtagggcacgcctctcagccctacctcaacggctgtcccatcgtagcgcacctgcctcactcaggggtgaaccatctatgcagggatactgctccgctcggctatctaatccgctaggtctatacccattcgagaagtacggttgtatgggggtcgtttcatgcttaacttcatggctcggtccttaattgaccggggacggtactagcctttcctagataccacccaaatcctccgtccgccccagtcgaaaataattgtttaattttatttctcctttcacaaatcatgtcatcaacatcatggcaatgtggcgctcatgtctccacatgccgtatctcaattaccttcccaaaagtaattgcccaagcatcatttgataaatatgagtatgcatgattctagaatagcatttctaagcaattgtcataatcgactagggactcatacgtaaatatggttacgaaggaacaaggggcaaacaataatcaaggcatggcataatcacaagtatgatgttcatcattgcatgcaattttatttgtaaacaaaacaattttgcaattgggatcaacatgttcaaggaatagtgatgacttgccttgctcaaagtcttgcgggtcttggccttcacttggatccgcaactccctcgggctctatagttatgtgcgaaaattgatttgaattcggttagaattcaaataaaaatccaaataaatccaaatggaagtcgaacgcgtaaatcgattcttttatattaactttacttttcgcgaactagggcaaacccaatttcgatttttatatcctaaactattttgcgggtataaatattttgttatcataagtttttaatttaatctacccgagcattatatccatataataggttggaaatttctatcgcaagctaaatatcggacagaatcctaaaattatcttataatattatacaattaaattttagtataggactaaacgactaaatataatatacgtctaaaattcctagtgattaaatccgaatttctaccgtgaatcaattacttatagagattacccaaaataatctataatagtctataagaattcatctaatcgtttagttcttaattacatttaaactactaccgcgaattgatttcttgtagaaattaccaagaataatccataatttatattaaatttcgcaattctacgtctataactagtctataactaaatgctaattattttaaattttctaaacttccctaatctccctctaatttcctatctatttcccttttctttttcttcccttctttttctttttccttcctttctttttctttttttttctttctctctctcttttcttttctttttccttctctctctcccttttcttttctttttccttctccctctccctcccggtttctctcctccttcctttttctttctctccctcggtttctccctctctctctctctctctctcggctctctgctaccaggggcggcgacggcggccgagcaagtggtggaggcagcggcttaccgacggcggtggcggcgacggcggcgacagcgacggtggcgacgtcggcgcaaggtgcggcgcggcgcggcggcttcgtggcggtggcgcggcggctctatgcgacggcgcggcggcgtggaggcggcggcgtggaggcggcggcggcg

SEQ ID NO: 55047 - DNA, 1714 bp, Oryza sativa
acgggatggcggcgagcgacgcgcgacggcacggcggtaccgccggtgcgcggcgcaaggcgatggacggcggcgcggtgacgcgacggaaacgacggcgacggcggcgcggggttaggggcggccaggcatggtgatggcgacggcgtcggcagaggggaggcggagcggcgcgcggcgcgcggggcgcgacggcaacgcggcaaaggaggggctagggctaggggacctcgtcgaacactttaggtgcaatgaacagtgccgttttctaattaacccgattttggcccatttattatttaaatttgattctttaattcccaaattttgcataaatgaagtatactcaatatttgtgccattccaatccatggattcattctagattaatttattccatgttttacatattattattgtaatttacttgaacttaattagagttaattctcattccattgcttttaaatttgatggatataaatatggtcgtaataatattttactcatttctatcctcaccaaatcttattttaagttgcactttaattatttactttttccatttactttttagggtttattcctaaccaattatctattattcgcgatttataaactcagaacccaaactccaataaaataatcgaataaaatcggcatgatgcaatttatttaaaaagtttttaaaaatccgcatttttagagtttagatttttgtcgtcgaattttcagggtgttacatcctctcttctctgttctttcccatcctcatctctctctccgttctctccgacaggcgacagcgaccggcaacgcggcttcccctcttctctcacttctcctctcgggcaactaccggggcgggtggggaggaggacgccggggcggccggcgacgtggtgacgggagcacgaggcgacgcggcggtgggagccggggtggcgccgcatccatgacctccggacggaatctcactgaagccgccgccaccacccaccgcagtggctctccagcggcgccatcagctcctccgcccgcagcgctgcctcgtcgaggtcgccttcgccgttgtcgaggacggatttgagcttgccgacggcttcgtcgatggcgtccaacgcggtgggagcatgaggcgacgcggacggcggacgcgaccaccactgtgagcgaggagacgatgtcgacggcgaggaggatgcgcgtgcggccgccggggcaccgccgacttgctggcaccctgcatagacgcgatcgccgctgtgagcgaggagacgacgttgatggcgaggaggacgcgcgccacggccgccggggcaccgccaacttgctggcaccaccgacttgctggcaaccaaaccggatcgagtcagatcgagcggaggaggagcgggagctgccgcggcggtgaggaggcgacggctccagtggaagcatacacttacgacgttgccaagcgcgacggcgttgaggaaggtggaggggcggcgcgggctggactcgtcggaggggtcgttgtcacccaggaggagggaggcggcctggcacatggactcggcgagctggacgagcttgtccatggcctccatggccgacgacgacatgggcggcgacgatgccgaggcggcgcgggcccccaagggaggagcggcgcgcggacacccgggggcggagcgaacgacgcggcgacgggcccggacggggctgcagg

SEQ ID NO: 55048 - DNA, 1387 bp, Oryza sativa
ggcccacatgtagtgagaagaaaaaaaatataggtccgcatctcctctcttttcttcaatcttctctcacggtcccgacaaaataaggcaggccggcgcaatctccagcggtcgccacggcggacggcgggagcatgtgagcgggcgacgacacgggcacgggcacttattcctttcttataccaaagtagttcatgggccaaagtcgctttctctgtatattcggcgggtgacatgcaccgggatattttggtgttaatcatgagttgggtttgccactcggggttccagtccttctggcgtaatttattgttgagaatagttacttgtgacaaaataaattgcttatattacttgtaacacgcagcagcaaaattcccaagcatagttccaaaccagcaacagagtccttcaaaacctaaaggcaataaataaaggtaacaaaaggttaaagttcaatttgcttacattcgattaatataataccaaccaaaaatccaaaatatatgttacactaaccagaaacccaaacagttcaggcactaccgtaagtacatggtgattatgtacatgctttctaatcaccatagatttactaagtataaaaaataatcagaaataacctacatttccatggtgctgattataaatgaggggggggggggggtgttgcatgatggaatataaactgtgattatcatagatgaactaagcttttacaacagtactttatataaatttggaaaaggccgaaaataatttaggaattaatcgtagaactgacacttgaattagtccaactataactgagaatgtcgaaaatatacataggagaaatggaaagtttgtaaatgcctaaataaccccttaaaccctgccgtttgaaaatgccaactacaactagatgtgaaacacatcaggataaacaatcatggcaagtaaataaatccacttataatttggttacaatttatgtatctgtttacaattgcataacttcactcactaatggccaacaaggaaataataatgtttaacaagctcaaatacttcccattagaatatgatcaaaactatggtgcatagttgcacaccttttacagcaggcaatgtacatttagacacaatcaggatgatccacgctagagctcaaatgttgtctgcaagttctaattcatttagtacaatgatgcctgaccaaaattccaagccaagcagctttgcatgaaagcccagcccccatcaattgcatatttgcatccctcaataataaaagctctaacgatatcacgttatgtgtgtatcatgtaatggacccagacacttttctagacataggaaatctggatgtgttttaccacaatattaaaccaagtgccggggtgca

SEQ ID NO: 55049 - DNA, 4495 bp, Oryza sativa
ctaggccgaagccgttttgtcaatcgatcgatcaaccgtttttttctacgtataaacagtgaggacgatcgagcagctctgaaccatacatgtccctttcagtaaagcagcaattagccagctgcagggagatgtgcagtgagcaactggacatacacacgcagacacacacaacacaagttgtgtccactttaaacctgcacctgcggctacgcactgactgcaccgggatgctctgtacagagcccaagctttgctagtaaatataggcttgtgtttagatccaaaactctgcgctgaactaaacacaacttttcagtcacatcattttcaatttcaaccaaaatccaaactctgcgctgaactaaacacaaccatagattgctcgtgttcgtgctcctttccggttaacctgctcgtaatctttttaatcagtttagcacgcgagctagatagcgtagagaccaccggctttcgaggaggggaggtggtggttgccgctgcaagccacattgattgaacggacgcacgctggctgtatgtaaccgaacatcttaatgccgcgatacgctacaaaagttggcgtagcacgagccattttttcctttgtttcttgcagtactcatcgtttctcgagagcaacacgacgacattgacattgccgtgatgctacgagtacgagctcccaggaggagagaaattaagcccatgaccatgaggccgtgactccatcacctagctgcgtgaatgccagaacaagggtccaatataatgaagatgacaatgcaagtttcatcagtttcctattgtccttttctctccaggaaatcaggagcagggcggatgataaatggatagtggcaagaagcactgtcactgagagacagagatgctttgccatggacgccacggagtttgaactttgaagcgagctactagtagtagcttagctgactgaatgagtgagtgcagaaggatgcatggtttctgaagaatgcactcttatcccttacttgagctttacccaaacacccccagttatgcggcataacgaaagggaaacacaatagtatcagcgattattagttaatccaatccaaaggcggccaagttccaaagtgatgcttgccgtaaattggggctcattgcaagaattcctcccttgggccccgaacacttgcagcagttggccgtaaatcaaggtgcttctgcctgcagcaacgagcatggccgaacgttttcctttctttaacgggtaatccctagggtgtaggtccagggcccataaggcccacatggcagcgagagaacatgtatatgccggcctgatgaagagatcggacggcctggattggcacaactggccgcatcggacggctgcgaggcaatgaacggagagatgggagatggagagcggcccaccaggaacgggccttttttccggcctagggaagggagcctccgtttttgggggcctttattctgttcccactctaacgagaaaaactgtctcaacgcacgctaccccgtggcccacaacttttcacgcttttaccgggcccaccaataaactacccctacagtaacaagtactccctctatttctatttcaggtataagataaactgctttaaatttaatcaaatttatagaaaataataataatatttttgatacaagataaatttattataaaaatatatttaattattaatttaataaaactaatttggtaatgtaaatattattatatttgattataaatttagttaaacttgaagcagtttgactttaaccaaagtcgaaacatcctgtaacctgagacagagggagtagttaaaaaaaatccaaaaattactgcagctgcagcggtggggccgcgtgagcgtgtgagtatgagacgatttgtggatgaggagaggagatgcacgccgatgccatgctgcattaatggccggtggtcgcggctcccgacgaataaattttgccgtcggtggccggtgcagcacagccggcggtgattcggatagtgaccctctccggtgtgtactacgtgtcatcgtacaccacccccccgtctgaaacgtaggacgccttgtcctcttatacacttggcacatgtgcacatcgtactggtggccattgacctctccaactctgttttccagcggtaaactgattagtacaaaatctcaatctcactacaatctttctgtgtgaacgagattatactattgtctgcgtggtaaacgtacggaatctttcgcctgcacctggggcggacgcgaaggcgacgcgcggcggcggccgctcgtcggagcggagatggtgaggagtcgctcgcggggtcacatgcgatggcgcggcggcggcggtgggcatgtgggcgcgcgtgtgtttgagggggtggtggttctcgcggcgacgttaacacgaacgtggtggttgctccacagatgtcagctaagcatgtgaaatcatagtgcccgcgggacccctgctactactaccaccaccattacctctcttgacctctactactactaatttatgcctgcctctctagtctctctatacccacaaatcccgggtactaatactactccaatacgactatctcagttcagctctacctacgaagagcaaatactcggtccattttgggattttcttctttgctactctactcttgtttccatctccgccaataattcagggttcacccgccaagatccaactaggacatgtccctgtccgctctaacaaacggatgcattatgcgctacttgcatgctatggctacatggcttggtgtaatttcggactgttcgattgctacttctggctgatcttctagtagttgagaataatgcaagtggtttatggctttaggtgctattctgcggacacgcgctaagcaacaaaccaacgggtgtgtaaggtttgctcttgggctgggttggtagaaattgttcctgctgaatcctttgggctttcgcttcgcactattccagcccaaatatgtatggaagttttggtcttggcccatcattccggacaaatctggaagcccaggaacatattgcgcgaattgtatgtttccttgcctctatgctctttttcatagtggcagacaaattaacaaatcggcaggtttgtttcagcacacttaagggcctgttcagattgtagccaaaataaacctaaaattttggcaagatagcaatattgacaaaattttgataggatttcttatgtatttaccaaatttggtaacaaactaaacgtgatattttttagcaactttgctaaaagatggtatggttgaaaatgacatcaaagtgaacaggcccttacagtactgagttaccaactagcaaatgcatttttacactgtagagatcgtaaatctgtaactaagataagatatgttttacaatgctctttgctaattgtaggaccaaatttttagataatggaaatggattacatctccgacttctgtcaaaagacacacagccataagtttaatagtaataaaaatgcaagataaaagtaaatcaaaatgagaaataaggtgatgggacaaatccccaactcccctttattattgactagcgttaaaccacataaaattttttagctaacaattcttatgtaactacgccacccatagtggaataagagacccttggctaccgatttcaaaagtgtagcaccattgcgcatagtatcatgctctgtaggaccaaatatatattgtttatctttttcaatccaatacgtacatcaattattggtaatataatttttttcctctatgactagtagaagagtagaactcataaattactgtagctcttaagatcacttccactgacaatagtagtggcagtagaatactataagtagaaagccctataaaggtactcaccggttaaagatttgtaaacccttttatctggttcatgatatgttgcaagagtatggtgcatgtcttttatttttccctcaatgagtttgtaacagtaaaaaactcatcagtcccattaattttataagttgaacagaccaaaaactaaagtcaagtttttttttttaatgcaagaaggggaaaaaagaactggggggaaagacaatcgcatctctgtctctctaaaaaaaactcaatccagttgtgatccgtgtgtcctaaaacttagggacggcttctgcatgcattcactttgcagcgcatgcatgttgcaaccactacgctgcgtatcctagttttaaatgagcaacagcacggcatgataattgcatctatcaatgtggaatcgtacgtaccattgtccattgattcaccagaaaaacacacataaacggactatatatgcccccctgcaatctgcagagcaacttcctctgctggtacctatagagctcagataattgcagtgggtatatatcactgtataagaatatacgactagtaggatttgggctgcaggaa

SEQ ID NO: 55050 - DNA, 1531 bp, Oryza sativa
tccgaccaccaaacaaaagctcagaatcctacctgactagtactaccactactagctagtagcgagctactctctctggtcatcaagctttgagtggttggagtggtggcagctatggctttttccatctccaagaaggctgcagttgctgcactcttctccttccttgttgtcacctgcgtcgccggcgccaggccggggaacttcagcgcctccgacttcaccgccgatcccaactgggaagtcgccagggccacctggtacggcgctcccaccggcgccggccctgacgacgatggtacgtttgccggtgcacctcggcgactgatcattccatcgagatgaaccaattacgttgtataattgaactgttataaataagtgtggtgttgatgctgcaggcggtgcttgcgggttcaagaacaccaaccagtacccgttctcgtcgatgacctcctgcggcaacgagcctatcttcaaggacgggaagggctgtggctcatgctaccaggtacactaaagattcagctcaaatttgcaatgacgacgggcgttgagccgttgatgcgaagcgactgatcgagacgtaggtattcacagtgttgttgactgtttgttgctggtgcatggcttctttttttcttcagataagatgcgtcaaccaccctgcctgctccggcaacccggagacggtgatcatcaccgacatgaactactaccccgtttccaagtaccacttcgacctgagcggcacggcgttcggcgccatggccaagccgggcagacgccagctccgccacgccggcatcatcgacatccagttcaagaggtaatagtttagtagtaggctagtagctcctgcaggctgcacgaacagaagcatcatcatggccaccccttgccttgcagttgctagcttgtgccgtcgtggagccctcgtacttttgggtgcaaacccgacagcgacattgcttgtatgtcctccgggacccaagcagattatgatcgcacaaataccactaaaactcttttaattaagtacatgcagccgctttacaatttgtcgcctctgcctgtcatcacctactactatactgccttgcatactcactctgaattaatctgataagaatgtaacactaacacatggattgttgggggtttggccatgcagggtgccgtgcaacttccctgggctgaaggtgacgttccacgtggaggaggggtcgaacccggtgtacttcgcggtgctggttgagtacgaggacggcgacggcgacgtggtgcaggtggatctcatggaggccaactcccagtcgtggacgccgatgcgcgagtcgtggggctccatctggaggctcgactccaaccaccgcctcacggcgcccttctcgctccgcatcaccaacgagtccggcaagcagctcgtcgccagccaggtcatcccggccaactgggcccccatggccgtctaccgttctttcgtccagtacagcagctaagccaatgatcaagaacaagggctgcagga

SEQ ID NO: 55051 - DNA, 4773 bp, Oryza sativa
  unsure (1)..(4773): unsure at all n locations
gggtactcgcatgatgcggggcgtcatctccgggagcggcagcgcgatgtcgacggacgcgccctagccatcgcctccccgagctcgccgtctcggccgctagtcgggggcgctcgatgatgccgacggcagtggcggagacggggatggctgcgctcggcggcggcgcgaggcgggaggcggaggcgctcggagacgacaacgcgacgacggcggcggcagcggcgggggaggtggaggcggcagcgcgagccgacggggacgacgatggctacgttgcaaggcggaggcgggggcgcgaggggaaggcggaggcgacgacggcggcgcgagggggaggcagacgcagcgggagagggagagggtgggatgagaggtggcggcggctagggttttttgggggaggtggacgcggccgcggcggtagaggtgggcgcggccggggggcgcgaggggcaagaagcggcggcgcgtggcggcgacggcgggagaggggaagggagaggatgagggtgtgtttagttgagaaaatgaaaatttttgggtgccacatcggacgcttgaccgaatgtcggaaagggttttcggacacaaatgaaaaaacacacctcataacccggcnaaaaacgccacacgaatctnctnaaccaaaaaaacccatcannagnnaannangcncaaaagattcgtctcgtaatttcctccctaattgtgtaattagttttttatttatctacatctaatgcttcatgcatgtgtctaaagatttgatgtgatatttttgggaaaaaattttggggaactaaacgggcctgaggagagacgagagagaagagggcggcggcggctagggtttggggcagttagagttagtgcgcgtcgctttgcggaaaagcccctcgtcttttaagttttacatcgctgtccttactcgcgatttttccctcgttttaatgtatatccgacttttataagggtctcgacctaaaataacatctcacaggtactgtttggagggagctatttcgaattacaaacaaattggagggctttttcgaaaaatcaccaccgcgcgcactgttcctatcctacgtggcatagccgagcggacgccccttccgccgctcttaatggtttctaatgtgtcatttattccatactttgcgctggtaaaagttgctttttgatattttattattcttcaggcatatgcgcgaaccaaacgcacaaagcttcagcctgcctgatgaggcaagtgttacatctcccaacgctgcctgtccggcgtgagtttttctcaggcgtggccctcaggacacaaaccaaacaaccccttaggccttgtgtattatttacaagatggaaaaaaaaggaaaaagttcacttgacgtccctcattttgtcgtcgagttttgtaatactggatataatgcatcccgaatatttgcaaaacggtcacattaggtctgaagacagtatagctcccaaatttagttgacgtggcatgtgagtcagtgtgggacccatatgaaccccacatgtcagcaccacaagtccacaataccctcttccattcccatcccctctcttcccatatctctcatcgtgcggcatgggcggagccctagttgacctgatgaagatgctgttgctccttcggtgaggcccgtgagaagctttgctagggtttatccccgcgtcgccgccccaaaagatgagaccaccatggccgcggtccagtggtggtgttgttccagaccaacatcaccaaggctgcgcgaggctcggcgccacaacctccatcatgtttgccatcgctctacaacattgatggcaaccagcgcgccgtcatcttatatcggttccgcggggtgctgccttggacagtcgagaagaagcaggtggcatagcaggaggccgagagcgctccaattgcctcatcgccaaggctgagcaagaaaggcgcccgtgcatcatgcacactgaaggagactgttaataaccaaatttagtaatctaagtatcggagatgaggatgggattgaagcggaattcgagatggaaatcgtcatgaaaacagagtacggatcggctgaagtccgaatcggctgcggttggggtaggcagagttcgagtcggacgaggttagccgatcgagccgaatccggcaacgtgacgcggtatgcgttgtcgggttgagctaacgaacttcatgaggattgccacccatggatagagttttgagaaggcaattgtatatattaattaggatatttcatgtaatttccttagagatatgtttgggcaaaagtctgccgcaaagacttatggtatcttagagtttgttagaaataagagtcgtgtccgacatggacatattttgtaatctcaggtataaatagatcccgagccctatgtaatcaatctaacacacgttcaatacaatctcggcgcatcgccacccttttactttcgttttgtttcgacgagttcttgcttttgggttgagcccgcatcggtttcgatcttcaactagaggtaaaacttgttatggcggcttgcgttctcggtattagtgcttacatctttatgatactctaatattgcttatgtaaatcgtcgagttatcatatattttatgtaatctccgtcaatatcgctatctaaccttcaatcggctaatgtctgttactagaaggcagtcgattaggttaaataccgacgttgacttagattacataggatatcaaccactctatgaaacatccaacggcttgattgtctagatattgtccttattttcatacttatacctgcattagttgagtttgatcttatgagtcgtgattagaatctcaacctctagcctgtctttggttgccgattagggtagcatcgggtttcagccaatcttacctgatttaactatatttttcttatatgcttgattgacatgttaaatctgccctttatattaagatcttgttgcatttaggtatattaggctttcgtttggtatattctacttgctttaatatcttaatatagagtggtatcggagtattagctgatacatgctagatctatatgatcagctatgctatgaacatatatagtcttgttgctaatatatctttcgatctaagtaatttatactgtctcggcatggcgaccgatctatcccaataacttgatttaagtatatatcgacataaggattatatattgttaatatctacagccaatcgagtaaatttagttctttcttacttattcacgattgccgatcgatctacatatgacatcggctcaaagataaatgatatgtcatcggcaactagccgatcagctatcatttatggatttaaccgcggttctttgtctttatttcttgttgattgcaggatcaaattaactggcacggtcatacacttaaaggcaagcttttggacctgcactggagttaagcagatctccaaggcctcgtgtttttacatcaacagagacgtagccgatgatccttaatcccggcgtcccagcaaaaaacgctttccgaaccattgaaggagttattttgcactagttttcagagacgggggagatgttataccggttttatggttgagggaggaaattcaatcaggaggaagatgagggatgacttattccaaagggatggggagagcccttcaagggcatggtctgtctgatgggccgcgttagtcaaaaacctgagcagaagtaaatgggccaatcgttctgcatttcacaggttctgggctggaccatagaaattcaccgagaagcgactcgaaagcagtagttcgtgtcctcggaacgaacacgtattttctaatttacgtgtctcccaatcgtagccgacgacggtcggtagctctctttggctcctcggctcctctccatttcccatcacccggcgctcgcatcgcttcgcactcgcccaacatggcaagcactgaagcacccacacaccctacctccacacgccatagctcgctctcccagcgtggcgcttgccgccgccgccgccgccgccggcgggatgatccccttcaattccgccgtagccgaggatgtccgctccctggtgcagggcgtggacgactccaccttcgactccacccaccgcgagctctgccaggtaaacgcgagccgccctgccccgccccgcccgggcccgaaatccacggcccgaggtgcttcgtttcggcctggcgttttgcgcggcggcgattggttcgtgccgcggtcgtagatccgccccccccccccgtcgcttggatttcgtctttttgaagcgcctcaatcttgagggctgatctagggttttggcggatttatctgtcttgtgggtattgacgaggagcgatactagggcatcgcctttgatgctcttctccgcgacttaatctagggtttcggtgggattcctcacgattggataacgtgggatgtgttggttggtgttttttttttgttgcatagatccctcaatgtggtgcacgtgttccatggttcaagtttctcagtttgatggtcgtgcaaaatttactcttgggttggaataggacacttaagctttggattgttttgaatttagcctgacttgtggtcagatactcagatgagaattgtgttaagatgcatatgtttgtgaatttgtacaagattttgcattctttgtcattgcagatgtcttgggatgtctgtcttatgtttatacttacacaatcaactccgctggggtgcagg

SEQ ID NO: 55052 - DNA, 1088 bp, Oryza sativa
actgttctaactcatttgcattcataattatctccaccggaatttgctttagttggtggaatcctttctaatattttttacctttcctttgtttcagctagcggactgcagtcctgatggatgcagtttgctgcttcaagtttgtttggatgaagtgctgctgaatgccgacgtggcaaagagctctcgattgaaacctgagctcttatcaactgttttcaagtattgtctggataaaccatacttcagcaccagtttttgtgaagcactgaagacagtacatgtcagtgatatgttccttgtaaaattgtcaaatgaacttaatctatctgctggagagagggttggagttgggcttgccctatcagattctggaaatctaggcttgattacgaaaggtaggtgcttggtagatcaatttccctggcttagtcatgtgtcagttctcattgaaatgcttaattacacctctattctttgctttatagggcaaaagttctcaatcgctgaaatcgaggagatatgtgcaaatccagcccatgttttaacaaatgatcaaattcacgatattgttgtgtttcttcaccagactgatggcctctcaaagcatatggattctttcactaacatcatctccctattaaatgtcaaagagatgccattctatgttcctgccccaattaaggaaggcaacgctcggccaacaatttcttcaaggtttgaagagttccttctatttacattatgcttcattttcaattttgctttactcatgcacatttcattgcctttttggcaccttacaggcacatggaactatacactggtagcttggatgatgattttgattcccttctatctgaaattgggaaagaaataagcatggctgacatcattactgaattaggctacgggtgtacttcagatattgctcattgtaaagaaatactgtcactatttgagcctcttgatgatatgggaatctctaagttgcttggagcagttgtttgcactcatgttggtcttggtgaagctcataatacatattcaacgttcatgtcggccgttggcaacagccaaccaagtga

SEQ ID NO: 55053 - DNA, 1183 bp, Oryza sativa
  unsure (1)..(1183): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctcaccacttcggcaaatgcggcaaaccgaggtggtggtcgtggtggacgcggcagcagcactggaaacagaggtggcagacgcggcggcttcggtcgtggcggtcgcggccgcggcgcccctagcggcgcaagtcagggacgcgggcgaggcaatgatactcgccccgtgtgccaagtgtgtcacaagcgagggcatgttgcaagcgactgctggcatcgttatgatgactcatatgttcctgatgagaagcttggcggtgctgcaacatacgcctacggtgttgataccaactggtatgttgacactggggcgacggatcacattaccgggcagctagacaaattgacaaccaaggagagatacaagggaacagatcaaattcacactgcaagtggcgaaggtatgagtattaaacatgttggtcatgctattgttcctactcctagtcgccccttgcatcttaaaaatgttttacatgttcctgaagcggcgaaaaatctagtatctgttcataaacttgttgcagataattatgcttttcttgaaattcatggcaaatattttttgattaaggacaaggccacgaggaggacaattcttgaaggtccctgtcgacgaggcctgtacccacttccagccagattgtctttgagacaggccttcgttgcgacgccatcttttgagaggtggcatgggcgtcttggtcatccctccaagccaattgttcttagaattctcagtcaaaataaattgccttgtcttagtaattctgtcaatgagtctgtgtgtgatgcttgtcaacaagcaaagtgtcatcaattaccttttcctagatcaactagtgtgtcaaataatcctttggaacttattcattccgatgtgtgggggcctgcctctgagtctgtaggtgcaaagaaatactatgttagtttcagaagtttcatgaatttcagaaacttgttgaaaggcaatttgatcgcaaaattctttcgatgcaaactgattggggaggcgaatatcttaagctgcacactttctttaatgaaataggg

SEQ ID NO: 55054 - DNA, 2365 bp, Oryza sativa
aatgagaaaacatctgatcaagggggagaggaacatcatgatcatctgtttaatatctctatgccaaatgctactgatatttcatgtgcagaatctcccagaaatgtgaattcagatataccgggggcatttggccgggtacatggagcaaatggcgacttggcgggagaatccgcctcagattcagcgtcggtctaggcgcagctgcagcggcaggcctccggatctgcgacgcaaggggagtcggagcagcagcactcgggcatccaaccagcgcgcgccacgtcgcctgctgcatcgcctactgctgctcctccatcgcctgcccgtgctgtcgcgtcttcgtcaggtggtgcgcagcagtcacatcagccaggatcatctgcgccgtctgagtctgcacagctatctgaggtaatgcgacctaaaacaaggttacaaagtggtattagaaaagagaaaatatacactgatgggacagttagatacagttgttttacatcttctggagaaccacaaactttgcatgaggctttaggtgataaaaattggaaagaagcaatggatagtgaatatcaggctcttatgaaaaacaaacctggcaccgagttccttctaagaaagggcagaatataatagattgtaagtgggtctataaggtcaaacgaaaggccgatggcagtctagatcgatataaggctagacttgtggcaaaggggttcaaacagagatatggtatagattatgaggacaccttccgtcctgtagttaaggctgctactatcagaactattttgtccatagcaatctctagaggttggacccttcgtcagctagatgtacagaatgcctttcttcatggggttctagaggaagatgtctttatgaggcagccaccaggttatgaacagaaagatggctatgtgtgcaaactagataaggccttatatggtttaaagcaggctcccagggcatggtattccaggttaagtactaagctgcatgagttaggttttaaatcatctaagtcagatacatctttgttcttttacagtaagggagatgttactatatttatgttggtatatgtggatgacattatagtagccagctcatctattgttgccactaatgctttgcttaagaatcttaatcaagaatttgcactcaaggatctaggaagactgcattacttcctaggcattgaagtgaaagaagtaaatgatggcatagttttgacacaagagaaatatgctatggatgtgttaaagagagtgaatatgagtgactgtaaagcagtcaatactcctttgtctatttcagaaaaattaagtgctcatgaaggtaatcctcttggaccagaagacagtaccaggtacagaagtctggttggagcattgcagtatttgactctgactagaccagatttatcattttcagtaaataaggtgtgccagtatttgcatgcagcaaccactaagcattgggtggcggctaagaggattttgagatatttgaaacatacagttaagcttgggctaaaaattagcaagtctaattctcttcttgtaagtgctttctctgatgcagattgggcaggatgtttggatgatcggcgttctactgggggttttgctgtttttatagggcctaatcttgtgtcatggagtgcacgtaagcaggctactgtatccagatctagtacagaagcagaatataaggctttggctaatgctactgcagagattatgtggatacaaaccttacttcatgaactgggaattcaggtacccaaaattgctaaggtatggtgtgataatattggtgcaaagtatatgacagctaatcctgtttttcatgctcgcaccaagcatatcgaggtagattatcactttgttcgtgagcgggttgcaagaaaacttttacaagtggaatatatatctaccaaagatcaagttgctgatggcttcaccaagacactgtcagtcagacagttagagatgtttagaaacaatctaaaccttacaggttcagattgagggggagtgttagatatttctcacatatgataatgtaacaaatagcgaaggataagagttgttgggatgtttagatagataagataagtttcctatgttttagtagatgcacaacaactctatccgagctatatatacctgtattctgttaagcccggttttgtggcaagtaattaacacgtaaactcctcgctgaaggagttctctccacagtccctcctgaggctctcgtcaaatatgacatcgatcgcgagcgagatgcgcatgtacacgctgtatccttgcatgaaggacacgatacccccatctcatctttgtggccgatg

SEQ ID NO: 55055 - DNA, 728 bp, Oryza sativa
agttttttaaaaaaaaatgtttcagaggatatcttcaaatcagtatcagtgaacatactggaagctcagaagacacttattaattggatttaggaagtgtggcaacataattttcattttacctctcaatacagatagttatatcaagtgatacaacacgagactacatatttgtatttattacatggaaatgcagtgagagcaaaagaactctagaatttagattgatatgaaattaaacatgaagggtaagaaatttacaggagaatcaactaataattatccttaatgttttcctacactaaggcaaaagaaaatgtgtaaattaaattgactgtcactgtgaagatgatattatgtcagtcgaaaacgctaaaaaaaaatgcaatagcaatgccaaagtaaacacctttcatcgcttgagttgtctcaagttgaaagccattcaagatccagaaagtttgaatcaccagaatgaatgcaactttctttcaacggctggaacatgatgtatctgaggtaccatgggtgtatacctgtagcaaattttgagagaggaattaaggtttcaaaaacaaaaatggtagtagtccactatttaagacaccatgctttttcatgatttcctagtaaaatacttgtatgagaaggatgaaggtcaaccctgaacgaatagaaaccaaccttaattttgatacctcactttcacagctcaatgaaatttcatt

SEQ ID NO: 55056 - DNA, 711 bp, Oryza sativa
ctgcagccccctttttcatccaaaattaagctgaatgaaaactgaaaactgtcacaataccatacctttataagctcaatgaaagtaattagtagcccccacgggtgagggcggttaactattagccgttccagaagtaccctagttatttgctcctggactatttcctgcgatttcagattagttcccatcagaaagggtgtatatttgcatacaaacaaaaaaaggagaccacatagtaagtaatcatccgatacctggtttgcctcagaaaacaagtaaagaattatgaaggaaaaatagtgtgtgtggttgtttggatagcgcagctggttggcaatcgcatgaggaggaggtagcgaccttctgtatccgaattcattacaagatttctgaagagctctgtagctgtctcaatctggacatccagttgactttggttcatttgctgcgccgacgctgatgcattcattttattaagctgcaactgttgcacagcctgaatatatcaattgtatcagattagtgttgtcaggacctcaagaatgtgaagaaacgttgacatgcagcagagtcaaacaaagcttagccacgccacgactataattgtgaatcaatatcatatgatgcatccagttaaacatggtcaggccatacgatagaataccaagtatgagcatattacatgagtagaaggcgaacacaaatctg

SEQ ID NO: 55057 - DNA, 748 bp, Oryza sativa
ttcctgcagccctcatgtaaaaccatgcactgtttttgttctacccgtgtacgtacgacctgtgaattggcattgcgcggcatatacgtgtgcatgtattatttgttattggatatttttgttaataaaaaaataattaatctagataaaataaattgataccatcatcgagggttgtaagaatgtgttagtctagctaggaagagtcaaaatgtttaaggactttcacgcacagctattattatagtacaacttacaatttgatcggtaattgatcacttataatcgaagtacatattatacccctattttgaatgatgatcaaaattgatcagaaactgtgacgcatgtcatcgtctctcgcaggcgcacaaataagatccagcgactgcaccggcaccatcgagcataaattagactggatcaagtctcaaccatgaaattatttaaaaccctttctaactttcataaaatttttaattcgtccattcgttgctagtatatagtgacagtatattgtacttatgggttctctaattatttgatgctagcacgctctgtagatattttatctgtacagaatactgatcacgggatgttacattaaactacctgagattaatgatgaaaattacaccttataatccaacaaaactagtactgtacgtaccaacagtattttccatttctaagacacgacacttcgtcgaaaaaaaaaaactgtgttccatacttgggtaccacacgt

SEQ ID NO: 55058 - DNA, 768 bp, Oryza sativa
ccctaatgtttgatgtaataatgattattgttgcagtcaatactttttatatgttgtacctctttagaataatttgtgaagtgggttgaaacatctccacaaaagatgaaagaattatttttaaatagtttaacataagtttgttttcttctagaatgcatatatatttttatcaaaatatattcatgtgagatcttgttataaatgatagattggatatatattttagaataaaattttgtttaaagtttgattaagagagagaatgtaatggtgcctcaggccaccttggcagccagctctactcctgcatgcatgcatgcgacaaccttgcccctccaacgcgtccctgcatacagacgaagagcagcattcgatatttgaaaaaaatattgaacacacgatttgtaacgtccgatttaaaaatatttcaacataattaagtatttgtgcaaaattctaatggtataattgaaattttgatcagatatataattttggagaaaaatatttacaatttgaggaaaaaaattaggcacgtgtaataggagggagagggagagagagtatgcaagcagcagcgcaagcaaaacacaagccgaacggtccgatttttggtgtgatgccgaacggtccgagccgtagcgctctccgcgcaaaacacaagctatagctggtgagatcggcagggctggcgcggctgcgcgcgcgcgcggccccggaatccggtgcgagagagggtgatggcgccatctcgcttgccggctc

SEQ ID NO: 55059 - DNA, 1897 bp, Oryza sativa
gcaatgactagggagtgtgtcatgaagataacggtggtgtgacacgaaaaataattgtattatagggctgctgtatgacacgcagtggaaagaaccgagagattcgaaaaataccatgatatttataaggggtagaaatcatattctcctaaaccttccatttttatattatcacagcgaccatattaatatttttttaccagctcaattactagaaacttttatcttttttttttgcaaaacagggcagctcatattaaattataaaagagattacaactctttttgttgcaatatctggaaataaaagaactaccaacacagaacaaggaggctccacatattgaaataccgcaagagatatgagcaaatgagtgtagccacaatgctgacattgtaacacacgcaaaaacatgtaaaatgaatattgctcaccatattcatatatccttcgacaaaagagcaaaccaataccaccgaacaagtcgacaatttggaacctaaaactaacgccaacaatgtaatatttgatgaccgacaggcaagtctccttgatttccatcgaggacctcacgaatgaagtagccagcaacacatagattaaaaaagacaagaaaaaatctaaatagatttaattccatgaaaaacatgaaaggcaaaccttagacaccaaatagttccaacctacattgaaaaaaactcaaaaaacttacgagaagctgtccccttcctcatcgtatccggcgaggacagaggagaggggaggggtaatatgtgtccaataataaaactgatttttttttaataaatcggtcgtaactcgtaacggtagagaccacggtaagaatgttagggcagtactgtcacgtacgttagctacctatatgagcgagaggagggatatatacacgtgttaacaatccaagcacggtgggtgttgagatccgacggtttacgaaaaccgaccgactttctgcaagcgatggttgacttgtacatagtaatgattggcaggtaatgacgtactgcactgtacgagagtgtacctccccaacatccataaccgccctgccaagatgcgatttgacaataggaattctcgtttaccgaggcttaatctccattcctccacgattcgctccagcgccatgtgactagaccgagctagctcgctcgatcgatctctcacatacacacggcacgcacgtcgggtgcaacgacttatcggtgccaagttgccgatcgatccggtttttttcgtttttgccagttagcctaattctgcctataaatacacgggcaaatctcctctcgccaaaacacaaagcagacaaggtagtagtacaggcttttgtacgtacgtagcagagggagttcccaagatggctggggcctctgccaaggtcgtcgcgatgctgctctccgtgctcgccacgtacggcttcgccgccggcgtcgtctacaccaacgactggctcccggccaaggccacctggtacggccagcccaacggcgccggacccgacgacaacggtgcgtgtagtacatgcattttttgcaaattacgctgtcgtacgtatgtgctcttctgacattcgaatgctgacacgcattggcattgttcgatcgatacgcaggcggtgcgtgcgggttcaagaacaccaaccagtacccgttcatgtccatgacctcctgcggcaacgagcctctgttccaggacggcaagggctgtggcgcctgctaccaggtatagtataaccacgttcgtgatcacatatgttgttttggcttatcgacacggtctccaataaatagtacatctcaacattaacctttgtaccctacatctgaaaagtgtacacaacagtgggtatggaacttctgatcacaaataaat

SEQ ID NO: 55060 - DNA, 1491 bp, Oryza sativa
attagatcaaggtggagtcgaaggcggagattgatccgagaacagagcaagaatcggctgaagtctagatcggctacgattaggatcggctgggtctgagtcggactaggtgagctgatgcagccgattctgacagtataatttggtgtatgacattgggttgaattgaggtgcttcaacatgattgtcgtacatggatagagtcctgagaaggcaattgtatctattaattaggatgttttatgtaacttccttagagatatgtgtgggcaaaagtttgccgcaaagacttatggtatcttagagtttgttagagatagtggtcgtgtccggtatggacatatcttgtaattctcgggtataaatagacctcgagccctatgtaatttttaacacacacgttcaatacaatttcggcgcatcgccacctttttgctttagttttgtttcgacgagttcttgctttctggttgagctgcatcagtttcgatcttcaacaagaggtaaaacttgttatgacgacttgtgttctcgagattagtgcttccatctttatgacactctaatcttgtctatataattcgtcaagttatcatatatcttacataatctttggcaatatcgtcatctaacctacaattgactaacatctgttaatagaaggcagccgattaggttaaatagcgacgttgttctcgattatataagatatctaccattttatgaaacactcagcggcttgattgtctagatattgttctttttttatacttaatgctgcatcagttgagtttgatctattaagtcgtgcttagaatatcaatctctagcctgtcctctggttgccaattagggtagtattggagtttcaaccgatcttatctgatttaaccatattcgatctatatgcttcaatgacatgttaaatccgccctttatgtcaggatcttattgcatttaagtatattaagcttttgtttggtatattatatttgttttgatatctttatataaagtagtatcggagtattagccgatacatgctagatctatctgatcggctatgctataaacatatataatcctgttattaatatatatttcgatctaagtgatttatactgtctcggcttggtgaccgatctatcctaatcacttgatttaagtatatattaatataagaactatatatcgttaatatctacagccgatcgaatagatttagttccttactatctatttataaccgccgatcgattcatatatgacatcggctcaaagataaatgatatgtcatcggcacctagccgatcggctatcatttatagatttaaccacgaattctttgtctctatttcttgttgattacaggatcaaatcatctggcacgctcatacattcgaaggcgagctttggacctgcactggagttaagcagatctcccaggcctcgtcttttctgtcaacacgggcgtggggcggtgcgtgggcg

SEQ ID NO: 55061 - DNA, 1517 bp, Oryza sativa
tcctgcagcccgcaatcacacatggaacagatgtacttgcagcagaaagctcggagataatctccatcagaatcagttaatttttcccgcatactccgtaccaagttcacgaatgtagtagtactccctccgtcccataatataacaatctaggggtctgttcactttgatgccattttcaaccttaccaaattttggtaaagttgccaaaaaagtggctacatttagtttgctgccaaattttgataactatataagaaatcctgctaaaattttggcaagcacagttgccaaaatttcagcaataacaaaatttggtaaggttttttctggcatcaaagtgaataggccctagaactagatgggacatcacctgttacaggctccatgtccatgtccagatgcatcgtattagatgatgtcccatctagttttaggttgctatatttttagatggagggagtagtatttagtgggttgatgtggggtaattgctatgtttttatgttgaggtttgtaataactttttattagggtctacgtgtcagcgaccctaaatagtctgatgcgatcttgttgggcctgctcgaatctcagccggtttacttcccggcccagtatggcccaaaaacttccctatccacaacgaccgaagcgctttcctccccgcggctccgcctccgcaatccgccatggcagccgcgaagccggtggagccgctgccgctgctacgagccggcgcggataccgccgccgccgccgctctccggagattccagcttccgccgcagccaccacgcagtgtcagagccaacgctatcagggcctctcctccttcgaacggcgccgggagccccgacgagctacccgccgcgctcctgcccaacgcggcgcggcggcgggacggctgcgggttcagcctcggcgtggacctgggagaagcacgcaccggagtcgccgtcggcaggggcatcaccctcccccgtcccctcaccgtacgcattctcgctcgaaccccctctcgtttgctgcgtcgtcttgggtgggcgatctgaaatcggagtcctctgcttaggttctgaagctgcgtgggcagaagctggagctgatgctgcttgacatagctcagcagcaggtgcagatgaatgatcaaactcaacgcgtattttgattattatttcctccccaaatgtggcggcggtttgtgaatttgccgctcgtttttctcccctcttctgcaggaggcggacgagctgatcgtggggctccccgtctccgccgacgggagcgagacgccgcagtccaacaaggttcggagcgtcgtcgggaggctcgccgtccaagcggccgacaggtgcgttgcattgcgtgtggctgcaaagctgcagactgcactgcactgttcaatgttcagtcagtcagtgtggttgccctgcatcaatatattagaagaaaaagagtttttgttacacaacgcaattagccggaccggcttatgctaggggaagggagaaaag

SEQ ID NO: 55062 - DNA, 5938 bp, Oryza sativa
tacaagtttcgatcaagattcgtcgtttgctgtttcaaatcaaccagatgtatatcgtgcaacttgcccgatgataaatctcgtggtcagttctgagtctggatttcgttgctagtagacttcttgttcagatacttgtatgtcacttaataataatagcattatggtttccaagtccaacaagattgtatatgcgtagttttcatagagaaggaatttgagagtaaactgctctaaaactcagctttggaaagaaagaaaaaggtaatgtacaacaatcccccgtcccattccatgtgctaaacacgcactttacccatttgagagtatgactgatctatctttactgtatctgcatcaatcatggttgctgcaggcatacattgctgctgacacaaagtagaatgcctgagccaaaatcgtcagaatgaatcaagaattagagaatgtgattctgtccaaatgaagatgcatctgaatctgtacaaattgaatcaaaacagcttgctgaattcggtttcctgggccggttcaccaagccgagggaagaacggttccctctcgagcatagtctgcaacgagtccatcaccctcaccagagacgcccacaagaacggcgcagaacaaaatgcgtacccgaagattgccagaaccctcacgataccaccatggtaccacgggaatgccatgacgaagaacatgccaataatagctaaccagggcgtgagcacagcaagcaatggaagcaagaaggcattgctcacgagcactcccaatgccaatgcaccaaacaggtacatggaccagcccatgaatgggtgaaccgtgcgtgggattataaagaacgggatggcatatgcaattagcatggccacgattgcagacatcttgatcagcccctgcaccatggcattttgcttctcgggccgccggttatagcacagttttgtcatcccaggctttgccaacctggtaatggttataatgactgcgtacatcaatatctccatcaggatcactggcatttcagcggcatacctgttgatgtgaacatgcaaaggttaagtgaacagtaaggatgaaagtggagtttagagtctgctcaagcacattttttcagttcagttcttgtctttactcacccaagatcatcccaccgttgcttgtgccaggaaaggcccagtggcaagattggccatgaccaccaataccaaggtttaaaccaaggggcgctggggaatgtgataacgctgttgggcccacaagggacatgccaatgcaacttgagatctgcattattccaccaaaagggtgtcaaagataatctttgagaggcaagagcaaaatgaaagtgagaaatgtataacagtagtactaacagtagtaggatgcatccatctgataaccaagaggaaggcgatatgtcccgttgagcttgctgccattctcaggagggtggaacattggtctatcaagcaagtctgggtagcagccgacaagaaacccttggtcagcaccatcagagttggcacggccaatctctaggtcatgaagcatgcctttgaagacatccatagaaggctgtaaatggaaaatgttgccgatgtcagattactgtaacaggaaatagtaccagcatcagattacttgtttgccactacatatgtgtgagcagaagatattttcaggtgtgacaacttaacactgattatttattaatgacatgctatttcatcgtagtacttccctaacggatactatattctaatgaatatggaaggaaaatatccagtctgtgacctgccaatggctaaaatccactgtacagattggcagaatacagctcatatttcatcaaaccctccaaatggccaatgcatgatcaatccagtggtagtggctcaactgtcatatgacccattaccaatccaatgccaccatcaacacagctgtaggtatggtcaaatttaagaaacacaccgtttttactctaatgaacactatgtaacctggcagaagcaacttattttaatcatcaaggcaacagaatctcaaccagcatactccttctgtcccaaagtaacccaacctaaaataagatgtgaccaaacctagtacaacgaatctggacaaacctcctatccagatttattgtattaggttagatcacatcctattctaggttgagttacagaacaggtggtacagactagaaaatactgtacaaagtacaggaattgcatcatcgtacctggagcacgaaaagaccagtgtggaagtagcaagggttgatgaaaacggcacagaactgtccacactggaagagctcatcggtcttctgaaggaagatgttatcggagtcgatcatgacgacgcgctcatagtcaaccagggtccacgcatagagcttgttcagcgtcagcttaaacctcctgttgatccctccaaggttgctctcataaggattcttcatattctccaccagcaccactctcatgccatcctcttccctcctgtttccattcacaataaaaaggtgtcaagttccaaaaaaaaaagatcacatgaagatcttgtaataacaaaccacagcatggaaagttttgaacaagaaatgtgattgcaaccatctttgttcgcattgcatgttgtctgaaacgttttgactatgacaaagaagccattgattcgaagtttcgaacaaatcatttgggatttgaccgtccctgagaatatcatcggtgcaactgattcattttttcaaagaaaggaaagttgaccacattaattgaactagtactccttaccaaccaaggcaagcaaacagatagtcaaagttccaaagccagcgcaaccgtcccaaatcacaactatggttcatattggcatatatagcgactagccagaaagaacaagtaactaacggtaatgtaatcagacaagaacatcaccagttgaaaccgagcatatgcagtgcacatctcatatcgtcaaacacattgagaaaatccgatacactaaaatattaatcagataggaagcttccccttctgcaggtgggcccggccccctcccacgaaaccatctactagtattaaatcctagttgaaaaatacccgaaatgccctttccacgtcatcttcttcttcttccttgttcccaactccagaggaagaaaagctctctcaaaaacagaaacctccataggaagaaacgcggctttattgattaattaagaaactagcgtgcgctggcaatggcttagcgagggtaattacccccgcgtttcgacgattagcgatggtgaggtgagcatcggagaggcggagagagagactcacattgcgcggacccagtcggcggggacgtcggcggaggcgatgaggacgcggtcggcgtcggcgccgatcctggcgagggagcgcatcatgacgcgcacggcgacgtagaactcgtagtccctcggcgtccccatgtacatcatcgccgcgtacgcgtgccggtgcctcggccaccgcccctgcgccgccgctgccacgactccactctccctccctcccaactcctcctccaccgccgccgtcgccgacaccgccatcaacgccgccacgacgacgaccaccaccccccaccggcgccaagcagccgggggccaccaccccatccccgtcgactccaccaccaccacgctagctagctgctgcctggacttggatcagacagagcaagggtagtagtagtagtagtagagatgcggctgatgcttctcgagttccttcaaaagcagaggagagaaaaaaaatggagaagagaggagacgaacgaggaggaggggaagcggccggcgcggcgtttcccttatttatgggtgtgctcgtggaggggtggggcccacacgtgcctgacaggtggggccggatcgggagtgggcccacccccgcagcgacggctgggtgcgcgtggccgtgtcacgcgcgcgcggatgagaaagagagagagagagagagagaaaaagaaggtgcagcaaacgctctgtgcgccgcgcggctcgtgaaaggaaagaggaaagacgaaggcgaagtaaagacgcgtgcggggattggacggctcggattgacccgttcgtcgcccccggccgacctcgtcgtcgtcaacacaaatgctacacacgcacaacggcacgagctctccccttttttatcagcgaatcagagatagagtgtttcttttagccaaaaaaaaagggaaaaaatacgaattactattttcttctccttttttgcggttaaaaaaaatgagccaattcagaacaaaaagaattgatgctttggtttggtacagagatgtgtgtgaaaatctttcgccagagatccgcatcatcagcatcggtgacggcatattaaatggcagcggcaagctaagcttcaattaatcaagctgcaaatggagtagtattaaagcttatgttacgcagagatttagccaggctgcaggcttagtgcacgtaaacctgggcttatgttattcggaaaattatttttctattcccatgacgtgtagacgagctgttcaacggctcaacctctccaaggctttgcttctcttcaggtacatctacgatcaagatatttaattttgttgctcaatgtcaaatttaaaggagagaatcgttctctttgtacgtcaccgtccggcagttgcataatctctaatagcgggcagggaatttaatcgtacaggaatcagttgcaaactctttgctgtttgctcttcaatcaatgtaccagccgcaaacaaaattgaaatattagaatttcaccattaaagttgattattgttatctttcatcatgctttatttcttacattgacctttagatcactaaaaacgtactccatccgggtttgtaatattttcattttagataaggatgaggtcaaactttagaatctttgattatgaatcattttttaaatatttatcttttaaatattgtaactatatgtatagattagtcttaaaaaataatttaataaaatcatatatttgttagcacttttatactccctctttccctaaatgtttgacgccgttaacttttttaaacttgtttgaccgttcatcttattcaaaaacttttatgaaatatgtaaaaattatatgtatacgtaaaattatatttaacaataaatcaaatgatatgaaagaattaataattactttttgaataagacgaacggtcaaatatttttaaaaaagtcaacggcgtcaaatattttatgatggagggagtacatattataaataaaataatgatcaaagttgtttttttgagaccgtactattgttcaaaacgacaagtattattaactcagagggaatatatatagaaattttatctttagattattttacttataatcaactgtaaacgacacaaatgacggcttttagataaggtagtatcggatatagtcagaggaatactttaatattttgggttgagctattaaaggtggcatctatcattgtaaagaaaaagcatatgcctcattggtctgatcctttgcttgcccctttccattagagcaagtttaatagtatagccaactgctagtttcaattcatctatagttaatttaatagcttatccatacaatagttatatactacactattaatacctggtcccatctgtcatacacatattgtattttggagtccgtactataactggctacaaatctgtagcccgctgctcttctctctccttatttatctctttaaaatatgtctgcagctggtctatagccagctattgtacctgctcttaattccaactgaaacgatccaattgaaacctcacacgtcaggattaattaaacccgtttctatcgtgtgctgatgttaactcgctccatgattcccctcccacccc

SEQ ID NO: 55063 - DNA, 4112 bp, Oryza sativa
taagatgttttgactttagttaaagtcaaactgatttaagtttgactaagtttatagaaaaaagtactaatattttcaacccaagacaaatttattataaaaatatgttcaattattgatttgatgatactaatttaatattataaatattactatatttgtttataaatttagttaaatttaaaacagtttagctttaaccagagagatgtgaaaagaataatattgaaaagatatgatggatgagtcattaacatataattaattaatattaataatttgaactttaaaaattggtgtattttttttaaaacacacatcatttaatagtttaggatatgtgtgacaatctttcctctaggaacgaacccagccacgttttgtatacctctgtaactaaaaagattacatgataataatctacttactaatgaagaaaactggataaagtcgtgagagtgaggtccggtatttatccggccggatgagcgtccaaaggccaaaaaagtgttgggtgaaaagtgtgccaagaatatgcagctttcgtttctcgtgggcgtcgcgataaggccgagccaacagtacgtagctagtgtgctttgtcacgtaccagtagcaacgcactacagtagtacgtggcacacgaggacgttttgcctaggaggaagagaatggccgtgtcgccacgctcgctcgacagcttccagctaatccaaaatatcttttgtttactcatagactcgatcgtacttatagcaacggcgagtgttgaatcttcgtcatgtctcgtggtcttttgggagctgtgaaaggaacgggaccgtagggttttcgactttgtgctctcttcagtcttagtggttctggagtccatccactcggaaggccatctgtggttttaagctgacgttgctgcttttagagacttgttgggtgtatagcgtggttcggccccttcccgctgtttggagtttatgtttagccacggtagttttctaagcttcagcttttttattttatcttttctcccttttccctggcataagccagtctgaccgatttgtattgtgtaattaaaactatgttagtcgtgtaattttttttgcacgttcattaaaaaaaatcttcgtcgtatcgaagtggaaaaaaaggggattgaagcgtcgtggtcgtcaccaacgtacccggccggttaataagccggtcgctagcttagctttggttttgcttcggttgccggtctagctcgctcgctcgctcggtttgtccccttgtgatctctgcttccaaaacgggctgacccaagtttgaattgaatcgcgacaccaaccacgcgctgcgcgggcacgcacgccgcgattgacttgtagagtcgtacgtccatgcaatatattgcagccaccaatccaccgcccggttaggcgcagcggcgtattggcatcatattggagtagcggattagccgtgctgcgtcggatgcgcgttggcagcagttgccagttgaacccaccgtgaccatggccgtggtcagaggtagccagcgccacggtcactctcttccaactctcaaagctactagtgcaccgtacgtcagtgggccggccaacgcccatgatcgctactgctacttggcacttgcagagtgagtactactgttccaggttgcagatgcagatgcaggcaagaagatactttggggtttcacgaaactgcaggctgcagcttcccttcagacctcctcttctcttctactactactctttgacttcaaatgcggccggactcacttgcctgtgaaggaaacgaaatatactagtattccctatttgacgccattaactttttttaaacatgtttgaccgttcatcttatttaataacttttgtgaaatatgtaaaactatatgtatacataaaaaaactatttaacaatgaatcaaatgatatgaaaagaattaataattacttaaattttttaaataaaacaaacggtcaaacatattttaaaaagtcaacggcgtcaaatattttgggatggagggagtactattcaagtaaggggcgcagctaaaacgaaatgaaaagaggtgacacttgcttaaattattttactttagatcaagtttaaactgattcggttgtataaatttatatttagggatacacacatggtaaaatagatgagataaagctttatcgggttcctgggcacccctcatatatctagcttcaccccgctcaactttagaatttcacttctcctacttcctcgtctcattttaagtgcagttttcagtctatgcgtctaacatttgaccgtccgtcttatttaagaaattaatatttttttagaaaataagtcacacataaaatactattcatatttttatcatctaataattaagaaaaaagtaaaataagacgaaaagttaaacgttgaacacagaataaaaactatacataaaatgtgatggatggagtattacaaatccacaatattactattaccagtagtatacgaccgatcgattcacacggttaggatattaacgatcgttaacactagtcactggcacaacaagaggacacaccactagctctgtagctcaccatcaacgaccattacctttggttaatcagtcatgccaacctttgctgtcacataaagcatgaaagttactgctcctaagaggagtatctcgatggacgacggactccttcagaaacgaccagctcagtagctcgcacattcagactttcaggcaaaacctgtgtgtatagtgtgtactagcaatacattacccaaggttaaaaaaaaaaaactactccataaaaactactgatacgatacgatacgatgcgatgaagatgttgagattatagacatataatgatttaatctattccataaataaatcatgacattacagataaaaactagcatgaacgcatcattagatctacacatgtaaactacacagtataacatgaacagatcaaatatgcgcaacatattgaacacgtaccgaggtgacggaaagaccggctgcttggtcgaaacttttcgcaagtgtctacgaaggcacgaaacacgcgagcgaagaggaaggcgagccgtcgcgaacgaacagggagcagtcgcgcgaagcgcttcccaaaaaccttattgccgccttctcccggtgcagaacgtcgaaggcagaggttccggagacctgctctcccgatcgccggtgcacgccggcgagcgggatggagtagtctacgagcgacggcgcagtacagaggtaggaagcaaaccctagattgattttttttgtatgttgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatctttcggaacgtttccaaaacaaaaacgaatccgaatttgcaacaaaacaaaactgcaaaaggagcctgcgaggcaagcgagcgagcgcgcgcgtgtgtttcccctcttctctccaccacacatgcttcaagcaactaggagggcatcctcccttttaaggaggtccccctctcctagaataagcaaggtggtactaaactccacatgcataccatcccatgaggtgggcttttgtgattttccaaagaattaatcttcgagtgggctaaggcccattcattaattccaacggaagattcacgcggtgaagacacgacttgtcgactacttatcaggtactccagtgcacacgcacttttcgcacacgttgattaattcgctgcacttttgctgagtggtgctgacctgaccttttcgtcgatgatatgtttgcttcggttcttcggattcatacggtcgatcgattcgcagatgcagtaatacgtctagggcaaggcgaccgcgacggatcgatactctctttgttttgaccaattttaaccaacgtcacgaacgtgtgtgtgtgctcgtcagagtcttcgggcagctcagctgggcccatctgtcagccactcatgtggtatgcatgtccacgtcactcgtattgactt

SEQ ID NO: 55064 - DNA, 7373 bp, Oryza sativa
aggttgccagtaaagtggccaaatccatagcacaagaataactagtaagtggcaacatataggtataggaacgaaattgttggtatacatacattattgcaagatcagaattacgtaagtatggtgcagttaaatccaattctgcagactaatggacaccagtgtttactattccgtaaaagaccgcaatttcgggaattccagaaaatattggtacgaaagtatctaaaatttaaacaagttttgactgaatttgaataaattttggccaaattcacaacggattgaaaaaatccagccgaaattctccaaatttcaatccctgatggacactaagttgtaaagacagaaaatccaaaatataagacctctttgaattaatgaaataaatccatagccagaattgtaaacagtttctataacttgacaagaaatgtttaatgaccagtataaatgttgggagcaaggttcaggaatttctaaatgcaggaactatatctgtttgctgtatataaaaattatccaagagcaaagaaaaggacgtgcaccttgcaatttcaccaccgttatcacataaagcacaaaccaaatcaacattagcagaactctcgccttcagcgttatcagtcatatcttcgagtttacaattgcaaattcttgcttcactcttatgccttttataaaacctgtttaagcatccaaacagtatattatttagcactgtaattgaaatttacaattatttctctttccgtagcatattctataacatatgttttgctttagtcaaattattctggctgaaacaataccaataaatcaaaagtaatgctgtatgatgagaccctcattaaagtaattaactacagaatgaaactaaatgttctacattgtttgttatagaaacaggattctttttttctcatagcaaagttaacaactgccaaaaatgaagtgcatttcatccaaataagcactataaacagtacaagtggcaacatgtaagtatatcttaaattaataggctgtagctatgcctgtcaaagttaaaactacaagtatgcagaatacaagaagttcccacttggctgcaaacaggagtataaatttaaagcagagaccagttgaccactccattggttatacagacaggctcaaggcattagcagttcattgtaggatgaaatgatccaaacaatcattttctttccaaagaaatagcaaatagaaagcaacaaccttacacccatggaccccacctagtaagtacgaagaaaagctcatctagttcctccggagcgcaatatccatgaagaatatgaacaaggtaacctgccttctccaccagagcgcaatatccatgaagaatatgaacaaggtaacctgccctctccaccagagcgcaatatccatgaagaatatgaacaaggtaatctgccttctcctatcagcctctagtttctttcctttgtttttttagtgcagcctctagtttcttactatttgtcatgcaaaaattatggcatggcataaacattccatcggaaagctacagactcggtttacagatgaacttgaaacagcacatctgcaaatggacgaaccaaaatccacccgacacatcccaaaattgagggaaactaccaaactgcaggatcaggatccaaaccgcttcaaatggaaaaatatattatacttgcttttttacgccatcgaccaggaaaaaaaaaaagaaacaccgtgcatgatgtctaacagggagaaccgctcgccgaagcaatcaggcatgccacaccacatggccacatttgtgcacagaaagtggatatgcgattattaagagtctacgacatccttatttccctcagctcatctaaactgaaaaatgcaggccagtgaagtcgggagtcgaacacgagccgcggaagccggaagtggagaaacgcgtcaatggcggaagccgcggagccacaaaacatttcggtgccagtgcgcctccgccgacgcgtcgcccacctcaccgctgctccaccgccggctgattccgagcgctcctctccggtgaggaggagacgaaccgtgaaaccaaccacggaggaagccaagagatcatccgacgaagctgtgcctcctcacctcaatcgatcagaaccttcctcaaccacacccagaaaaatctcctccccgaaaaaccgcaagcattccgcccaaaaatccctcccaaaaaaccggagccaaccgatcacccccaaaattcgccacgaacaacacggaaacgatcatcgagcacgcatacctcacgattcgagcagctcgcagcaggaaaccatcgggatgcgctcgctagggtttcgatcgccgcggagagacgaatccgaatcccctcctcctgcacaaaacccacaagccaaaaacccaaccacctctctctctctctctctctctctctctctcgcacagagatgaactgaacaccacgcacgctttgaacgaagtgggagagagagagaggagagagggtcacgtccaattcatgctcgcctctctctcctcctcacttaccgacccgcccacccaccacctcactgacagatgggccccacacccgtggggcccgggtggtcatgggctaagcgtagcctccatcgacgtggggaggagtcgcgggatcctccggtggggccgacctgtcagtgagggtggaacggctccggatgcatgggggtagggccgggcgacgtaggccgtaggataggccagccttccgggggcgtagagctcgcgtgggccgtcggatcgggatgggctctgacacgtgaggcggggaggctgcgttgcgggcaggtggccgtgccggtgaaaggaacggacggtggggattgggttggacgtgtttcgtggacggcgcggatggagccgtggaggaaggtgcagcgtcgggattctttttactgtgtgacccccttttttgtcccgtggaaacgaggccgagctgaagcttttttttttttactgctcccttttgcccctttctctctcgcagtaaggggctgtttggcaggactcctctccaagaaaatagctccatctccaagtttttttttgccaaacacgagtagtggagtagctccggctcttgaatcgcagctccatctccaggaatattctggagctcctcaaggggtactccaccaaaacctggagtcatatgtcctcatggagatggtaaaaaattacccaccattgccattggttacaaaaaaaacgattcgcttctattccacagtaccgtcccgttcccgttcctcattcgtgaaaaaaatgtttccaccagagcgccgcccgagtctgcaggcaaatcgccaccgccgccaaccctagagccgccgccaccgagatggccggatccgcctctgtccaagatggatccggcctagaggaggaagtcccggccgccgagatgaccatgggcgccggactggagcatggctatgggcgcggcttccctcctcccgcaaccggccaggggcgcggctgcccgcctcctgctgccggccagtggcgcggccaggggcgcggctgcccgcctcccgctgccggagccgccctgcacccgcctcccgctgccggagcagccctggggcacggctgcccgcctcccgctgttggagccgtcctggggcacggcagccctgccgccggagccgccgtggggcgcggctgctcacccgccggcgccgcactggggcgcgggtcccagccgaccggcgctgcccagtagcaagctcgtcccccgcgtactggatgatagaagagcttttccccatttcaaaggttgtattggtgctcttgatgaaactcatatccgtgtgtcattgtcacctgatgagcaaattagatatattggaaaaactggaattcccactcaaaatgtgcttgccgtttgtgactttgacatgcgttttacttatgttgcaacgggtcaaccgggagctatgcatgacacaagtgttttatacaatgcattaagagtggatgaaaaattcttccctcatcctccacaaggtaccacacttgtattatgctctctatttgtgctaactgtgcatgtgttactaaaatgtatcaataatcatactatgctatcttttgtaggcaaatactatgttgttgacgcaggatatcctaatcgtcctggttatcttgctccatacaagggtgagagataccatttactagagtggcacagaggtatggaacccaatactccaatggaaaaattcaatcgtgtgcactcttccatccgcaatgttattgagcgatcatttggattactaaaaatgaagtggcaaattctgtacaagatgccgtgctaccccatgtacaagcaaaaaatgattgttgaggctgctatggtccttcataattacattcgtgagcatggaggtgaggatcctgattttgctaggtttgatcgtgaccctaattttattccaacaataccagaacggtacaacaaatacgcagttcctcgaacggcatctgatgagtcaactcccgaaagaagtacaggaactatggatctcttccgtgatgaactagccaccgctttatcaatttcttggcgctagatttgtaagacataagatgataatgtatctttgttggacttcaattatgaacctttgattaaaatgtggtaccttgtgcggattttgctatgtgcggattttgctcccaactcgtttctcaattgtggcagatttgcatgtgttccattaagatgtaaaataaatattacgataaaaaaattagctactcggaggtgcaattccctagtacagtagcagcattgccatgcgtgttgctttgcactctgactgtgcgctctccggtctactgtgtagctcgatcgtggccgttttggcgttttgctgcaacattacctctcgcagcaggattgaaataggtgcttgcatcgtcttgaaaaaagtctattttataattttttttttattttttattataaaaaaattagctattcgagctaattttgtaccgttcttaaaatagctacttgcatcgtcttgcaacaagtctattttgtaatatattttattttttattattgttatggctgtgagaaatattaaacatcactatatattagtaatcaacatccatacaagatccatgggcaaaacagtcctttcactcatcctcctaccaaatctggagctggaccatatgtattattacccaaacaggtgctagctccaggagctccacggtggagaagatttcctggagaggagctcatttttttgtagaggagctctcccaaacagcccctaaataactccgtcggcttccgcttgacagaaagagccaagcattttattcttcgcactcgcagtacacaatggcatattaactgaattgcaaaatatattcatttggagaataaactgttgcatttggcatgttgggaatgaacttaacaagcagaccaaattaacactaatgagtctgtcagaacatattttctaccacatctgtaaattggcacgacttacagatatcacagtttaaaactcaaatttcaaacatgctgccagaatgaaacaacattactataaatatgagcttatttgccctaacatttctcctctttactccctggatctagtattcctgtttaaaaaatacaatcaatagcaatcatatttctaagttctataacataaccattaattcatgccaatcgatctaaaattgcccctaatagaggaacaggaaggaattcatgatctcaaccaaaaacttgccattgaggatgaaaatgaactcatcgctgcccacatcttctgtatcttagacaaaatccactccttgagcagggtactcgttagtctggctccaccaagtgtcccgccgcttatcgtggcggcaagcctgcaacagcgtgcgacactgcttctcacagccccacactccaaccctgggctaagccatcgtacctcaacacgtgcatttgagccacatccctctaacgccgatatagccatctaacttgcaaggacaacaccctccaagcccgctgccaccctagaatcacttatttcgacggttgccatatggttccggagaggaaggttgaaaggaaggagatgatggatcccttcacgaggaagggtggcaggaggagcgtcgcgccgcatcagcttgggaaggggaggtggtgaggggtatagtgttcgggcaccgacaaaagggagggaagaggtatagagcaccgagaggcgttgccattggtggagaaaggcagagcgggctggagaagtcggtggcacggccactactaggagggaggaagcggatctcaagcgccgcaaccaccgctaggaaggaggaggaggctcttgaatggcacagccaccgctaggagggaggagtgaggaccggcatcggcatcgctggtgctgtggtgtatgatacacaataggataacaagtgagaggctgggattttttttcctcgtatatttttccttttcggataaggggtggtggggactctatatttctatatgtttctttccgcatactacacgtgattttctctatggttcttttttcagatggaaacgggtgactactgatttctgctgtaccattgtctcgggataatactgatctctgttgtaccattctcttgggataaccaaaatcccttataatattggacaaaccaaagggtcatttatcccctgtagttgtggacagagggagtacttacataagcattttaaatttgcaatgcactcttcgcctaatcggtgcgagtaataaccaaagttaaccaacttagcacgagaggtgacgtgtcatccgaccaaccgctttggcctctaccgctagtacttctcttaccactccattcatcactgtttcggcctttcgagcaaaggcccagcttggaaaattatggttagacaaataggccgctgaacaagaaaaatgttcactttaggtctctcttctaataattagttttaaaagataagggatgttttatatccggttttatgattaacgaacacaatttaaactcgatgcttagctgagggatctaaaataaactttatctgccaaacaaccaacggtttgctaattgatggctaatcttgtggtatctgggccgggccattggctgatccaacgttggcccactaatcacactgcgccggcctcagcctcgccgccgccggcggccaccgaagatatcagccatgctccggcggtgaactgataagtagccaggttttggctcaaagatgaaaatgtgttccttgtctgtagcgtttttacccc

SEQ ID NO: 55065 - DNA, 17147 bp, Oryza sativa
  unsure (1)..(17147): unsure at all n locations
gaagaaaatagagttgttgttacacaatgcagccgaccagactggtcgttgccagttacaaggaaaggatttcgaacccaaaaaagagtaaaaactaaaagctgttgcttctatctagcgggagggggtggcggaggaggaggagcttcctaatctccaaataggtccccaatgaagcggatggaccccagaactatcgagaccgatgaaacggaagaatcaaaaaccctggtgaaacgaaagaatcgaaaaccctaacgttccgctctttccaaagctacagtaaaccatgaggattagagagtcgaaaccttacgaagatgcgcaggaagactagccctagccgtcggccacccgaccattagtttttgtttttgtttttactaagggaccgcgagtgtgcaccgtagttatatcatctcgatatataattaaccaactttaatagaaaatcatatatattatcttaaaacaaaacagttttcgtttttagccgccggtttgtttctacagatcatgagcatgcatatcactgccgatgcagtataaaatagggttaatttaatccatgccactacaaatgtggtaaataaaaaaatgccactactattcgtgttatcgactgggtgccactgaaaatttttaaaattaaaatcatgccactcccgtcattatttccgtcctcctctctcacgccgccaacctcaccgtggttgccgccgacgaggtcgcgcgccgaacgcccatgggacgagggggctccgtgtaggacgttgccccgacctcgcagccctttgcaccaccttccacaccccacaaccgcagcgaggaggatgggcttccggcgagcactaggttccacaccgacggcaccgcggatgatgggcttccgccgctgctcctcccaatccccgtctcctcctccagctccgtcgccgccaaccccaccgacgagggctgtcgccgctactgctcccctcgatccccatctcctcctttagctcaagcgccgccgccgctcctcccgatccctgtctcctcctccagctccggtcggcgagggccgccgctacttctcctcccgcgcctcgcgtgcaccatgccaccgccaccgctactcccgctcccgctgctacttccactgctgctgctggtgacggtgaggatgctgacgtgaggaaggaggatggtaaaagtggcgggagtggcatggatccaattttaaaaattttcagtggcacttagccaataacgcgaatagtagtggtatttttttatttgccatatttagagtggcatggatcaaattaaccctataaaataccttgtgcaattcgcaacatgcatcggataaacaagtaatcatcgactaatcatacaagcatatgacggaaatactcccataaaacttaatcctaacacaatgcccctactatgtccaaagaataaaattatccagcaaccaacaatccatgcaaaaaaaaaaaagaattagaaaagtttcttagcatcaacacaggagcagcaatccagctgaggcagatgcagcaagagccaagaagtagccggcaatgccggcgccgcggcgcgacgacggcggcgacgacgagctcttcttctcgtccgccttcgccttggcgctcgacgacttcccggggagcgggctggcggcgtcggaggccggcttggcgtccggcgccggcgccggcgacggcgccatgggcgggtcggtcctgaagatctgcatcgggaggagcaccctgtccacctcgtagacggcgacggggcgggtggagtagacgctgctgctgatcttggggttggaccacatcgacccgacatggacggtgcccatgtcgtcggtgacgttgaccgtgtactcgccgccggcgagcgtgggcaccgggctggccgcgccgcccagcctgttgaactcggcgagggagtagtacctcggcagcgcgtggtacagcgccagcgacttgagctggtcggaggtgaggttcgccgtcgccgacctcgccagcgacgcgaacgccgcgtccttggggacgaacaccgtgatcccgtccttgctgccgttcgcctggctctggaacgtcctgagcacgtccgtcttctccaggaggtcgaggaacgtgtggaacggacccgccacgctcaggaggtcggcgaggtccacgtggcgcggcgccgccggggacggcgccggcgacggcgggaggctcacggccgccgcggcgggcggacccttgtgcttctgcgcgaacgccggtgagatggaggagcagcagagcaggatggtcaccatcatggctgctttggattccatcatcctcgaagtccctgatgtcacgcaagaacagtgaagtgaagcattcagcactgaattttttttgtcatgcgtttctggagcacaagtctgtaactgctgaatagaattactcttaatcttgtgaattctacagtgtttactgaacacatttagtagagtacttaagttcaaatcaacatacaagagatctgtaatgttgttctgtattctgaaatgccagaaaaccaacttcttgtgcttcagattactacagttcgtggtaattctgaacattgagaattttaaccaggctcattattgttcagatctttctagctcctagagcagagttttcagattactgaaatttagcacaaattaatggccctttccctgtcaccaagagagacaaatgcacaagatggggcactttcaagactcgatctagtccgaattgacaactgcattatactactacttcaactgttaggtgccaccaaccaaatcaggagaccacataatctaacacaagaacaaaaacagtactcctactactacatcctgcagatctcagcaccactggaagcatccaaatctctggaatttgggagccaagaacagttaagtgctaagctttgcattagcatttcccttcaacctgaaggaacataaacgcagagcaccaagaagagacgccaagctcaagagaggcgcaaagatctgttctttcctcgggccaagaactgcgaggaacagatccaaatgcgccctaaacaaatggctgcctccaagacgaccaacccatgaaacatcatactggaactcatggaaaccaaaaaattaagagaagagattctgagcatggcattgcagctgaaacaatgctgaggagactgacctgagctgctgagctgagcagggaagtgaaggcagtgaaggaatggaggagagtaggaggggagttaaggaggagagtggctatataaaatgtggggaaagtaaaaagataatgaaatcatgggtggcagctgttgatgaggattgagtagaggacagagagggctcactactgttttcaggctttcatctggagaaaataaaaagatagtaaatccaaaagaagaacagctaaataaaagctggccagataggagctgcccctttctgtcctggctctctgttgtttgttttctgggggagtaggagtagattgcatttgcttctggtggatgattagtgatggcattagcatccataaactgctggtacttttcagtggcattgcaatgcttacaagtaaggaagtttcttgcttttccaaaaaaaaaaaactgaattgtttgcttctttgatcatcctttgctttagtgtaaataacaaaagcaggagagctggaatgtggtgatccaaaaagggtgatgttgtaaagatgaacaatgcttgcttaacttattgctttatcaagttataaagatgatcaatgcaacaaaccacccagtgactcagtgagttcatgtgatgtactgacaaaagcactaatgtgcctcttttggccttctttataaaatctagatagcaggattcctcaaacttcctcaccagctcttttgtttggtcatcgtgttgtcagccgcagctaaaatttatctaattttaaacttgattgttatgtttttattgtaatttatttataagtaaaatgcaccaacggtctttaaactttccaggaggtttcacttaggtctacgaacttgcaaagcgcacatcgaagtctctaaacttggtttattgtatcatccagtaccaaagccgcgtttgaccgtggtcttgcctacatggcatgccacatggacgatgacatgtaattttttttatttttttctcactcctgtgcaaccgagccgccgccctctcctctcctctgtgggcgcgcgtgccaccgccatcgcacgccatgggcgccaccgctaccgcggtttcgccgagccaccatgtcggaggtgagcacgcaggggcaccctcccctcgggcgcagccggcgacacctccccccgcgtgcaccaagctcgccgatgcctccccccgcgcccgccgccgccctcttcgccccacaactccggcgctggcccccacgtgtccgttgtcggcaacccctccccctgggcgcggtcggttcaagctcgccctgccgccatcgagctcgcgcccgccctgctcgtggcatcgccgtcctttttttctttccgccgcacaccgccgatctctggccactcgtcgccacgggggcggcaacgtgaccagctgcctcccaaggccgaccgcgaacgcctccttgccgaggaggtcctctacctccactccctctggttctgcgccgcccttgctcccgcatcgaccggcggaggcacgagagagaaaaaaaaggaagaagggagaaaaaaataaaattattccatgtcatcgtacacgtggcatgccatgtaggcaagaccacggtcaaacgcggctttggaccgggatgatacaataagccaagtttagagacctcgatgtgcgctttgcaagttcgtggacctaactgaaacctcctgacaagtttaagaactgttgatacattttactctttattttttatagtggcttttaaactactaaggacacatataaaagttttatacataaataattttttgatcgttaataagtgttatgacataatataatctgttgtaggcgaaacatgtgctgaacagcaaagcactactgaattcattctatttgtttagggaaaggaagagtgtgacaaacacaccatcggcaattttcctgaaacagaccggacaccaccattaaaaaaatcgagggtagaagaaacctgctgctttttcagagttattgtctggagaattttagttctgaatagaaccttcagtcttctgaaggatgctcaactgcacatgcttaatacagccatataagtaacagcttatgcattgctgtataccactagaagtcatacaagcaaaatgtagtataagattaacatgtcttatgtctcctctctttcttgccttctcttctccttttcctttttttctttttttttttctttccacacgattgacagtgcatgacagtctgaaactctaaacattcctgaatctaaattctgaagttctgaactactacctctaactctaattcgacaagctccatgtaattaagctctaaactggatgtgattacgtgaggtcgcagcagattgtgtcggtggaggaccagctgcctgccctgacggtggctcgtatccggtgtagttaagtatagtacttaatcagacaaaatttgcagagtcattagctgtttccggcggtaggtgaggaaggcttgatcatgaaaggggacttagcatgcatttcttgagctgtcatgctcagctgggctctcaattctcaagcttaaaccaagcattactcctataacttactttgcaatcgacataatcaaatggcttggaaatgaggatcacatggtgtacaaaagcagaattagtgagaatgtaaagcccagcatgccgaaattaagcacaagttttttcttcatggacacaatcacatgctgtatcattccacattgtactcctactcaactcttgttttgctttcccttcagtttgaagaaaccagagcggcatctgtgttactgcactttaagactgccattaatgacccacagcaactttcaatttctttaacctctctcttaatcttggagtaggagtactagtactagtgttccaggttttgatgctctcttggaccacttgaagagcagagaccttggtccttgttcttggcctcttggggcctttcagtatgcctcctctgcttttcaccaactaccacaagagtacaaggtttacttgatctgcaaaatgcacacttctttatcttcatctttggtgttcttttccagattaagttttttacgtgggtgatattaacgtatgattgattgagttttaattattataaacttgaaaaatagattaatatgatattttagagcaattttcatatataaagttttcgcacgaaacacatcgtttagcagtttgaaaagcgtgccataaaaatctcaatcttcatccaacttttgttggagaagagaataggattggttgaatctcctgaagatatagatgaaggtaaagattaagtgttttacgtaaaacgatgtggtaatagcgtgtgattaattgagttttaatattacaaacttaaaaatggattaatctaatattttagaacacctttcacatataaagttttcgcacaaaacataccgtttagtagtttgaaaagtgtgccacgaatatgcaaaactttatcttactggaaatgaacaggacagtcctatcaaaattatcggtttgtgtgctacgaaaattatcggttctcctatcaaaatcacacagtttcggatgcattgcaactctatcaaaacttccagcaaattgaacaaattgtgaagcactgactgctcctaccacttcaggcttgtcgtaatagttgtagctcccatccatgtgatgcctgaagagcattcaaatgcgggtttgagacgtcccaagcataattaccggttcaattatttggccgctaatgaactagtagctctgtcccaaaatattgctgcatactaattggactattggttcatattcagattcattatactgtgatgtgtcacatccaatactatgtaacaacattttaaatcaggttagtactatttctgattttttttctctctctgtgtttttgctctcttccaagccatgccaaatcggcaatcagcggcgtccgtttcgtttgttgatcgcaacgtagtagtactacaactctagtacgtgtgggtacgacgagctaatcctgtgttgcttttggtactggactggacgccgtcatactggattggatgcgccgtagatgaggtaatgtgttgttcctcacggaccaagcaagagcaaccaactgagcaagagtgtgttctagacttggattggcccatttattggacaaagtttgcctatgggcctacgtcaatctggcccatctggatcaaagcaaaacctccacaaattcaggatgcgtctgccattataaagtccaaaattgtggtactgatggaaacttagagcaaagtataggacgtatgtggtaacttcaattttaagataaaaataagggtacgtttaaaataaagttaagttataacttttcctgacactactatagaaaacctaatagatgttgggaatctcacatagatatcggactctccaaccggtaacacgaagacggtacgatgaggggactcatcgcagccggattgggaatcggcatctatggggagttcatgactaaaaaagcatcgggcccgactcgattcatcaagacgagttgattgcttcgaaccaagatcaatattcagaaattgagcctcaaaatcatcgcaaatccaactgcaatgaatcagaatcatcccaaacattacaaacccataccattcatacaaaacaaaataacaaatcaatacatggaagcctaattgtcgtagcccaccaaaggccaaggccaccgccgccgccgcatctcactggaggctgaggtcgttaccgccgcccaccatcatcactgctcaaaaatccaataggccatgaccaaatctagtgggtggtgggagagatccgggagggggattttgggggataggacgaggtgtatctgtcgttgttgctcgaccgcaattaccaccattagatcgggtcggggaactatcgttgtcgagctcaccgtatcgcttcgatctcactgacctcgagcttgtggcaattagatctagcaaccctgaccttgtggggacgcagggccaaggggagggcaccgtgttgtggataggttgccacaaccatcgtgatgagggtgccactgatgaggcgcattcgtggtgagaccatgagagtggcgttgcccgagaggagggtgccaccaccgtggagaggtctccatcgccttgaggatggcgccgccgccgaggcgccgttgtggggaaggtgcctgccgctgaggagagaatcacgcgttgctgatgactcggtagagaaaagcgaggagaagctgaggagaaaagagcgaagagctgagagagagtgtggagagaaaagcgaggagatgccaaaaccggaaatgaggtgggtgatagataagtcagggcgaacggaccatggcttagctcagcttggtgatttaatgtttcgggctttttttttaaaaaaaacccaacacatataatatgacaaccttatatatacaggtttttaatacgaaccggcacatatagatacttatatgtgctggttttaaattttagccttatgtgagatgtcggatagacgggaaaagcttcatatgtgtcggttttaaatgaaccgatacatataagggtgtccctattaggggttttgtagttgtgcgatctttctttcttttttttaataaggaacaagggcatcttttctttcagaatttcccgtaattatttggttaatgtatatattttcatttagaaaagaaatccaaccatatgggccgaatcaaatggcggaatgcacaagcaagcaaccatgtacatacgcacattacagctgacagcgtacagcatgctcaatcgcgaacccctggtggttttctttcggcctaacataaaacgcagcggcagcccatcgttctcgttgcctcgtcggccgaaagttccatgcttgtcgccgggggcaacccggcaaagccaccgcatttcgctcccacgcggtcacactgccaaatgcaccgtgccgaccttgacacctctgccccgcttttttttgattcccaaccgccgtccaccacctccaaactccaaagccctttgctctagctatttctttttgtaataatgaaatataatctaggtcgttactcaaatagttacgatcaattattacaccaattcaatcgaacacaaacatatcttaacaagttataaaaaatacactcattattcttgcataatgacactcaaaaataaataaattatccatattttcttattattttaaactctcgagttaagctgttatgtgtttataactcgacatgatatcagagttcaatgtctcgagttcaaatcctgattgttttttaataaaagttacaacctatttatattcactaaaacctcgacatgatatcaggcttaaggattctcgcgtgagaaagaatgttggaatataagtgaattgcatgtcttttcacatccgcttaaatttctattcatggtagaggttttagtgacccacgcgtgaacaaaggcagtgtttgtcaaatgggaaagggaaataatttcccacccatttttaaatcctaaccattcattctcccttttccatttaacccaaacccttcattcattttcctatcttaatcccacccctcatttcccattatctaaacacacccaaaagtgttagaaaccatgacacccccaactgacactaactccgtgtctccgcacatccttcattcgcccacaaatctcacgccaaaaaaaaaaaagaaaaagaaaaacacggcgaatcccgtgaaatcttcgcttcaattcgctcccaagcacacacgccccggcggcggcgcccgtagcatctctgatctctctcagcctttcaaaaaccatacgcgcgcacaaacgcgccatctctccatctcgccggcgtcgctataaaacgcggcgatcacgcttgcatctcactcacacaacaaaccacccccaagatcaagaacaacaacaacaacaacaacatttgtcaagatgagcgtggagatcgtggacgggagcacggtgcggagcttcgtggacgacgaggccgccttcaacgcgtcggtggacgggcgcttcgcggcgctggacgccgaccgcgacggcgtcctctcctacgccgacatgtccggggagctcatggcgctccgcgtgctggacacccacttcggcgtcgacgacggccacggcggcgccgacgacgggctctaccgcggcctcttcgcccgcttcgaccgcgacggcgacggcaaggtcggcctccacgagttccgcgccgagatgaaggaggtcatgctcgtcgtcgccaatggcctcggcttcctccccgtccagatggtcgtcgaggatggcagcttcctcaaggtggccgtcgacagggagctcgccaaggccgcctaattcaataacctagctagctaattaaccacattgaactagcccacgacgattaatttgagtactttgtttggtaaattttattgaatttggtgttaatttggatttgaactactgcattgttacaatcttacggagcactgctccctctgtttcatattataagtcgttgacttttttctgagtcaaatttatttaggtttaaccaaatttataaaaaaaatatattagcagtatctataacaccaagttaatttcactaaatacaacataaaatatatttcgataatatgtttgttttgtattagaaatattattatatttttctataaatttgattaaatttaaaaggtttgattctgaaaaaaatcgaagcaactacagtataaaatggagtaagtacttttgttatgaagaagaagaagaaagaaacagatcagtcgatcgatctatatatagttaaaattaagaggcattagggaatgatgattaatttaactgttcactgttgtatacatcgaggttcaagattaattaagtaaaagctgcagtaccttcacaaaattatactccttactccttagcatagagctgatcgatggagcgtataaaaatttaactttacatacagagaccaaattatatgcaataggattaatttgccgctgttccgttctgccaaactgcaggcagaaccatcgctgctgagaattgctttccttccttcgttcgttgtgcttcagatcctggacgggatgagcggcgtcgaattcgacaggtacgccgccgccgccgccacgccggagccgagcttcaccgggtagccgatgtccttgagcaccatctccactccactcagggcacccatcaattgcagctgcagagttatggagatcaatgagatgagtcagatgttgctgcaataattttcatctgcaaatcgatctgcagagttgtgtgtgtactgacctcgttgaggtggccgaggtggccgatcctgaacaccttgccggcgaccttgttgaggccgaggccgaggctgaggttgtaccgcttccaggcgtgcttcacgatctcggcgctgtcgatgtacggcggcacgacgacggcggtgacggtgtcgctgaaccactcctccttctgcgtgcagttcttgagcccccacgcctccacggccagcctatatatgcacatcacgccgtcagaatctcacgttcaaaagtttgaccgaatcttgttctaaacgtcaaaatgttcttcctcggtgaccgacctggtggcggtgccgaggcggttgtgcctcttgatgacgttctcgaggccttcctcgaagatgaggtcgagggcggtgcggaggccgtagaggagctggatggatggggtgtagggccagtaggtgcccatcttgtagaacttgaggtagtccttccagtcgaagaagacccgcaccgacttggccgtcttgctcgcctccagcgccttggggctcgcgcacacgatgcccagacccgtcggcagcgagagcgccttctgcgaacccgtcagcgccacgtccactccccactcatccatgcggaagtccaacgcacatatcgatgacaccccgtccaccagtagtagcgccgggtgcctgtgcttgtctgcgcgtatcgtcgtccatcgttgccatggatgagcatgagtaattcatcaagagaaagaagacaagaaagtgataaaaagctcaagatgttaccgaggattttgcggacggcggaaaggtcgttggtgactccagtggcggtctcgttgtggacgatgcagatggccttgatggagtgggaggggtcctggcggagcttgtagtcgagggcggcgaggtcggcgccgtagccccagtcgctctccaccacgtccacgttgaagttgaggcgttgctgctggtcgatccacagcaggctgaactgcccgatcaggaacgacacgatcttgtcccccggcgacagcgtgttcgtcagcgcgctctcccacgcccccgtccctgcaagcaagcaatcaatcaatcttcgggcgccaccatagataaaaggtgtaaatggttaacctacgatcccacttatagattaaaataaaccgtaaacccatttattgacctgtaagcgggtttgcgggttagccagttaaaacccttagctatggacgtggtcgatcgatgaagctaggtaggtaggttggttgggttaccggtggtggggaagaggaagggggtgccggtggtggtcttgaagatctgcttgacgtcctcgaggagggtcttggtgagggcgggcaccgccggcgagcggtagtcctcgttctgacggctcatggcgcggatcacctggtccgggatgttcaccggcccaggcacgaacaggtggttccgccccggcccatacacgtagtccgccatctccctgcccacacacacacacacaaaggcccatcaggcccaaacaaaaaataattattcgtcccacagcaataaaaactcctgcctaatataaccttctgaaagtgttctttgaaaaatgactagtgataatctcatcttactatcttagttgtactatatacggtttgttaattgttttgctctaattatccgactatataacatagcaaacatataattaatacatggctttagttagacataacagtacactactatctcgaaagaaaaacaaaggcaggagtacttgctagtactagttgtcactaataacgcagaagacgttatcaatttggacagtttcacttatccaaggaaaccattagtcctttcttccttttttttaattaaagaaacgactattagtgcgtgctctgatcctacttggcagattaactcgtgcttatccagaagaaatcaattcatgcggctactggctctctgttttgaaaattcaagttgctagctctagacaataacaaagcaaaatttctctgaacttagtctaagtttcaatttcttcttgcacatacaaaatccaaccatatggctaaactgaatttactcatacacctacgatcattgaagatctaatagaagacgctaatggagatggatgtgtgtaccttgttcagataaagcctcctcgatcttgtgctgatgattttttttttcgcacgtaatacgtgcgaaggaggaggcagggaggatggatagggtgctgaagaaggctatatagggagccatggtgtcctttcgtggggcccacacccgtccgacgtggcagataaggggccttgccggtgccttctgttcgtgaggccctcgtagctcgcctcatggagtggtgcttagctgctacttagctctgctctagctctagctgcagccatcactggcatagcatgctaacaaagcgcacggattttgacagtgtgtaacgactactcatacacagtaatctggcttcgtcaatcccatgtatatgtcctgtttatcgtcccaattttatcagatgtctgcttaatttccctgtatctgataaggtgttagctgcaccagaaattatttttcttttttcttttttgttgaaagctttgcatcagagataattagttaagcaagctgcagaggtgatcctactgtttgagtagaaattggagctagaaaggggagagaaataataataatccggtttcgctttgcttgctggctggctgaggcgatagagctgtatggcctgtgagttagtgagtgagtgagaaaaatgacaggtttggttgagtccaagcagagccaatctgcaagccaagggcgcaggagcgtccacgtcggatgttatcccctaccatctcgctttgcggtgtccgtggaaacccagcaattttttttccttctcccttcgtttttattttcagaggtgaggtcaagacaaaagatgatgttaaattgtatcgccatatgcttggagaaggttgagagggagaggatgacggcgaggccacaaacgaacagatgggaggaaggtgatagctagtgtaggtggaaatggaatcgagctgtaccaacgagattttatcgtgagaaaaatcgggtaattcactttttactttgatatttatcgctttcgtatgaactttctcctttaaaacctgaaaaaaaatcaggcgattcacttatacgctttgatgtttttcgcctttgtatgaactatgttgtgtctaggttggctttagcatgtccgttgatgcagtgacttgagtgaggctgtagctgtagctgaagccgagaaaagattgaattctgaaatatgaaccttttgctcgttattctgatgagttcacggtatctgttccatatgttacagaacctgggctgtgtatatccattgtggatgtagaggccgcattttaatctattttctaaagaaaatgttacataacctgaaaagtgggctactgggctttttttcttaattagacgcatagcgcatgttcagacatacgaagtctgaatactgatcatatgtactctcaaggaagaaccacatgcaagtgatacccaattgggtattaaagttgtgtttacagctaaaaggcttaaagaaagaaaagttcaatttttatgccagaacgaaaaaatggagactttcaaactgtagccttcaaaaataagccctcccaaccgggcatgaagtttctttcggttctatcggtcattcggttggctaagagttattaggggaagaaaaaaaaatttgtgtgtaaagacaatgttaaaaaagaaacacgttgacaatatcgtaaaaataattctaaagttaacttttcaaattcaaattttgggctgattcgttgtagagaaaaaaacaatgaggccctttctgtcttaaaactagtcctttctttcctcagcctctccatttggtaaccaagaaagctactacaacggtcggccagggagcaattcatagtctctgaattttgaacatggactaaaaaccttgctccccatgaacaaattcttcaccttcaaatcccaaccagcttccaagtttgtttcgttggaccccaaaaaggcagaaacaaatttcgtctccgacgggtccattttcgcaggaggaaacatctgcatttctttgtggctcaatgattgcgtcgacaaatcctacgcccaaattccagaactggtcaccttggaacatgcaaaaaaagagcaagggagagagaaagaaagaaagaaagaacgagaaagcaaaagggtggtatagtgcagagtgcagaggagaccgtggaccaagaagattctgcatgccatgcggatatacggatgttctccttttcctacatatagacaacgtattagcagcactatcactgcacatgaacaaatccatcaagaattgaaacaggatcaagaactgaatcaggatcatgccttgatcatgcaggattcaccggactgaaaaagatggatttttttttgaatgcgacttaacgaaaaactctctaacttttctttcaatgatggaaatggtttatatttctggtctctgctaacggtcacgcgtcgaagaaaacctctcaacatgactatgtttacatacttctattatgcttacttgcatacacatgattgcatgaagattcatatgaagaaacgcttgatttaggcacgaacacacttgcccatacaccatgattgcaaaccatccatggaaaaagatttagtgatcatttgagtaccccacgggaaaaacataagaatcacatgagacattttgacttgaatggaaattttccaaagagattagagctcttgctaaccctcttttaaaatctctatggaattgttcatttcatatgaatttcaaataagagatgtgattcaatcatttatttcaaaagcttccttagcattttgcctttgaaatccctgaaatttcgtatgtttttaccgggagtactgcaaatgaaaggggccgatttcagcagcaatgctgctggcctgctgcgcgcgcgcagcactgaaccgagcacacgcatcattatgatctcttctactacagatcaggagcacaacatcacaaatatattcagaactgataatccagcttctgctgctactatgatcaaaaggtgtttgtgctgttgttctactatgctcgcttggcatcggatgcctgccctgcggcccctgcctgcctctcgtcgcgagacagacaggcatgatggcgctgcaagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaat

SEQ ID NO: 55066 - DNA, 923 bp, Oryza sativa
accaaatgattcactttggtcctggttcttctatacctagctagcgtcagcaccgtgctcgtgccaagctctcctagggtcagctacttagcattgaaggcgcatacttatgatggaggtcaatctccctatctgggttcgtacttaagcttaggaacgaacaagagaaaagagagaaaaacttcccccattgctgtggagagggtgtttagtggtcaggtgggggtgtgagaagagcaagtttccgtgtacatccttggccaaggacatgagcgacctgcttctcgggctggcttggctttggcttggtgaaggtgtactgatcgatgtcggcagtgaggaggattttgtggagatcgtagtgggggacatagtagtattccccccaagggcattagctgtgtacttgggatgtcaccaagcccatggacaagctctaacttgaggtcatgcaaggcgacgggtggtttgcaggctgaaggttgagcacagtggtgtcaccgactagactcaagatcgagcatcggaatggtgccaaccggaactgacgacctcatcgacagtgcttggctttggccatatggagagaagagagccattagagggagagaagagagagatggagctggactgctggaggaagaacgggtccgagttgaaataattggcaaagacagatggtccaaagtgataatgtgtgtttaccccagtccaacttgcaaccatggtaaaaatatgtggcccaacatgcaatttactctttaaaaatagacccatagcttgccgccaaagacattggtatcgatgttatatgtatatacatgatagacgttggcaccaacatgtggttgccaagagtcacactggtgttgacatggctagaggttgcttcaagaagcctagcacagatggtcaaaggtgaa

SEQ ID NO: 55067 - DNA, 971 bp, Oryza sativa
ccagaaaacattttttcagcgtatccagatcttactctataaattctcactaataatctaaagctccttaaaacatccccatgaagtctagctatcgatatgatccaccgctatctccgactttaactatgacaaaatgcagatcaatggaacatatttggctaaaaaaaactcttaaaaagtgcaagtgtaaacactagtagatgctaccagcagctataggtcttaaaaattttcaaccccctaggtcgccaatttctcacattggcaggtaaacttttgcagtaagtaggtagccagcatcagatccaaaagtcaaaaccagcagctcaagaacacaggcagtatctcgtatatatggactaaacaaaggtgatgaagatagcgacgctaatgccgcgccttaattagtaattaatagtgatccacgtttcgtgctgcatattgctctaccctttgtatatttctcgtcatacgcttggtcggggagagtgtgaatcccgaggacggtaaattcttggattcgtgtccatttcttaaaatggattaattcctcgagcgatgttgccgtggcgctgtgaacggagcacacagcgctgtagccataggaattttacagaatttctacagtaactttgtaagagattgctggttaattttttccattataaaaattatccaatgtttctttttttttaacgactcgcacaagacggtgcgaagttcataaggagttaagggaagacgtttttttccatgcaagttagttgagtttccaaataattgattcatttacaatgaaaaacagacacatttaatgttatttgggaattcaaattagcaattcagttatttacatatgagtgcttaagtttttttcgtgggttcaaaggaagcatagataatatgatgatgtgttaggggtacatgacttcagtcatcagggttaacaactctgggctgcaggaatt

SEQ ID NO: 55068 - DNA, 1324 bp, Oryza sativa
ataggcatacatagatagattaatatatagccggtacgtagtatagttgtgcaataatgtcacctttagatgaacggcaccctctttttgtgaagggatcaccgtagcttccgtcgtggcagcggcaaacaaaagctcctggcgtatttatgcagagtccaccatagcatgagtatttttctggttccgcacactcgttaatatctagacaaataccacgggaaaaataaaattatcaattactctctctattaagaaatatttgatgtctaatgaactaaactaagttatatcaacgtcaaataaatttgcccagaagaagtataaattagtaagcatatataatggaaggacgggtagcaatgctggaaaattatgggacaatctattaaaaaaaatgaaagtaaaacttcattttattttatttacattacataatacaacggaattgaaactaaatagcttagtatcaaaattatgggttgccatgttggaaaattattatgcaactctacaaggccttgtctggcaggctatccccaacgatgggccgggatatatatggacttcgccaaacaagtgtcaattaaaacaaattaacaaaaaaaatctaattattaaatttctctatgaagctactctgcctgtctattacgtacttctctgtcaatagggagaggcataaagtaattgtagtttgatacgatgggagtatatatgcgtaccttgacatccattcagtatcgaagcgtttcccttgtatccatgatggcactggcaatcataccctcctcgtgtatttttgcagtcgccgtaacaggggtagatgtgtggagatttgcattcatcgatatctagacgaacagaacaaattaagttagattaaataagagaagggtagactaaaataagaacgcacttattaccactatgtcggccggtaagacagagggtatacgttattagactttttacagtaaaaatatgactaagtctttctactgtaataactctgtaagaaagtaataaatataaaacttaatgtaagttgatagcatccaccaatcaaggacaaaaccgatagcaaaggttagtcggttttcacttataaatagttaaagcctagtttgttcagttaatctcatctcacgaaaatagaaggagacttgttggaaatgattaattccacacttgctgaggtgtggaataaatccccggtcaatctattaacttattaaagtaacagggaaaaaaacctccacgttcgttctcatggtttagaatttctcatattaatcggaaaaaaaatagagtccatgtagaa

SEQ ID NO: 55069 - DNA, 1591 bp, Oryza sativa
agcagagccttgagcagcaaaccagatttaatttgctttactgatcagatgtgtttgtatatgttcaggttcagagacgtttacagctcaatcatggagtgtttggccgtttattatacggctctgaattttcactgtctcaaccacaagcttcaaactgtttcaaagaataacatgtcgaaataaaggatactgatctctctggtcacaaaaaaattgtgcccttttaatgttgcgaagatgttttcgtcactgatccatatcacaccgcattactattaagtttcaaccaaaatacaaattatcgagtagattgctaaaacggattatttgctccatgttttgggaaaaaataaaaaaaaagtcttctgttatattatttagaccacttgtatttaaattaattattgtttatttaccaaaatatttaatttatctccataactaaataaataatctttagtaatagtcagctcaatatttgttttgaattgagcttggtttggagtcaaatcaatatgtatgacctttgtgcatcaaatgtaaatattttaaaaaataatactcgaagtttttttaaaacgttttttttgggaggcaacgatcccattcattctccatgattgcaaccaactacaaaccagtcatgcacgctagcccattcagcccactacatatttgcatagccatttggctgaactccctacttctcaaggcatagctacttccgcattagctcggcttctcaatcctatatgtgtaccgatgtttgcactttgcagctcaatcttggagtgttcggttgtttatacagttttaaatttcaatgtttagatatcagccaaataacaacttgtggaaataaagtgaaactctctctggttataaaaaggcccaatcaatttaatttagacgttggtatggtatttaaaacatattttttcccactattttgtgtcagtattagcaagctttagtaaaatcataacattagtgtaaaagtaggtttcgtatcaaatcaatatcaatatgtgactttcgtatctactaaccattgggcattagcccattcaggcattcagctcagtacatatataatgctttcttgcatatttgactatctaaatcatgtgaatcctggtctaatggtggctaattttatagtggaattttagtaaagaaccaccttgcgataatgtttgcttttacctttttatccaacccaatcgatgcccaatatgcatttgcaccatttgctatccaccaccattctcttgctagtctcctaaaggcctatgccaatgtcaagcaccatgctaaaaaaggtgtctccaactgacttggcaactgtgtggcattgatcatgccttgagagctggacaagcaacaaaagaagcgagataaatgagtgaatagggaaacacatgtggtcattaataggatagaaaggcaagtatgtaaaaccactctccaacaatgaagaattgggtcagggcaaggtcaatagaagagtcagggccataactagaaatcagaggcccccggtgcgaatatacatattgggtcctaaaatttgaaagccatggtggcc

SEQ ID NO: 55070 - DNA, 6903 bp, Oryza sativa
attcctgcagccctcaacacaagaaacaaccttaattgcttcaagaatcatctaacccaaactcaatacaaaaatgtagtacctaaaaacaaaatggaggaagagttggcaggaacctttctgtcggagagggttctctaagaatggctgtcatttgcaccatccccttcttctatccctctcgcatactgaaatttgcaagagaacttttaaaatctcaaagaaaacttcagttgggttaaatattaacaccttcagaccaaacaaggatggaacatatgggaagcatggtaatcagattacacattgaaaacctgtgtgatctgaccagtttttactccctctttgatcgacttgacttcagccgattacaacaattccaagactaaagggtacaatggaccccctcccccccaccccaccccgctctgtcacacacacaaaaaaaaaaaaaacttggtgcatgcagcaaccagtatgcttccgcaagtcacaccagcaaacactgaggtttctaagtatcggcctatgcgcatgtcattgttggagcaaagtcacacaacaagcggtgagttgaacggcacaagatattttgtttcagtaacagcaccagacaagttatttatctcaattagtacgagtgaccttcatgccttgggaaaaaacaatgcaggcattctagaagcctcattacgtgcatgctgcgcagcaatccttgaggtagtactatgagttaagtgtactcgtcagggtttgtatgacttctaataagtggaacaccatcttctctccacacaattcggtcatcacatagggcagcaactgcctcaacataaacctgatgttcctgaaaaataaggttaataaatgagcaaaagaacgtgtatcatcaatttcagttgcagctaagtgaatatgtcatagccatgtatcatcaaagaaatcttagcggagcataagatatgttacctcatgaaggactcttgcagccaattgctctggagtatcattggctagcacaggtacaaccctttgggctagagtccttcctgtgtcatagtgctcatccacaaagtgcacagttggacccgaatacctgtgtatagttgacacttaacagttagagtacaaacaaagatcattctccaattaagttaataatcaagatttaattttcttctacaatgtgaggtatcagctcaaattgattgccaagatattgctttccatggaaatagcattgagtagatatgcaaactgcacagcagttgcttgtgatgggtgatagagagattgtgaagtacctggcccctgatgcgatgactgctttatgcaccttcaaaccataataacctttgcctccaaatgctgggagtagtgaagggtgaatattcaaaatggattttggatattcctgaactagctcaacaggtataagtttcaggtaaccagcaagtagaatgaagtctaccctgagttccctgtttcacataagaaattaaggatagattgagaatcttgagacctattgcaagtgaccaaaacaaatatccgcagtaggcaagccagtcttgtagaagaggatataagtgaagtgggaactacaaacaccgtaaaacatgcagtggctattcgtgaaaaaatcaacagtggtacattacagtatatcagctaggcaataacaaaatggaagctaatctgactgactgtgtgggcacactgtacaactgatgaagaacacactccaacaggttccggactaaacgtcaacccagagcataaaactgatatcaaagttcatctggcaaaacaaggtagtggcacacattcaataagtaaacactaaaatcatttaaatagttaccaattcatcttcgtttaaaatcatttaaacgctactcgcacacataagacagataaatggattagaaaacttttatcagcacacagcaatgtatcatgtatgcattttgcaaacaagactaaaggcaagtgtgaaaaatctcatatcgaccatttttttctacaaatccacttatctaaaacctaacagatgaactactaaagctagaacatcgaatgtcaaagcctgaaggtgagatcaaagcaaccaacccaacctcagagcattcaacaactcatcaatagaaaccccctctggagcagacttcgacttcgggaacacaaccaccggtatcccattacccctcgcatgctccgctcctccacagcctgcaagccacatcaaaaatccccaataaatcccaacaattccacccacatcgccacccaaagagctcaaggaagcaaagcatcgtcgtcatcgtcacctggtttatcggtaaccaacgcaaccacatcaccattcacctccccacccagagcggcgtcgtggatcgcccggaagttggatcccccaccggaaacgaacaccgcgagcctccttctctccaccccgacgcccccaacctcacgccccttcgccaccacccccaccgccaccgccgcgtaggctcgagcatccggatggggcgaccgctcgcagcggacagcgcgaggtcgcggctgggagacgaagcccacccgagcacttcgccgctcgtgctgctgcttaggcatcggattgggcgagcagcgcaggccggagccggtggaagcgacggccgcctccatcgcgagattcccccgcgcctcgcctacgcagtttgtcctgcgtaacccgatgaaccctagcgccgccgatggccgccggcgacgatcggaagggagagagtgtgtgttactgccgctacgcgtcgaaagcgagcggccgatgggatattgcgatgggacgcatgtgggccttctgctgttgttagacaccaagcccaccgaatttacagcccggaatttgttgggatcgaggttggaaaggcccaatacagaacaaaaagggcaaagatttaagatttgattttttaaaaaaaaatcagttcccaaacattagacctttggtgattaaatttggttttatatacttcagttccaaaattaacatctttgtgatgataatggaatacaccgtctagtcgagactttattcgtggatacggttggctggcatttgtgagcatctggaatcaatttctatcagagtccacacaaaagggaagatgtgtccattttgccaggtaatttatctatagtttgtatatttgatgagaaatcatgaagtgtgttgacagacagtatagaccattttggtgtttccatatacaaacaatcatcgtgtaggaagaccatactacatcatttgcctaagagcagcatatgagcatccccacaacagtaatgaaaatgatttacaggtatacagaagcaataggagattgcttggtgaaacaattcaggccatggaaacttcaagagaggcctttgcaagccacagcaagccaggatcgttccttttcaataccaagtaagtctctgcacgaccaatctcatccgagacgacatcctcacagaaaccaatcagttcaaggacctccattgcagctgttttcagggaggcgaaaaaaatgaggaagttagttacagttgatttttgaagacctgaagaaaaaaaaagaggggagtctataaagcaaatagatacctttgtagttcgccacactcctttggaactgtggattggactgcatatttgaaaaatgaggattagtaagtaagaatttttttagtggaccaattgaacctaataaaagagcataagaacagccaagcataccttacgcagtctcctgtacttgatatcatgtgggtgctctatcacattcttgatgatcttaaagagtgtttgaagagcagaagttgcctctgtaggtgttgcttgtgagcgaagcatttcaatggccttctgaaggcgtgcacagagggctgccactggttcttcgatcctctggagctcactgatgtttgaattagcagcatgatcatcaggatcaggctcagattttgacattgtcgagtttctgctctgttcagtctccacttccatcttgtttacacattcttctacaacagcttcgcatgtagtttcatcagacctgtcagttcccagcttcttattcagaatagcatttgaggaatcatcaggatcaggttcagaattctgaactgcgaagttacttcccaattcagtctctacttccatcttgtttacaggttcgggaataaatttgctagtaccattatcgtcaggatcaggttctccattctgcttcccatcaatcgtcaactcctggctaagaatatcaacatttgaggaatcatcagggtcaggttctaggcaaccagcagtgctttgctggtgaatatcatcagggtcaggctctgagtgactgatggtatcttgttctgtaaatgatctagaaactgaggaccaagatgccccagtccctacatccacgttcatgtcatcattatcatctgggtctggctccaccttagtgttgtcctgagaaaaatcttgaccaacatcatctggatcaggctcaaattttgtgttaggcacaagaatttcatttccaggtatagtaacgctgtctttagaactctctaaatccgctgatgcattcaaaaaacgcttataagcagcagacccagacaacacacgagcacttgccagtgaactggatcctcctccaagtttgtggccaacaacaacactgtctggctccagaacaaattcgtcttcataggaatcgaagattttgcgaccactcagcacatgacctcttgacttggtccagtccaaggaagctgcttcatcattcaactgaaattgacattgtattaaagaacagattaactcaaaaacataaagagacagtagccaatcatgaaaggattgtctaggaaaaaaaatcacctgcttattaagagcaaaaaaatttgcatcatgctcggagtgcaccatgtgtgcctgaaatcaccaagtgcaagtttaatatacaataggcatgattacagaggacaaacggaagatctgcataagaaatctccatttcatgaaagcagaaaaccaaggaggcatacaagttcatggagtagagttctcttgatactttcatatttcctaaatcctttcaagtcatcagttcgtaggcgaagggatatttcctctcccatgttctgtattaacaatgaggaagacatgatgatataacctcagaaattgttgtgtgacaagtatccatatgtgcagtagtaaaaagcttatacagttatactaaccttattgaagcctagaatgcattttggactgacgcctacataccctactggtgccatttcagtcatgattcccactcgccatctatgctgaaaaggccaacaggataactgtaaaataacgaatgtacacaaacataaaaaacagaaacaccacttgaaaatattgctaccttgttcatgatcgcaattatgcctgggtcacatgctagcatgtgcattcttttcagagcttctgaaggtgggggattcaactggcatcaaacaaaaggcacgtaagcaaaactcgatagttcaagatgttgtgattggcctatttgttatcatacaaatcaggtatatctgtttttctactagcatgcatgtattttttttacgaaagaatgaggtatatatgaaaataatgtctagtgttcaaatctaatgtactatatataatctatagcaagttacaggaatcatatactgatttcattacaattgtcatagtgaacccattcatttcatacatatactgatttcattataattattatagtgaagtcatgtcatgaaatgagaaggtgttaactatgataaataaaatgagcacaccacattgtttaacgttgtcttttcacaaagttttggacagaaaccagtgcaaactgcacaatggtccaattccttcaaactatttaatccacaatttatagtgtgcatactgttcaaatggaacacttcgtgcgctgcttgcatcctaattcaagcaggaaattgcaagagttcagacttcagaggaaaatgtgcgcgctaaggtttatgataatccgtgaggagacaaatgatatgtggagtatggaaggggcggattgacatgcctacatgaactgtttcttatagatttcagaaagcacgtagggagtagaggctaactaacctcaatcccaggtaagtgaagtgtccgaaaatcacagaagatgtattggccctgtggaagtttgagtggaacttggggcctgcctgatgttcgttgcctcagccgttgttcttcctcctcaaatccaattatccgtagatctgttcttttgccattgtccgatacttcctcgatttcatcattaaaaacacccatcattctaataggcttcccctgtagcaaacaatgattgaatataaattattccattctccattataatatccataacgtagcaacatattgctgagcaagtacaactcttgtgcatcttacatcactaatagcagcttctttcaatgtcaaaactgaatgagggtcggaaaacggtgtgatcagcttggagcctttgtttgtagactgcggaacaataagcttcaatgtctctgggttaacactagtcaaatcctgcaaaagttgcccgaattccttcaccgtacagctcgggtctgcatcgacatcgagctgtctgcctctccaagtgaccgaaatccgagctattctcttctcttccatcttattcctgataagaaaaaaaaacacgttatgccatcaaactaatttcatagtatgatgatgttataacagaagatcatagtggcacctaccaagaagttatcaacaagacagggaagaaaaaaaattactaccctatcttgctgggctgcaggaat

SEQ ID NO: 55071 - DNA, 3160 bp, Oryza sativa
tcgattcccaaccgagattggggcaggtggaattgaaggaggtcagcggcgtcgcaccactcgcccccctccctcaaaaaaatccttctcgtcggccgccgctccgcgatcacaccggtcgcaccgcagatcgggaggcagagaagcgcacggcgatggcggctgcgcactcgcgcacgcgcggcggtggaggaggaaggaagacgagcgaggcggctgcgccccactcgaggggagaggggaggagggattttttttttttttttttggcggaggcaagcgaatgttccagaaggcggcagcggccgtacggcactcggagggaagggacgacgattctatgcacggaggaaggtttataaacgccgtccgtctcctggtgattgcgtaatagctgacggctggacgttttagacttgggaaatatagctgacgccgtccatcttacccttcttttaccgcaatttgttttctctaataaattctaatactacgatgagtcgatgataagggtgcccatcggcatatctgcaaagaaaaagtcatttgtgaatacaacttttatatgcgtgtttttaacgaattaaaagtaaatgctaaaaataaactttgataaaaaaaaactttaaaatcaatttcaaatttaaaattgaaaatttaaattttgactaataagtactccctccatctcataatataagggattttgagtttttgctttcaatgtttaaccactcgttttattaaaaaaatttaaaattattatttattttatttgtgacttactttattatctacagtactttaagcataactttttgttttttatatttgtaaaataaatttaaataagacgaatggtcaagcattgtaagtaaaaactcaaaatatataagcttaaaatgaagccgcacatttggtttctgtgtagtattccaaaagtttcatatgtgtacagcatctttgctcatatactagtatttgatggttgagagtgttattgtttcttttattggataatgcagcctagttgtggcctacgaatataaatatatgatttgatgttcagtgttaaatttatcgcatgaaaaattacctttgtagcaaaatgtcacatatgctcaccaaataacgatttccacaattgtaggttgtgactgctgtgattattaacttgcaataccaggtgaattttgatggagtaatatgggtaacatatactcccttcgtcctataatataagagattttaagtttttgcttacactgtttgaccactcgtcttattcaaaaaatttgtgcaaatataaaaaatgaaaagttgcgcttaaagtactttggataataaagtaagtcaaaaaaaataaataataattccaaatttttttaaataagacgagtggtcaaacagtgcaagtaaaaactcaaaatcttatattatgggacggagggagtagtatagaacagcatagcgaggaaggcacttctactgcaaacagattcaagttgaaactgggagacatccagagaagatatattattaccgaggactttaatttgtaccccaagtatcatctttgttctggatatgtttagttgataccctcaaaattttggacaccaaacggtcctatccacatcattaaaccatacttaattccatgctttgtaatcccttgttttcttgattaatcttgcagcactccctccttcaccacacattggacagaaactaccatttttcacatcccaaagtggtgacactgatgatcatcaggattctagtaagtttgggctgactgaatctgaatgcaaagcagatgaaggaccaaacaaatctaacgacttgcgagacttgcagagccatggactggagagatgaagtgaccagcttcatttcgaaggaattacacaccacagttcccatattactaggtcaacgcccgagctgaccgatgacactaacaaagtacaacagaaaatttcaccattttactccctccattttagaataaggccctgtttaaatcctacacaaaaattttacaccatatcacatcaaacatttgaacacctacataaagtattaaacatagtcttagaaaaataactaattgcatagattgtaactaatttacgagacgaatcttttaagcctaattgctccattatttgataatgtggtgctacagtaaacatttgttaatgacatattaattatgcttaataaattcatctcgtggtttgctaacggattctgtaattagttttttattagtgtccaaataccacatgcgacaccctatataacatccgatatgacacgctaaagttttacacctctggatctaaacaccctcataaattaaccttttcacacgaatctacacatgctatgtttaattttatgtataaaaattagcttattttagaacaggcagagtatgtgctgtatatacctcatagatccatgtgtacatgataggcgtatatacttccattttgttgtacgaagttcctctcggaagtcggaacaagcttgacatcttgtgccctcttttctggcccttcagcctatggtccccgggattgattccgtcgccttgccaattgccaagcagtgaagcaaagcacaattccttgcccctttttttgtttccttttgcgtttgtgcaattctgcaagtccatacattgaaatataagtttttgttcatgaatttgaattgatatattaccacgtctgcattctgatctcgtttggttgtctgtgtccccgtgtgttgcaattggctaaattattttgttgatatgccaaaacatgtcctaccaaaatacttttagtagttgaatagtgcacatgtggttttggtttgcaaccaaatcattggcattgccaatttccaatttgatagtttctagattgtactaaatgtttggttccaaattagttttgctgaccaacgaacctaggccgtgttctttgcaatactattccaacttcaataactcatttgtcacacgcacatttctcaaactatcaaacgtaatttgtttctatgaagttttataaaaatattgttttaaaaatcatattaatatgtatatatatatatatatataagttttttaattgatacttaattaatcgtgtcaataggt

SEQ ID NO: 55072 - DNA, 10616 bp, Oryza sativa
agtactagcccatagagatgatggttttcttaatttaaaccgactccaagcctctccactcctccagaaccttccaaaatataaaaaccataaccaaccgactgacatgtgggcccgacgactcgtcaagtcgtccatctcccaactcccccgctggttcgagcccctggtagaacgttcgagaacccccatctcccccttatatatcgcccccttcttccccatctttctccaatcgaatcgcacacgccacgcgagctccctctcctaaagccctaaccctagcctccaagtcgtcgtcctccggaagcttccggcctccgccgccgccgcagcgccatggcctcggagacggagacgttcgccttccaggcggagatcaaccagctgctgtcgctcatcatcaacacgttctactccaacaaggagatcttcctccgcgagctcatctccaactcctccgatgtaagtgccctcggtttactggttcagatctgcacgcgcgcgcgttagaagggcttttttttggtccgattggtagatcggtttgttcacccaatctggttcgagctgactcgtgtgtgttgttatgtgtgtgggtgtgtgagggagtttgcactgcagcactggttactggttactgagacatcatcccaacataaatctgcgatgtggtgtttcactccccattttttaagattatgtttcgattccgacgttaattacgtttctcagtgtatcaatctgtggatcatgctcgcagtacttaattttgttagtgtaataatctgtggatcatgcggtccttaattttgttaagagtcctgaattttgctgctgattagaatgttataaacataactgcaggcataggcagcattatctgtcgttgttctgctaattaatctcgtagcattatttacgattgctctgataaagtcgcatctgaaaagtctcacatgctttgagtgttgatgtttaaatgttgtaaaacatatcccctataaacatagagggttgttattttgctagttatcatttatttgtcatttattttgctagttatgtcacattctaaattgataggagggtttgaccatatataagacaaaaacacccgactagtgctttattttgctgattcattgttaaaattgcctctatgaaacaaaaacacccaaccagtgctttactttgctgattcattgttaaaattgaccctatggaacaaaaacacccaaccagtgctttactctgctgattcattgttaaaattgcccctatgaactgaggattggtctggttctctatcctgccaaaaatgtggtaaatcctgaaatctttggagttgctaaatttgggcagggtagagatgtcccatttggtgtcaagattgagctgtgagaatagatggggatagctgaacttttggtgtggaaacattattaaattattgtcggatagtgaattggaattgctagctgctttcatacaaaaccggccacttatcttatgcttttgtgttctgcaggcgttggacaagatcaggttcgagagcttgacggacaagagcaagctggatgctcagccagagctgttcatccatattgttcctgacaaggcctccaacacactgtcgatcattgacagtggtattggtatgaccaagtcagatcttgtgaacaacctgggtaccattgccaggtcagggactaaggagtttatggaggcactggctgctggtgctgatgtgtccatgattggtcagttcggtgttggattctactctgcctaccttgttgccgagagagtagttgtgaccaccaagcacaacgatgacgagcagtatgtgtgggagtctcaggctggtgggtccttcactgtcacacgtgacacatctggggagcagcttgggaggggtactaagatcaccctctacctcaaggatgatcaggtactaacagaatttcattgaattcttgttcaatttgtgctgcttgtattgctgaatgcccttatagttcatgaatgtggcttgctattgataaatgcatcaactagtaattctgtcctcgtaggattattacgaatattgttggtacttgattttatagccacttttagaaagaacatgttgatgtgcctcaagttttcaccataggcatgcttgagccaggtgcttaatcggtctgtttaagacataaaaaatgtctctatgtaggggcatttggtgaattgattgaacagaatgaacatatttcacacactgttgacattgtgataatctagatagatgccttaacatttcgaactcctgctgtgaaaattatgttagtatgtttctgccttggatgttatgagtaatcatgttacacatgtacttaggatctataagcttattgttgagctcataaactgattgtgtatgcattttttttctttgggtctggttttgtgtcagtttgattgcgtgtggttgtctaatacttcctccgtttcacaatgtaagtcattctagcatttcccatattcatagtgatattaatgagtttagacatatctctctatctagattcattaacattaatatgaatataggaaatgttaaaatgacttacattgtgaaacggagggagtactatgaattaattagtaacaagtattactgttctactgttgtgaatttttagaatcacctgaactcctaagttgaactgtgaaatgtgctataaggtgtcctggctctaatgtgttcatttgttattgacaacttgctcatgcttcctgcagttggaataccttgaagagcgccgcctcaaggacctgatcaagaagcactctgagtttatcagctaccctatctctctatggactgagaagaccactgagaaggaaatttctgatgatgaagatgaggaagagaagaaggatgctgaggagggcaaggttgaggatgttgatgaagagaaggaagaaaaggagaagaaaaagaagaagatcaaggaggtttctcatgagtggtccctggtcaacaaacagaagcctatctggatgaggaagcctgaggagatcactaaggaggagtatgctgctttctacaagtccctgacaaacgactgggaggagcatcttgctgtcaagcacttctctgtggagggtcagctggaattcaaagctgttctctttgttcccaagagggcaccattcgacctctttgatacgaggaagaagctcaacaacatcaagctctacgtccgccgagtcttcatcatggacaactgtgaggagctgatccctgagtggctgagctttgtcaagggcattgttgactccgaggatcttcccctcaacatctcccgtgagatgctgcagcagaacaagattctcaaggtcatcaggaagaaccttgtcaagaagtgcgttgagctcttcttcgagattgctgagaacaaggaagactacaacaagttctatgaagccttctccaagaacctcaagctcggtatccacgaggactccaccaacagaaacaagattgccgagctcctgaggtaccactccaccaagagcggcgatgagctgaccagcctcaaggattacgtgacgaggatgaaggaaggccagaacgacatatactacatcaccggcgagagcaagaaggccgtggagaactcccccttcttggagaagctgaagaagaagggttacgaggtcctctacatggttgatgccatcgacgagtatgctgttggccagctcaaggagtttgagggcaagaagctcgtctctgccaccaaggagggactcaagcttgatgagagcgaggacgagaagaagcggaaggaggagctcaaggagaaattcgagggtctctgcaaggtcatcaaggaggtgctcggagacaaggtcgagaaggtggtggtctcggaccgtgtggtggactccccgtgctgcctcgtcaccggcgagtatggctggacggccaacatggagaggatcatgaaggcccaggcgctgagggactcgagcatggccgggtacatgtcgagcaagaagacgatggagatcaacccggagaacgccatcatggaggagctccgcaagcgcgccgacgccgacaagaacgacaagtccgtcaaggacctcgtcttgctcctcttcgagacggccctcctcacctccggcttcagcctcgacgaccccaacaccttcggcagcaggatccaccgcatgctcaagctcggcctgagcatcgacgaggacgagacggcggaggccgacaccgacatgccgccgctcgaggacgacgccggcgagagcaagatggaggaggtcgactaagcgggtttccttttttttcccctcgtcaaatccttcgcagcgaaagtacaccatggagcattggagctagcttatctgttttaccttttgaacatcgcgttgttgggtcggttcggtttattttgtgcgatttgctttacctttacctagcctgcaatgcatggggctagattgtgctatgggttctcgaactgcgtacgttaattatattgctaaatatgagtattatattagtgtcctcatgagttgtctattttttcctctgcaagttagatgtatcaattaattttgcgaatattcttctgcctcaattccaccttcgagcaccagctttgcaatttacagttacagaaacatatgattgcgtagtgtgaatgggagatcttgtcacgctgatcaaattgatcaacagcaacgggaggagttccttgcagcgaatgcccttggcaatttatactgtgctttgttggtggtttgctcgctctggtgtttgttggcgattgcccgttggcgtccaatccttgcagctgatttctttggtatccttggagcacctgatgaaaatttcttcagctcacgataacaattaaatatatctgttttctgttagcaataacaatcaactttttcttcagagcaaacaatcgactgtttcttcagagcagctcactccggattacctgacaaaaacacaattaggactagtaggtacctgacaaaaaccaaaaaacaacataacactcggtcctcgttcatattcacatcagctaaattttatacttcctcttcatcatattataaatcacatagtagaaaaaacatagtagcatctataacacaaaataaacatatcattacaattattcaatgttagatttaatgaaactatttttccataaaattggttaaatttaaaaagcttgactagaaaaaaaatcaaaacaaattacaatatgaaacagagagtaacaaacactgctaacagacgagtctcgaagaccatgaagtgggattatgtctacgcttatgcacgtatagcatattgtcattggatcttctataagggtcaaggaaacacgaccgctgaaaaaattctgatgatttaaataagttttgcctatgttttgatgctcaaggaaattgatggtcaaggaaacaagaccaactgaataaattctgatgaattttaagttttggcctgtaaagacagatgctgtgacataatccatctttggcgttatggcaatttcaatcagctctgaagcataacgagcatagtattttgctatctggggcttatgagttgtgatgttctaaccacatttccgataacttgtaagcattaagcaatatacccaccagtgccaccacttccattgctcaaaagcgtaaagtcaatatcaggcttctgcaagaatcttaaacctatcgtgtccatttcctgatgccagacctctgcacaacttgcctcgcctccagaacatcgaaccatttaccagcagcagcataaatgtcagaaatcaaaacatggcagccagactgctgggcgttgagattgaggctatggatctcactctgaactctttcagccacatcaaatctcttgtgcattcgacaggcacccagtagagcgccgaaaaccatgacatcgggtgccatcggcatgctccggatcaactcctctgcctcttcaagaagccctgctcggcctaacatgtcaaccatgcaaccatagtgcttcacctccggctgcactccgcaggtagacgccatgctctggaagcaccgtcgaccttcatccaccagcccaccgtgggaacaagctgtgagcacaccgacaaacgttatgtcgttcggcttttcacccgttctcttcatctgttcgaatgcgtctacggaatcccgagcattgccgttcattgccaacctggtgatgagcgcgttccaggccgagacgttctttcggtccagggagttgaaaattttgacagcaatgtcagttctcccgcacttggcatacatgtcaataagagcagcaccaagattgtactcgttgttgagcaccattttgtgcttgtcgatgaaggcatggacccatcttccttcttccagtgctgttaaatttgcgcatgctgaaagcacactcaccatggtcacctcattcggctgtacattgctctcagtctgcattgcgcgaaacagctcaagggtatcctgatagcgtccagcctgagcataccctgaaatcatgcatgtccaggaaaccacatccttctctggcatgacatcgaacaactccctcgcgccatccatgtcgctgttcactgaataaccccggagcattgcattccatgacaccagattcctgactggcatctcatcgaacatcttcctcgctaacggcagcagcccgtggcgcgcgaatcctgtcaccatggagttccatgtcacgacattcctcccaatagctggcatccgatcgaacatctcccttgccacatccagctccccggccgcggcatagccccccaccatggtgctccaggacaccccattcctccgtggcatttcgtcgaacaccctcttggcactctccatctccccgcacttcacgtagccaccgatcaccgtgttccacgacaccacgtccgcgaccccggcgcacgacccgaacacctcccgcatcgacgccgcgtcccggagcgcgccgtacatcgcgaggagcgcgttgacgacgaagacatccgccaagaacccgcgccggacggcctgcgcgtgcacctgcgcgcccgtgcgcgggaaggccgggagcttacccgccgaaccgaggaggggcggcaaggtgaacctgtcagggacgagcccgcaccggaggagggaggagaaggcggcgaaggagaggcgcggggacgcggaggaggcggaggcgcggatgaggatgttgtggaggaaggtggcggaggaggaggggaagagcgggaaatggacggcgcacagggcggcggcgaggtgggggtgggaagggaggagcgggacgatgcggcggaggtgggcggggctccggcggaggtcgccggagacgacgaggcggccgaggaggagcgggaggaggtgaggcggcggcgccatttttatcttctttttttttttctcgccgcgtggaggggagaaggctttatttgaatatttgaaagcttgtgattaacgtgagccgttggatgcgcatcggatggctgagatcagataaagctggagaaaaagaaacatttatcactagctactggtttttctatactactgtatgagtggaaaattgtacacattttatgtgcagaactttcattagtacagagttaggcttatcctaagtcaaacctatttaaatttgatcatgtttatatgaaaatatggtaacatctacaatatcaaattagtttcattaaatcatcaatatatatatatatatatatatatatatatatatatatatatatatatatatatatatatatataaatttgatcatgtttatatgaaaatatggtaacatctacaatatcaaattagtttcattaaatcatcattatatatatatatatatagtaaatttgtttggtgctccatggtgcccgggcaccattgttgaaattgagtatatacctaattcaaatgggtatatatatagggtttttttaaatgatgctatatttttctataaacatgatcaatcttgaaaatatttgacttggtacaaagctaaaatggctttttagtatgatgaaacggaggaagtacattgcaagtcaacagcactattttaaaagaaaaacattaacacaatgtatatatctaagtaaactgcggctcatctggaagacgaggtattcagggagggatgtgcatgatagaaagcagagaatctgaatgctttgcactagagattcatgtcattttgtctactatcaaatttaacaatgaatgcactccacctgacttcgaaccagaacccaaaacaaaagagaacattttatttactatgttagctagatgttcataagccatgctccaatttctatgttcagctatccttgttctcagctgccaatcttcaaagcttgattgcctttgatttttacatttgccacgctagccagtgcgctcagaggctctgaatccaccatagttgatttcttgacaggatcaacaaggtcaagcctcttctgcagcttcctccttttgtatgtgaaagggtacctatgaccttcttcaacttctgtaactgactggctggcaggagtcttcagcttcaatccttctgggtaacgcattgtttcagactgctccaataggtgtttgtaagggccagcggtgtctgtaccaagggtcaacacctcagaaatactttcagcagttttcagaccatgcgtcatgtatccatttgtttgatgacaatcagtattccttgtaaatggatcaggagaactttcaggaattacggcattttgttgaccaaagttcttcaaaaggttcttctcgtggggtgcttcattgcaatattccggactatgtttggttgttgactgatggaaggaattcggcattcgagaatagtaaccccttttaagctcctctggaaccataatttgcactccaaacggactttcaactgagtgagggtaagtatcaagtgtgccttctctttggtagggacgcacatgtagatttctcaaagtactcttgcttgtgtttatgtggtagtaataagctgaattcatcgcaaaaccatgaacatccagtgcagaagcgcaaggtaagctggagacctgtattcccagttggtctgctagcatcggttctggtgtacgatgaattccttcattgtgatcaatgagggaagcacaatcggtctttattttcagcacacctttgggcaatctaatacatgtagtaagctcaccaggaacatgaaagacaggactcttcaatgagctcatttccattgatttgtctctgtagactattcccttgcgcttggctgaacaatgagtggttactgtcccatccatacgtttggttcgcttcaaaggtggaagggttgcatctttaacctcattggcaattgatagacttctattgaaaggagaaccgcttatgtcaacacctgtgaggggatcttcatgtcttctgtcattccaactgttaaccttaccctgaagaccagtactcgccccacatcgtcctcctaccttgtccatggatgcaaacttgaaaatcatgccatcatgatgggacttcagaaaatgataatatcttcgtctttcaaagatcatcagtaattctctagcctgggaaacttctggagaataaaacccaccattcaatctgtggaagaagctcttcactggactcccaaagaacaggtcactgccactaaacagctccttcattgttacaaagaaatcatgttggtccatgtctgggagataggctgctagacggaatctatcatcttctgttagacataagttccatgtctccaaagaaagaatatcattcaattcaggcaaatcataaagcccataagggacactacagatctgatctccagactttgcaagctcacaattgacctcttcatgttcatagtcatcggattcatgaataggaaatctctgaagcagcattttctcctcttgtgtaatgtcctcgtctccacagctgtaagcccgctcttctgtaggcgcacaacttgctaccttcacaatgcccattgatcgaaggaagaggtgcaatgctccgatcggtatcagagataatcatagagacgaaagtcaacagtgtgtccagcacaataccatactatccgacggaagatccctgtgaagaaaaaggaaaagaaaaacaaggaatatcagcatcacaattcatctataattcaatttgaagaccatatttcatgacctcatgcaccaagtaggctggaaggaaatacattgcagagccaagcctaaataattcctggaaatagaatgctatactggcctttatttgtttaaaacattgggtgtcatctcaatttccatttagcagcacagagatatactggttgttggtaagcactagtatgttacaacttataactgggagggcagcattgtctagtccagtaaccaaactgattacacataaatcagaaatgcttccgcttgcgaatagcaccaccatatagacatcatgtctgacagtctgagacaagctaaaaatgctaggcattc

SEQ ID NO: 55073 - DNA, 1625 bp, Oryza sativa
tacggcctcagtcctctcctcaccatctctctctctctctctctctttttttgctcagtgctctcacaagtcaaggttacggccgcttttttttttctagctagttgtgggcagttctcaggactgttaaatttctttttggcccgtggatcccgtgctaagatttgtgctgagatattttgctattggatctaaaccattttttcacaaactagtggcactagccagtttcaccattgcatgtttatggtagatttatttaagtttttaggaaaaaagggttcttacccagtttacccaaaaaactgtccaaaaattgattaaaccaatgactttcggtcaacgccaagctaaaataattgatctgttttcacaaaccgttcgccggcgatttcataaaaaaacgagcggttttcgcaaaaaaacaattgatattgtgagccctggcccggtcaatgatagttctttttttttacctcataatattcgttttgaaaaatacgatggcctatattaaatctaggactttggctcagatagatgggttccaccataaagaaacaaatcggtcgaactttaaattttgagagtttgaactagtggtaccaatatagttagcacatgattacaaactttgcatgtaaaattcggttttaccatgtgcagctgtggcgtgaaactcatttttgtaagaaatgcatatctttgtttctcttggccattccacgtgatcccatgtgttttcgattgtttttctacatcaagggtaacctttgttcagtaacatgtaatatattggatcttggagagcaaaatcaatttactctaagagctaattgaagcaatccaagataacttcgtagcaaatcaaagttatttaagaaagaagtggagacaattttatagcaaatagaagttatttcaagagcaaatcttagaactgattgttatttctcgatgaaaaactaaacatggaaagatatatgcactagtaattcaaataagagcatgtacattaaccgacagtagtacaatcacctctcctttagtgataagttagagaacggagattaagaaaataagtagaaatgattagtcactagttatacacgtgctcaatagaaaaaagaatgcaaggtaacaatgcagctaacaggtatgctttaaagatagttgcttactcttctcaaggccgtacatccatatgtataaagcgtaaatctaaaagacgtgaatattagagaaggacctaatatcaaataattagaaggggtgaggcttcgaacctaggttgtctagttcatcaccttgtggagctagccggaagaccctggacgtttttcgtgtaaagcgtaaatctgttcaaggtcttcaaaatttagggctcccaaatctataagtactagtactaattagttatccaatctaataaacactattgcaagtatgaaaaagcccaacaagctattctagcatccatgataaagtccaaacaacaagctaaattctctcattacctcgtttgatcaaaccaacatgcaccgcacactgcacttactcgccttcttggctcctctgattcccatcaccactacaaatttaccccttttttcaaacaattaacg

SEQ ID NO: 55074 - DNA, 2220 bp, Oryza sativa
cgaaaaataatgaataataaaacatttatatacatgttgcttaacaatctaaaaacaaaaggctgaaaaataaacttcaataagaaaacctcaaaataaacttcaaatttaagaatgaaaattcaaaattttggctgataagtataagcataagtaaaaaataagactgcaagctccaccaatcagttatgggggataaagagggtacgatgaatttaaatccagctgacccctcaggtacaagcaagtagtagatgagcacacattttcctttcgttaatttaatgttttatagtacgctagcattgacttgacctctcctagtgcaacttgatcttcaaattgaacactgatcgacgtcgacgccttaactaagctaacagtgaacaaactcaatgcacactttagtggttacgatggaccggacgtcgacgaatgaacatccggtgtgcacattgccagctggtacgtactggctcaatcatctcaatcgcatataaaaggtagttataagtagcactttgtaagcaggtttgaggcacactgcgaagaatcaaagatggagaaacatgcagtagcattagcagcattcacttttctagccgcccccctgctgcagctgctgttgtttgtcgcggggaacggcagcagctgcaccaccagctgcggcaacgtgagcttcgagtacccgttcggcgtggaggccgggtgctaccacccggggttcgatctcacctgcaaccactcgtacagccgcccaggctgttcctgggccaagaaagcagcaccatgcatcaggtgctcgagatctccatccccaacggcaccgtgcgcatcaacagcagccgcatggtgtttgcgtctgccgttttagagaacagcaccaccatgcggtgggaggtgggtaaatcctacttcctgtcggatttaaacattatagcgttggtaggatgcaacgccaggtctccctccgcgattggggcgatacactcgtcaactcctgcatcacgtcgtgccctctatcactcgactccggtaatggctcctgctcaggaattggctgctgtgaggcaagcattgctatgcacataccggtctacagcattagcgccaaccaagtggtggacccgggtgcaggacctgaccctaatgaaccaaattttttcgtgtacatagtagatcaggcgtcgttttatttcgacaccaacatggttactaagggcatcagcaatactcctgaagcgctcccagccatgttaaactggcttatactcagcaattcatcagcgtgctcggcatcgaccaatgcttctgcaccttcgtctgcccccgaatgttgcagcgccaacagcttctgcaaaggttacaacggtactactgctgactacgatgggtatcggtgctactgctccgatggctatgaaggaaatccttatgttgatggtggatgccgcggtaagtatgtagtactacctccgtttcagattataagactttttagcattgtctatattcaatagatgttaataaatctagacacacatatatgtctacattcattaacatatatatgaatgtgggtaatgttagaaagtcttataatatgaaacgaaggaagtacataatatgctctagactcttctttcaatattttttttatttgtaattgtatttcaatattaactctaaactcatcatttaatatttcttattttataattttgaattttatttattctaaattgtatttctatatcaactttatactatttttccaatatttcttattttacttatatctagattgtatttatatatcgactccatactatttttccaatatttcttattttacttatatctaaattgtatttctatatgcactttaaagtctaaaatacaattttaattttattatattttattctgaatttcagttagttctaaatttctatatggactttatactattcttcaatattccttttttaaaaattttgattttttttttgttatttctaaattgtatttctatatggactctacccctttgcctttaattttcttttttttaattccaaattttagttggttcaaaattgtatacaatatggactctagacacctctttcaatatactccctctattttaatatatgacgtagttgacttttttttatgatacgttaacaattctttttttagaaaaagttgtgtaat

SEQ ID NO: 55075 - DNA, 2036 bp, Oryza sativa
caggtttgaccattggtctaatagtcagcggtggttcagtccttctacttctagggcttgctgctcccttcatagttcgcaaggtcaagctacaaagggtaaagaaaatgagggataaattctttatgcaaaaccatgggttattattacaacagttaatatcacgaaacacagacttcgccgaaagaatgatcattaccttacaagagcttgagattgctacaaacaattttgacaaatctcgtgaggttggtactggaggacatggggtcgtgtataaagggattatagatctacatgttgtggccatcaagaaatcaaagattgttgtgcaaagagaaatagatgaattcataaatgaagtcgcaattctttcccaagtgaaccatagaaatgtggtaaagctcctcggatgttgccttgagacagaagttccattattagtttatgagttcatttcaaatggaaccctttaccatcatcttcatgttgaaggatctatatcattaccttgggatgatagattaaggatagctcttgaagttgctagagctctttcatatctgcattcatcggcatcaatgccaatattttatagagatattaaatcttccaatatacttcttgatgacaacctaacagcaaaggtatccgactttagagcttcaagatatatctcaatcaatgaaacaggaataactactgcagttcaaggaacgattggctacttggatcctatgtactattatacgggacgacttacgagcaagagtgatgtttttagttttggtgttcttcttatggagctacttactcgaaagaaacccatcggtggtacatttgataatggcgatggtcttgtttcacatgttatctcacttctctcaaaaggtaatctttataatataatagattctcaagttaaagaagaggaagatggagaagtcctagaagtggcaacactagccacaacatgtactaagtttaaaggagaagagcggcctacgatgagagaagtagagatggcactggaaagcatagtttcaaagaaaagctccttctgtaacaagaacagtcaatcaagtagtagatccgatgaaaatcgaattttagctctttacatgtcgatcgaaggagttaccaaggacaaaacagttacaattacagaaagcagcacggaaggggaaataccattgtcgtcaaggttttctcgataatcattctctgtcctgaacgagaacgccttgcaagaaagccggaaacttagttacatcgatcctgttttgttctaaatgattgctaaagtaattttgctgtcaaacaataataatgcaacagaaaaattgtgtcgtatcagaactttgaagtacttgtggtttagttcatgttgattaagcatctgattcgatcagtttgctctaatggactgaaattgcagagtgccgtttgtgttttcattattcattgaattattctgctagcggctgcagagcccatcggctctgtaggcgttcatttttacagtttatctatcgcacccgcgaagaaagataatttcgttctttcttatagaataaaaagggaaaaaactcacttctacttattttttttaacatggatggaatgaaaactatgtcctatcaccctcgaagcggtgaaaataatgcttcggcccgagtgtccgaggctccggacgcctctccgctcggcccatttctctctagaaagtcgagtcctccatcttccctttaccattttttctccgctccatctccggagaattttcagaatttgccatccaatacgcactatctttaggatatgccatccaattcgtactacttttaaaatatgtcactgggacgtgaattttcttcactctatgccactccgtccgatgtcagtcctcgtcgtcgttcgtccgtctgctgccgctcgcatccccttctatccgtcggtgccccctcccctcccctcgggtccattcgccggcgctggccccgtctcgccgtccatcctccggcaccgcccgcgtc

SEQ ID NO: 55076 - DNA, 2580 bp, Oryza sativa
cacatctggtaacgcccatatacaaaatggatgtgtttcaagcaaacttaaattttcaggtaacagaaagaaagttcagtcaatgtctgagggtactgttcattactatgtttcttgttgagatcaatttaacggagtaaacgatttaaaatttacattttcttacaaatccaggactcatcattggaataggacttggtggcagtctaatcatcgtggtactaattcttactggaattgtcgtaaggcgaaagttcaagtctcgaagggccaaaaaactgaaggaattcttcttcaagcaaaaccgaggattgttgcttcatcaacttgtagacaaggatatcgctgaaaggatgatcttcagcttagaagagcttgagaaggcgacaaacaattttgacgagtctcgaaagcttggtggtggtggccatggaaccgtctataaagggattttgtctgaccaacgtgttgttgctatcaagaagtcaagatatgctattaagagagaaattgatggatttattaacgaggttgccatactttcccaagtaaatcacaggaatgtagtgaagctttttggatgttgtcttgagacagaagttccattgttagtctatgagttcattccaaatggaacacttcatgaatatcttcatgtcaactctgcacaatcagtcccatggaaggaacggctgaggatagcacttgaaatagctaggtctcttgcttatctacattcagctgcttcggtatcaatcatccacagagatatcaagaccaccaacattctacttgatgataggttcatagcaaaagtatccgacttcggagcttctcgaggtatcccaattgatcaaaatattgtaactactactatccagggaacttttggatacttagatccagagtactaccgtaaaagccgacttacggagaaaagtgatgtatacagctttggtgtcatacttgcggagctaataacacgaagaaggccaacttcctacatatcaccagaaggcttcaatctaaccgaacaatttatcttgctagttagtgaggacaggctcttggaaatagtagacagtcaaatcactaaggagcagggagaagaagaagccagagaagtggcagaaattgctgttatgtgcttaaacttaaagggtgaagacaggccgacaatgcggcaggttgaggtgaaacttgaagggttgcagggtgctgtaaacactatcagaggtcgacgtgcagttcagttgaattctccattgactgaagagagcgattccaacatcgttgctgttggtgacgctggttatcacaactcaagcaggcggctcagtatggaggaggaattctggtcatctatgagctttcctcgttgaccatcttgtttctcatccagctcataagattttttgttttgttggtctttttttaagtttctcttggaacatctgcaattgcaaggaacttccaagctgtatcagtaggatcctccacaactcgtgcgatttcaacaaaacttgagaacttggcacttccctgcagtcctgtactgttcgtgtaataacttatacttcctccgtcccaaaaaaataaatctaatacggaatgtggcacattctagcactacgaagaaaaagattactagctttttaggagtagttcaaacgaaacaacatgtttgcctccctttgatccttgcagttatcaccatagatctgccaaactgatatgttctatgccgaacagttaactgaacttacaatggatattcagttatacattgtcagtgcaccaacacaaggtgactgaatagtaattcattagtaactaagttcagatcgccttatgagtccgatgtgtttatcattcctacaaggacagattcagacgatgattctagtggcagtgaaacatgcaggatatgaagagtggaactggtgcagattgtagagagaactgatcaagctaggtacgctcctgttaatcatgatatattatgaaaagaaacagaagagatcagaagggaactttttcttgtagagtatgcaatcttgctgatcaatttacagggatcactgatgtatctactgttgtaaagaacatgtgcaacaatggaaattcagaactattgctttcttagcgaaaaaagataagaaagatatgtctgacatgcaagaattctgatttctggaggtgttgcactgctctgaaaagtgcagaataccagtatatgactataagaattttgtagctgtctttgcctcaacaatatcaagtgctttgttgaggtaaacagtttcagaatagctttgttccttctagaaaaaaaaaatcccatgaaatgtttttcatgtctgctcaaggaaatgacagggaaaggtggaaaagaaaatgaatcactcctgcattttctaaacctgaatctcagccagataatttccatccaacggatgagacgagcaaaccaggggttcggagaacaattcaccgaccccaaccaaagataccccctacccatcagcacagccgccggtgaagttgccggcacttgtgtccatcttgaaatccaaaatt

SEQ ID NO: 55077 - DNA, 1924 bp, Oryza sativa
tcagtggtagtagcgtcccacatgtcagtggcagctactacatatacagtactgcagacaatccccactgcaagcacgcacatacgcaagcatgcaaaatcgatcgatcgatcgatattaggtcgtcgccgacgatgacaggacactcccggtcgattggccgcgaccgtttgtcaatggaatatctctctttctttctttctttctcgacgagtccaatcacatcatgattcatgcatggccatcaacggcgtgcgtgcgatcgagccgatgcatgcgggcgcttgccggccgcggcggcgacggcgatgcgacaggccggatcgatcgctggtgttgctcgctttttcttccctttccggcgaggtcgatcgacaacgacgacatgaatgaatgattcgtgagtcaaatgtacggtggacgaccatgcaccaatcagcccggctagtgctagtgctagtgctatccccacacgaccactctctcgagttcccctagatagatcctgtttcttttttcttttcctgattcatggacgttttccatcctctttggttatgaaaatgcgccgttttagatattggcacggtctcaacatatatttaattttaacatgtcatttttaattttttatgtatctgtacagctcggaaatacaattttaactcctatcgtaaatatttgcacatataactggaagagcttacgatattaaaagaatgcgtgtttttttttcattttaaaagtttgactttagagatagtatgttttcatggtcataaccagactagcatagtacttcctccttccaaaaatctgagacctattttattctttggtttctctaaaaatctgagtcatatttggagtcactatgtgctaaattaaattgttgaccagaaaccaagaagccattttagtacttattggttgcatgttcattatttttgccacatggtgagtgagttaattgcttcttggttttgatgaaaaagaaataggtatcagatttttggaaggaatgagtagcatataatattatggtgatgtttaaaaaaccaccattatatctctattaatttaaagcccattcgctgctccccatatatatattagcacccaaccattgtcttcaccaaaaaaaaccaagcaattgattaataaaaaaaactggctgtattagttgctttcctcactcccagcccatttctaattatacaggcccgttgtaacatatcagtaagttactcgtattaattagtattaaaggcataaattaattttcctgttatgagtgcgtcttgttaaattaacatgtggtataattggaagaggttgtactgtacatggtgtttcatcataggtttgtagaatctcttgttaaataatacagcaatcatgtggagaaaatgtgtacttttgggtgcatatagtacaattagtactaagcaagatttgtccatcgcatactagctgtcggctgcgcatctctgccttcatttctcagtcaaatagctaatcatttggggaaagtagatttgttggaagcaaagaagccttttcttttatttcttctccttttatgcctgcctaatttcactggcctgaaagtgaagtcagttgtcatacggagtgacatgacaatagatagatttatttgaaggacttgaggtaggtagatgaaagaaagcctttgtttccatcctcccctattcagcatgaccgaggttccatcgcgatttttgacattatggtcctcatataaaacttattttataaaatatgctctaaaaactaatttagaaatgagtaaattgcgtattagatccccttatgagaccattgtggtagcctgaaccagggtaaagcaacattttcatattggactggttatatttaccaaatgattcgggctgcaggaatt

SEQ ID NO: 55078 - DNA, 1247 bp, Oryza sativa
aaatggtgcgcgtgacgaacggccggtcggaggcattgtaatcgaagagatcttggacgagctgtgaatccggctgatgttgccaggcacatttcatgtgtgataccggcttcaagggcaacaacatccttaaatataatgaacgggtgggttcgaaaggtagggtttttggatggccctaccactaggctggctgccttctttcggatgggaagcaggccgggcctgatgggcgagctgttggaaatttggtcataattcgacatattttaattcaaaataacaagataataaatatgatatttacaatgggatttgatccagtgatagtggtgaatgtaatcaacatgagcatgcttaatgtagaataagcatcaacaatcacataataacataatgttgacattgggatgaacattaacagtaaaacttctaattgaaatattgtaagaatgttataccccaagaattgtcctccgctggagtttgaggcagtattgcctccgttggtgttgacgggagcctccttctccttgtatccagtgttgccgttgtctccagtgttcgacatattggtgaaggtgaagtagatgttgacgaacagtgagtagtcgcgccttgcactccccaaaaacctgatcgcccgcccgtccgtgcaaacgtcgcagcagcgcgtggtttcggaggcctactctcccaaagcgtgtgcacacactcgtcgggatgggattaccgtagcaacaacaacattggaaaatggatgaaagtgtgtctgactgttctcgcgggagatcaaatccattctcattttataagaggaatggaagatgaagagtaagagtcatggaataggaagaggaatagagcaactaattgtcatcaactagccatgaaccatcctccactacacaaccatcaaccaacaatcaattaggagtaattgatgtaagttaccaatggaataggaagaggaatagagcaactaattgtcatcaactagccatgaaccatcctccactacacaaccatcaaccatccatcaattaggactaattgatataagttatcaattccctaatcaaatggattaattctcaaaactcttcatcccattgatatcccataaaagaatgaatacacatgaattcctagcataatgagccttggaatttatttgatttaattgatttaatggatcaattacccaattaaatctaacacgggcatctcttgctacgcaagctagc

SEQ ID NO: 55079 - DNA, 2058 bp, Oryza sativa
acatgaactaaatcacaagtaaagagttctgacacgacgatttttttattttgtgtaattattgttttattatagcaaaagaactttagcatcatttagaacagacatgatcgatttattagctaagttaccggttttcttgcaagtcgttctccttcagaacatagaatgattatctagaaaaccttgacgacaatagtatttcctcttccgtgctactttctgtaattgttttgtatatcattggtaactccttcaattgacatgtaaagagctgaaatttgattttcatcgcatctgctacttgatcgaatattctctttattggaggggcctttctttgaaactatgttttcgagtaccatctctacttccctcatcgtaggccgctcttctcctttaaatttagtacatgttgcggctagtgttgctacttcctggacttctccatcttcctcttccctaacttgagaatctattatgtcataaaggttaccttttgagacaagtgagacgaaatgtgaaacaagaccatcgccattatcaaatgtaccaccaattggtttcttccgagtaagtaactccataagaagaacaccaaagctaaaaacatcactcttactcgtaagtcatccagtataatagtacatgagatccaagtagctaattgttccttgaacggcagtagttattcccatttcatttatcgagatataccttgaagctacaaagtcagatacctttgctgttaggctgtcatcaagaagtatattcgaatatttaatatctctgtgaaatattggcattgatgcagctgaatgtagatatgaaagagctctaacaacttcaaaagctatccttaatcgatcatcccaaggtaatgatgatgacaccgtgccttcaatatggagatgatgttaaagggttacatttgaaatgaactcataaactaacaatggaacttctgtctcaaggcaacatccgaggagttttaccacatttctgtggttcacttgggaaagaattgcaacctcatttatgaattcatctatttctctttggtgtggcttgtaggttgtggaggagcggagcatgcgaggggtaatgggataccggtggttgtgttccctaattcgaagtctactccagaggggatttctactgatgagctgttgaatgctctgaggttggttgctttgatctcaccttcaggctttggcattcgatttctagtagctttgtagctcatctgttaggtaggtgttaaaataagtggatttgcagaaacaatggtagacacaaggcacacaacatctgagatttttcacacttgccttaagtcttgtttgaaaaatgcatacatgatacattgttgtgttgtttgctgataaaagttttctaatccattcacctgtcttatgtgtgcgggtactgttgttcgaagccgtcaaatgaagatgaattgataactattttaaagattttagtgtctacttattgaatgtgtgtcactaccttgttttgccagatgaactttgatatcagttttatgctctgggttgacgtttagtcaggaacctattggagtgtgttcttcatcagttgtacggtgtgcccactcagtcagtcagattagtttccattttgttattgcctagctgatatactgtaatgtaccactgttgatttttttcacgaatagccactgcatgttttatggtgtttgtagatttacttatatcctcttctacaagactggctcgcctactgcggagatttgttttggttacttgcaataggtctcaatattcggatcaatctatccttatttcttatgtgaaatagggaactcagggtagacttcattatacttgctggttacgtgaaacttataccggttgagctagttcaggaatatccaaaatccattttgaatattcacccttcactactcccagcatttggaggcaaaggttattatggtttgaaggtgcataaagcagccatctcatcaggggccaggtacttcgcaatttctctatcacccatcacaagcaa

SEQ ID NO: 55080 - DNA, 711 bp, Oryza sativa
acttttttttgtctaactttaagtatggctgatatgtaaaccgtttagagggtatatatatcagtgaccaatgttgcgtggattgagatggaaattaactggttgtttttgtggctgttcctttgtccatccgtcgaccgatcgtccgtgtgtccgtgagaggttgagatggagatgggccagatggctgcgagctgcctgccggtggtgtcggctagtggtgccttcgtttcagtttcatttcaccgtgttcggaacttagggctcttttgtaacaaagaaaaaaataaagaaaatttaggggattaaaattctttggaacacattaattcctatagggtccttttcgagaaaagaaatgtccctctcgaaattgtttaaaattcctatcgaatagcttattttatagaaattttaaagaaaatttatcaggaagatacgtagatcttattgtttctcttctcctttctcaaaattcccatgttctccgatagtgctattgaccacattccaaaatataaatgatttaccggctttcttttttctttttctgttttgtacagttttcatatttttgtacattgtttctctctctattcaatgaaattggcatattctaagtgcatgtttgttaaaattttatctatatagtacgaaacatttattttagaaaacaaacttgtggattcattttctgtaggattcaatgag

SEQ ID NO: 55081 - DNA, 4420 bp, Oryza sativa
agggccatcaaaacactcactgttgtcactgagacaccgaaaagcactcaacttcttagcttccacgcacgatgagttacccagcatccagttaccacagtccggacacccacattccttgcagcatccggcgccccagcgatggcacccagccttgacaggacctcttgctgcagcagcatggcattgtctgccctcctccaccactcccccttcaccaccaccatgctcgcgttgaacggcaccgcccttggactagactgcagggagagaagcttgatcgtgtaggagttgtggtcttcaaccaccgatgcgttgcagcagccaatgccatagcatgtgccatccgttgccagtatggggtaacctgggcggcaattcgaaacgcagttgctgctgctagtagcattgtctcctgctgctgcaggagaactacctatgaagaagtggaaaccacaacccagggtgatgaaaacattcatgtctgccgatacccggaagagtttgtcatccaagtcgaggatccatttctggttgtagctgtctccccccaacatttgggtgatgccggtatcaaggtgcagaactctacgtgccagctttatcttgtgaacttcatatccagggccgttcatgaagagcttggggggatcataagctgggtcgcacactagtttgaagccctcgcggaagcaccgttcgtcgccaataccgaatgggtaaggtatggttgtgtttccgcatgtgtcagtgcaaccaggcaatgctatgttatatgaaagtatcaggggtattgctgctagaaactgcagcaagtgcagtgtggctatggcaaaaacatgcattttactgacatgaataggtgccctgatcagtgtggcttggtggtttggacttaggacacagttcatgtcacatatataggccttgacaaagcatttgcaggaactggtcttttgctaccttggaaaatttcttcaccggttatatattacactataaagatgttatcagattgcaccgataattgttgcgtatcaaatcagggtggttatatgtcactttatcaaccttaaaggacaggacggcaggtttaaaaagagtcaatctaggacatgaaaggaaccacaatacattggaaatttcatttcttttgagttttgcagtttggagctccccaaaaaacaaacctgaagaaagctcagacatatttatctacttctgtatccaaccacagaaggcaagacatgtccagtcaaactgctgacctcattagattgcagaaaattagattaattacattgaagtgttgaacatacgttaaaatggaaaatgaacggcagtgacaaggacggtccggccggcaggccaaacatgattaggaaacttgaaaacaatttccacccgttcaaacttcagatacgcatcaccattatgaactattttttgaacacaacatcgccatgatgaacttttgtttaccacaacatcaccattgtgaactagatttatagggtttgattctcaaacagacaaattttgcaacaaaaaaaaaaggagggagaagaagatgtcaaaatgtcatggcgtgaacagatcgaacggttaaatttaacaggtattgcacttcgtaggtatgtataatgcagaatcacctaggaattttacattagtaagattttacccaactatgccacagtggtactactaaaacctaacctaaatgcaacaatcacttagagcatgtacaatagcagactataaaccagctgcaaccatatacttcctccatcctaaaatgtttgacgccgttgacttttttaaaaatatttgaccgttcgtcttattcaaaaaatttaagtaattattaattctttttttatcatttgatttattgttaaatatacttttatgtatacatatagttttacacattttacaaaagtttttgaataagataaatggtcaaacatgtttaaaaaagtcaacggcgtggagggagtatatttttaggagataaatgaagaccaggaacggaaccgcggcgcggcggcgtgcatgggcggctccgatggaaccggtggccgctccggccgcgggctccggctcagccccacctgctacgcggaaacggaaacagcggcggcggggggagccatgagccatcgaggggaacgacgctcacaggggcgctgtcgcggttgcggacgttgaagcgagcggcggcggcgtagattccgtcggcgggggaatcgaatcgggcggaggtgccatgccgagcgccggctggttgtgcgccgacggcgtcacgatcggatcggcgcctccgccaacttcggtgtgactccgcgctctccatcgattttaaccaaggtttcgtaatcatccccccttgtatttaccatagcatgagcaatttgagcagccatcgactttgtgaactacctttgcatctagatttatttactcttccaactgaaacacaagtcaagattcctactcatagtcatcgaaagcatgcaaaagattaaatctacttttatagttttatttatttataatgtaacgaccacgtggttgaatgatgcaaatgccccttaatttttatcttgctactagctgttgttaattcttattttgaattggagtcctgtcgctttctctgaaaaatggggagtgctgtgctgtcctatttgggttgttagctgcagggaaaggaaggttgttcaacttaatcaaatcgtgttgatagtgcccgaattcctcgtagtttcatttggtaggttggatgcataagggtagagtagtggttaattagcttggggaatggagactacaagaagctcaagtgccatctgcctagtcagtggagattgagagagcatcagttcaacatatggagaggttcgcaagtatgagagttgtgttttcgctatctgtacttgcagttctgctgctacagctgctgttgggtgtaccaacggcggcagcagctaattgcagcacccactgtggcaacatcggaatctcctatccatttggagtagagcctggctgctaccacgagggcttcaacctcacctgcgatcgctcgcacaagccgcccaagctgttccttggtgatggctccgttgaagtgctcgagatctcgattcctagtggcacggtgcgcatcaacagcagcagtatcgttccagtatcaacatcaagtgctgttggaactggcagtgtcaacaagacagggaaataccacacatggggtggactgagaaagggcggcccgttcttcatctcgccgtacaagaacaagttcctggttctatcatgcagcaatgttcaagttcttcttcttggaggcgataattccactgtcaatgcctgtgctacttactgccctccagcccccaagaaaggccaaccttttcagttcccaatgcgcaacgagtgttctggtattggctgctgcagtgcggccatccccaaaggctacacatcctatagcatccagatccaacctgccaatgaaatttcagagtttgatgcagagtcctctgtgtacatagctgaggaggggtcctataatgccacacgccttatctttgaaactgtcagtgcactcccagctttgctggactgggctattagcaattcgacatgtggtacgaagccatctgcagcccctgcacctgcatgccgcagcagtaacagctattgtcaaaactatacaagctatgtctacaatggctatcagtgtcgctgcaatgctggttatcaaggcaacccttacattccaaacggatgccaaggtaaacaagtcaattcaacctgcttttattttctttaagtcatacaaagttaaaatggaaatcagttgaaaacagctcggtgcttcgataagtatacatctatgtggctattttcccagtctaattacatgcttcttcattatttggttagacattgacgaatgttcacactggaaactccactcatgctatggtacctgcgtaaatatgcccggaacatttcattgccgctgtcctgatgggacttacggcaatcccttgatggaagggggatgcatcaagataaagaattcctctcaaggtgacaatcactccctaattaccttgtactcatgccatcaactctatatgtagattttttttagtaatgagactggtggtaatggcatctacatagctggcagttggtatccagtaattgatatttttttgaaaggaatgttcagtagtttttattaattctctgccaattaaacatgtctgttgctctgttctatcttcattacctgagtgcaaataattgcgcattccagttgtttttcgtttgtttctctgaagaactgttttattcattttacatgagctcttcaattatttgtttcacagggctgcag

SEQ ID NO: 55082 - DNA, 2300 bp, Oryza sativa
ttgtggccatcaagaaatcaaagatagtagtacaacgagaaattgaccaattcataaatgaggttgcagttctttcccaaatcaaccatagaaatgtagtgaagctcctaggatgctgccttgagacagaagttccattgttggtttatgagtttgtttcaaatggaacactttatgatcatcttcatgttgaagggccaatgtcagttccgtgggatgaccgactaaggattgcacttgaagttgctagagctgttgcgtatctgcattcagctagttctatgccaatattccatagagatattaaatcttccaatatacttcttgatgatagcttgacagcaaaggtgtcagactttggagcttcaaggtacattccaatcgatcaaacaggagtgacaacagctgttcagggaacatttggatatttagatccaatgtactattacactggaaggctaactgacaggagtgatgtttttagttttggtgttcttctcgtggaattgcttactagaaagaagccgtttgtacacacctctagcaacggcgatgctcttgttttacattttgtttcactacatacagaaaacaacttggtcgacatattagatcctcaagtcatggaagagggagatggagaagtccaagaagtagctgcactagcagcaacgtgtattaaattgaagggagatgaccggcctacaatgagagaagtggagatggcacttgaaaatatacgagttaagaagaagcatgctacacttggtacaacatcaaatagatgtgatggggaccaaattgtatgtgattatttgtcgactagaggaatcactgacgaatcaacaagacaatacactatggaagaggaaatattgtcgtctggtacctatcctcgatgatgtttgtctttggcctgaactagaattgctgtttgttatatgtacaacgtttgtaaagcatgtcagtagtgcaagaagtgatcttgctttattgttttggaaatgaagaattgtttctatcccgtcataaacaattcccgaaatcttttcgttggcagcgaatgtctggctcagttgaattcatacattctagataaatcaatgcatgtaaacataacaatggaaggcaattatatatttttctctatgctctgactgaaacgtatagagttattccttaccgagaaatatcatattcacacaagtcctcacgtatatacactgtgcacaccaatttataaatattaccgaaaaatatagaaaaaatgtacatgtactttcaataatattacatctacgtgtaaagtcacatcttcaaattcatcctacttagaaactaccaaaaagataaatttctaatggattaatagcctcaaaacttaaattctattttttttgttacatctaagatataaggaatttaaggttaagattttacatgtaggaataatactattaaaagtatatacacaatttttactatatttttcggtaatatttatttgttggtgcgtacatgaaacttatatgcatatgatatgataaaatagcacatcacagatgaaagaaggctgaaaaaattaagataaaagtgtaataaaaaagataataggaggagaggaaggttagagaaataaaaaatagagagaaaagagaggtaatattatgatttttggccttatcaaaatacaatggattttttttgctaggatggttcttcataaaaaaatgcaaaatgtaataggttgcataaaaaattaactgtgtttcttttttgtcctatacggcttgaaaatgaaaaaaagcatagcaacaaaaatttaatttaaataagtggttcaaattaaaaacatgtataatttgtaaaaatcaaaccatccataatcatccatagattactatcataatttgattatgtccttagaaatactttaagttgtttgaatgtaggattttttttacgaatttttcagccttttttaatttgtaatgtagtatctcttctacactgccttatatctgttttataggttttatattctagattctatttttagttattttttccgcacacgcctattgccacatttcggccaagccatcggtccacgcacacaccctttcgccttatgttctcccttgtgaaacagtggaagcaccagcgaatgtaggtcatatgtttcaacgacccttaatatacaagagttcaccgataaatttaaaactattatttgtttgagtttaaatttttgtgaaaacgttgtgcagatttcatcaaatttatgtaaatttgattta

SEQ ID NO: 55083 - DNA, 2626 bp, Oryza sativa
  unsure (1)..(2626): unsure at all n locations
ttgcaggaattgtgtagtaacaggacggtcatcgtgcagtaacaagacaactttctcacagtaacaacgttaaaaagtagtcatgatggatctagtttcgttaagcgtttttttatgaacatcatggtgcaaacggattagaaaaacaagatatgatgtgagagatattgctctataaagattgagatttacctctttttagttcttgtctcactggaacagcgtagtaacacgatggccaatgtatagtaacacgactgcttttcgcagtaccgacattaaaaagtagttacgatggttctagttttgttaagaattttttttacgaacgccatgatgcaaacgggttagaaaaataaggcatggcatttacgttactgctatctaaagattgagatttaaaatattttagctctacaaaaaaattactacaatagtgccacccgttactctacatgttctctgttactgtaaatttcgtcatgttgttactgccaacattatagtaacaacctataaattttgtagtaacaaactataaattttgcagtaacgtatcatgttactacctttctgtgataatattactgccgaatcacagtaataaggtatgattcttgcagtaacataactgatttgttatcacacaatttaaacagacatacaaagcatgcaaacaatattttctattcacataacattagacggtgaattgcttagaaaagcttgccatgaaccatgagatcatgggttcaagtcttagtttcaccaatttatttttttctaaaaaaagaaaagaataggaggaaaaataagagatgtgagggagagaaaatggttggcagagagagatcgagagggggagggaatacgggaggggggatcggagggagggaagagagatcgagagggggagggggggaggagggtgcgccgggagtgagggagggagggatgggctggacctaggaggtgggaagggatgtagaatagttattctagggggaggtgtagaatagagctgtactatgtagggtatgtataaggtgtagaatagagctgtactatgtagggtatgtatatataggccctctttgtttaggcttaggcttattggcctaaacttttaagtcagtttattggcttatatgatttataagtcaatggatttaatgtcctaaatttagtggtggagtcatacatctatctcatataagccaaaaaagcttctctaatatagcttttggcttaacagtgttagagtggcttagtggcttcaaaaaagccaaataaaaaagctgcttgtttgttttggcttagacttttcgacttataagttggcttataagtctaaacaaagagggccatactctctctctctctctgttttttttatttgacgcaccagttcaatctcaaagcgttttttttatttgacgccagcagttcagtcccacctcttctgcacacgaatttccattcttgccccccacagatgcctcattctcctttcgacttcagcgggtggcgatggcgtctagggactcactccatcgctccaccgccaccgccgacctcctcctcggcgacgcgcactgggaccgcttccaggaggccgtcctcgagctcaggcatgacgtcaccgaggcgcaggcggtgctgcggaggggcaacgccgcaaggcgaggctcgcggccgccgtcaggtcccaatgctgggccgaaggagctctgccgcctcgcctccgccactgcggctgccaccaagcacttgtcgccgcgcctcagctttggctccatcgccgaggaaatcgagatggccgccgcggcatccattgctgtgttcatgacaaccatgttcatgttgtggccatggcatcctcatgcaagaagacgccagcatttgtggcctttgcatagaaggcctcgccagagacgcggaggtatctcttgacaagtttgaggagttggatcaatgcatcgatgagtccaagagcagctacccaaggtgttcagtagtgttcttcagacggaatggaagcattgtattcttacaagaagattttcttccaacccacagatgattggagttgcttcttactgatgattggagtatcagattatcagtanatcacattatactggcaatttgagtaaattgaaatattgtgacttggaagaaatttaagatgagatgagagattttaacagtatcgcctttaaaggcaacaaatggaattttgcaattccatcatcatagagaaaagaaaggagtacatgtcattctcagacacatcccacattccatcattccagcatctttacaactcatgcataaaaatagagtttttactccagcaaaaatatctcaaatcattcttaaagtggagtttgcccaaattgagttctgaaacatgaatggccttttaattcttcttcttctggccacattggaaggaattcactgtcatcttagacagttatatcatgatgacaaagcataattttactaagattgttcaaccataatttggttataccacctgaactatgagcaggcgaataaaagcaagaagatgcagaggccatcaatcacgtcgtcatattgcatgaaaagtcaacagcca

SEQ ID NO: 55084 - DNA, 8399 bp, Oryza sativa
ccttgccctgcttgatggctgtgtcgctgccgtcgtcagcctgctgtgtagcagttggagagtgctggtggagtgatagtccgccgccggactcatccgaggtgccaccggcagtgctcgtctcgccgccggcgcgcgtggaggaaacaccgtagcgcaaaggagataagaacgaagggcaaaagagtcaatttgcagcttccttaatttcctcaatcgtgtcggaaacatcaaataaaaaaacggagtatataatgaaaaataatgtgataatgtgaatgaaaatgattggatgttgattttgtaaaattcaatgaattatagatgatattgcaagcttgcataagttttgtatgtaattattgctagtggatgatgaggtggcatgtttgcatgttgagttttagaattagttatttataactttacagtaagatacgatacaggaatatgataggaatccaagtgtaaaatagatgattaaaaaacacaggaattttatatggataattgtttggatggatcaagggaaaaacatgggaatcttataataaaagcgagtgcaatgtaacatagcgtcacaaacagtgaagtaagcaatatcaatgaacactttgcttttatcatgctttgattggttgcttggcttgattttcctttttcccacgcgaagggatagaaaaaagaggttggtcgcagattgttctttttcctgtgatcttctagtgaacaatctttttcctgtgatcttctagtgaaatcgctaatataggaaaatttcctatgtatttcctatgaccgattccagtaatccgaacgatgctaaagtggcttaatctcgatccatacgaaaatgcttctcctcgaacgttcggactgaacaagaaaaatcgggcgggctgactctaacacacgtccttttaagcctacacacatatacctttaacgatatttaaaacaatttttctcgtaaattacttatccaatctacaatccgatcacaccattgtattcgttttacaataagatatcgcatgattatattctgattaaaattaatcatatgtttcaatccattaacactctttgtttcatacgcgatagtgatatgttttaatatatctcttcagcatgtttcacaaatttcgtgaaactacatttcactactctctcctctctctccacctcatacatgcacgcatgtatgcattttaacgagcttcaaaacaatttgtctcataaactaattatccaatatatgatccgatcacaccgttatatttgttgtaattaaatatttacaacaagatatcacataattatattttgatgaaagaaaaacatatgtttcaatccgttaacactagttgttttatatgtgatagcgatatgtttcaacgtgtatcttcatcatatttcataaaatttttaaatgtttcagttgctgattttttgtttcaccatatataatttgatgtttcactcattggtcaactagaacatttgacaaaccaattttctttaggacttgggacgtcggataggaagattcctcatgattgaggagtgaagaatgaagtgcaacaacatgcacatacacaatcgagctgggcgttcgatatttggtgatatattggacgtccgagccgtagtgctctcgcaatccataggaactgaaatccttcattttttcccttcatttaatctgaacgatgctgaagtggctcattcggattgagccctgaatgttttttcatgtcgagaattgtgttcttcttggtatgctagcatatcagcacataaatgtgagagagggcaataaaatcatttgaaaaataaactaacggtcaatttatgaaatgggtaagatgagatcgaaatgaaaaccaagtggatgcaaggaataagataaaatttagtggtatataagaaattgagaaaaactcaaggacacgaaagaaaattttcccttttcataatgctacgctgcaaggttggggaaaaatggaagcatcaagcatgccatgctagagccgtggtcattgatctaacgtgtttgcaaggatatataggacacttcagattgaccattttaaatcatatctttctttttataaaattgataaatatgtggatgtatttagtttattgtcaaacattggtaatagctagagatttgttttagaagaacagtacctttctttttataaaattgataaaaatgtggatgtatttagtttattaccaaacattggtaatacctagagatattttttagaaatacagcataaacggagtcaccactggcgcctcgctatcgatgaatacgtcgtctatcaccgaaagaataattaaccgtaatgcgagcatccgtgtcaaatttagaatttgatcctgtgtgggttggttccaccacaagtaacttaactagttgagctccgctcacttgcaaaatacctagagattttttttttttgcaataacacatttaacctatcatacaaaacaagataatgttgtcaacctatcaaaattttgtcattaccaaattttgaaaattttattttggcagtaatgtaaacagacccgtagcctacccatagcctcacgctgcatgtttttgtaaagttttttttaaaatattaaagtaaattgatttttgaaatgggaagaaagtggttaattattgtgctgttgaggtcaaccggaaaatataggagaatggtttacctcaaagggtaacatctctactgacaaaccatttcaatagtacgggtgctgccgtgccatgaaggcacgaagtatctggcttacccgattatctttgtgtttgcaatcctatgttcccaacccctctctctctctctcttcgcgcgtacgtttttcaaattgctaaacggtgtattttttaaaaaactttctatacgaaagttgcttaaaaaatcaaattaatctatttttttaaaaaatagcaaatacttaattaatcacacgctaatggaccgctccgtttttcgtgatcactgttccggatgggaaccgcttctagcgaacacagccgaatcctgactatttagtgaacaagtgcacgaagaagatgcacatgtagcttgttcatgttcaaaagagtataagcgtgcgtacacatgtgtaccttagaaatacgcgccaagtatgccgaccataagtaaggctgacactgatgtacgttgactcgatcagtcgatctcccctaaatgcaagctcgatggagtataattcaaacacggatgcttaattgatctcttcaaatgcacgtgacctccaacttgaacaccaacttactacggtggaaatatatattacatataatctaatagttattttttcagatttgttgtcatttagttgacataatagacaagaggaccgtttaaaaagaataagtgagtggactcccaatccgatgactaaaataattttccaacactaagccagatcctatcatctgtgacgggctctaaccctcacctttgatggatttggtcttggtcactgattagtggtcactgatgactacatctcatctcaaacgggtgaaagcccgtcaatgatgattggcacctttgacggaccgaataaaataaactcacacatgatgagtgaatcttttcagcccatcaaaggtaataaacacctctgacaggttcaactcaccacccgtcacaggtgtggaaaatcaacaaaaaaaaatttaaagccctcagcctctagctctcagctctcagctctcagccctcaggccatatctcatgacatgaagaacatctcaagatctcatgacacaataactttgcattttattgacagatatgttgacacatgaagcacatccacacaagtaatatacatcacaaatccacacaactttgagtaataaactacaaatccacagaagcaaccatgagtataacccaatctgaaatttggaaatgaaaatttgcacaacctataagagctggaaatggcggcggagctagtgggtgaaggagacggtggacgacgccggcggtcaggggtagaggccgccggatccaacggttggcggtgcggtggaggaggctgccgctggatcgggcaagcggcggtggggtggcggaggaggaggcgactggtggtcgggggagaggcgccagatctgcgtcccccaaacgtgttgaggctggcggtcgttaggcaagaaaggcggcggcggctggcgatcgggacacggaggaggaagtggccgacggtgaggggagaggccgcggtggccggatccgtgccgctgtggtcatatccggcggccaacggtcggaaggcggtggaggcggcgccggccggtggtcgggagacggaggaggaagcggccatcggtggggggagaggccgtggtggtcggatccacgccctataggccagatccggcggccggcggtcgaaagacgggggaggcagcgccggctggcggtcgggaggcgaaggaggaagcggccggcggtggggggagagcccgtggtggccggatccgtgccccgtaggccagatccgacggctggcggtcagaaggcggctgagggaggcggcgcccgacggcggtcgagaagcggaggaggatgcggccggtggtggccgctactcgcgcgtggagttgaaggccgccaccggacccggtgttcggcgcgtgcaagcttggtgcgtgcggaggaggatgaaagaaagaaaaacgagagagagagagagagagagagagagagagagagagagagagagagggggatggataaggaagaactaagaaacgagagatgagtggtctcggactgtcggtgggtgatagataaggattgggttgggtggtttccacctgtgacggaaaaaaaaagaggacccgttagaaatggtttcataacatctttgacgggctggatctgtatggcccgttacaggtatctagtcacctgtgacgggccgtagccggatgccttaccgatggcggcatcccgtagaacctgtcaaaggtgatcctcatcactgaccaacacttatgcccatcacaggtatgtcgtcaaaggttgaggatatggcgtagtgcaagacgctttacgtgtattatttagtactaccttcatcccaaattaattgtaattctaagttatttaacatatattaagctttgaaaaacccttattgaatggtttgtaggtaagaatgaaagggtaaaatagaaagaaatttagatgagaagtgatttatgagatcgtgttgatgcaaaaaaaaacacacactggcctaagagatttgctttactctagtgcaggttctaaatttgctttcgggtttagagcgtgccagttggtttgatcctgcaaccaacaagaaaaaaagaaaccaaagttaaatctataaacgatagccgatcggctggattgccgatgacgtttcgtcagatatcaagccgatgcaatataacttggatcggcaataaagtatatagtagataaagaactaaattcactttatcggctgcagatattaacaatgtataatctatacttcaaaatatgtttaaactacgtgatcagggtagatcggatgttgccgagacagtataaataacatatgtttaaaagtacttcaaggtaaagattaaataagttcatgtcagccaataggtaaatctagcgtgtgttggctattgctccaatacttctttatactaagatattattatagattaaatatattaaacaagaatgataacctaagtagatcaatatcaagcgtaatatatttcaccttagtgagatcttaatataaagggtagatttagcatatcaagtaaatataagtgaagaacaagatagctaaaccgggtaagataggctgaaactccgatgctatctctgttagcaatcatgaagcaagttagatattatggttctagatattacttaatagatcaaacttaactgatgcagcattaagcataaagagaaacataagatctgatcaacaaaccaatgaaagccttttcgagatggtggatatactatataatctaacccgacagagttatctaattctatcggctgatctcgatgatggaggctagtcgacaagaccagatagtaatgtcaatctagattatatagcatatatgataactcgacgatttacataaacaagattagagtgtcataaagatgtaagcactaatcccgagaacgcaagtcgccataacaagctttacctctcgtcagagatcgtaaccgatgcagcccaactcgaaagcaagaactcgtcgaaacaatgaaagtagaaaaaggtggcgatgcgccgaaagtgttgttgaactggtgttaatcgtttacaaggtgtcgggcacatatttatacccaaaatatacaatatgtccacatcgaacacgactccacttctattacaactctaaaatacgaacaagtactttaggcagactcttaccgaaaatctatgaagaaactactagaatatcctaattaatagatacaattgccttcttcggactcaatccatgcttggcaatatttgtggaacatttaaatcaatcccgacaatgattctaagatcactttgccaaaattggctacatcggcttctccctatccgattcggtattagccggtgcaaacgatccgatgcgtactctgtttccgagaataacgaactccttccaaatccgcttcggttttgactccaaatccaatctatgatatattaaatttggtcgttaacacatcgttagtactctattatgataattattttgagacaaatttaaatcctaaaaatacaattgttatgggacatatgtagtacttagttagtacttacaagtactgatggcataaagctttaaccatcatatttgtaataaatgatcatagccttcaatgaattaatgtttgtcttgtgattttttttccttttatatcaatataaaaccttacactctcttatattattcatttcaaataaccaaattgttcaaattgattgtatggaccagcaaatgatttacaagttgttatagttattttcaccacactattagaaaacattttttttttacaaacgggccaaaatgatttttccagatggccatccaccccgcctgcacttcaagacctatgaaaatacatgatttttgcaagcggacattggctgattttgataggcggtatctccatcttcacaagcgttgtagccacctgcctgcgaaaatgttctcggcgaacaaaaaaaaaacgccaccgtcccatccttcgccgccccaccccctcctcctcccccaacccggccggaagatagattttcgtaggcagacggccatcttgcccccttcccatcttgcatgcggaatagtggtggtaaaattttcgtcctcctgtaggtatctcgtctgaaaaaatggtttttccaggagtgccaactaggccgtttgtgtaatagtatgtagatgcaatagtttgaatagatggtaatatatacagacatcggaagagatcgatgatgcagagggtagcaagcggccgagaagttatgacgtcgtcgtcgtcgttctgctgtttagcagcctcgctactgatgctgttgctaccgttctttgccatggcagcagcagctgcaggcgggagcagcagcagcagcagctgcaggcgggatcagcatcgagtacccgttctgcgtggagcctggctgctaccacccaggcttcaacctcacctgcaaccactcctacagcccgcccaggctattcctcggcgacggcacggtgcaggtgctcgagatcgccatcccccaagccaccgtgcgcatcaacagcggccgcatggtgttcaattctactggcaatcatgccgtcaacagatcattattggatcaggtgggaaggccgtacttcgtggcagcttcaaacaggatagctttgctaagctgcaacgcccgggttgacgtccgcgcggctgggagaaacaacaacaaaactagtactaagttgctcagttcctgcactgccatctgcccaacagacgatggaggtggtgctaccactatcctcgatattggtccagagggtccatgctcagggattggctgctgtgaaacaagcatgctactagcaggaagctcgactgctgcctacagcatccaggtccagaacttgcaggagcaggccgtcgtgctaaatcgaacggatgatctggtgtacttggtagatgagagatttaactataccttggacatgtctttcggctacagcagtcctgaagagctcccagcacggctagactggtacataaatagttcatcagcgtgtccgttgcccgcgtccgcccccg

SEQ ID NO: 55085 - DNA, 710 bp, Oryza sativa
aattcctgcagccctaactcaggcttcagagaaaataaaagggaatatcaaaagggataaaaaatgtttatgtaaacatatgaaggaaagaaagtaagatttttaatctgttcaggctcagggtttgaatattttcagggaagaacagaacctttgattgtggatcagtctttggatttcgtcgtatgtgtacgttagcaagaagtaaaatcagatgctcacgctgattggaaacattgtctgtctgtatgtcaagaagtcgatgagacatcaaaaccccagataatggtaggttaagagtcagaatcatagttatgaagaacaaataagcaacgaaaaatattcaaacaaagtgtggattgcctttcctgaaaaccaaacatagattgtagccagtccaagaggtcttcgttaaccttgtgttcataagttttgggccatggaagacctctagtattgcgaagagcaacagcggcagcttggatcttgaaagtgagaaagtatcagaaagtccttcactttgatagcattaagtcaactcaatagaatcgtaatataaaagaaacctcaggaaatttcatgactgcttgattgccactgtctggatcaagagggagtatattgaaagggagatatatctttgtcttctctttaactttatcagcggcttccaagatctaaagatagtaaaacagatgatctgattggta

SEQ ID NO: 55086 - DNA, 1508 bp, Oryza sativa
atctaactttatttgcatgtgtgtactacaggaagaaggatgggtggtgtgccgagcattcaagaagaggacggcgtatccggcgaggagcatggtggagacgtgggactactccttgcacgagcgcaacatcatgagcgccgcggcggcggcggcgttcgccgatccgagcgcggcgtacgcgcagatgaggcggcagcacaggagcgggcggttcaagcaggaggcggagctggacggcgccgccacagccctcctccactactccagccacctcgccgagctgccgcagctcgagagcccctccgcggctgcggcgccgctccagcccaacccgagccagctggccaccgccggcgaggacgacgactgcaagggcgataatggcggtaggagggccaagaaagcccgcgccgccggcgacaaggtggcgacgaccacggactggagagcgctcgacaagttcgtcgcgtcgcagcttagccccggggagtgtggcagcatggaggcaacggcggaagccgcggcggcggcagtcgccggtgtgagctcgccgctggaccacggcgatgacgacatggcagcattgctgtttctcaacagcgacgagagagacgaggtcgacaggtggacggggttgctcggctccggcgccggcgcgagcggcgtcgacggcgacctcggaatctgtgtgtttgacaaatgagggacaaagcattcacagcacgatgtgttcatcacatcaaccggatgggatatatggttatagctgaaatttttataaattgttctctttttttttcttctgcttctttttatgttcccaaatgtgattgtaacctttaatcgatctgtcccctgtgcagagtcataagatgcatggcattgcaatgtgctttttttttcccagttgatgtgatcctacattggcactttgtaaatgtctttgactcccagctgggtggcatatatagtacactgtactctctacagtaattaatgacataatatttgaagtcagcataacttgctagaaacgactaaagcaagaggtgcgcgtgcagaacaaaatgctactctgactcagcacactactagtaactcgttgaacttgtacaaatattatcaagaaaaaactctaggaaatttagattgtgatcactagtcaagagggctgtgcgattgatcaggctatatacataatcatagattccaaaacaaagttgtattatatatatagattcttatagcactgctggagaaaggggcatcactcccggttggtaaccctctaaagtcctggttttgcaactggaccacgaattcaagactaaagatgttaaaataaccaagagtaaagattgatctttattcccggttaccaactggaacaaaagagggtagcgccaggctctctaatccctattctcctctttttttttttctttttcattgttctttgcatattgattttacaccaaaatcacatagatcaacatcacaaaatc

SEQ ID NO: 55087 - DNA, 1895 bp, Oryza sativa
cttacacgatagtataaaatttagaagaaaaaataaactagaagagagatatataagcgggcttaaaaaaaacccgcttgcatccctaccgtaagattattatatacgacaacagatgatcttccaaataggaggcctattctctcgtgataggtagaagggatcaacaactaattaattataccgtagtgcgtgcttactacccattaatcaattattataccgggataatgaactcagtctaaaatctctgttcatgttggtctaatatatattatcactaactagtctgatcaaaataatgcagaaattcctattctaaaaaaaaactgcagaaatcaaggattcaagggtgtacctgctgaattgctccggttgatcggatcagcttctgaaaatccacccacggatcgtaactcgccgctcgccacacgcccaaaccagtacaactagggcggcggtgcgcgccaacgccaatcgatcggccggtggtggcggtgacgcccggtgccggcgccggccctcatggaaacgagaggattggtgcgaccgccggagtgcgctccgatggccgattggccgcggcggcggcggcggcaccgcgagtcggcgagacgacgcctgatcaggccgccgcttctcttccccaatccctctacctcccggtcttgtactgtacatcatttaggcccagcaaagcccacgtagtccgttttttatgtgggcctcatcagtccttcctcgcaactaaggcccatttagcgaaacccaggctcgttggcccagttctcccctccgtcttcagttttctccaccatgagaggactgctacagagttgtggagtggatctccgcctccggtgagctccagctccgatggcacgcggaggcggctacgggtgggcgctcgcggcgggcctcaacgccgcgctcgccgccatctccgccaagttcttcgcgcctccggtactctactagctctctctctacctccctccgatctgaacattctgttttctgttcataccttgcttggaaggctgccgctgtaaccttaataggccgcttcagcctttgttcgggtttaatttgttcatgctggttcgattaaatgattttaccaagttcatgggcatgaaacagtcacttacttggatccgaagttgcggattcatcagataattcgaggttagatgtgtgatcccttcagctaatgacttagtgctagaagtataactgggataatgtggaaattgctgatcaaaagttaactatcatgtgtggttcaattagtttaggatcagattgtgaaaatacctcaaatcaaatgataccggtttaacctgtactccggattagttcctcctaccagtgtacttgtagtctagtgctgcctgctattttgttacttgagacttgactttattattgccttctacagcttctgaaatacagcatggtgatacttttcaatgtgacaatgtggggctgctatgtgaacagcctcaaagcactgtcatccctccaagcaaccgtcaccaattttgctgccaacttcatttcatcaggtcttgcagggtactttctgttcgaggagccactgccttctaaggtaatatgagaattctcccttctgtgtagtgcgtgcacatcaagctagttattcatgcagatcaaatagctaaaaattttcaaatttatttgtgttagcttatgtcctctgttagattgggctttttcttccctttcaaacatgggaagagtatcctaggttgatctgtcacattgcttcttagtagtatgagtaggtttatttattataaataggattaaatctagttattaagctaggccactttatctggattcatattactcgcttgaaaagtcacata

SEQ ID NO: 55088 - DNA, 1643 bp, Oryza sativa
gaggaggacgacgagggtggggcgctacgagctcggcaagacgatcggggaggggagcttcgccaaggtcaaggtcgcccgcgacacgcgcaccggcgacaccctcgccatcaaggtgctcgaccgcaaccatgtgcttcgccacaagatggtcgagcaggtccgccgccttaatcatcctcaaaattgaatatttatctctttttttagacatcaggtaataacaagttggatcttttctcggaggggatcgaattaagaatcctaaattattctagatagatgctagattattataaaagatggattttcatggggattaataaacattaaacgagaatatgcgcttactacgtctctaccattgtcaagattctgtctgtttggattgtttgtgattgaagaaaggtcatgtgtccgcctgtccagcgggctaaatctgctctgatctaaaggaaattagatggaattgtatcaagtttgaatcggaaatgtaacaacagattatcaagctgggccatgtaactataacaatatctccgatgcggtgatgccaaccctgtcttaatcaaatgctttctgcctagcaaaaagctgtgctagctttggtgttcgtaggagtggcaagagttgttctagattcatttttttttctcggggagttataaattcagtctgactggggggaaactcgggtattgtacattccgtgctagatcactcattggttgatgcattgtttggtggaaaaactagtattttttttggttaaatatgtgattttccatatgatgtgttggcacaattaaatgtccctgctcgagctgttctgttttccagcttgagctttcgattgtgaatgataacctcatattccacttctatcagatcaaacgggagatttccacaatgaagctaataaaacatccaaatgtggtccagttgcatgaggtactttgctatctttgcaggaacaatagcgtcattaccactcatacccttctttttttttttatctcatctcattcaatgagaattttacattcaatgtgtgtttgacaggtcatggctagcaaatcaaagatatacatggttcttgaatatgttgatggaggcgagctttttgataagattgtaaggcccatgaactttctgtgccagatatcacgattcttatttttgtttatgtacaaattgcttttacatgctgtaagagtagcttgttgaaccggcacatttgactgttttgatactgactgactaatccgcagttcttggaccatacaagttgacccatttatcatcatgttattatcaactaggtcaattctgggagactaggagaagatgaagcaagaagatacttccatcaacttataaatgcagtagattattgccacagcagaggagtgtaccatagagatctgaaggtttgttgaattatcctgcttacctcctttctgggtaatctccactgggatggatgtattctcattcatattttttatgtgccatttgcagccagagaatctgcttcttgattcacatggagctcttaaagtttcagattttggccttagtgcgtttgctccacaaacaaaagtatgatatctagctagtacccagaagtatgtttttgtagt

SEQ ID NO: 55089 - DNA, 1458 bp, Oryza sativa
tgacacccttgctctctagcagccgagatgtagaggagtcggcgcttgaggacctaggctgcgtttagtttcaccttaaaattgaaagtttgaagaaattgaaatgattcgatagaaaagttaaaagtttaaatgtataggaaagttcgatgtgacggaaaaagttgaaagtttaaaaaaaaaagttaaaatctaaaccgagccctagtttattttataaatacggagtaggtccttggtgctaatattcttggtaccgatcccatttgcatcattgactatttgactttgcttttacagagggctatggtagggtgccagttattattggcgtcgaggcattgaactttcgtgttaatgaactgatgttgaggaaaaagatctattcttaaaataggatttttttaaatctatttatataaaaaaaatcaacatccagttctgatatccctccctgatgttattggtaatccacaggcgccgggcaaacaccggcaacctgaaatctaccaaccactggaggaaaattctgccgtgaccccatgtccccatcgcaggcaacaacactacgaacgcacagcaaacaacctatcttgcccggaaccggagctgaacggaagagaggtaggagtacacctagtagtcaagttccattcatctacatccaagcgcggtgccgtgcagccgtactactcgtcctccccggctccccgcgcttgtcaccaagggagaaaagaaatgttgtactatctgcagaagtcgtagcctatttttaatccaacattacgcaattgcgagcattatctgactttgtagtttgtaccgaaccgcttgcacgtactggtggctggcaaaaaataattctatctcgctgtcctctctgaccggattaatggaggctgtgtttatgtctagttcaacgtaaagtttagattttggttaaaattaaagatgatgtgactaagaaattgtgtatatgacatattgatgtgatgaaaaaggagtatctaaattttaaatctaaacacgggtgctgtcatgtcatgcctgtctcgtcaaaacgaaatctctcgaattgaaaacaagccatgtgatacgcacgcgagatagggaaccggtcgagcaactgtccttttctagttaaagattactagattttatgtccattttgttagcacatactctctcctccttgtagctgtcgaattacgtctaacgttcgattgtttgttttattttaaattttttttaattagtatttacattgatattagatgataaaacatgtataatattttacacgtgatttatttttctaatatttttataaattttttaaataagatgaatgatcaaatattggatacagaggtccacagcacacttaaaatgagatgtatggagtaactactaaatgatgtgattggtgcgaaatttttctacgggggctgcaggaat

SEQ ID NO: 55090 - DNA, 735 bp, Oryza sativa
ttctgatcatctcccgttcttgcattcttcttcttcttcttcttctccggcgtggtgtgctgctgacggctgacgctggctggtcgtggacatgtcgaaggtgaggctctgtcttttgctcttggattctcatcctgattactgtagtagcttctgtgggataaaatgatctctgcttctgaatccagtaaaatatacatgttgtttttgtccgttacacattgcgagcgttcgtataccatggtggtgcgtaaactaacactgatgtttcacatgttcctctgctgcagaagattgtggtgaagctggatctccatgacaacaaggacaagcagaaggccatgaaggtcgtctccacgcttgccggtacgcatcgtgttcgatccatcaaccgttctgcccgtgttcagaaacgatcaagagaaatgactgctgttcgtttatgcatgtcactcatgtcaggcatcgacgccatttccatggacatggcgtcgcgcaagatgacggtgatcggcacggttgacccggtgaacgtggtgagcaagctgcgcaaggcgtcctggccggcctacatcgagtccctcggcccggccaaggagccggagaagaagaaggagggcggcggcgatgccaagaaggatggcggcgatggcaagaaggagggaggaggagacggcaagaaggaaggcggcgatgggaagaaggaaggtgacggcaagaagggtgaggcggcgg

SEQ ID NO: 55091 - DNA, 2923 bp, Oryza sativa
ccttggctaatggtatggtcgatgatccaaaggctttacgtacaagatacactagatgcaaagtacacatacacgtcgtttttgtactcgacgtcgttttaggctacgaggatttccacttgtaagcacgaaggtacgtccatgagagtaacctctgacaggttattttacatgtggcaggcttggagcagttgctagctactccagcttgcacaaatgtgttcagacgtcgagttgcaggcagtgtgaatgtgccatttgtatgatcagcatgttgatgtgtagatgcagccatgcatgcagatattgcgaaagcagaatgaaagttagctatcttgccacaaatcgagtgaatacagtgttttgtttgcctttcgtctattcctcagaacgctaaaaagcgctgagattttttcccatggaaaggttgtcttttcacagtacagtacaccggcaggcacatattgttgcctctagaaactcgccattgtggcccaggccagccggcgatgcagaaaagtcaaaagttgttcagaactgtactttatctgtgatgtgacgggcacaatacatggatgctgtgttcaagatcatatctgctgttagcctgttactataagatcatatcagaccgagcaggaatgcaggatattaaggagtatgcataaaaagttatttttcatacttaactttcattggttggtcggcaccatgcgtatctttgaaatgctgtaactaactcttcttaccttggttaattaatcgttttacttaaccggatggcgactgaccaaaatatcctgcagccccagagtaacgggctaaacgtcgctatcaaagttaacccctctgcttcactttgcatcattagttacctaagcatatgataacatttacaaagtcccatttaaactcggatagtgtgtcggcgtccacggccgccccggcaggtaacattatattggtttctggatgggaaaaaagacagacggtccccatatacaattcaaactcgatcgaaagtcatacatataatgttacatgcgtgcatgcaccaatgcagatcactggccggacgtactgtaagtttggactgtaacagcatgcagctggtatccaaccacgcggggcaataaccaatggaacggtggtaagtggggcggtgcatgcatagtgcggatggggacggcacggctcgtcgcccatgcaccgcgtgcgctcctcgctcggtcgatcggtcggtccgaaagattagcccgggcggcgcccatccgcccgcccaatcatgagcacctcgcgggtcgcggcatcatttgctcgagatatatatcgctacgtacgtacacggccggatcggtgcgcgcgagcccgacgccgggtagccccggcccccaccccgcgcgcgtacgtacgtaggccccgcctcgcaccaccaccgctcgtacgcgcgttgcgccgtccgcgcctcggcggctctcgtatatccacaccaccccgcgcgtttcgcgtgccggccaacgccgacgcgcacgtacaccaccaccagcgtgcgcgcgtatctcgcttgttttccgcacgacgcaaccgcgcccgcgcagggggtgggctatagctgcaggttacgcgcgaggccggcgccggcgtgacctctcccttttgcggttttgccgagaattgagcaggcaggcatgccgcgcattgtactacaggttctatctgtgcgacgggatggagaccttttggatcgtttggtgaggaaagatacggcaagttggctagcgagaatacatgtgtgagatccttggcgtaagcggcaaaaaggctaagcatgcttgtttgctcccttagtgcatgcataaaaagcctagctgctgtgacagtaacacacacacacacacatacaaattgttctcttctgtgttgtactgctagctagttagctacatatgctcgcgctttcatcctctctagctgcttcaagaaaaagcctatttacctttgatgtaagagtgatgacgtgctaaaaatgctactgatccggtgacccgactgactaagaaagctaagcttgattttttttttctggactctcactttcactggcggcacaagtgtgattgatttggcggcacgcttataattttgaagcggtgtgacatggatgtatatacatgagccgacttatatgcatgcctgatgtagtatatctcagatcgatcggctagctagtgcgaggagaggtgaacggcaagggatcatcagaaggatcgatatcgtaggttgttacgagttactattgaattgctcctacgtggacagaggctgcagccatatatggaggttggtaaagggaaagtgactgcacaacacgttggctactgagaaaagggcagctgatgtaggatagatagatatatagatagagggatagatacttgttgcacactactcttaccgcttttgatacatgtgatgtgagcatcaagcttgtttctttcttttcttttcttcttcccttcatcctttctcttccctgtacatgctgtccctgcatgcatggcttgtcgatgcttccttgctatcattgctcgccggcctccattcccgttccattccagggtatggagtgccatggttgtgatctcaaaagctagttggcgtgagcatggcattgtccggacaagcatgcatgagagtagttaagtaaattgaatcaacttcgattgttaacttgatagcttccctgctgtgtggccaaaaaatctaccatgttgttcgcttctggaacggaatcattcaggaaactggcagcccctcggtgtgcgtgaggcatcgatggatttcgtggactaataaccagcggaatgatcgcgcgctacctctatcaaatcgatcgtctctcatgacgacgggctgcaggaat

SEQ ID NO: 55092 - DNA, 2438 bp, Oryza sativa
gatgtagaaactctgaagaaagaaaaaaaatagagagagagatgttacgggtagcagcttccgttctcccttgaaagttcaaacggaggacaaagaggccaaattgctgagttggctgtttaaattgggcttaagttccccctcggcccaaagtagggcttcagttgttttcttattgggctagtgtagactgtaggcttgacctgtttctgatttctgaagcccatgtattctttcttgtttacattttttttccggagtcgttagaaatatggcgccatatgctacagtcgattttttttcagccacttacatagtagttatatctcatttacaccccacttacatatataattagtatgtattttttgaatttacatatgtaattttagtacttacatatgtaattttgagacttacattgtaaatacactatgaacttacaatgtaaatacatgccgattattttttgatgaaaaatatggcaccataaatatagctacacccttttttttatagctcgaacaaacaaatctggagacactgccaaagtgctagaaaaatatcaatcgaacatatgttggcgctatgtatcttaggaattgtttagttaggtaaaatttttaggtttgattgtcacatcggatattcggacaatatagactaataacaaataaattatagactccccatgaaattgcgagacgaatttattaagtctaattaatccgtcattagcaaatatttactgtagcaccacagtatcaaatcatggcataattaagcttaaaagatttgtctcgcaatttacacgtaaactgtgtaattggtttttatttttatcaacatctaatactctatgtatgtgtctaaatattcgatgtgatggatgaaaaatttttattttagcaactaaacaaagcctttgtgctacatggctgaatattaagtctttcgaagtggtcatacaaaaattctcgtttgagctgtgctgcaagaaactctgcatctatcgccctgacacgcgcttcattacgatgaggttggcaagcctgcaggacatcctcgtctagtcgtttgcacatgatgtagcctgtagcctgtagccatacaagagagcacgaccaaattactggagtatggtacgttgctgcaccgcgtactgttgggaatggaaggcgactaatcaacctcagaggccacatcccatgtggtcctcttcttgaagacgtcttttaccctctactggaacggcagcagtaaatcgcattgcctcccagtagtcaatggccatcgatcacgagcaagcaaggcattgatacgcgcgtacgtacagtcagtcctacacacatccgtagtggtatatactccctccgtaccaaaaaaaaagacaaactctatttttcgtgcctaatatttgaccgtccgtcttatttaaaaaaattatgaaaaaaattaaaaagacaaatcacgcataaaatattaatcatgttttatcatctaacaataataaatatatgaattataaaaaaaattatataagacggacaattaaaattggacacggaaatctagggtttgtcttttttttgagacggagagagtatggtacagtggttcatgccatgtcaatgccggcctcacgaggacggctagctcgccgtgtcgaccgcgccaccgcgaacggggcgtcacggcctgaaactgcaagtgtgttccttattctcggttagaattcagaaattactgtatttcctctgaaacctctgcaggtgtacgtacgtcgtcgcgcttggtcggtgacatgaataactagtccagtacgtagtccgtacgtacatgtacgcggatgatccccgtgctgcgtggtccgggtgcagcacgtcatctccggcccagccagcctacgctcgtgacaagtgttgctcgatcgttcgttgcaattgaccttggagctagccggtcgggccatggcttcgcttaagaacgaccgtcaatgtctctgcaaattaagcccaaatccagtgcaggatcagtgcggagacaaaaccgatggcgatataaccgaatcggccgatcgatccattccatgtgtcgcgctcgaccatcgctacgccttcacgacagcccggcgcggcaggcacgtcgtcttgcggatcgaacaaaagtgggcgatgtgttcggcaccaccggccgccgcccgcgcgtcccgtggagaatccgaatagaataatccactactactagcagtgttacatttcgcctcacagaggctcacagcttccacgggagaaggcgtcacggggagctacgcccggacgccccccatcgtcgtggcgagcgcgagtcgcttgctcgatactcatcgctcggtgtggcagggcagcaacggcagcgcgcgcccggggggggtccacacggtttcctccgcaaaaaag

SEQ ID NO: 55093 - DNA, 3574 bp, Oryza sativa
tattccctatggactacttttgtagcacattgtggatgccctaactgttgtagattaatcgcgactaacaaaatacctgtcttgccttgaccgtgtgcttccgataatccgatgcacgtgatgtgtcgctaaagcggctcactggctcaggatgcaccgtgcgtgttactaccaccgactgcaaatacacgcggatcgacagctcagtgtggtggtggcttcagcttggcggccaagaaacttcaaaaccatattatggcatccttccaaaattttagaagggaagaagaggagctatgatatagacagtgcgagccggctaccatgtacacttgataattggacaccttcacagttcacacaatgccaccatcatatcaccataagctttattaagggatactagtcgaccctgccttatgcgcctagaaacttaagcacgctgcatgtacgaatgactaattaagtgtgtgaatgtacattggcgaatctagagatcttttagaacatgaacaaacatatatgtccaaaggattatatggatgccattgaacatcagcgatggaagctattacattgatgtgacttgtcaatgagttcggacggttgcccgaaggtaaccactagccaggtcttggatccgctcccaaaaatatacaattaattatttctttaattaattaaatgtggaaacaaaactagctaggcattatgcagttggtcacaaaacgacatgtttttttagctggaagagtacattttactgctagcttgaagtgcacgagctcgggcggtcgtccggggtcaccaggtcttggatccgccccccaaaaaaatacaattaactatttctttaaatgtaaaaacatatgtgtgtgaaaaaggttaaaaactagctagacattatgcagctggctacaaaacgacatgttttttttcttggaagagtacattttactgccagctgagaaatagtgtgaagcttaactctaggtgcacaaattcggacagtgccactcatggtcggcaggccttggatcctcccccaggaacatacaattaacttttttttgtttaaatatgaaaaaaatatatgtgtggaaaggtttagaactagacatcatccagctggcaatagaacgacatgtttttttttacatcatcgagttggcaacagattgacatgtttttgtgactggaagagtacatttttactgtcagctttgaaatactatgaagcttaacgctaggtgcacgaattcggatggcctcccgtagtcgctaggccttggatcatctcacaggatatacaattaactattttatttaaaagagaaaacatatatgtgtgaaaatgttcagaactagacatcatgcagctaacaacagaaacgacatgtttttaatttgtcataggaagagtacattttacttccagcttagaaatagtatgaagtttaactctaagtgcatatatatgaacggtcacccgtggtcaccaggccttggatcctccccgggaatatacagttaactattttgtttaaatgtgaaaacatatgtgtgtgaaaaaggttaactagatcaccatgcagctagcaacagaacaacatgttattgtgaccggaaaagtacattttattgccagcttagaaatagtatggaccttaactctaggtgcacgagctcggacggtcgcccagggtcactaggccttggatccactcctaggaatacacaattaactatttctttcaatgtaaaaagcatgtgtgtcaaaaggtttagaactagacatcatgaagctggcaacaaaatggtatgcttttaactagaagaatacattttactagcatagaaaatggtatgaaagcttaactcaaggtacacgaatttggatggccactcggccttggatcctccccaggaataaacaattgactattttgtttaaatgtgaaaacatatatgtgtgaaaaggtttagaactaaacatcatacagcttgtaacacatcacgacatgtttttatgactggaagaatacattttattgccagcttcgaaacagtataaagctttaactctaggtgcagcaggtatgaaagcatactatttattttactagaaaaaaatgtaaacatgtaaatatccaactttgcagcggaatatgatcctccgacgtaaattaacatgtgacaattgccacatgaccccacttgtcagccacaaagttatggttatgttatgccagaggatctgattcggcatgcggatccttgggctggttggtttgcatgatattttcgtagcaaaaactagttgtagttgagtccatggctctaaaattctcctaaggtccgccattgatctccccatgcaagagggaggcatgtctcagagaggcctgtagcgactagcgaatgagcaggggtccaacaggccaacaggaagctcgtaccaagacttgcaggcagaaacctacatgaatgaatgccttgattgcgtgccgggcagtctccccacattcgcagcagcatgcagctgacaccgatcgaacagggcgcacgtacgtacgtccgaggttggccagtggaaagtgcgctgcgctgcgacgggtggcaacggaacgcaacgcgccccatatgcatcgcatccgtttcgtcgcttccgccttgccggtggctgccaaaattgccatcccctggccagtaaatcagcaaggggcagtggcgcagtgtgcaagctggcctgggtgtaagacggtacaaaagtggtgcgtagcgcatgtgaaactgatggtgaaacacatgtgacgcgagacgagacttgaggcggggagagggctatcaggcaaccccaccgcaccaccggaaccaccacctcacaaacaccgtcaccaaacgccgacttaatacccttaaaagcgacccgatccccagtccgggcaacgcaaacccccacattcctccgctgctgctgcgtcgcgcgcgcgtgtgtgcagtgcaccgcccgttcgcggagccgattgattttacaacaccgcgctcgctcgcggtcgcggggggggcggaagctggtactactcgctatcatgaacggtggcattggcgacgcgctgatgcagccgcagcacgtgcaggtcatgtcgtcgtcgttgccgatggtggcgtcgacgttcgtggcggagccggcggcggcggccaacaagccgagggccgcggggctgccgcccacgccgccgcaggtgttcgccgcccagcgcgcggcggcggcggcgggcggcgacgtgtgcatggaggagtcggcgcaggggggtggtggcgggctgccgccgcgcaaggcgcaccgccgctccagcagcgacgtgccgttcgggtacctggccgggcagcaccagctcctgccgcccaaggtggaggccgggtggggccacctcggcgccggcgccggcggcgcggcggccgccgatgacctgttcaacgcgtacctgaacctggaggggctggacgggctcaactcctccgacgaccgccacgacgaaggggacagccgcgggagcagggctgcaggaat

SEQ ID NO: 55094 - DNA, 1833 bp, Oryza sativa
ccccatggccgacgagaagctggccgagatggcgctcgccgacccaaagcgcgtcaagaggtaaataatattcgatcactctcccatccatccatatcgtctcgcaaatgcaaatgattagaaaacgatcgatgattgcaatgtatattgagcgctacgacatgaggggatcgatcgactgatcgctgagagctttcttcctccggtgacagggtgctggcgaacaggcagtcggcggcgaggtccaaggagaggaagatgaggtacattgcggagctggagcagaaggtgcagatcctgcagtcggaggcgaccaatctgtccgcgcagctcacgatgatgcaggtaacacgcactgatcccttcgccttcccgctttctcgtgcaattgccgtctcatcgtcctgatcgccttttttcctgcgtgaaatccacacggttgtttacgttgtctgtgactgttttggcttttggcagcgcgactcggcggggctcgcgacgcagaacaacgagctcaagttcaggctgcatgccatggagcagcaggcgcagctgcgcgacggtacgtgcctcccctaaacctcctcgatcactcgctcctcccatgtttgtgctcgccaacgtcataagatactttagatgtgctcggcactatgatgaacagtcttgtgtaagttattgacgttgacatgcttgtttgtcctagtgcttgtcaactgttgccataatctcgtgtttttgcgcttggaggttggtagttagcttttctttatgcatatatttttctctcgggaagccggtggtcgttagtatgtactcctactactggtagggaggaggacatgccttagcaatcatccaagaacgaagatttgctattgtgcgtgccttttcccccaatcaaagataaaatatatagtatgccctatggcgtctctgaagtctgaatccgttagttgctagcatgttaggagcctgcagtcccgtgtaggagaagaatgttttggagtattcaatattctgcggtgacttctccagattgccaccctagttttcagggctttcacgtatcaaatgtttctccttggatgccatattgccatgtgattgccacatttccttctctcacaaggagtctttcgtttcaagaatctacactgatctaggatgtctactgccttttacatgatgacttcatccttaagggttaatctatctattaatgttatgagtagctgtatttttaccaagatgaattcatcctattgcaatatactgttaaacactgcaccatgaaagtatgccacgaatagagttcaggaattgttcacttgttagttctggttttgatgctcagttcctcactgcttcgccattatcttatgttcaacagcgctgaatgaggccctgacaaccgaagtccaacgcctaaaactcgccaccgctgagctcggcgattcttgctcgtccagcagtctagctcagcagatccaactcaatgctcagaatcagatgtttcaactgcagcagcagcaggctacgcagataccattctatcaactgcagcagtcacaacagaacggtgcagcgaagaacaatgaatcaaaagaatgattccagaggcattttgggctggttcatggaaagagaatattggtttagatgagcgcaattcgcatattcctaactcatttgttttaatgttgttaataatcaccttgcatttttctagtaggtggtggttggtgaacctccttttacctttctatgttcattgattctttggatgatacagttgtcatttttaagttaccaaactgatgaagttgtagg

SEQ ID NO: 55095 - DNA, 1298 bp, Oryza sativa
catcagacatcagatcatttttccaacaccacttcctgggagttgctttctgaaatctggatcaacaatttcgatcatagcattaagaacacgatgatgatcggttattttactgatgacatgatcaatattactctggctcccagcagcctgtccatcagagttcactaaagcatcagctgctgagctccctctgacattttcatcctgctccccggcatggtctgtagtctcccccaagctcctaggagactcattctccccattgacagatggacctgtttccactgcccagctaccagcaacttctgaggccaacaaatcagctgtaccaatggttctggtctgggtatcctcgtgttttctctcagaacagttaacctcaagtttttcttcagaatagtgaccaatgccatctttgagggttaacgaggcttcctcatttccttgtggttgccctctatctttgcaaatcaagatggactcatcattctcttgtggttgcacttcatcatctagctgcatggtatcacctcccatttcactaaatctttgaagagctgaattgtgatcaccacagccaacattaccagcttggctttctgtctcgggaacttgctcagtatctgttggctctagctcaggagctgtagcagccagatcaccatgagaatcagacctgaatctctctgttgccatttctggactattgcactctacctcttgagtgtttgccccttcaactctggtaaaatcatcctgttgttcagtctccttggaatcatcacttgaactttgttcacttgcctgggtattctctgttgaagcaccagaagcttccattgtattttttgagtagtttactctcgtgcgggcatcgtcagcagttacagttgccagtggcactttattgagatcatcacccatgatactgttctcataattctcttcatcctccagagttctctgcattgctttaagctgttcctgctgttttgcaaacagagaagatatttcctctgtagttgaatagaaagcacgcagctgagtctccctgcagtaagcaacataggaaacaaaagaaaaggtaagctgatttgtagtttcacaaacttggggttcacctctatatgaaactcaaacaatgtttcttaccgtaaaataattctctctcttgctccttgatacctctgtttctcgattgatagatctctaattgtagcagctatttcaagctcaagagctgagacctttgcccatgcttcttcccgagcagcctgctaacagaagaacacaga

SEQ ID NO: 55096 - DNA, 7234 bp, Oryza sativa
  unsure (1)..(7234): unsure at all n locations
tcctgcagcccatccacacttcttcactgtagtctgcacttcgaggaagaattaaaacatttggcatctcccttacctatgtcaaataaatagtatccatcattttgctgaacaacaagttctttttttataagatggatgatgaacaagtggcaccaccatagcaatgcagaaaagggcacagttgtttgtcctctactactagcatattggttgttgctcttctgtacaatatgcagaatcaagagagttcaaagttatccctaaaatagtaagagctcaacaggtggagtgcagggaacttgaaatacttgatgctaaactaaattaaatatttactcattttccatatgtttttcctagagattccttttcaacatccggaagagcagagcattctaaatggtgatgttttgatcttagatgaatttcatccatcgcaaatggccacttatcaacaaaaaaacacatcaaaagctgatggacgtacccacgcttccatccattgtggaccttcagcaccatccaatgcacaaccagctattgtaccatcaatcaatagctgtttgagtgcacaatcatctataagttggcaacttccagtatttactatgaatgctcctgtgagataaacaagaaaattatactgtgttttacggctgaactaaaggcatgataagcattatttcggaatatataatgcataaagcagaagaaagaaaggggttgaagataaaccttaccaggttttacatgctgcagacagtcagcattaagtatatgcatcgtgtcatttggtaatgtgcagtgcagtgaaacaaggtcacttgctgccaacaaatcattgagagtattcattctcctggcggcagatggaaatacaatggaaggccgctttgcttttccattagccttcagtagacatgctaattcagttagaatagtcaaaataatactttaccgcctagcatttcttaaaatcagtaggtaattgcatacaagtgcgacaagatatatatcatgaactttggacataaataatgtgaactgaacatgaatttggggagatttcttaatgtaacagaaagttaatagcccatgaaaactttgggggggggggggggtaataggttanaaccagataagatatacccatcaagatgttcttgtcacaatgtcatcccctcctttgcattttagcataagttactactccctccgttccgaaatataagcacttctagcattttaaatttgtaccaaaatatagcccttctggtgtactacttgtcccatcaccccccccccccccccgaacacacacacaccaaaaaaaaaaaagcttcccatattacccccaaggccccaaccatacctcatctatgagggggcatcatagtttcttttctattcacttaatctttgctaaaaccctagaaatgcttatattttggaatggagggagtattgttcttacttctttatcaacagctagcattcgtaccacagcttacagagaatatatagttgtctcattcagaaagctgaagaattttgctaaaatacagggaatgagatcattcagctcacaacattacaaagggacgtctcatcataggcagaagcagtgagatcatttaagtcataacattccaaatctttggactgtctaactgttcaatcacctattccaacttaatatgttcaaagaagtttgttcatagcagaacattactaatcagaaaacaactcattctagaattgggggtgaaactgttccagtcggttgctaggtgtatgaccaaatgaaattaccacaacaacaatgcgcggattaagatccagagttttagagctgtgcaagtatacgtagaacagtagtaagaagaggaaactacaggagcgtagcaagtcgtagatccagtaccgaatggcgcggatcgaagtagaggacgtccatccggaaggcgaggctgcgagtggcgaggcagcgggcggcggcggatcgaccaatgatgccgagcacgaggccgcggcagcgcctcatgccgcgacacatcggctggacggagcctagccacccagcggcgacagcggccggggccgacgaggcgtggcgcgagagcaggtgggtccggcggagcagcccgaggaagagcgccatgacggtgtcggccacctcctcggctcggttggcgtcgacgtggaccaggcggaggcccagctccgcggcgagggcggcgtccgcggcgcggtcgggcgacccgaggcagagcaggagctgccacgggcggaggcgccgctgcgcggcccgcgggaggaaggcgagcgagggcaggagcacggccgcggccgcctccacgcgcccggaggcgacggcggagagggggacgtgctccacccccgccacgccggccagcccctcctgctccagcgacgggtcgtcgaggcagttcagtgacaccaccagcggctggcccccgccgccgccgccggaggcccgccgagcgggccatccctgcgcctccctctcggcgctcggatcggagcgttcgcgtggcgcgggttttggtgcgggcctcccgtctccgggccgaggggggctttttgtcccgtgcaaagggaagagcaagaagagggaagaaatgctctgctgctactacgcttgtcagagtggtgggccgcacgggggccaccactcaccagctcacgagggaacggtgcgttgcaaaccgtcagattcgcattgttaattgtttgcagcttgtgcttgtgtctctcgcgccactgccagtgactgagcagatgcaaacaaatcttgaattatttctttaattcattgtgatgattcgaaaacattatttagcatggcaatatttatgaagatctagtagctaaagtccagaaaagatcagttggcatatccatcaaaataagagaagtttgtttcttcgtacttaatcatggagttttgggtaccaagtaaagcactctctgcttttcttccctccaagcaaagcctggtttagttcccaattttttctttaaacttccaactttttcatcacatcaaaacgttcttatacacacaaacttttaacttttccgtcacatcattttaatttcaatcaaactttcaattttaacgtgtattaaacacaccccgagagaaagattgcctcacatcatttagctgccaaggatagacagctgcccgccgcctgtgtacattgtaacaaaaatgccggactgaactcaagtgaagagttaaaagatagagacatagagttccatgatttccatcaagtaacccaacaagttagcacaacaagatcatgccatcgagcatcatcattcattatagtgcatgcgcttaataccctgaacatttaccaggcatgtgatatatcgtcacaatcaatctagaacagaaaaaagtatgcagagcgcaaccggcatggaggcatgttactcctccggtgcattgattctgctcaatcacacaagcagcagtacagcatggttgctttcttcagagccctcatgaagggggaagtaccatccatgcatctatcagtgaaagctactaacgaacagtatttgtcagtgaaagctactggacagctgttcagacaaaccaatttgtcactttacgaagctgacatggatttttccttcaaacaaaaatgcatgaatattaacagtaagagatgacaaaactgtcgtgtagtatgttctgaacttcgtgctgcttgtttgtcttgacaaccttccaacattcgcacattcactgagttcaacttatgcttcacttcgctatgctacttaacttcagaaacaaaatttgagtgtggctcaattaccttgcacttctattccttgaacatttcagtgttgcatcagaggcatatgcctaaaacacactttgaacaaataaccaagtcagcatggtattaaagttttttaatcaatcagacaggcacatagtacccctagagctaataatcgagtgttgttacgttaacggtacataatactgtctgcagctaccagctactactcaccagaaagagagccatcaacagagggggcacacaagttgttgaagcaaatagggtacatctagaagaaattgttcattctcaacctcaagcaagttcgcaaggtacccactgtttcacttttgtgctcatctcactaggaactgaggtagaccactcatccaagtttggaagaggacccgtcaatgcaacgtaatttacactctctttctctgatagtctcttccagttgagctgtaattcaggtttacgtcaggtgggcattctaacaacagtgacatggcattgctcgtatacgtagcaacccaaaacagttaaacaattaccattccatattttattgttttaaacttttccatcatctagtactagaaactatacaactacagcagtcaaaatatggatatttctgtggttcatgtataatcttacctgccccggaaatgcagcacagagtgccttaattgtggaattctgaacccaggacgaaaggcccgtatcattagcaagagatacagcagcatcagctccaccacagttaacaatgatccgtccatctggcattagctttttcgcgatttccaaccaggtttcaacctgtaacaatgttgaaattaaatccagtagaaaataaaaaactgtggaagtgttccaaaaagttaaaagaatatagatatacaaaagtagcgtccaggaattttctctcagctgcacttttacatgttttgaaaaattgttcaaattatttcaattgcagagaatcatatcagccatttggtcaattaggcttgaaaggaagggtcgcaaaggagagtaatccatggatgccgaagacactaaggtcacgtaaggttttttgttaagaacactaaggtcacacaagtagcttacttttgttggtgtatccaaagcaccctctattgatattgggatgcataagattttttgtcgacaaattcacatatcactatagcaagccagccaaactaagggtaataaatcaacacatcatgagataaattaaaatttattacaaacttcaagatatgtagatatcaagtaatttcatccatgcttgaccatgcattcaactgatccaaggaataagaaatacatgctcaaaagcatgaaatctgatgcaaccaacgtagcatatagactggtaaaaaatgaatagaaagagatgcagaggaaatttacttcttgtagctgaggtatgatcttcccatcagcaaacaaatcaacaacaatacctgtacacattaactagatgttgttaggccagaaaactttgagatgcacttgatggtgaagttgcaaggagtgtgtggtttcaaccccgacgttttttgttcaatctccaacacgctcacaatttcttcttaaaaattgtttggagagatgtctcttcctccaaactcttattttttaggccagaaaactttcaaagcctttgaaaactcaaaaagaaaaacattaatctaacagtacatgctttccaatatactacagataatccaactagcatactccaaaaatgcatcatccaagagcgttgtataattaaatagtaacaagagagtaaagcatgtattccatttgcatcaggtagtaagcactcaccagcaaaccctccttcaattgtcagcgttgtataattaaatagtaacaagagagtaaagcatgtattccatttgcatcaggtagtaagcactcaccagcaaaccctccttcaattgtagctgacggagaaagtgcatcaccaatgcgcacagaaagtgaaccacctgattctgttgccttttctaaatcagataaaccaaaataatcccttgacagttcaattatctgtcattcagtaatgcaaactgagagtaagaaatgggcatatgaaaatggatgcgtggagcacaagggataagtctaaagaaaaataatgcaaagaggtgcttgagctagcttaacagccttaactaggaatatattactgaatttctttttgcaacacaataagtaacaatgtgaaaatatttcactaccatctgtgagcctgtggtcaccaaacaattaaaaagagagagaacaatgaaaagagtgttcaccttaggatcaatctcccatccaacaagttgcaaccaaggataaaattttagcatcagatgtgctgcagtcccagcaccctgaaaaagaaacaggggaaaagacaggaatcataatgtgcattgaatatccacaagcgtgtgaagaggtaagttgcccgtgaaaaaaatagaagtgagttgttcaaatgaaaagcctccgtaatgcttgtggatgtatgctggaattgtgatgtgtgctgataatctaattgcaattggtcggtaagacatccattcaggccttcccaaaccctctaagcatggcaggaattttgctttttatgcatagtagttatgcagaacaatgaagtatgatgaacaagataataggtgaatcatgcaccaagtgatttaccaatcctagaagagcaacaggaccacgtggaacaacagctggtaggctcacgaactcatcctgtacaataggaaaagcacaccgtattaagcatttacattgagcagccatttttaaaggatgaaaaacatcatttcaaacagaatagttggcgtagaaataggatgcgttttgcaaagaaaccaacccatcacatagataacaagtacctatatgagcatattatagtctttttttttttttggtactaaactgctatccaactaccaggagcctattactgtccttctcaaaaacttgtttatcatggatagttgacgggatagagcgtcaaattcctaatgcatacaaggcgctcaacaatattatgcttgtatgtcaaaatggcacattagtaatctaaattcaactcgatcagttcagattactcatacgataaatgcataccctgtcagcactcccgattgaaatcgctctcaaatctcacactcaactcaaactttcaactggatcaatttgggaacactggacgaacagcttgtaggcatgaaccttggtagacaaaggttttcgtgctttgctagttaatctgcagcttttcggttttcttccctccgttttgaacgacaattacaacaaggttagggccacgatcccatggtgcgctccgtgaccgg

SEQ ID NO: 55097 - DNA, 5280 bp, Oryza sativa
tggcgggcgagtcgatgatcatgatgacctcgttgaagtcgctaccggtgatggcgaggagcgtgtactcctcctcctcctccttcgccgcttgctcctgctgctcggtggctggaggggcggagacttcgccgccgccaccgggggcgcagtacagcggccgccgcgccgaggccgctccccgtcgagggaggagggagactcgggtggcggagcggcgttggggcttggcttcgcggcggcggtggcggtggaggaggcgaggcggggagaaggttagcggcatggtggccattgctgatgagatagaatgctaatgcacggcgagggattgggttcccacgatttcaagccgttgatggagatggcgggttaggaattcccttttgataactgcaaagcgtattagcgtaatcggttcttctcttaaaccatgattatttcttaagaggccttttcggatgaggcccgataagagaaaatttcagaggcccagcagatatagtcttacaatgttatgggccataattgggcctgagtattctagtgtggttggtttcatctgaaatcaaactgcgaagcaagcaagcagtaaactcccagaataatagcatttcaaacctgtacaagacaaacaatcttgatgtgttgtattgattcgaaacttcgaacggctgtttcagaatatgagcaattttttttgggacaggaagaatatgaccatagtacttaactttctcgcaggtaccacctactccaggtgattgtgcatgataaaatgaatctgcagctaacaacctagcctctccccaacttccaatcagtttggtcaattggagcctttggacacatgcatcggacgccaattgacctgtcgccggccgccgggagacacgccgcgacaggggccacgacgccgccatgacatccgtaaaaccagcaaagctgcaaagacatcgcggccgacactgacgcacgcaacggcgcacgtcagatgagcccacgttccttgagatcgccggcaaatacactgggaattcgatgtttcaccgatccgccggcgccgtctcgcgcaccgacgcagtttctatcaaccactctctccatccaccaaattagccaaaagaaaaaggttcggttggtacttggtaggctaagctttctagctcgttttctttgtgctttggctcgctatcaacgagcagcctcccgcacttcacggcctaatctccatcaaattgcagtgacaataatgtactcttaaacgtatttaatgacacgtacacatgcagcgaatcccgaggacgtggatttatactgcaactgtagttaacgtgtcagcgcagtgcgtgcatgcgtgcgtgcaagcgtgcaaggtgcaactgtactgcatgcagcatgcgtggacaagacgtacattagctagttggtagtggcgctgtacgggagaggtttcgttggccggcggcgagggcggtggtggttgtgttcgccggcgccggcgaagagctcctcacagacgtcggcgaaggcgcggaggatgaggtggtggtggcgcgacgagttgagcgagaggaagcgatgcagcagctcccgcagctcgggggtggccgtgatctcgttctccacgatcatctgcgccatcgaccgccggaagtcgcccagcgggtcgtccgactccgtcaccaccggcacgctctcctcctccagccgcccgcgccgccgcctgccgcctgacgatgcatcgctcgcgctcctcctgtgccgcggcggcggcggcgtcgccggcctgatcccgcggtcttcccggacgcccagcgcgcgcacgccgcgctccagctcgcgcagctgcagcaggagcgtgcccacgctcggcgtgccatccgcgtcgtgcacggtgttcggcgcgggcgtgggcacggtcaccctcgtcgtcttcgccgacgtcgcggtagcacttgacgtcatcgtcggtggcgtggtcgtggcgggcgagatattgccggcggcggagagccgggacacgacggacaccgacttggcgccgccgcagccgcacatgaagccgcgcgcggccgctgcgctcgaacccttcttcttcttcttcttcgatggtaggccctgatcggccatgccgcgacgtgtcgtcgctttcatgtccttgggttgagagcaagtgagcttgtgcgctgtttgttgtggactagctacaccagctatagtggggagctagggggacagacttcttaaagcctgggcttaacaagagccagctaggtgaatttcagacatgctgatgcagtagcagcaattactcaactacagacacatttataattccaagtcattaaccaaaaaattagtatcacgctatccgttgttaggaggtcagtgtcagattctggtcgatttaccagcggtaatcttgggtcaatccagggtgaaaacaacattgacttacaaagtatagctcaatactatttctgaccgttcagttaatcggttactactcctatttgtttcagacttatacgcttaccattctgttcgtgtacagatgtactgatgctttcagattttgcataactctatttgcaagggaagttattacaaaacgcacgcaaggttgtactgctacgtcagaaacagggcaaagaacacatcagacaaatgaaaaactaacataccatttcccaagcttgcgcgcgatttgcgcaactaaatcccagcgaatagaacaaaagagcagatgacacgagacagaggaaaatccaagggatgtcaaagcgaagtgacgggagatttggatgggcctaattaacagatttcctttcaaggtcagagaccctactgcaaacagcaagattacactacagagtacagtacagtgcagaggaggagagatgccttggaagaaacactgtgctgggcctggacgtttgtttgcttgcttgtcacatgcatcttctgctggtaatacattccggccacgctaggcaaagtgctccccgtgctctgctgctcatgatcatgatcatgtcctcaacagaaggccaccaaacttacatgcttgctgtccctgcagctaaccgagattgaactagtgaagtgaatcagactgtcaggaggtaattgatgcagtaggaacaccaaacagcaggtgtaacagacaagtgtgtcttctttagagatactgatcattagatgatggtaatgtggcatacatcaaaacgaaaaaaatgcttcattagactgctggcctattctgcaaaaaataaataaataaataaatcgcattctttttaaattggcatgtcctgcctttttgagttttgactctagcacaggcacttggtactcgatcaaacatgttgtctcctgataaaaggtggcaactcctgtatcagatgcatcctggggtgattgattggaaacaagaatagttgtcttcgatcgttgtgatggacaaatggtgtggaatctcaatgatgtcttgattggcttcatggctgacggctcatgtctacctgggtatcaggcatggagcattacgaccggactcaaatgatggtatcagcgccggcgaaggcaatgggccaaactagggtcatatccagagaagtctagccaaacactgatcttaactcagcccaactgattcttggcccagtactacatatcatttctcagcccatctagcataaattggtagaaacagcccaaatacccgcaaaaaacagaaagcagcccaacatctgccttgtgaaaattgggcctgaaatactaacaagcccattatatccacttacaaaggccctaagtggaataaataaggaataagttcatctgaggtcccttaacttgtcaatgaatccgatttccgtccctcatccggaaaaccagacacaacgggtccctcaactatcaaaaccggtgcagattagttcattcggtggttttgaaagcggttttagctgacgtggcgcctacgtggctaatttaactcggtcttcatttgacgtggcattaacgtggcgattacgtggcaattcgatccggaaaaataataaaacccgtaagacccacgtgtaagtctcacacagaaaataataaaaaaaagtggtgggacccacagtcagtccaactcacctctcctcttcttcctcctctctccccatctccctatcttcatctctctctcctctcctctcctctcttcaggcgacggagaggcagcggcacgcggcggcagtgcggccggacaacggtgcctatgcggaggagctcggccgagcgacggctcggcgcgagcgtggccgtgtggcggcgccggccccggcacgggtcgcggcctcggcggtgcggacgggcagcggtgccgatgcggaggagctcggccgagggacggcggcaccatttctggcttccctgcctcctccctccccgcccacctcgccggccgccgcgcgccgcccgtctcccgtctccgccgcgcgctgctttgctgctggtgaggtgagagaaaaagaaacagtgagagagatgaccagttcgctcgcgctgcccgcaactttctcctacctccggccgtccaactcctcttccctctcacaggctcacacacttggcgcgccccttgatcaattcgttccccttctttttcttcccccttgcttgcagatgggggcaactagaggaagcggctgagacaggcagaggcggcgggcatggtggcgccgcatgcagaagtgtcgttgcagccgcaggcgcaggggcaaggggcacaaggtagtgagcctcgcgcagctgcacaagcggccggcggtgacggtgctcagtctcgagttagacgatggcgggtcggagcacgtgtcgacgacggcctcctccgcatcgtctctcctctccgagacgagctcgtcacgcaattcgaccagtacgagaacgagatggtgcatctgtttcaggatcatgtgagggtcgtcgttgatcgtgttgttttgttattgctatgttgttcagcgatgtttttctgatggttgtggtgtagctctgcttgcttgttgtagacggagaggctccatcgcgtgctcggcaaggcgaggcggcggcaataccagtcgctgctcggcgcggcggaggcgcgcaggatgagggataaggaggcagaggcctcgaatgcggcgcgacacatcggcgagctagaggagcgtgtcgcgcggctgagggcggaggcggcggcgcggcaggcgaaggcgcttgccgaccagttccccgcgc

SEQ ID NO: 55098 - DNA, 1834 bp, Oryza sativa
tccgcccaccacacgccgccactccgcttcgccccgccgcccgccatcgctccgcccaccgcccccctctgcgccgccgctcgccgttctgtaggggagagagagagggggatagagagaaaagggggctgacatgtgggaccacatgggccccaccttttcttattatttttttatagctgacatgtgggtcccatggtttttaattatttttccaggatccaattgccacataagtgacacgtcaatgccacatgggacgaggatctagtcaaagggagccacgtaggcgccacgtcatccaaaaccggacataatactgccgagggacattttctgcacggttttgtaagttaagggatgcgttgtatccggttttctagactgaggatgaaaatcaaactgggtgacaaattgagggaccgaaagtgaacttattccaataaataaacattcctgcttaacaatcctccagaaatagtttttctccgtggtactgggattgtagtcgtcatgctggttgtcatcctgggagcgaactcttgtgtttggaggtgttcgttctcgctcggtggtcgggttgtgactacggttttccaaaccctagtcacaattgtggccggagccggaataccatacggtaaccgtggtaattgtggcaaaccgtataaaatttatcaaaatttaaattatttttaaaatttatttaaatttaaggaggtttaccgcggtttttcttttaacgcaccccgtggtaagcgcgataactacgataaccacgtgcttaccggcggtttgggaaaacttggttgtgaccaaggtgttttttctctgttttcagaattgtgctgtcttgaactgtgtcttggaaaagctggttttcccagtgaatgatgccgtgatagctttctgtaaaaaccgggtcatatgacctactacacagtacgtatgttttatcgtttgtcttatttaaaaaaatatgttattattatttattttattgtgagttattttattgctaaaagtactctaaacatcgcttatatcttatgtatttagaaaaaaagtttaaataaaacgaatggttaaacctgtatacaaaagtaaactgcgtcatttattaaaaaaggaaggaggtgctttctaaaaagaacaatcttacagaaaagaaaataaatacggaccagctaaatatgttttagcagcccgccagtattcatggagtgcaacatcctacctgtataactatagccttgaatcttgatgtgaaaatggatgttctggccttacttagtttcaaattttttcttcaaattttcaacttttctatcacatcaaaacttttctacacatataaacttccaactttttcatcacatcgttctaatttcaactaaacttctaattttagcgtgaactaaacacaccctctgttcagaagagaaaacaggagttttgggacttagtaatgtctttccaacgccagcgccagcgtcaccatctttcttttccgatcacacggtcatcactcggtcaggttctcgtcttgcaaatccgctcgtctgctagctcacattcggtcaggctcctgccgttggaaaacgacacgacccaacgttccaacaagggggcagcagagtcgctccagttgggctgggagtctctgagcaaggcaaatcagtcttagctaactaaccagcagagacgtcaagcaattggtctcatctctttcagtttcataccaatctgttatcccccaaaaaacaagaagtttcataccaatcgagacgttttgttgatgtcgcaacaatagtagcccggctcatgttctccc

SEQ ID NO: 55099 - DNA, 710 bp, Oryza sativa
gctgatcgaatggtattcttgcattgcatctgatctgtagcaactagcaagtagccctacgtacattttctcgaacatgatgtgtatactgttttttttttttttttttttttttgagaaccgatgtgtatactgcatagtagtgtatctcgtgtttgaattggagggtagaagaatttgccggcaactttgaatttctgacgagaagggcggtatcgagtcaaaccattgcatggaagaaccatactaattcagatgcctgttgactgttgcccgtggtattaatggagaaattagccatctagagacactaatttcagccatctgctttcatttacttcgacaagaaaataagaacgaggaaatgaaagaaggtatagtaatgtgctgcaactaaagctcagctaggagcctaggacccatcagcaaaacagtcctaagcttttcgtttaggaagaaacagccactcgtaagcctgaaaattttagtgtcctttcaattttctagtgtatgtatctccacaaactttttcaactataaataaactgaagattagtcggcgagttctttattgcgcactggttttaggatcacaacaatccatagttaggaaaaggtttaagtctcaaccaaaagtttgatctgcgtatgcattttctcattaaaaataccccacaccatgaccatagattatactagcactgaggact

SEQ ID NO: 55100 - DNA, 844 bp, Oryza sativa
aatttgagctgttgtagatctttcaggcactgctgatataagtaggagagaacaggtggtttagatgagctgctcctgtaccacaatgctcttgttcaactgatccttcgctaccctgcaaacttgacacacaattagacagtaccaactaccaactcctctttagctcagacatgcagaaagaggtactcaattcagagtggttgatcttacatttgcattttccacagtactagaaagaaaagagggtgtagggagcacccgaaaaaaacagagataaatcctcacagggtttggtaatttgaccaaaataaccacttattcagatgcaaatctacattttacaaatgtgactggggacacaataaagaataaaaacaatgtgatcatctgttcaaaaaccagaaaacgttttttcctgttttaacatcctattctgctactgtaccgtgacgtcaggagatcatgaattagttctaacagactccaggtactgtaccacctctgccatgtttggtcgggcagatggtgtgttcgaagtgcataccagacctaatttgagcacttggactaattcagcctcaacaaatcccttcatgctccgatcaaagcagtctgacacagtcccatcctccaatatcgccctaacataatcacgcagaaccactgctgtcgccaccccagggctctccactggtttcctccctgtcacaatctcaagcaacaccacaccaaagctaaatacatcactcttatcactatatctcaagcttggagatgctaactccggggcaatgtacccaatggcagcatgcaatctactcaattcatagctacctagaat

SEQ ID NO: 55101 - DNA, 3709 bp, Oryza sativa
attcctgcagccccaactttccaataatggcatttgagccttgtctgccaggagatgcaagcatcggtgtgctctcggactccagcacctcatcctcctccttcccctcttgctcctctttactcctcctcatgtaagcctttatgttcatagcacaaacaatgcaaactccaataagtataagcgctgctgcgactatgacaattatgacagacacagccaattgtttcgccctccggctagccccacacagattgttcagtggaggtccacatagtaatgggttacccatgaaggcggagctaccgaaactctgtagaactggcaaggcagggatcatgcccgagagtccattgtaggacacattgaaatgggtcaggttagacaggttcccaagctctgaggggattggtccagtcagttggttctctgagaggtctagaagatcaaggtttgtgagctgtgcaagtgtcactggaatcccccctacaagatggttccgatgaagatcgagcaacttgaggtaagtcaagttgttaagcgtgtccgggatcactccttgcaattggttgccagacaaattcctgcagtagttcaaattagtctgtcagtacatgaaaccactgtaattcaaacgaattggactgggttgcgtagttaacagacactcacagctcaagcaagaactggcattggctcagggacaccgggatgtctccgatgagagcaagaccagcaagatctagtgtgacaagcatctcaattcctccgagctcggcagggattgaaccggcaatgcctgcatttcctgcgagcctgagcactgaaagcgacctcaatttcccaatgcttggtggtatgtctccagcaagagcattcgtccccaaatccagaaccctcaggctgcggcaattggccacactctccggcaccggcccagtgagccggttccctgaggcgtcgaagtaggagaacttggtgccgcacgttgcaatgttggggatttcaccatcgaaggcgttggacgagacgttgaagtaggtgatgtttaccaggccaagaaggccgaaaggtgccggtccggcgaaatggttgctcccgacgtcgagcaggtcaatgctccggcaagcgttgagctttccggcaatggcgccggagagcgagttgcttcggacggagatgtagctaatttccggcggcgcgcagagctgatccgggagctcgccggagaggcggttgtaggagaagtcaaacccggcgaggcgcgagcagttggtaatggcggtcgggactggccccgtgagggcgttgtgcgcgagggagacgtaccggaggcggaggcatgggtcgaacagcgaggcggggatctcgccggagaacgcattgtaggagaggtcgagcaggcggagccacgggaacgcgccgaggaacggcgggatctcgccggagagcgcgttgcggctgaggttgagcttgtggagcgtggggccgagcgcgctgaagctggaggggatgccgccggagaggccgttgccgaagagcgagacggactcgagcgacgccagccgcgccagcgacggggtgagcttcccggcgatgcccgcgccgtggacgcgcaggcgctgcacggcgcgggacgacgggtcgcacgtcaccccggcgaagtccacgcaggggtcccctcccgccgtccacgacgcgagcgcgccgttcgggtcggtcacggcggccttgaactccagcagtatccccctctccgccgccgtcgccgcgtccaccacccccacccaatgcagcaccacacccaccaccagaacggccgccgccgccgccagcgagcgcgtctgcctcatcgcgacagctggaggagcaggcgcagtgcgagtgcgagcgcatgcattacccccgccgcggtggcgacggcaccggcgctctacttctactgctgtgactactgactactactcccctcgtactgagagagagagacaaggcgcgccgagtaaaagagtggcgagtaggtggcggtgggtggcgtgcgttaatgtgcgggtggtgctgccgcgcggccatgagccctttcttccttgacgtcggttggccagaaaccacgttcttctgggtgtttggtgcgtggcgcgcgcggcgtttaccttcaccttacccgtggaaatctaggcgagacgcgcggtcaaaccgaaacgcgaacgcgaacgcgatcgggagcagcagcgcgcgcgcgcgcgacgtggtttggtgccacactgccaatctgccggcatgttgaggtgggcaggaagtgcgcggcgcaggcgcagcgaagggtggggtacggcatgggacgcgcggttggggaggaattttttctcttcaattcgctggctgcgcagccgcagccgctgttcacgtcaaccgctcacgcatcgtgccgctgttcacgtcaaccgacggccgcggacgtggtgtcgttgcccgtttcgcgttgcgtccgtataggtcgtagtactgtggcctacagggaaaccatgggtacaccacggatgcataaatgagcttattcactgctcgtccgtcgtgccggtacggtgctactactatggtgctaccaccgtgctgcggctgtacgcacagatctacagtaatagcaaagctactagtactgctactactagtattcattcaagcgtgagtggcaaacagatcagcatattgctgcgtgggcttcttgtatcatccgccggcgcaactgcgcgagcggacgatttaactactagctagatgtgccatctgccatgccatgccattgatgggaccaacataagatgcagtaggcatggtcgcatggagaaagtttgttggggtttggagttcagcgtgcctttctgtcggcaatgattcgtcggaacgtatcatcatggaccgacgtgcttgctaattaccccgatgatgcgttccagtgccatggctttcgactctcaaagcctgaactgcaaggtctctgtcaagatttggttaccaacctccacaaaagcattgccatggatgaaaacgatgccatcaccgggtccttaattacctcaaatagtaccagatccttgaaaaattgaaatgaacagaaacggcacgatcaaacttggcggaaatgaaggaaagaaacgtgctacctcatctactctactctacatgtctgtttcagaatagaaaggtctaatctgttatagtgctttgctacgatacccaagtactccctccgcccctaagttcaaatttacactaggggtaccaagtcctaacatctaaatcgatcccggcaaccaaatcgagccatcaaattgttcatgaattcgatgggcatgaagtaatgatctagcaatgtggcatttgaggtctgaagtactccaagttgaacttaattattcttctgttacccaatgtgtacaaacatatcacgtacaagaccacaagacaaacattatagcttacactctcatcgtctacttgttagcttatcagtcataagactcacaacaataaaaagtttaatttcaaaagaagttaaaccatctttttaaggagtaaagaggggttgtggcatcttccccctctctccccagtggtgacctcagatgacaaggagaacacctcaacggtgacctcagatgacaaggagaacataagctaggccatgatagtcgaggtggtagcatca

SEQ ID NO: 55102 - DNA, 838 bp, Oryza sativa
gtgaatttagatttgcagtatataacttacaaatgacacctgttgccctgttggaacacaggttctccaaaaaaattggaatacaaaacacagcatacacacaagaggaaagtcacacctacttgatgatctgagatgctgttgttgaagctactcttgtctggtgctgcaaaaggaagaacagcaattcattatccaacaaagcgcagcgcctaaggttcaaaccatggggcagaatgtaatgtagaatagacagtgttaaaccccccaaaattgcatgacctataaacaattctgaaatagcccatgaccagccaattgaaatctctcctaccatccaccatctctgttgactaacaaacaaattttccggtgagccagtgcagatctaggaggaaggcactaggagggcaaggactcgtaccctcgggggtgtcgctatcggagaactccttgtcgagcacgcggccgaacatctcggcgatgctgccgtccccggtggcgttgcccgagccgttggtgaccagtttcccgtagaacttctcccgcatctccttgtcgggcctcgccgcggcggagcggagctgcaccccgaggacgagcgcgagggccaccaggagcagcgcggcggtggagcgccggcgagacaagggtacccgtcccgcggccgccggggccatcggatcggtccggcggcggctcgaccgaccggccgaggcggaggaggcggaggaggaggccgcggcggcggcgggagggggagagattcgcgggtggcgcgtcggggtcggtggattttgattccgcgggaagattggtgtggttggcgcggtggcgg

SEQ ID NO: 55103 - DNA, 3668 bp, Oryza sativa
cggttggtgagtctacttcaggggatcagcattccggaaccttcgaaaagagcgcctcaccttgttcgccgtcatcggatggctacttcctacctaagaattgagcttggaacgcaaatgctggtgcgctgatccatttcgccaatggaagcacgaaccgacaaggcggcaatacatgatgcggatgcatgctctcaagtctgaatctgatgaaccaatcaagttttcctagccatgttaatttggagagatctacatctactccaggtgactgacagacagatagcaagcagcaatatatactccagaacggtaaaatctatgggcaaagcagtgaaatcacgtgtatatttatgaccttactgtactttacttgcaaaatgtattgtagtagtagttctttaaaaacaacatgcagcctcgggattctacaggtaaagccccacttaaatcaactagctagtcgtcttcgaatcaggtctaccctcgtccctcgtccagtggttgttctgtagaagaaaccactgctttgtttctttacggcagacgtgatctgaaactggcaagaaacagtgccaacgcccgtccaacgataacgagatacacgcaacagaagcgtataaccaacaatttctggaatcattttggaaggatacccgacacagtaatggtctaccggttttcatccaaatggcagagcagaacgaacagtcgaaacacccgacccgacagaacggcaaaaaacgggcctgaatgccagcctgaaccggcaccgcgccaccgccacgtcgtcatcgtctcgattggcagctgccctctcacttccccaccaatgctagggcctgtttgttggaacttttacctgctacagtttttctcaaaatcagaaacttcccccaaacaatctagctttgatttgtataatctagaaaataaactataacccaaaacttaaaaaacctagcttctttaattctcataagctagctaccaacaacttctcggaatgcatgccctagatctcctgcgctgccatgccgcatcagcttagctagcgccttcacgtgcgcatgtgctcgctatattatccaaatcgcaaaaccatccaaggcgcgcggcctcaccaaccaccacgcaaacccattgttaattaattagcggcacactgtcacggcgcattatttgctagctccagtgacagctcactcctcttcttgctgctgagggcttagctagccagtccacctcgtcggtgtgtgtcggtgtagtctagcagctgcggcgggaggaggagttgccggccggagatggcagcggcggcgcagcggcttgtcgccgctgtcgtcgtcttggtggcctgcctggcgttgccggcggcgcgggggctgaacatcacggcgatgctgaacgggtacccggactacaagatgttcaacaagtacctgtcggagacgaaggtgtgcgacgagatcaacgcgagggagtcgatcacgctgctcgtcctcggcgacgggccaatgtcgacgctcgtcctcgacgccgaccagtcgctggcgggcatcaagaacgcgctccgcctccacgccatcctcgactacttcgacccgaagaagatccgtggcctccccgacgccgacacgatgaccgacacgctctaccaggccggtggggacgccgccggcaagatgggcaacgtcaagatctccaccctggacaccggcaagatcgccttcgcgtccgccaacccggggggaaagtacgaggccaccatggtcaaggccatcaagcagatgccgtacaagctctccatcatggagatctcggcgcccatcgagttcgacggcctgttcgacacgccgtcggcgaccaacctgacgaggctgctggagaaggccgggtgcaagcggttcgcgtcgctcatcaccagcaccggcgtgctcaagacgttcgaggatgccatggacaaggggctcaccctgttcgcgcccaacgacgacgcgttcgacgccaagggcgcccccgacgtcaagaagatgcccagcgccgacctcgtcacgctcctcaagtaccacgcgctgccgtcgtacaaccccaagccgacgctcaagacggtgtcgcgcgccatgcgcacgctggcgtccaccgcgtcggggaagtacaacatcacggtggacacgcggggcgacgccgtgacgctcaacacgggcgtcgacaagtcccgcgtggcggccaccgtcatcgacgacacgccggtgtgcgtgctcacggtggacaacctcctcatgccggtcgagctcttcggcgacgcgccggcggcggccccgagcccggacgacgcggcgcccgccccgtcgccgtcggtcgcggacgcgtctccgccggcgccgccgccggccgacgcgccgtcgaagccggcggatcacaaggaaatgaaggcgtcgtccgccgtcgcgttgcggtcagtagtgctcggcgcattagccgcggccgtgtgttccttcgtgctgctttaagcacaagtttttttttccctttcttccatgtccagtgccggtgattgtgattgcacgagctgcattgccaattattcctctgtataatgcgagcaaactgtgtacattttgttctaattctgatatccttttctccgaatcgtctgcgccatttcggtgcggtgaatttggaagaattcatgtcgcgttgagctgtacaactgtagatcatgtgagttcttgtcctttgagcgcgtcgtcatgcaggcccaccacagcaaatgcgggtgtgttgatgtgatcttgaaaaaacagattcgggcgagagagctagtgcggctgccgctgcctccttgtgctggcattggcagctcctacggatttcgatcaattcgccgtttcaggaccaccggtgccagtaatgcccgttggccgtgggttatttgataactctatctagtctttaaatatttttagacaaaaataatagaaatttaggtcatcctattttgaacgcgattctcaaatttaatagactaaaaaattaaagtcccttaccacctaggacaaccacaatgcagaaatacaaggggtattaaggggctgtttggttgagcgccaacctttgctacagttgtgacaattaaatttagtgtttggttcatgccacaggtgagttataccacttttttttttagcaagctagcccacttgtcattgagtaatttttttaccataacttgccacaattgtggcaaataaattcttagccatataatgtgccaaatattttgtggtaaactatgaaagttatgaaagtcatccaaactatggaagcctctaaagtggtccttatacattgtaggagtagttcatatatatataatgcctagccataagaataaaataacaatactttcttttctctctcacataacatacaattgagtgggaccagtaagatctatgctaatgcctcatcttatcatagcatattgtagcaactaccataattaatatcaggtcccatcttattacccaagtagacattatacattaagcatgccctaagggcatcagcatcagcaatgtttattcccaaaccaagcaataagggtgggcccgttgtcagggaaaatatctagcaatgtgtgtatgtaacagagggctgcagga

SEQ ID NO: 55104 - DNA, 1183 bp, Oryza sativa
ataaaagtgaggtgggacccatcatattcccttactaccggcaataaacttgtaacctggtagtaactatttactactgtcacaatgtttattacttgataacaaacccctatttaatgcttattacctgctctagcactacattgtggatgcagttgtgagcactgtgtagttaatccacggaagagtaaattacacttctagggctcgaacttgcatggcagagaaaggagtacaataatttggaaacgctttttctgctcaacttgttcatgcgaaccaagaattcaattgaaatgcgggatgcacgggtatagccgttcagcgatattagtacagatttaactatttatctgtggagaataatacaaatttatacacatgaactccataaaagtaattaagaactaatgtcctgaaccctgatcattgctaaaggtcgtataaacaaatacggtatttacacacggaattgacatgctggcgtttcttacacactacactatccaattatacatcttatgttacaagtaagaggatatatttcactgtttgagcgaagttgtaactacaatagatacaatatgccctgtggaatatttacaacatacatacgccaaaatacttaaatcttgaagaccacaagcacaaaatgggtagagaagatcagtccttgttgcgagaggaccgctcccgctccttcttctgaccaccaagaatccgagagatttgcagtcctctactgaacgcttgattaaatagcatccgtgtctgaaactcggacacaaagggaaaccatgccaaaatagtaattggtgtaaagagaagaactcccataattatctcgtatgcccgagcaagggcacgaacagatccccatagccctgctcgccgagcaagaggcttgcaagcttgtgcaatctgaaagagattgagcaacaatgagaaatcaactaaagcataaatgaagttaatgagcagaacaagtaggagaaagacaaaccagcaatattccccatccggaaggtaagaatgccagaaagcacacaaatatatctcgtaaggtcatatgaagtattgctatcagtacaatcaagatggcgatgaacgaaacaaatatcataaacttaatcagacggaaaaatagctgaaaatccgcactaaatctccgccttccgacaga

SEQ ID NO: 55105 - DNA, 878 bp, Oryza sativa
tatcgtggtcgcgacaaaagatatgagcaagttggatttgtggtgtttgtgcaacgaatcagcaaaatcttacagccagatcgttggaaaaggtcgccacggaagaagcagggagagtaccatcagcaggacgagctcacgagaacgagtttttcgtcctgtctctccaacaaccaaagcgtagaaacatcgcgatttccacgtgcgcaataattcatcctataataatcttcttcttttttggaataatccgatgatagtgtaggatgtatggcacatatgctgcatagtcctataagagcaggtacaatagcaggctacaagccagctataaacatattttaaagagataaaagaagagagagaagagcagcgggctacatatagtcagctgcagcacggatttcaagacgtaatatgtgtatgactagtgagactaggtattaatagtatagtaagcaactattgtatgaattggctattgcgttggttatagatgatttggagctagtagtggactatactattaaacttgctctaaagcactcatcgactgcaacctactcccaaacatcaaattacacggtttttcttataagataaaagtatcaaagtgattgtaccaaatgcattttggagaggcattaaattacaccatgttgtaattctatactaagggcccacgaaggattggtaaaaaaaataatcataggaataattttcttaggatttttcttcctatataccctatgatttttttaaaaaaaaatggatatatccggcctctatatataaatcagatatacacagtaacacagctattgatggaacatgccagttttgcgagcgcttaggatccaacctggatgggctacgtg

SEQ ID NO: 55106 - DNA, 1734 bp, Oryza sativa
attcctgcagccctgtcttagaaccttgtctgtgttttctactccatattataggattaaagaaacacgctacttcaatttatatgtttttcctatcctttatttctttattcctataatacgttttaaagggggttaaccatttaaggaaatagttgcctaataaaaagagttagtacggcagtagatcagatattcagatactgtagtttcaaactttcaataactgtagtacagattattattattcctgcatactccctccgtccaaaaaaaaggcaaaccgcgggtttgcgtgccaacgtttgactgttcgtcttatatgaaatttttttataattagtattttcattgttgttagatgataaaacatgatgaatactttatgcgtgacttatctttttaattttttttcataattttttcaaataagacggacggtcaaacattggacacggaaacgagggtttgtctttttttgggacggagggagtactcatcctatgcaacaaggctgcgtttagttccgtccaaagtttggattttgattgaaattggagatgatgtgactgaaaagttgtgtgtgtatgacatgttgatgtgatggaattttgcaaactttagatccaaacacacccaaaagtggaaaagaaaagtgaggttggtggcgagcagatctgtttcagtttcgcagccatccctacaaaatccgctcgctcgcaggtctccgcctcacaccaacacacggaacactgggctggcttctctcttcctctgaagtctgaaccccacccccaacccgcacgaatccactcgcccctcgcgtcgcctcgccgcaccaatggcggcggcgtcgatcaagctctcctcctccgccaagcccctcgcccccgcgccggtctcccacctcctccccctccgcgcgcaccacgcgcggccgctccccgcgcgcctcccgccgccgccccgcgtcgccgtgcaacacaccgccgcgcgggcctccgatgcctccccccgcaccgcctccttcgacaaggtgcgccccgcaatgtctcgtcgcttctccccctcttcgtcctcatctggtccggggctcgtctcagccgtttgtttgtttgtttgtttgtttgtttgttgtggtggtggtgacgtcaggtgctggagacgctgatcggcggtgaccacttctcggaggaggaggcggaggcgacgctgcggctgctgctggaggaggagaacgaggcgcgcatcgccgccttcctcgtgctcctcagggccaagggcgagacctacgaagaggtgggtgcgccgcctcagccgcggcgctaattttgatttcgttctggtccagagatgggagtgagagatttctccgccttgttctcagatcgtggggttggcgaaggcgatgataggctgctgcgtccgggtcgacgggctcgatgacgccgtcgacattgtcggcaccggcggggacggcgcggacaccgtcaacatctccaccggctccaccatcctcgccgccgcggcgggtgccaaagtcgccaaggtactggctcctcgcccctttcatttgtttatgggagattatacatgcgcatgccattttcccttcagtttgtgctccaattggatttaggtagtagtactactagtggtgatgcactaatgtgttctcgcttgcgttttgtgcagcaagggagcagagctagctcgtcggcctgcggcagcggg

SEQ ID NO: 55107 - DNA, 4866 bp, Oryza sativa
gctatgaagagtagtcgaagaccatagctccctttcgtctaaagacacgtgtgatgtttacagcatgtgtatttttttttctgggaataaaaggttaggctacaaaagcaggccacctgcatctcagtggatcacaaagttccagtacaagtggtttggtctgttcatgagatacataaacagagggagagattctacattagaactacaacaccagtatccatacccataatacataacccaattcaaacctttgctccaacactgagggtgctgactgcagagctgcacatccaccaagctgctggtagcggaactagaaaattttgtagagcaggccatgcagtaggaattatataagcatgttccaaatgatagatctatactcattctagtgctaaattgtgtaccgcgtaaaatagtacgatacttggggataggggtagccacggcccctgccagtcctctgtctctctgccactgcaagcagatatagcttactgaaaatttgtgctgaccactgaggttggtacctccaaccttcatctgactgaggtgcgaagcacgccccatttgtctagttgacatctcagatctactacatagatgtgtagatcagcctctttatggttctatcatttgtttaggtttgcttatcggtgtaaaaaggcacaattgaattgttggattccagtaattggattatgaacatcaacatttgaagttactgtgtgcagatacacatagcttgttcttgtagtcacaaactgaggctgaatggtgttacatatttagactcgtctctagatatttgtggacaaagggagtagttaggaattctagatgtagtcgctccatttatttataatgtggctgtttcttctaagcacagaaaggctggttgcccctggcttttcaaattttacattattcactattatatgcatcttatggcatcagaaacctggtggggtttatatatattattgtattttcttttttcagggtattaaacgatgtgtcaatgaggtgggtgttggattcatgatgtctgcaaactatcatccagcaatgaaaatcgtgaaacctgtgaggaagaagctgaaaataaagacagttttcaatatccttggtcctctcttaaatccagcaagggtgccttatgctgttattggtgtttaccacgagaacatagtaagttccttattcatttcttcttttcttctagtaaatcatcaaagcataaatagtatgatatgcaagaaaagattttttaaagtgacaatttaatatttcgttgacccacatgatcgtcatcatcaccactattgtcttggttttatacttaaagtaggtgtagggcagtttttaagttgacaaatgatgcgagtttatattaaagaccttaaaggcaagcatcagacatctactgttgagctgttgaaccgatgttgctcaattcagagttcagatataagattctccttttccaatttttagtgaacttcatctttagcaaatattgtgttacttgacttgcagatacatggttataaagctttttttcttgagatgtcagccccgctaaaagctatattgcagttgctggttttccatctagtgttcattgttcatccctaatgaacatattttgttttactcaggttaccaagatggctaaggcagctcagaaatttggaatgaagagagcattggttgtccattcgaagggtttggatgaaataagcccacttggtacggacacatactaatgtatccatttcaccactgtgctacactgctgctaaaattccatgattcctcaaaaaaataccttggaatattaaaactaagtgttctgcatttaactgagaatttcttttatcaatgctgtagggcctggatatatccttgatgtcacaccaagaaagattgaaaaaatgctcttcgatccatgtacgagtttttttttctatgtttttctcagaatttttagaaacagagactgtttattggactcacttgtgtaattgagcgagtcttcgagtttagtctcatcaattgcatgttttatgcacattatacttatttctaattatgcatgctaacttctgaaatacattatgacgatatgatacactttttttttagtctcactttttaaaattatgttacaatccagtggattttggtataccccgctgcacgctggaagatctaaaaggaggtgatccagcgttcaacgcaaaagttctccaggatgttcttgctggtcaaagaggttcaattgctgatgctctcgtaagttaatcattacagttatcctctctttctagttacttctactttctaccttctaaacttcttgtaatgcatttttttacaatgaactcagaattctgcagtggttagcctatctttaacatacgaatatttcataggaagttcttcaatagatgggggtttgcagtgcgccctgtcataaacagcttaccgatccttgtcatgataggatttaattttgtttagattttttttcacaaatcatatatgacacttaattattaccttgcacacgttgagttgctttgctatgcaaaacattaatcaatctttttttcttcataggtgctgaatgctgcagcatctcttcttgtcagtggtaaagtaaatactttgcatgatggtgtagcgttagcacaggaaacacaacgctccggggaggccatcaacacacttgaatcctggataaagatttccaatgtaagtacttctgataattaatatttgcaaagcacattttgtctgtcagctaaatatgaatctgacgccctccggaaaattgttgatacagagttgctgagactgatgttggttggccaacagaattcctcgataagatcctcaccaaagaaaaaaaagggattcttcaataagacctgaggaatgatggcaaataaggattattttaggttatctttgtccatagtgacatatttatgtatgttcgttccaagtgccatctggggtgagattataaggttatggttgggattgtagcttcttttctagtctatttagagatagatgactcttgtttagagatcttggtagtgcccgttacattatgtgctagtgcaaggcgtggaaggaaaacggagctatacagtatatctgttcaatgttgcatctcaattttgtaaaatgcttcagaaacaatacatatgattcatctcgactgcctcccattataaactgaacttgagttcacaacgataccctggatgtgcacgcaattatggaatcatttccaatatgcctatcttcagtttttcacacacaatcagttcacaagcacaaaatgacactcataagtatgtacaaaaccatacattagtattgatacacccagtggtggcaggcagataagtctgcgctagctatctaagaccaaaacgatggacgctagcagcagcattcagattttctttggggaagaagcgttgtgtttcgccgccttgaggatcgcggcccggatggcggactcgttgccgtgatctccccggctcgacttgcgccaccgccgatcccacagcagcgaccagcaccgcacggtctcgccatctctctccctgcatcatcgtcatcatcagttcgtttcacgtcgcgattagcaagtcgatctcagaattgccggcattaaaccagacgctgcgcacgctatctggtccacgaattcagtgagacaaggacgcgtccccttgtcccgactcatgtggttgcgtggtaaccatctatccgtttgtacgacactcgcttcccttgctttctccatcggagtaggtcgtcgcatttacagtaactcgtactactcgtgtaaaacagtaatctgtagcatgtactactggatataccaaacagtaacaggtggaatgatgtggggaacgtacaagcagtcaagcaggttgatcttcgttttacagattgcgcggatcagcaggcggcatctagagtaggaccatttctatgtagactcgttttactttacctttggaattgccgtgccggctttgatgcttatacgttttgcttttgttgactgtctatgtacgggtttgattggtcctatgctgtgggagtactatattatcgctagctgaataaaaacgaatttactaaatagtacaatatttgtgttgaaaaagttggttcttctaacgaatttctgtgtgttcttcgtgatctagtactaattaatctccttaatttgcaatcaaactgatggagaacatagagatggagtgttagttggagtcagaattgattgattacctcttgttgcgatcggagcagacactggcggtccggccgccggagaccgacggcggccggccggggccagtggtgcgcggcgcggtgaagctgcgggtgaaggagcgtggcatgtagaagttgagcaggacgccgtcgctgctgctgcggaagctgctgccgcccgcgctgtcccaccgcctcgccgaccccctcctctccggcctccccgccgccgccgccgcctgctgctgctgctccgactgcctgccggacgccgtccgcgccgggcccggctctgccttcccctccgacggcgaaggcgaaggcggcgccacgccgacaccgccggccttctcgacgaggtccgtgagcgagagctcgtactcggactcggggaggtcatgcagcatcccgagcatctcctcccgcctccgcgcgatctcctgcgccctcgccgacagcccggcgtccaccgcctgcgggctcatcccgggcacccacatcccggccgccgccgccgccgccgccggctgctgctgcaactccgagctc

SEQ ID NO: 55108 - DNA, 10721 bp, Oryza sativa
  unsure (1)..(10721): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttacctacgccctctggattctaaagaaacacagaaaggtccataaaccaggactcgatcgagaagtattattgtaaaaattgtgggtgtgtaagtgtagattgaacgagttctgtttctgtaaaaaacgtgttgccgtcgacgtacgtatttgtgagtttccgaggccgtccatcctgctggttagagaaccgtactacagcctagggattcatgcaggtttgacctgtgtatactccctccgtccacaatataagagaattttgagtttttgattataacgttggaccactcgtcttatttaatttttttttgcaaatataaaaaacgaaaagttatacttaaggtaccatagataataaagataataaagtaagtaaaaaaataaataataattttaaaaatttttgaataagacgagtggtcaaacgttgtaaaaaaaactcaaaaactatgggacggagggagtagtaggactactttgcattagtcttcgatcatgtcctcttctttcggttatcccctgtaactagtgatatttaatccgagggctctgattggttgataacgtgaaaccatgtgaagggtagagcccggcgcatgattttcacggtgggtatttaatttttaaactatgttattaataaaaaataaaatgtatcttttgagttttaagcttagatagaaagctattttgtaaaaagaaaaagttaaataccctcccctaggcttacatggaacaagttttataataattaattataattatattgataccaactattcaactcttttaaaaaactctaatgatggtgatgagtgatgaatccgttaccacccaccaactgacacgtggagacttgaaattggtgtcaccatctactcctactatcaccagacatatgggtgccactaaatgaagcatgtagactatttattcccaagctatgaaatctatacttctttaaaacaaacatagattttggtaattgcaaagaggcactacttcatcccatggatggtagctctatatattggtggtgtaacgaaaatgtttctcctcctaaaataaatgttccttttgacagtcaaaattaaggagtatgacctagatatatgctctctattacaccagggatagttggaagtgaaataatgattaggataagatgggaaaaaaatgaatgataggtgattggagaacaaggactactctagaatatcattcttattgagacacatttaatacctaaaataacaattattttcatatggcaagagtattttcttttaaaaaaataacacagcgcacgtacgttattttctttttctaactacttcataaattatttaaaaaatattagttacatatgtttgaattacattactgcatttcccggaaaaaaaatgatacattattgtgtggaacgataaacgacttactaggatgcttggaggtgaagaatttgacgcgtctactgctgctcgctgcttaacttcgtgggaatttcttgggcactaaagtgtgttgacctaattaacaacacaggagctgataaactcaccttagagcacccgcaatggtaaagtaatatgttatctacaaaatatgtacatctcagcaatagactagattaatagtaaaccacttcaatggtatgtctacataggtatctatagttctctaatgcattgcctcgtttttctctatagactatctccaggttaatagatagttttgctctctctcttcatttaatctcttctaagtagaaaaatatgctgatatggatctcttgtagagagcttatagataactattacgggtgcccttaagtagtgttttatggtaatgatgggcgctacaaacaataatttcaacggtcgtagttaagatagaagtcagctgcatgatacgctaagctcatggaagaagatcgatattatattacatgtgcattgcatatgcaagcaaaaacacgcttttgctttgaattgaattatccagggaagatcagtaagtaggatctggctataatattcttcaagcagagttttctgatagatatggaaggagaggctcacatgacttgaattttctaggtcaaatccttgactggccataagagaaatgcgtcattgtcccttagtgagtttgttggtatttccgcgagcgagcctaagggtaaaatattgttgaaactcgaaaggatctgctagtaaagtaggattatttactagcaagaagtttgaaaatcaaatttgctagtaagatatcttttagtccaaaatctaatcttttttcaagtagatttttaaaacttgatgaaaggtggcgtcgcttcatttttcttttcctttattcgtcttgctttggtttatgttgaaagaaaaaataggaaacggaatattgcattggccaacagttgagaacgtggaaattaaaggggaaatatccaactggcctctgttttttctcgctgttatttttagtatttgaacattttcccccacttaattatgttcttgttttgtttaagcctatactgtacacaacaatcctattcgcatatactatttttttttcttgttacaactatctacttcctccgtttcataatgtaagtcattctaacattttttatattcatattgatgtgaatgaatctagagatatatatctatctagattcattaacatcaatattaatatgggaaatatcagagtgacttacattgtgaaacggagggagtattataatattttcacatcgagtcaaacctcaaaacgaaggaaaaaaaattaatgtcagctgtacttaggtcgatcagaagcaagctagatcacatcctaccaaggccaattaattactggttgccattatctgaagcaaatgttgatctacgtacatccaaacaataataagatacatgttcatttctcgaaggaagtttcttggcgacaagcatgcaaagtttaggctccaaagaaatcagatcgatcacaattcactatatattgtgatcaaccaaaagtttaggcaatctaaatacaaattaaatgccacaagttaaaaataataattgtgatcgacgcatcaagccacagatcttaatgctacacaaattctttgactgattggaacgatgtgtgctgcacacatatgacacatcacacatacggtgcgtttcgtacgaaaaaattttatatgaaagttcctctaaaatatcagattaatccatttttcaagtttataataattagaactcaattaatcacatgttattaccatattgttttgcgtgaaacacttaatctatatcttcatcttcatctttagaagattcaaacaccaccaccacagagcgcaacttgcatgagagatcaccgttaggcaaacaagatccaatcaaacagtgtgcaatctttttttttctttgaaagaaggtgtgcagtttttttcttaaaaaaacaacggaaaagaaacagatgtttccagctgagtgaaaatttaatatctgtagagttatgacctctacataactaaaatctaactatccataataagtagtactctgttatatttatgaacaaattttaaacattcagaatacatatatttgtgaacagaggaggtatttggggacacgaatattataaatttacctaaaccacactagtaaaaaaaggtttttccagacggccaaaacagcatttttgtgtgcggatcacccattcgtctgcaacaaaaagtctgcaaatatccgattttttcgtgcggtggatgtgcgggcgcttaagtcatccgtacacaaaaatataaaattgcaacaaaataaaacaaaaatcaaagccctagccctcgaaccctaatccaaccgccaccgtcttgcccaagacccgctaccgtcgtcctgcccgaggcccgctgctgttgtccccgcggtcactagcgatggatctagctgcccgagacccggtggcgacggatccgacgctgctctcggcgctgccgttgctgggagaccaccgccgcaactgcagtcatcgtcgtcgcctacccgaggcccgccgctgtcatccctgcagtggctagccacggatccgccctccccgtggtggcaagtgacggatccaccctccccgcggtggcgggcgatggatccgccctccccgcagtggccggcgacggatccgccatccccatggttgccaggagaccgtcgccgccaccctagttgacaccaccctcgccgatgtcactgcgaccgccgccctagccgatgccgccgccatcgctgggagtgggtagagggggagagggagtgggaggagtgggaaggggagaatatatatgccggaaaaagataagtggggagaaaagaaaaaagagttgggagagatgggagtgggagagatgcgcgctattttcgcatgcgggtcacttaacaggcccatatactaaaatactgttaatgggcccgtctgcgaaaatgaattttcgtgttcggctcataaacctaacacggggaaatgatttttgcagactatatagtatttatgatctatataaggagggtctcgtccagaaaaattaattttgtagtagcgctaatttattcaatttcaagtggatttaatggaatctttcatctagtcctcaaggatccaaaacgaatgttcggaaagattgaggctgcctacaccaaaaacagacggcgtatctgctcacggtttattgtctgccatgtgagtcagtcaattaacaatcgcagcaggttgcatctggttatcaaattttaagtgatgccattgacctgatgcaagggaatgccctgatcagttcatgtgtctcacaatattaattgcaagataaatagtgtgacagaactgccatgcaagagttgcactaattaattattactagttaattagtttgaacaagtcgcacggtcaaatttaactgtacttttatttggcccttggatcatatccttttctttttggtttgttttggaaattggatgcttggagatgaagttaagctagctagtgcctattggtggttaaatgaacgtcgtcatgctttggtttaaagaagttgtatggagatcgaccatggatccttactataaactgcattatatttatgcatttttactttatttcctagcttgcattggttgctgcatgcccgacaactttcttcttaattaagaagaagatcaacttgcatttaattaatttcctactagtactgatcatagtgaaggtatcagatgaacaaagggtctattggaaaatatgactgtactacccttctgcatcttatatactctctccatcctcgtatgtaagaacctacgactagattcattgtatcgtagggtcttatccgatcctataggtaactatattacgagacagaagaagtattatatataccgtaaaagtccattgaatactctacaaatgttcttagtatgcctcgtgcaaaccaactttatcgtaaacatactttaagccaagtaagtatgcaaactaactccatcgatgctattcccagcatggagatcagttccatgctgtacgattagaagggatgcggtcatggaaaacccgattcctgtacatataagagaaggataaatacgtataattattcgtaaaaaaaaggcggaaaacatacgtacgagagatattcgctgagaaaaacatgcatacttcgtatgcttgaaaacaaactatattagtcctttcccataaaatcctcaaattaaaaattaaaaggttattatatttgtacatacatacatatgagcttctctcttatctgtggcttgagtaggatctatctaaattaggtcttcaaacataataaaaaaaaatattacatcccatgttaactatatttttaaaaaattatcacatagacaatatcctagccttttttaatatctttctcatcaaataatcttaagtatatattactctctccgttttatattataaattgtttgactcttttcttaatcaaacttacactaatattttcaatagaaaataaacatattatcaaaatatattcaatattaaatttaactaaactgatttagtcttgtaaatgttgttattttcttataaactgtcaaatctcaaaaactttgatcaaacgacttataatatgaaacggagggagtacttcgtatttttaaataattaagcacggggactaaattcatttataaactttgactgtttgtcctctatgtatgaaatttataaatattcacaaatgatctatttgtttggcagaaaaatatagaccaattaaagatatgctaatgggggcaaaatcactaacaatcatcattggcttcttttaatagcacaggattagcttctttatatagtatagataaattatatatacgtgggttataacacaagttgagccttatataaatttaaagatgacacctaattatgcgtgtatagcttcatctgataattatatcccatgagcttaagttaaaccagcagatacctagactttccaatccaattggcagtcccaggttatgggcctttagtttaaccttttgttaaacaaaatccaaatagactccccaatgtctaataccattggcatttggccaacagttcatgtctgagagcataattaaactgaacaaagtacgcgtaggttaagttatatatgctccaaaaataacgaaacttccaccaaattcagtgcttcgataattgagttcagacaagtgagcctcacatggatataatttttgggaggtacagatacatcatctacaaagagctcttgatactcctattatttgactatagtttagtatttttcaatgcttggtaagaaacaattactagccttaacaataccaacattccgcaacatgacatgttaccatgacatgagatcttatataaatctacacaataacttggaccataaataatctaagtttgaattgcaatgtgtgatggtgacggattacatgtgcatgatagctagccagtagctagtattacatatgttgacaagtttgctgttgtcaacgtttgttttcaactcttatcttctaaccacctacagtgatatccacaactaggagaactcataggaaggttcctaaaactgattaataatcacaacaagctcgacgtgatctcatgatagtcactcaaattaggaatatatatatatatatatatatatatatatatgtgtgtgtgtgtgtgtgtgtgtgtgtgtgtgtgtgtgtgtgtgtgtgtgatggcacgaccatgtgaaaagaaccgttatgctatatttgaaactttgtgttgttttattacacgcggtaaagaacaaatccaacatggaaattctgcagcatgatatgatagttttgacatgtctaaatgcttgaattcaacttgatctgaacaatcagatgcaagtttttgtgagttgtgaccatgtgtttgatgatgactatttggacttctgtttctctgctgtataatatattatgtttggctcttcttctcctttttttcttgaggactttgtttggctcttcttgaataccaatctacacgaggagctactggttgctctgtgttttctcaaataatagttagcctgtaacttaatttgatagttatctatttaaagatcatatggaacattcataacaaaaatgaaatgtttttcccaattgcaatatgctgatctgtccactcctagagctgctgatgtgcagtaagcacaatatagtaggaaatttagtaattaaaaatttaattactaatatatgccaaatatggcgcccaaagtttagataatgtggcatgttagtaccaattaatagttttcttaggactataagaaggtattaagttacgtcatttttagtgttaaatttctagcatatctgtatgtcaaatattaggaataggcacccaaagggagtgtctagatctaggggtgtaaagttttggcatgtcacatcgggtataaaactaattacagaatccatcagtaaaccgcgagacgaatttattaagcctaattaatccgtcattagtaaatttttactgtagcaccacattgtcaaatcatggagcaattaggcttaaaaaattcatctcacaaattagtcacaatctatgcaattagttattttttagcctatatttaatacttcatgcaggtgtttaaacggtcgatgtgacagggtgaaaaattttggggttgggtctaaacagggcaaaaatgtacatagtaaattccatttttgtgaggaaaattttcattattattattataagaatatatatagaatgcttatgtacctttgctgctgattttacatcatgatctgcacggggacaaactcgtatctcttcaaccacagattatccaatacgtgtgacttgtaaatgtacaaaataattgggatcacaaataatccaagtttgaattgcatgtgtgtgatggtgatagattacatgtgcatgctagctcgctcgtagtgccacatatgttgacaattttgctgttatcaacgttcgttttcataatatactaatggtcttatcttttgaccaccaacggcgatatttacaactagctatgagaactcaagtgaagtttctgaaatcgattaataattacaataaactggatgtggtctcatgatagttttggcatatatatgcgagggcacaccatgtgatcaaaagaacccttttatgccatatttgaaattttgaattgaatagttactaacggtagcgaaacaagttcaacatgaaaattcttcagcgcgtgatataatagtttagttttgacatgtcttcgtgcttgaattgtacttgatctgaacaatcagatgcaagttttgtgatttgtgaccaagtgtgtgatggtgactataaatggactttttgtttttcttatgtgtaatatactcctacttcttcttttgctttggggctatataccctgcttgattactaatcaacgccaagagctacttgtttcttctgttttttttttttgcgtgaaaagctacttgtttcttggaattttctcaaattaagctcatcgcttttgacattctatctataattttcccctctaattgtaaaacaatcagctgtccactcctagagattctggtgtgcaataattaagcacaaaatacaatagacagcacaattagtaaaaaaatataattactaatacatgccaaatttggctatacctaagtagaaagtgatgttgcaccacgttaaattcaagagtttttttaggtgaaattctacagttattttacatttccagcataaaatttggaactaagcttgtatcacatttacgctaggtgagataaaaaaattacactagaatatgtaagtataaaatcactttctttaggtcttcgaggaagtattgcgaggtttacggtagatatatttttgtttggatattattctaagtgtaatttaatttgtctgctaatcccacatcatcttagcaaccacatatgatcaatagcacaataaatttaatactaaatctcttggtgcccaaggaaatgttaagcaagtactccctctgtattttaatatatgacgctgttgactttttaaccaatgtttgaccattcgtcttattcaatttttttttatgtaaatacaaaaatgcttgtcatgcttaaagaacatttgatgataaattaaatcacaataaaataaatgataattacataaatttttttgaataagacgaaaggtcaaacgtttgttaaaaagtcaatggcgtcatacattaaaatacggatggagtaattaacaagtcctacccttccacagattatacaatacgagtggaccttttgcaatccacgtatatggaatcccatcatgccgcagggtatcgtttttccaacttaaataacagagttgtttaaacaaattcaacctataccacacacttgaagtccattgtcactttgtgaggtacaagtacaagccccttgtacgaaatcctcccctctcgctctacatgtttgactttgacttggtttttggatatttcatttgatttgtcaaagattctctcttcacgataacatggtttagatgcacgttgcaattaatttctcctcttcgatcttgttgttcttcaacgcagattttgttctttcttcgcctcgaatccaagcctagtgattagtgaatgccaatagtaaatttattatttttacataatgctcgtcaaacctagggtgcgtaataacaacggaccgacacccaaagtctcgacaaatgctccaataattagtttcgacaaaaaggccagttacgcatgtttctaacacttaacacaagcgggaaatgccaaaagtattttcttatcaaacatgtttagatttcaccaaatagcaactcttgatcaattcgtccttagcagtac

SEQ ID NO: 55109 - DNA, 16187 bp, Oryza sativa
cgtctccccgatttcgcaggttttggttcgatttcctcaccgtttcttgcttgcttgcgatttcttgctttgatgcagaggaggaacatgaagacgaacgcgtgcatcacggtgttcccggtgttcctgtgcgtgatcctcgtggtgctccagggggtgatcaaccacgagatcaacaagcccaagtaccagtgcggctgcgcctgcgtggacgccgcgccggacgggacctgccggaggacggagtgcggcgtcgagcactccacgctggaccaggtggggagctgcccgatcaagagcccgacgccatggccggccttggtccaggtcccccgccccgagtcccgggccgtcaggatcgcctcccagccgttcgacggtttgcctgacccgacctgcagggacacagggtcttgccctgcctctgtccttgtcaccggaatgaaccgctcgcttgctcaaagtatgttcttagttcgaagacatactagaaggggaaaaaaacatctgatttgttgttcaatctttggatcaaaagtgttcattaattcattgatgctttactgttggcaggtctttggggtggattgttccctgctgtgcctccctctctgaatttcacggattatcttgacgcgttctccaagattgttgctgtgagtttattcgtgcctaatggcagaattgcttgtacagtcattagtcatggttgccatgttctctaatgtgtggagctcttgattggatttatttgtcttaggggtcagacacatggacatggacaacgcagttcatagagccggtatttaccccagggcattctttatatgtggtccagcctcagtgttcgtccaatttatcacgaacaatttctaacaaagctggacctgtacccattcaactcagtaagttgcttttcttttcacagtttttcgttcagctgcatctttgtttgaaggaagcaggtagcgaaaacagggtaacttgctaggcctaacttatttaatttaatatgtactaggaagtaaaggcatatggtataccgaataagtaggtaattatgataatattataaaaaaatcattgccatttggaattactacctcagcactggtcacagttatattctcggacctggaattgcacagtattcctcgtcattatcaatagtcagacttaatgcctggtaaaaagagtagtagtcgtaccgcgttatttgtcagttataccctccagtaagaaatacaagtcgttttgaaatgctcttttgtaatattataggtctatcgcgttttataaatatattgcaacagaaatcagcggtcaaagatgcattttagaaactgtgtatatgttcaagacaacatgtatttgggactgggggaggcattattaaataagacaccaaagccatattggcataaagttctataacatcatttgactataaaaatctagatttaaatatgtttgattagcaatgttctgttgatgttgaattccagtgttatacttcaacagtaagactaaagtctgtcaatgtcccttcaatctttcatatatgtttcctacacctgtgaaaatgtccaaatctgatatgcatttcgcaatgtccagatatagactgcgttcaaggcttatcattatggcgtgaaagtgcatcacaaattaataatgaactatttagaggttatagacagcaaggtggaggaggtggaggaggaaagacaaatgaatttattgcaggtgatttcatcttctgatcccctcagagaaaagtgtctgccactattgatgtaatggttccttaccttatgtctaagtttgctttttttccaaaggctatgattttctgaacacaaacaacaatggtcttgaaataaacatttggtacaactctacatataacaacaacactgcatatgacgtcatctcattgctacgagttccacgcttggttaacacggtacgtacactgaacttccactacctcaagtctaacaattttcatatgcactacaactactaatacaactcattccatctttcctataggcatccaatgcatacatgaaatttcttaaaggaagtggagtggagatgctgcttgaatacgttaaagatatgccaaaagtaggaaccaaaccaaaatttgatctctcttctcttcttggtgctctgttcttcacctggatcattgaactactttttccagtgagtatgagatgcaacctttcttaactcttacataagttgcagaggacatcaaattagttggtacttcattttgttcccaggttatcttaacatatctcgtgtacgagaagcaacagaagctgaaaattatgatgaagatgcacggcttgaaggatgagccttactggatgatatcatattcttacttctttgctctatcagctgtctatatgatagtgtttgtggtatttggatccttgataggtaatcaactggaaatttcttcaatccattgtatttttgcaaataaatttatcatgcttacaaaattaactttcttccttacaggtttaaatttctttaaaacaaataactacggcattcagtttgttttctacttcatctacataaatcttcagatcgcacttgcatttttcgttgcggccttcttttcttctgtaaaaacagccacaggtttgtgattcaaatgctcaacttccaaagaagactcgtggatgactaatttgagaaatttctgtgctgcagtggttggttatatatatgtatttggttctggcttactaggggcatttcttctgaggttttttgtggagtctactagttttccgagtaggtttcttttctatttattttagctattgttttttatatcttatgcatgacgagcattgttttctccattcaaagagggttggatagtagtcatggaaatcatccctggattttcgctgtaccgagggttatatgagcttggtcaatatgcattctctggaaatgcaatgggaacaaatggtatggagtggactaatctgagggactctgagaatggaatgcgcaatgtcttgattatcatggttgtcgaatgggctattctactcccattagcattttatttggataaaatctcatcattgggtagtggagcccgtaaaacacccatgttcttcttgaaacgtttcaaaaatcgtgctgtatcactgcggaggagctttgggagacaagggtctaaagtagttgttgaaatggacaaccctgatgtttcccaagaagtaagttaatcctgattttgtatatatgttgaaatcgtgttgttgcatattctcaaattgcataaatgtttcattcctgattttgctaaattgtatccagagagaggtagtcgagcaacttctgctggaaccaaatgcaagccaagcaatcatatgcgacaacctgaagaaggtttaccatggaaaggatggaaacccggacaaacttgcagttcgagggttgtctcttgccctccctaaaggccaatgttttggtatgcttggcccgaatggagctgggaaaacatcatttatcagcatggtacagtggcaacaagtagctcttcaattctgacaaaaaaaatagacaatgttgcacgatccttacttggcatatactttccatgttttttcctccatagatgattgggctcattccacccacatctggcacagcattagtccatgggatggacataaacactgatatggatagcatctacacaaatatgggtgtatgcccacaacacgagtatgattcttgctctaaaactaatttatttagtaccatttttatggtaatccattgcaaaatatattgtggttgctaatgctgcttaaaatacagcctactttgggaaacattgactggaaaagagcatctattgttttatgggagattaaagaatcttaaaggcgctgaattagagaaggtatagttatcttcacactcatctctttattttccttcactgtaaattggtgtgttaattttgtcttgtggtaacaattccaatattacacatgaatatatcaatatttgaactgacaaatagcatactatcaggcagttgatgactccctgaagaatgttaacctgtttcacggtggtgttggaaataagcaagtggggaagtacagtggtggcatgaaacgaaggcttagtgtcgcaatctcattgattggggaccccaaggtactaatatgatttatgtgtgttgattttcaactgcacataatgcaatggaatgtgcaactgaaaaagttcttttaggttgttttcatggatgagcctagcactggactagatccagcatcaagaaataacttgtggaatgttgtgaaggaggcaaagaaaaatcgtgctatcattcttacaagtaatgagctttcctgaccttctttaaattgcctatatgaacaataatagtggataatccagtatgttttttttcagcacattcaatggaagaggcagaggtgctatgtgatagactcggtatttttgtagatggtggttttcaatgccttgggaatccaaaggaggtaatttacatagttacctgcaaaaacaaataaatacacttaatgtaacatgcctattataaacatttgttaatatctgaatatttggattgcattctgttttggcagctgaaagctagatatggtggcacatatgtgttcactatgacaacatcttcagaacatgaacaggaggtcaaacagctggttcagcatttgtcaccaagtgcaaacaggatatatcacatatcagggacgcagaaatttgagctgccaaaacaggaggtgaagatagcagacgttttccatgcagttgagaaggcaaaaagacagttcagcatacacgcttggggcctcgtcgacaccaccttggaggatgtcttcatcaaggttgccaaaggagcacaaggagtcaatgtgatcgcgtaaataatattatggatcgataggtggttattttttttccttcataggatcatgtgttgtatatagtttgtttgaactatatgctaacctttacttggcattgtgattgagttgttcatgtagtatggtaaagttgtatatttagcaaccatggaattcatattgtaatgtataacaccaattaggcctttttgggtttagagggggttgaaggggatttgagggatttgagggggaataattccacatcacaataggtgtgcaataaatcccctccaatccctccctcttggggattaaccgaacatggccttagtggtagttgattttgactaaaaccagctgagcagaatgtgcatatttaaaactatatcgggtttttttcccgcaaacagaaagctatatgcgattttattttatttagtaaaatgttgaaaacaatgttaagaaagcacattacctagtccctacttgtatctttctttgattcattatccttcaatgacatcctgaacaatacattaatagcttctgagaactaaagagaccacttattctgattttatactgctatagttaccaatgatcatttcattgtgggagcatcggaatttttttttaaaaaaaaactagagtattattttatttggaataggatagataatggattcaaacctcttctcatactgagatgttgtgcctctgaataaggtcttgttattttgtcaatcttttgaattttgaccagtaattatagggtggccgtaactgaaattgcaagcaaaatagcattgggtactgatctatctgaataatttatttgattggggatttcagatgctgtaatcttgtgcagctaccacatgaagtgtttttgtttagtgcgctggttccaaccacaagaataaactattgtcattagtcaaataattatcttggtgttaaaaaataagaacctgaagattttgtttttaagagtccttggaggaaagcatctacagtcatctgctctctttgaatttctaatagtccaggacttacagaagtcacacaacatatattatcttagaatgcatcattagatttttggctgtaagatctaaaatctatattcacatggaacaagtacaagtcatatcactctcatatatatattcccttcgtttcaaattaattgtcattttagatttgtcctaaatcaaatatttctatttttgagcattaatttctataaatctatatagtttaacaatatgcgaattatatatcatgaaattatttcttgtgatggatatattaaaatataaatcttatgatgttaaactatataagtttagagaaattgatgtttgacctaggacaaatctagaacgtcaagtaatttgaaacggaggagatataagagtcctcagacatctgtcaactgttttgcttagtatgtcatgctgtaaacaaaagtcaatttgctggaatcgaagggaggttgctctaacttctaaactaagatactgtcaatttgcttatgttggtaactgtgctttcctttgatccatctttgaatttgccggcaccaaggatgattttatcactctacagtactgatacggtgatacctttcgttcacatgaagctatcacattactgacgaacccaaggtgagtagtactcaagaacctaaacctatctctgctaatatcatttaataccattctttctttcttccaatgagatcaatgtggagatggagagcatcagtcttcgtaccaacgaaaactcttgcgtaacagagcatcagagggaaaatagaataacaaggggataaaaaaaaatggaagcatgaactgatgataatctaaattccttgaaagatgagtcatgggaagttactgcaaccacaagatttagtccatttggtagtaccgttttagaagcgatgaacacaaggcttgtcttattccatcaatccctgtccctctcttcttgatgtctcagctactagctaccatgagttcagataactcccaagtcccaaactgaactccaaaacaagaaaggtggctagtaaactgaattcatagaagggacttctgcactgtgacaatgctctaaactctgaagaatttaggaccagtcactaattaactatatagtatatatttaatatacatatatatgtcactccttgctagacacatggatcaaatcccaatgcagccatgccattgtcaatctctctgctctcctcatgtaactgatgaagcaaaacttcagttactgcgaagcttgagttaaacaattaaaatgcaagcgtaacacccgccatagttaagggacgatgacgcagcttttcttggagtgagatcagagtgctcctgcctgctgccatggaaggagtgaagcttcatctgcaatcctccgctgatctctccctgccggcgcctgatgccccggcggcaaccgacgcgtgattctcacggcgccgcgccgtggtgatcagctggtcggtttgagttgagtcaacactgcaaatctgcaaaccgttgctaatttgctatatatgcgagcttgctgatcgatcgatcgttgttgttgcgtcgagtttgatctgtcagagctcggagaagcttgctccaatggcggcggcaggttcttgctccaggttcttcaggcaggtccacgcgctcctcctcaagaacctctctttccaggtaggtgatggtgatgcaaatgctgtttcatccatccacgaatccggttcttgaaatcgatttcaaacttgttcttggatgaagataatgtttggttcttgagatgttaatatgttatcaagagcttgctgaatttttttcgtgttcttgggatggcagaggaggaacgccaaggcgaacgcggcgatcgcggcgttcccggcgctgctgtgcgtgctgctcgtcacgatccaggccgtcatcgacggcgagctggaccggccgccgttccggtgcggctgcgcctgcgtgcgccgcgacggcggccgcgcgggcgcgggcgcgtgcgcggcgacggagtgcggcgtgcagcactccacggccacgcaggcgctcagctgcgccgtgccggcgccaccgaggtggccggcggtgacgcaggtgccggacgagccgtaccgcgcgctgacgcccgtgcacccggcgaggtgtcgcggcgacggtggcagcggcgcgtcggaggcgccgtgcccggtcgccgtgctcaccaccggccagaaccgccggctgactgaaggtgcatgcaaaccagcaaatgtagtatatttttatgttgttcatgtagctcctctgcattttttctttcgattttttaaatttgttttttctttattgtatgaaagacgcacccatacacgaataatctgacattatgccattgtcataagtgggtttcacccaaatgccgctgtcaaaaagagattcgataaaatgccactatcaatatacggttacacgctagaatattatatgggaccaaattaccctccactcttctcccccctctcagctagtccaaacatttccccttacatgacaagagagaggagaggagagcagatcggcgatgggaccaaatgccggtgggccaacaactagagggagaggtagagtcggtgaggcccaaagtcagcgagatagggcactaaccattagcaagaaagcagaggccacgtcatcggcactcggtgtgcacgacaaggtgacctacactggagtcgatggcgaacctggtcgaggcaatgcttgatgtaggccatccttcacgagccgctcatgcgtagtgacgagaagagaggggtcgcactcaactccctgccgcgatagccagagcttgcctaggtggcgccattgtccccggtgtagagggaggaggcggcgatggccgaagcccgccgaggcgccgccggtatccctagtggagagggaggagaaggtggaggtggcgatggccggagaccaccggggcaccgccgctatccccggtggagagggaggaggaggaggaggcgatggccatagctcgccgggccgctgccactatccttgatggagagggaatggagctgtggatggatgaagaagaggagtggaggggtaatttggtcccaaatagtattctagcgagtaggcatgagttgataatggcattttatcgaatcccttttggagaatggtatttgggcgaaacccacttgtgacaatggcataatgtcaaatttcacacgtaggaagcagatcctctgacagttaagtcactaacatgtgagtctcactttactatagctcacatgtcagtggctcaattacacatgcagttaagccagaggatcattttccttacaaacaccactacgcacacacatcacacgtgttttgctacaacttttgcttttgcttttgttgttgtgaatggaactttttttttttgccaggccttggaaggggatttttcccagatgtccctccttcatactatcttggtgtgcccaattccaacaattcatcttatattgatgagttatcaaaaatagtccctgtgagttgaatatttgaaattttgagtgatcagtggcgttttacacaaaagattcgatacttttttaactctgatttgtgatggaaaggtgataccgaatatttcttcttccagggtacaagcacattaccagcgcatgtattgttcatagaaccaggatttgtgcccaatagtaccctatatgtgattcaaagaaaatgtatatgggattcgcacaatacttctagaagttctgatgcgatgccaattcaactcggtaaaagattgtttgtttcttgcttgtatgaagtcgtagcaactagcatgaaatgttttcaaccctgaattacttgtgcatttgtgcactcctttttattttaattgtaatagatgtgaagtgcgttcaaggtttatcactgtggtgccggaattcagcggtgatgaatgaccatttgtataagggttataagggtgggaataagaggaggacatcgaacgaatatcttgctggtactttaatttagttttccttgcaactgtgctactaaagtagcagttcagtttttttttggcgggttgaacaactaacttattttaaggtccatttttgcaggctatgattttcttgatacaagcaagaggaggtttcatgtgtatgtctcatacaactctaccttcagcagggacaatggacaccatcccatgacagttttgcgtgttgcacggttggttaatatggtacttaacttgcctgttgtggtacagtttcacttttaggtagaggaatactccattgaatattaaagggcatttatctgaactaaagaaatatcaatcattatatagtaagaaccggaaaacatgatttttaccatttcgcttaatggaaaatggggatacccgcattcaaaaaatatatggtaagaactagaaatggaagtgctacataaaaggcatggtgcactcctgtactgttccatcaaaacaaggctactgtagcaaaaacagcacatcttctacaacaacacttcatggttcttgtcatttgtgttgtttttgttgcccagatggatatatgtgccattttttttcagagtcctttcctaaaaatgagttcatctgttataggtcctaaataacttagtattatcactactgttatgcattttcatcaggcatccaccgcatatctgaagtttcttcgaggacctaatgtagaaatgcgcctggaatatttgaaagaaatgccaaaagctgcaatgaaaatcaggctagaccttaccacactccttgatgcactattctttacatggacagttcaactcctccttccagtgagttaactttatcgcgtcccacaatcaatctcttatcaaagctatcttggattcatacataagttatttaccaatttatttcaatggttttttcaggtaatgttgacatatcttgtttatgagaagcagcacaatttaagactgatgatgaagatgcatgggctaaaggatggaccttattggatgatatcttacgcctattttttgtccctttcagcagcttatatgatgttcttcgtgatgtttgggtcccttataggtactgtgctagttaactacagagtatggaaattgagaatttagcacattcgagtaatcttcgaaatcactgagagaactctttttggtattacagggctagatatcttcagattaaatagctacagcatacaatttgtattctattttctatatatcaaccttcagatcgtgctcgcctttctgcttgcgtctttcttctcgtctgtcaagtctgctagtggttagtaaaattcaaaccttctgttctgttcattctatagctcttcaagtgacctcagaatcaaatattttctgtgttacagtaattagttacatttatgtctttggatcaagccttcttggagaagcacttctgcaattgttcattgaagatattacattcccaagtaagtataagcacttctgcaattgttcccatataaatttttttcccaggaattattctgaatatttattggatactcattaaaaactaccattctacctgtttattagaacaatggcttgtgacaatggagcttgttcccgggttcgccctctaccgaggattttacgagctcgcagagtatgcatttgcaggaaggcaaatgggaaagcctgggatgcaatggagggacttgaatgaccccatcaatgggatgaaagatgttttgcttctaatgtctatagaatggatacttctgcttcctgtggcatttttactggatcatagacctacatggcatccactgttcctctttgggtttatgtcaacaaagcactcttcaccaacaatcataccagacaaagtgaaacagaggtccagaaaggtgtttgctgatatggcaaaacctgatgttttccttgaggttagttaagcatacatccgaataggatcaggatcacctaccttcaaagtcatgtgactttgtcactgacatgtgggacaaaggcatggtgatttcgaaggtagaggatctcaatccatctgaattggcgtgcttctttttttttatctgcaataggtgtgattaaatacacgtctatagaagttaatagatggcgttttccaagatagaagtataatgaagtaatgcagaactataatatgcaacaaggatactgtcataaattgttgttcaaaattctacttttcagcgcaaggtggtgaaaaaattgctgaaggaaatggacatgaggaatatgatcatatgccataacctgaagaaggtgtaccctggaaagaatggaaaccctgataagcttgctgttaaaggattgtcgcttgctttgcgcaaaggacagtgttttggaatgcttggtcccaatggggcagggaaaacatccttcatcaacatggtgaatatttcacaatattcttgtgcttcttatgatgttttgtcaaaatagcatttatatctgcttcatcaacacttcaaagtagctctcatttttcacatgaatcaagtagtacttaaatttatccatttttcctagtagtgaaataacatgaaaaaacctaacaaatacaccttttggaccaatttatatttgcagatgattggacttgtggcgccaacttatggaactgcctacatacatgggatggatttgaggagagatatgaatgaaatatatgcaaacattggtgtatgtccacagcacgagtatgatctcaagtggctagttcttttgcatttcttctgaagatggttttgttagtgatatcattgccaacaaaaaagaaattgttcaatgtgtgtgcagtttgctttgggaaactctgacaggaagagagcatctaatgttctatggccgactgaagaatctcacaggtgctgctctactgaaggtagtttaattgaagccatgaaaaaaggaaagaacatgtaaaattacagcactagctttatacagtcaaactgcgagtttcaaatctcatactcctactatacttcttacaagtaaaattgcaaatgttcactccatttgtagtactacacatgacattggaaacaattctagtatttgatcatcagattttacttttcttgatccaggcagtgaatgaatccctgaagagtgtaaatctgttccacagcggtttcggcgacaaatcggtgaacaagtacagtggtggcatgaaaagaaggcttagtgtcgccatcgcactgattggcaacccaaaggtagtaaatttaccatgaactgttcttcattcccttccactcacatctctgaaaaaacttctgctgtaactatctctcattgattccattgatgttgaacaggttgtttacatggacgaaccgagcaccggattggacacgacatcgaggagcaatctctggaatgtcattaagagagcaaagaagaactgcaccatcattctcaccagtaattaattactcctcctcttggttaatttttttctttccagctatacatgcaaactgcaatatttgtgactaatttagcaactagaactgaatttatatacatgaacactgaacatttcagcacattccatggaggaggctgaggagctctgcgaccgcgtccgcatcttcgtcgacggcaatttccagtgcctcggaactccaaaggaggtaatcaaatttaaacacctcaaaaactcaggtaaaaaaagcaaatgctgaattaattcatctgaaagtttgaattttttttgccggctattcagtaataagtgcattgattgattgattgatggattgattgaatgatcgatgttccagccgaacgcgaggtacagcaccgtgccggcactgaccataactaccgcggcggggcacgatgatgcgggggaacacgcggtggcgcggcggtgccccggcgcggctaaggtgtactgcgtgggcggtacacagcggttcaaggtgccccggcgaggggcgcggctggacggcgtgctgggcgcggtgaagtcggcacggcggcgggcgccggtggtggcgtggggggtgtcgtacccgacgctggaggacgtgttcgtccgggtcgccatgaacgcgcgcgccgccgcccacgtcctctcgtgagcttgctttaagtagctttttagctaatttagcggcgatcgagtgggcgtagcttagccagcggatgggcgatggattggtgggggtggatggtaaattctcgtgtttcctagggtgacatttgcaaattttacaaaactgactttctgtttctagtaaagcatgaactatgaagagtaattaattggttttgggggcagtagcatttatccgctactcacttcaatttataattatgataagttattacctccatttcattttatatcataagacattattaactcctaagttactatatgaaaatatccatacgtgcaagagggtataataatattagacaatataataacaatatgttgttatattgactttaattaacaatttgttattttcttttaactctaaacttcaaatttctcgtcctataatagtacacttttcaaaatattaaatttatgcatggaaaaaaattgtatataaaagttatttaaaaatcaaataaatttatttttcatgtttaaaatatttaatactcctccatcccataacatagatggttttttccttcaatttttttttgtaaaatataagagatcttgggatcctaagctggtattgtattctcaacctaccaacttttgtactgttttattccatcactattcacttttgtaataatttattctctcatctaccttttgtactactccctctgtccctaaatataagatgttttggttggatgtgacttatcttagtacaacgaatctagataggctttagaatgtgtcacatccaaccaaaataccttatatttagggacgaaatgagtacttttttcacccatcattttttttcctatcacatgtccttttgctactttattaattttaaaaaaggtataatcctctatataataagatgaaatgagtacttaattaatcatatgctaataatatttcttgtttggtgtgctctggaaatctccctccaaaccgaggaaacgaactagccctaggctatgttcttttttccgagttaccaacttctactcctttattttttgcgcgcacgtgttttttaaaaattttctatagaaaagttgctttagaaaatcatactaatgtattttttatgttttttagctaatacataattaattatgtagtaaaccatccatacctccgaactagttaacttcactccacatctcatcaaggtcaaaatagagaaaaacagagtaattcatactccctccattcataaatacttgcttgatactatttgcactttgatataaatagagtaaattttataaaactacaaatattttcatcaaactattgcaaaactatagatttaagatgttatataaaaaaactacaagtttagtgttaagtttatcacaaaactatagattaagtagcaaatttatcataaaactaaaggtttagtgtttatttaatcataaaactgcaacgtttatagctcaaacatattgatagtgctaaggatttgacctctaaattctgtagttctgtgataacttcgatattaaatatatagttatgtgatacttggctttaaatctgtagttttttttgataaattttacgctaaatttgttgttttgtgatacaatgcattaaatatgtagttttatgatagtttgatcaatatatatatatatatatatatatatatatatatatatatatatatatatatagttttgtgaattttattaggagaagttttgtgaaatttactcatctaaataattgcttgatactatttctattttgatcacgatctgttcacaaacaaatttaaatatctgaaaagatgttttattattaaagcgtgttgcatgctaacattaatattactagttgataccatgcgctttgttacgagatatgtagatgaatacatgttatacattatagaaatggtaaatgtatatctttaaataatctggaaatgatgtgaagataataatttgacattgcttgcatattgag

SEQ ID NO: 55110 - DNA, 1874 bp, Oryza sativa
cgatggataatgaaatatttgagatcaaggtttttaaaatgatccacattagatattgcaaagttttatttgatatagtgcaaagttttattttgatatagcataacaaaaattacaacattacaacacagtaaggtaaaaaaaacataacaaacatgccatcatcacaagtgttgtcatccacaccaaccaccgagtgcactagttgtcacgcccacctgccatgccggctgcccagcactgcctcccactattgtcgccaccggcgaggtcggccatccattaattgtcgttggcctgaccacgccagcctcccattgcccccgccgtttgaccctagtcatatttgacgtggagatgatggactagggacaccccatcagatcagtcgtgatgatgttgtatcagcaaccccatactaatggttcaccactgtagcctctcctggcttgccaagctccacaccgcctcacccgcacaagaggtgaagcgtatcggggttggtttagcctcgtcgccaccatcatgactcaccgctaggttctctaggcagtgtgctccgacaacggtgaggtggagaagaggagagatgagagggctctcaagccgcccgcagcctgcacgaggacgacgcgtggtgagtccgatgctgtttcactgtaacagacaaggatattcttttaataaaaactccgcttatatctactagcaataagtgcagattgccctggaggatagtgcatactccctctgtcccaaaaaaagcaacataggaggggatgtgaccctcttttagtaccacgaatctggacagagggttgtctagattcgttatattaggagagctggttgtctttttagggacggagggagtaagaattaggaaacgtctttaggtcctgtttagattccgccccaaaatttttcaccctgtcacatcgaacgtttaacacctatataaagtattaaatataggctaaaaaataactaattgcacatattgcgactaatttgcgagacaaatcttttaagaataattgctccatgatttgacaatacggtgctacagtaaacatttgctaatgatggattaattaggcttaataaatttgtctcgcggtttactgacggattctacagttagtttttttattagtgtctgaacactccatacgataccatatataatatacgatgtgacattctaaaactttaccgccgtgtatctaaacaccccctagtcagcaactcctatccactagcagtccaattaattttctctgtgatccggtgccctctgacccgcaacttccttttggcactaaactcgtcttatccgcatgattgttgactatagtatgtagattggcattggaagatactacgattgtatagattgacgactttacctaatacatcacccgtttcaaactttaagcgtttttagtttctttagcgaaacgaaaggtagagagaaaatattctcttttatagttattttagtcgttaaattctttcctaacatcttagtgacgggaaatatatagatttccattcattagaatatatattttaaaaaatatattacggtataaatatcaaaactctaccgatacttatattttagaataataaaggaagttatttttttccgagcaaatacaaatgcttatgagcacacctgcgaatgtgtcatctagcgtatactcatttttatcaaaaaaaaaaaacaatatagtatgttcaaatacgttgtactagaatactagattaagtatttttatagatgaagtatttgttctggttatcgagaaaatgctttgatgactaatcatatggatagaggtgtaattttagcttttttatttgtgacg

SEQ ID NO: 55111 - DNA, 3349 bp, Oryza sativa
gcccccacgattttcagaatttgccctcctcacttctatacttcaatccccttcctttatttttttttttgggaggggccgaggcaaccgtcgccactccgacgatcccgtcccatccgccgccgccgccggagatttcctcgaggtaagccctaccccgctcctctccagcctctctccccttcggcgggcgcccagcccgagccccgacctcgatttcttggaatttcttggcgagcgtttgtttcttggggtttcctctagattttttcttttttttattattttggggacggatttagctctcgtggaggagattgggcggataatttcgtcggaggggggagggggagggggatgttggaatcgggtggtgggtaatttcgtcgattctccggtccttttccttgagtttagcctgggaattgcggttggttcttggacgcggtttgagttcttggttttttccactttctgtgcggacagatttagggcttgcgctttgcgagtgggggtaaaattcgatggtgtgctgttccagctttgtccacatactgcttggaaatttcaggaggttttttcagtcaagtcaagcacatcttttttgctagactaggccatgagatggaggttaacgtcgaactgtacccacctcagctaaaaataataataattctcaacaacagtatccaagtggctgtattgtttattcttgtttagttatgacgcagatgaatactactcgctaaagattgtgactttcttagttgtcacctcgtcgtgtggagccctgtgggttcttgctcttgacttttatcaaacaatgattgcttggcaagtgtcttgtttgattcgtctgccctttggcttgcatcgccagagtttgctggcttgcgctggcatttaatcaaaagtataatcattcccccaagtataatcaggattagcataatctttagcttcaactatttatatgatatatttggcttgtctgtagtctgtagtggccaagaacatcctgaagcagatttatcctatcaggctatcagcactaagttgatcggcacgtataggttttcttttgcgtcattctttttcattactgcatttctatggtgaattgttttcttttcttttgtatggctacatctattaccctgttgacttctgtgagcctgtgatgtactccctccgggctgataatacttgtcattttggacaagcgcacggtcttcaaaaaacaactttgaccattatttcctattataatatgtaaaaaagtgttaacaaatatatgatcatattaaagtactttttaagaccaatctatatatgtagtcaccatatttgaaagacaaatattttaaaaatgatttatataatcaaatattctaaagtttgacctcacccttgtccaaaacgacaagtattatcagcccggagggagtagtaatcttaggcatttttcagggaatgattacacagtataagtttgagtaatgtgttatcatgatatgcttttcaacaagatatacatattttttgcaacactgtttggtctaagttatctgaaattgcaattgcttgacttttcatttgggatgcgttgggcaatctattgtcctgacatacattcatcttcatttgaagccatggctttatcttttttaattcatatcttttgtttctgtttgtatgtactaaaaacttgaaatatgaatttccattggagaagttaacaccaacggagtataagcaagattatggcaaaacattcagttgttagttgtttcgttagcatatggcaccatttgtaattctgcatttcttcctttctagataagccatgggtcaagcactcggtttggtacaagtagatcaatcgacagtagccatcaaggagtcctttgggaagtttgatgaggttcttgagcctggatgccactttttaccctggtgcatagggaagcagatcgctggatatctttccttgcgtgtgcagcagctggatgtccgttgtgaaacaaagactaaggttccccagtttattttcttaactctggtttcttttatatttcatggcaagtgtctggagcaattgtcaggcatgataaaaaatggttctcaaaattcttgcattttgttccattcgtttactcctttatgataacatactgatgatggttatgtgcacatatctctgttttccttattcttcacttacactaatgcatgatgcatcaaagaataaacccaccttttctgagctctctgacgatgtataccattttgtggatatctgcaggacaatgtttttgtcaatgttgtggcatctgtgcaataccgtgctcttgctgagaaggcatcagacgccttttacaggcttagcaacaccagggagcaaatccagtcgtatgtttttgatggtaaggttcctgtatgctgtgaacattcatgcatccgatgcatttgcagttcatactcttctgattaccttctctatgttttgcctctattgttcaatgctaacagaactttcttcctcgcagtgatcagggctagtgttccaaagatgaacttggatgatgcatttgagcagaagaatgagatcgcaaaagctgtggaagatgagcttgaaaaggtttgtgttcaataattggtggtcatctagagcatagtggagttttatactgacctagtatatactctgtaggcaatgtcaatgtatggttatgagattgtgcaaactcttattgttgatattgaaccagatgagcatgttaagagagcaatgaatgaaatcaacgcaggtaagtattaattaaaacatcaattcattccatttcttcagagacattatttggcttggtgtttatgcttgacatttgagcttgcattggaaacaattttctcctgtttagacatgaaaatgttaaattctctttccgagaaacaaaaccatgtttatattgtctagttttattcaagttttatactgaaacactgaaaattgttgccacaaatatttttaggctttcaacacagtaacactgtaagttatatatagatggaacactgaaaagttatatatagatgtacataacatattatgaatattaacttcgtgaatacttgcaccataacagtcataagtaacacaggcacatgtaactgcaacctattgattacattgtgtgcaacaaaaaatgtgttggtcaactagtcaagtaaatatttcgtgctttttaagggcctgcaacatatatgtttggttggtctggtgtttttctaaagatgagctgtatggctgtaaatgtgctggacggcaacatagttttaactgctgtta

SEQ ID NO: 55112 - DNA, 8815 bp, Oryza sativa
  unsure (1)..(8815): unsure at all n locations
aagattcttcagatcaagagagctgaaggagatgcagaatccaagtacttggctggtctgggtatcgcaaggcagcgtcaggctatagtggatgggctgagagacagtgttcttgccttctccgagaacgtgcctgggacctctgccaaggatgtcatggatatggttctggttacgcaatacttcgacaccatgaaggagataggagcctcatccaagtcctcttcagtgttcatccctcacgggccaggtgccgtcaaagatatcgctgcgcagataagagatggtcagctccaggccaaattgatctaagaggatggcagggaatggatgttctggatttcttgggcattacgaaagtctgcagtaataccttatctacgtattcgatattttgtgagataaaaacttaggcaaaagaagttctattgtaagtatcacatgcacgcgtgcttcagtaccgtttgttcatagtaattcctgaggttatttccctagacgagtgtcaatatacttcttgaattgcatgtttctgtaaataattcctaagtgttaccgggctgtttggaattatttgcatgttgatgttagtgaccttaagtaatgtcccatcttattatgtgatgtcatgatgatttccagaatgctagagtttaatactgcttgtggagaaatatcaaatactccctccgttttgagattacctgtcgttcttgctgctttgtcctaagttatacttttttgtagctttgaccattaatttttaaaaattcgtttaacatcataaggtttatgttttttatttactatgaaaaatgctttcataaaatataattcacatgttgttaatctatacaaatttttaaaagttgatggttaagacagaacaaatctacaactaaaagggcccctttaaattacatgaatgaaaaaacggaggaatagaaaaaaaacatatgattctaacaagaatgtaagtgtaaaacagaggattgtaaaacacagtagaagataggaacagaggattgtaaaacacagtagaagataggaatgaccatttgattaagtcacaggaaaaacaccagaatttaaggagaaatattctttccatgaggttctaccttatgttaaattttctctaaaacttgtctgggaagagacatttcatagaaatttcatatggttttataggatttattcttttgattcaaagggatatatagaaaaattttctataagaataaaatcctttaaattttttatgaatttcctttggcctaagtatttcaaacggagggagtaccatactttttttctctgccagtgcagtgccttagagcatcaccaacagtctatctattccatcctcaatcctaattttttgggattttggttaaaaaaaactggtccaacagattcccaaaagagctctggacgttttggagttcccatctccaattttctcggtacgtgtatttgagggcgagagaacgactcccaatcccctccttccactcgaatttctaaaaaaacgatttctattggtagtttaacaatttctaaaaaaaactaaggttaacaatttatgttggtagtttaacagaagagcccacttttagtttttgagattcaatttaggtatctcttggaggaagcggttttttcaccttctattttcagtttaagggatagattattggtggattgttagtaatgctcggaggtttggagatgggaatctgggatttctgcattgaaaatcgtgaaactgtgcttaagattattcgccttttcctgtttgtttttcaacggatggcacgaactcaagagggaaaaaaaagcatttcttcacttcttcagctctactggtactctgctagtaattgtttacaggacatgcagaaacaatgatataaatttcgagagaaattaggtataggagcacatttctgtagtaattgattcttttagaaaatttgaatcgatcttgtcgtaaaattatcgtgacacatacataatctccaacaccatcttgcaaatgaaactcatttgcgctataaatttcacttcctgatcatatcatacaagcaacactcaatggcgccatggtcttcagcaaagacgacttgagaccatcatcatcgtaagaaggcaaaaatttctgtaccaaagcttccattcagaaacagatcgtcactagctgcaaatcctgcaaatgtctgaaaatgtttgtaatttctcctcttgtccaattgcaagaactgcctaagaatcccagatcacctcctcctcagccgctggcaggtggtgccgcatctgcagcagcagcatttgccgtcgcaccctcctcgagctggacgagtcgggccacgatctcctgcttcttggccttgaggtcgtcgatcttggcgtccagcttctccagcttggctcgcagcttggccacgtccgtcgtctcctccaccttctccttcttctccttgcccttctccttcttctctttcttctccttcttctccttggccggtttcgccgcctcttcgccgttcttctctttcttctccttcttctccttctccggtttcgcctctttggcgtgttccttgatgatgatgatttataattgccatgcaaaaaggagtgcagatgttcgtcagagtttggtgagcaatgttacatggttgtgtgactaaagtgtgattgtttgagaatttcttgttgtaagcatcaaatatagtatcacctttctttttggttttgaagactagtatttattatcttgtattattgtgagaactctcctagttcgactgtcatttcttatgattctcacacaatcatgagtgagaataagtcttatcctgtcaacaaatttttttttcaaaaaaccagaagaatgtttaccttgtcctttttctcctccttgtgatgttccttggctacatctgcagcttccatctgcattgacagagaacatgatgcaatgttcacaatattagcttggaattaacacaccagtcatgttttcatgaaatggagatatgaagcttctcaaatcaaagattcaaatgcagagggaatgggagcttagctagcttgcctttctcaagaaactaacaagattatctgtggtgagatttctgtgagccttgactcttgtggacaacaaaaccaatttcaagtagtacggatatatacaaactaaaattgagttctatggatatatacaaactaaaattgagctctataattaggatagtgtatggatttgggcatgctgttgtgaggataagagtgaaagtctcattcagctaagaatagcatcattttatttttcctttgtagtactactagctagcaagaaaacctacctggctatctattccattaatgaaaattgtcttataatgataacaacctatatatgattcataagataccaggcatgaaaaagtataaagaactgggagagcgagagatggaatgagataattcttactgtcaattgcatgcaaactttaaaatatatatagccatacatgagagactatttacagggtgaattaaaacaagagagttacaagaattaactctaacaaagctactgcattgatgctatagggggttaaacttggtggtaatcaatattaatttttaaagaattaagttgtgtacctcctttacatccaaattaagagtacatgagtgagagactgttacaggttgaattaaaacgagagagttaaaagaatcaactctaacaaatgtagaagttactacattgtagtcaagggctcagtcaatgctttgatttctttctttggttggtgattcaatgttcttgattgattacaatctttgtaatttttttctacggttttcatgtccttttgtatgatgtaaatatttttttaataaatgccatactgttggacaaatacataacagtaattcccataaaaaaataattgatgttgtgcttggtaactggtggatcaagaagaagccatctttgatctttggtgtcaaagatcctattgttagtttagggtgtaatcttttttctttttgtttgtggtgcgttcgtgatgcgttgagtctgtcgtgtattatgttttctccttttccgatgcaataatatgccaactctcttgcgtatttgagaagaaagagctcctttaattacatccctcatttttaacactaaaaataaatatatgttttttttcacgagtgatgaactgagctatggccctgtttagttcgcgaaaagaaaatttttgggtgttacatcggatgtttgaccagatgttgaaaggggttttcggagacgaatgaaaaaactaatttcataactcgcctggaaaccgcgagacgaatcttgagtctaattaagccgtcattagcacatgtggattactgtagcacttatggctaatcatggactaattagactcaaaagattcgtctcgctatttccatgcaaattgtgcaattagtttttgtttttatctatattttatgctccatgcatgtgttcaaagattagatgtgacgtttttgggtaaaagaattttaggaactaaatcaaacctatcttgtagggtcaatgtgaaccgtcctgatatttatttgtgcataattctcatgctacaaagaaaacatgcaacacactcgagggatcctcagttgcaatgctttggagcctagttggataatactatatggcaagtttcatttattaccctgtcaaaataatttgataagcggcaaaccgaaacacaccattaaaaatcttgtcttgatataatattgtcatttaagcagggagggtttagatttcaggtcatttgtaaaatttcagttacctttctcattcgttgatgaaaaatataacagctctcatcgctatcatcatttaatttccatatttaaacaaagttccatcttaaaattgatttttctatcctaaacatgaaataattttataaatttatacttgatttatatttacaaaataatacgaaaaagtactcaaacttacatgaaaaaaaatgtagtagcatatgcaataaaaaattatatgaaaaatttttgactttaaccaacaaaacctattcttaatttttgattgtttcaatgagaaaatttttgaaaaattaagaattctagtattttttttattccttcagaaatagataagaattagtttggtgaatcggaaactatttttcaattttatagaaaaagtccatgtaattttatgatcaataatagttttcgttttccccaaaccgtctaaactcttatccacattctgatttaatagctcaaaaattagaaaataaactattccctttgtttcatattatatgtcatttatttatttttcttaatcaaacttttttaagtacgaccaagttaatagaaaaataaagtagcattttcaacatcttcaatataaaattagtttcattaaatttaacactgaatatattttgatataatgtttgttttgtattgaaaatgttactttatttttaaacttgcaaacttaaataagtctaactaaaaaaataaatctaactaaaaaaaagtcaaacgacttataatatggacagagggaggccccgtttggcatagttccagctcccaactccaacttacctagagccggagttgcgccaaacagtccagatcctccatttttggaagtggagctggtagagctactcctaaaaaatcaactatgggggtggagctggatttttgctgctccacagctccactccacccaaaagacccactaccctttaaaatttttatgtatttacacaaaaataccactgaactaccccttcacatctcctctcctcccattctctctccccatcttcctccctccctacagcagtcaacaacgagccagcgacggacgacggcgtcaacgtcggcggcggcaggcggtggtggcacggcgcggcgcgtgagagccacgggcggcggcggcgtcagcgggcacgtgggcgatggtggtgcacgggaggcgcgcgagccacggtggcgcatgggttgtggtggccaaggtggtgcacgggcagtggtgacagtggtggcagcgggcgagcgacagcggccgcggccgtgtagggcgactcgtgggtggcggcggctacgacagtagcaaggcgatgccaaccatgtgttcgacaaaatgcctacaaggaacgtggtggagtggagctgactaatctagccaaacactctcgtacccacttcagtttctataggagttagctcttgctggagttagagtttaaaaccctatcaaacggggtcggagtattaaggantctcaggncttttaaaacagtgcccaaggttccctctgggtccgggccaaaaggccctaaacctattcaggctctgtacacgtggcggccccaaggtgcttatcctggcccggaagcaaccgaacaagagttcccttcctttttagccggcggcgaggggcataatcgtcttcttccctccctcccttccccactactctactcccccactcgccgtcgcaactcccgccgccgcaccgccgcaccgccacaccgcccccgccgcaaatggcggcctcgccggagcagttccggggccaggcgcggctcccgcggtgcgcctccccgctcagctacgacctccgcctccgccccgacctcgccgcctgcgccttctccggctccgccgccgtcgccgtcgccgtctccgccccgacccgattcctcgtcctcaacgccgccgagctcgccgtcgacggatcctccgtccgcttccaggcacgcgcgcaccgcctcccccgttaaccatccgtgtctgtttgcgttgttgccgtgtgttcgtttcagggtcgctcaatcgttgtatgatggggttttgtaggatttggtgccttccgaggtggtgcagttcgaggaggacgagatcgtggtcatcgggttcggccaggatctgccgatcggcgagggcgtgctcaagatggacttcaccgggacgctcaacgatcagatgagaggcttctacaggaggtatcgttgccacctctttcagttacagataactggtgattgttgctagtctctcgttcacatgaggtgcgaacaggcattccagcagcaacagcttgcagttctggtttattagatggtagtcgcggacgtgggatttctagatagagaatcgagttttagagaacaatgtcacgatatctatgaaaaatcatttttgatatgccattaaaaatgagtaaatagttttccatagtttggatgatttacatgaatttggagaatttttttggtttggaggctacttttctgaaaatgtataattggttcaaattcttactccaatattagttaaaaaagaagacttaagaatatctattcttcgtgctggagacgaccaattgaaacttgaggaaataagaaaaatattacatactacataggatgtatggaagagtccaagacacctaacactagtattactacaagctattgaaattctaacaaacaattactacaagctattgaaatcctaacaaacagaagacaaaaaaattgaacacctaataaagagaggagaaaaaagaattgaggatgcaggaatcgaaccctcgacatgatatataataagaaagctttaaaccagtacaataagataagctttatgatataacgcattgttttcaaatatcttgggtatccacttgaatacctatgaaccatggggggttcacacctactagatgaggtccgaagctgctattcgttgttatgagtaactaggcttcgagcagtgacttgatggaaactgcaagtgtgtgtttggaagcaatcaatagcattggcacatgaactttaacaacaagggctaggtgtaccggttcaaaaattgttgccatgcttgatgtgctaagacaatggatagtatctatatcttatttggtaatgtcctagaaagtgactaagatctcaggatctttaggatgtgagcttgaatctacaatcttatcttataatgatcgaccatccactctttgttaatcctgaaacactcttcattaaacttattgaaccatttgtgtctgcctaggatcctgatcttgtcttcaaaacacacactatacgctattggtagagtatgctgctctccatactaccataacaccatccataactcgcagcctagcacccactgttcaccaggccctatagagcattagcatatgtatatccatcttaataatgtagttttgattatgatttttttggcatgttgtaatattatagggcttggatagcaaacatagtttttgggatatttatttccatttttatttgaaattgccacaatttgatgtaactagtaccttcctgtgctatataccatttgtaagtcttagtttactcctgtcctgtctttgtgtcaccaagattcatgattggagtgtgatgtataaatactgtatatattatccaggacctccatgtttggattttatcttcatttttgtaacaaagctgtatacattacataatcagtgtagtttggagtgcaccggttgtactttctttatatccttgtgatctgtttttaatgcattgtgggtggtgtttccgtgtttgattgcagcaagtatgagtacaagggggagtcaagaaatatggcagttacacagttcgaagctgctgatgcaagacgatgttttccatgctgggatgaacctgcatttaaggtgtttaacatgctacaatgttgt

SEQ ID NO: 55113 - DNA, 1191 bp, Oryza sativa
cctctcaagaccgtctattatgaggaatcgccacttatgtcaacttatctagtggctatagttgttggtttatttgattacatagagggctcaacattagaaggtagaatttcagtttctgtctccattgtttgctctctttcattcaaactatatgatatgtcccttctttgcctggtctttacacattttttcattggcttttgttaatttaatgtaggcaccaaagttcgtgtgtatactcaagttggcaagagtaaccaaggaaagtttgcactagatgttgcagtgaagtcactggatttattcaaagagtaagcttccaacatagtcttgcttctaagctttatttctaaagatgaggcagaataccatggatggtgcctatttcactacaataactaataatgttcttttatcagttattttgccactccttacccgctaccgaagttggatatggttgctattcctgattttgctgctggagctatggagaactatgggttggtcacttaccgagaaacagctttactttatgatgagctgttatcctcagcatccaataaacaacaggttatgcctatatttatctttatcaatttcatttgtttcatttactattggagagttagtctcgcacttgaatcctcatgtgtagttttggccaggtaaactgctatttttaaaaaagaaagaaagaaagaaaaattaacatctgttctctttaggttgcaatcactgttgcacatgaattggctcatcaatggtttggcaatcttgtaaccatggagtggtggactcacttgtggctaaatgagggttttgcttcctgggtattcaatctgaaaactattgtttgagaaattagaaatattgtccaattgttgtgtatcttaccggctaattattccatatgtttcaacaggtgagttatttggctgtggaagcattatttccagaatggaataactggacacaatttcttgatgagacgacctctggtctcagactggatgcacttgcagagtctcatcctattgaggtaatcttcttcagtatgctttggcgaagtcactgatggataagaaacataatattttgatgctgcacaaatatgcattacagatatggaagtacatgaaagcagtaagataagtgaattaacaaggatacaaagggctgcaggaa

SEQ ID NO: 55114 - DNA, 3846 bp, Oryza sativa
ttcctgcagcccattttttactctttcagaaagctttggcatcatatataaagaagtatgcttactcgaatgccaaaacagaagatctatgggctgttcttgaggaggaatctggggaacctgttaaggatttgatgactacatggactaagcaacaaggataccctgttatttatgcaaaactagatggacatgatttgcaccttgaacaggttttctggcagatttctcattctcatgttataccaacatacatgaagaactgaatatatgtatccatcggccttgccttattccattgccttatgcttcgtccaatctgaaatctaagtctttttggccttattcccaagaactaaggaagtagcaaaatggtgttgttcccttcatttattccattaaaaacacgatccatttattcataatagtagtagctttcaagtagaaagagaatggagggaaaaaagagaaaactgcctcaaaaattctacagtaacttgcacttagagagattgaaaagagtaaaagactaaaatgacttttatttggatttgaggtggtatatgtctaagttttagctgtactagtcacttgttcaggatcgcttctttccagaacctctacttttattcatacatctaatcttatattagtttgtttcttttgtttttaacttctcatagttgtctagaggacctcacctttcctcatacacacttttaggacaacatgcatgtcaccttgatcagaaactcagaaccataataactggagatgagaatatcatagtgtgctttgtgtttcatgttatctttcgttattcatgtatggtctgctgatgtctttattcacaagtgtatggttgtattttttttctcaaatgcatccaataactggcaaaattatagatttcgaagtattggaactagaaaatttcgttcttctggcccatatcagtgctttcatattgcaaaaagaggagcttactgaagtctgttctattacaggcacagtttctatcggacggatcctctggtccaggcttgtggattgttcctataacatcatgttgtggctcatatgatgcacagaaaaagtttctcttgagggcaagactgataaggtccatatagacctcactgcctcccaaaatgccggaggagagaagggtgaaaactgttggatcaaattgaacgttgaccaaactggattttatagagtgaagtatgatgatgaacttgcagctggacttgaaaaggcaatcaaagccaataagctctctttaatggataagattggtaatgacaagatgaattttcaatactactcgtataatatatccttgtcaagattttgacaacagaaacacaatattttgctgcaggtattgtggaagattcatactccctttctgtggctcgcaagcaaacactgacatccttgcttcgcctgctgaatgcttatcgcaatgagtctgattacactgtgctttcacatgtaacctctgtaagtaaacctttcgccacctccaatgaaatcatataccttgtatctttgattgattctatggtatcaactattgttctcaatattaaatacatgcatcctttttgacaggtatgcttaggcattgataaaatatcagttgatgctactcctgaattgtccagagatatcaaacagcttttgatcaatcttcttctatcagctgccaagtatgctaacaaacttaatgttttaccattttcatcatcatgtttatctggatttcacgaatctggatattatcatttatgtgcatttgtatatttacttctgagttggcgcatgccactggtgaatttgtttctgttaataaacttctgtctactatattcctgctgttttctttctatgatcatattgaaatccttcttgtacttctaaatatcagaacactaggctgggatcccaaggagggcgagagccatcttgatgtaatgcttagatcattgctcttgattgcccttgtcaaacttggacatgatgagactataaatgagggagttaggcggttccatatcttcataaaagaccgcaaaactaacattcttcccccagacactagaaaggttcaggcttttgcttaacatactactgcagtgttacctctatgatatctagcatactgatatgcattggtctgcaggcttcatatcttgctgtgatgcggactgttactacctccagcagagctggttatgatgccctcctgaaaatctacagagaaacagctgaagctcaggagaagtcacgcatcttaggtttgtgcattccaaccgtctagcttaagcgacagcaggaattttctgatgagttgtcctggaaagtaacgtttcttctgttttaggttcattgtcttcatgcctggataaggatattgttcttgaggcactaaacttcatgcttaccgatgaggttaaccctctgaatcatttatattttacttattctgaacaaatgattccagatagtaaatggtagaatgagaaccattatacaccattggtacagaagccaatctaatctctctcttgcttgttaggtacggaatcaagatgcattttatgtccttggtggtatcagcttagaaggacgagaagttgcatgggcctggttgaaggtatgttattatagttgcagggtacctaaagtggattattatagttatctgataaacaacgcacacatttctgatatttttgaaagaaaaaacataagcactgtatgtggtgctcaatatatatatatttttactgttgtgaggggttcaaagttcaattgttctgccaaatgccaatgcatgctaggtgtctatctcaatacaagaacaaataatttgttaaaagttaacgatggaactaaaacagatgaaatagggaagatgaaattatcaaaacttcctttgcaccgaccgtgccaatatccaagttactgcaattgaatgatgttccctccctgttcacactttgcacgattaggtctcttcacccaaaactggcgcaatcaatctattttaccaaatatcattggtcctgctcttttagccaaccagaaaacaaaaaagcaaaaggttttactgagatacacagtacatcataggaaagctgttctgacagatgaactgaagccgtttatgcagttgcaccaaataggagtatgctgctaatgagctttgtgcccttaccaatggctgggaaacttattccattatctaaaaaaatttcgatgatcacctccatgagatttaaatctccaaacccattcacgagtccacaattctgcatagctctctgctattcgagggaaatccaagcttgtagcgtatgaataacaatagaacacatttttccactttatagaagagatgctgcctgcataacacactatttgatactacctccgcccccaaaataattgtaattctaggttgtttagcatatattaaggtttaagaagaaagactatgataccccttattaaatggtatataggtaagagtgggagggtagttgaaggtaaaatagagagaaatttgaataagaaatgattaatgagaccattagtattctgttgtgataactatttttggacaaattcaaatcctataaatacaattattatgggacagaggcagtaaaatgagctaaacgaagaagttcattaataagttctgttatttttagcaagtctgattaggagttcagagtaagttgtacttttatgaccatgagcccatctgtgcatgatgcaggaaaactgggatcatgtcttgaagacctggccatcaagttcactcatatcgga

SEQ ID NO: 55115 - DNA, 11116 bp, Oryza sativa
cccctacagccatatcagaagggttacaaaaataacaccacacctggtgttgataacatatacaaatacaatacattacctctatacagtaaaagaaaaaaaaaagattgcacaacatacaggacagcaccagctcgtgaattccaaagtttatatttctaccaggtacagtttatacacaacatgttctactactagatcgaatatgctagtctcatgtaaagccgtgacagctcttaacggcatgtggcatgcatctcagtcactgatgatgttcatggagaacttcgataacaagtttggaattccagctatgattgagccatatacctgcaaaaaaaaaaagagtcagctgaagcagctgagcttaaaaaaagatggtaaaatcccttgtgttggatggtgataaccaaactgacctgagcattgtcatgaatctgggatagaggcacagctagcagcttcatgttccttggcacgacaaattggcgagacaccggcagtttaatcaagaacagttttatgcattccttcatgacaggcaacaataaaatgattcactcaggttataagcacattaatattatttgaggaaaccacatggttcatggatgaaccggagtgtatgtcaagctctttacctttggtgcacgggcatttggaagtagatatggaaatggagcagcatcaaactcagatctccaccacatcccaatgcactctccaatctatagccgataatcaacgtgaaaaggatgaataatttgctggatcatactggtggtctcactcccaacattactgaacatctctgttcactccagttacctgccattcgtcgtccccgtcgccgtcttcgtcatcctgatgtccagctaccgataacttggttgaaagtttgcgcttgagcccttggacatctgaagcagagataccaggcaacacacgtgtcatccaaattgcaagtgtaccggtgcactagcattatctcccacgaggagaaaatcacatcctactcggcagtagacacttgcacatggcaagaattcaatagtaggttcaattcaatccattcctaaaatttttacgggaaaacttgggaaattgcagcaatgatgattgatgagcaccttgttcccctggtctcaagcggccaccggggaggaggaaggaggagttcctgacttgcaggagcagcacgtgcggatgatcaaagagctcaaccagcaggacgccatggacgctggtccggagcccgtgcgccgcgaagctgcacagatcaatcaaaccacacacacaaaattacatgatcgtcacgcatttgatcgagcaggtggcgggtagtgcgcgcgcgcgtgcgtacttggccttgaggcggagggcgcggtcggcggcggtctccaaccccgcacccgcgccaccagcggcaacatccctggcgccgaagtagtagcggcagagcgggtaaatctcgacacgcgccgccgccgcagcgggcgaaggcgcagcagcagcctcgtccgtcatgatctccagccccatgccggtgcagccgcccgccgatcaccgcaacttatatataggcagccgcgcgcgcggggatcagaaggcgacggagatcgacgggcagagcgagggtttgggaagcttctgccttggcctatacgagcctatacagggtttggtttggttatttgggggaggagaggagaagagaagaggagaagggtagagaaaggtcaggagcgggaagaatggcgacgtggcggggaggggagtggggtggttgggcggtgtgggtgtgggcccggactgtggtcgctagtcatgggcccgtacgggctgccgaacttcgataggccgtgatgatgtattgggccgtccaccaaggcaaacggatcggataaactatttaccgtaaccgtaatggaagatcactttgactccctcaactgaccaccgaatctaaatcgtatccctcaaccgcaataccagaaatcttgaacccccaacttacaaaatcggtacgatttgactcccttggtggttttggagagtggttttgctgatgtggcatatacgtggcagcgttgatttggtctttgtcccacgtggcattgacgtggcgcttacatggcattaaaatttaaaatatatgtgggtccatttgtcattcacacaaaaataattgtaggccccgctgacatgtgggtcccacgtgtcatcctctctttatcccttcttcctcctccctctcctcccttctctatctctccctctttctctttgtgcgtggggagcggcgtccgaatcggcggtggcgacggcctagatccagagctccgaatggcggtggcggacgggccgctggacccatcaaaccgggaagccatggcgaccacgccgcccgcctcgtcccagccgccgccgccgctgcctcgcgcgcttccttctccaccttctaccctcccgcgatctccctatccctctcccgctccgccgccgccagctgccgcggccgcctcgccctcgcggctccaagtccaagggcgcaagagcggaggagaacaagaaggggcaagagcaggagcagcaggaggcgtccatgacggtggtggacggcgcagaggaggccgggaaggaggaggaggggagaagagccccgagacggtggcggcggagctgaaggaggccgagaccgcggccatcagcagcgggtggtgggtcggcgtcgcgcaggagatgtcgaagatcgagtggccggtgcccgggaaggtggtgggcaccacaggcgtcgtgctcggtgtcatcgcgggctccaccgccgcgctgctctccgtcaacgcgctcctcgccgagctctccgaccgcaccgccgctcgagcccccacctgccgccggctcatgtcaaggggagagagagaaataagggagagaggaggaaaaagaagggtggtgagagagaggatgacatgtaggaaccacatgtcagtggggcccacaattatttttgtgtgaatgacaattgggcttcgcatatattttttaattttaatgcagcataagtgtcacgtcaacgccacgtgggacgaagaccaagtcaacactgccacgtgtgcgctacatcagcaaaaccactctccaaaaccaccaaaagagtcaaattgtaccggttttgtaagttgggggttcaaaatttctagtattgcggttgagggatatgatttagatttggtggtcagttgaggaagtcaaagtgatcttattccaaccgtaatactctacatccttcctataaaataagattaacgagattatttttatctatcagtatcggcaagtactataagcatctaagcacgagcccacgagctcctagataacacataagcttaaatgataaggtagagaagagaaaagaggagagagaggatgaacgacccctcatgtaaaaagcaaccttttcacaatgtcccctagtaaattagttgatgatatggataatattagatgtgactataaaacttgtcatctaatatcaactattctttctcgttttccgcacgcaggtttcccaaaatgctaaatagtttattttttgtaaaaattttctatagcaaagttgctttaaaaacatattaatctattttttaaaaaatatagctaatacttaattaattatgtgctaataagtcgctctgtgttttgcatgcgcaagagattagttcccaactcaatgtatcgaacatgcacagccttaggcacaaccgaactacatttgataagtagttatgcttatgcacctataactccactctgcgtctccaccaacatatcgacggtggtttcaatatttgatgcctagcttgatcactgcagggagatatcaaaccataagatatagaaaatcactacaccacatcagtgccggttaggaaccccacatagttaccgattttctcaaccagcaccatagaagcggcacatatatgaatattggttagagtatatggtagttagagtcatattagaatataattgatatgtgtgaattccttcctatttgtaatccttccttacactaccgaagaaaccttttgtagtcccgattggtaaccccctgtagtcccggttttataactgggactatgaatccggaccagttgaaataaccggatctttagtctcggttggtgttactttttttctcttttttttttcattgttgttttgttgtttatatctcgagcacaatcacacaaaaatcacacacataaatcatccaagaaaaccattcacaaatcatacacaatcatccactatacatgcccttccgcaatccaccaatcatccccaaatcaacaaacaaatctacacatcaattcacaaaataaaaaaaaaagctccttagtgtcaggagccaagatctgaactcgctcctaacaattgaacttacccggcctcacacttagggaggccagtcaccgccggcctcatccagcgtgggccgccgccgccaccgcccggccacctgccacgcagccagctcgctcagccgccgccgcccgaccggctgccacatggccgccgccacccgtccgctgcacagccgcctgccgcgcggccggctcgctccgccgccgccgcccggccgccgcggagaggggaaggaggaggaggaggcggggagggggatcagaggagaggggaaggtggaagaaggggaaaggaaggggaagaggcctctctgatcgatcgatctgttcgggataccgagtcttaatgaaggagagaacgaaaggggaggggataccgagaagataagatcggcacgcgactcggctgtttatttttgtcccggttgatataaacaaccggtattaaaaatagatctttagtcccggttgtttataccaatcgtcccggttgtttataccaatcaggactaaaagataattggggcctgactcagacccgccaacttctttgaactaagactaaaaataatctttaataatttttagtcccgattcctattcaaactaggactattatgtttttggacgaccgacgaaagatggtaacgtgtctaatattcgcagtatatctctcgtctactatcaatatggtatccaagcgggtgatgtagggtcgccgccgctcgcgcttctgctcgtcgccccggggagcatttcgatctcacgggggcgggcaccattttttgttttccttttttttttgggttcgtcgtcatggtggttgcccgtgagggatcgatctcgatcttctccagtgaccctcgtcggcgtcatggtggtttgagtcaagcatcagccgcagtaacgcatggatctaccggtcgtcgcgtcgcgagttctcgtcatcgagccatccccgccgccgccgggtggacggtcgcttcttcctcaccgcgtcgaggtgcacggccggcgtcgccgagccccgaccgcccccggcctggcgcgctctgccggcaccaccccgtcgacctctccacccggccgccggactccttccgcaccgcctccgtcttgctgcgccgacgccctccgtcagcatctctggctggacagtcgttggccgagcgccctgtgaccactttctgcagtgcctccttttgaccctgttgactagccatcgtctctgctgtgatctcgtgcgttgctgccaagtgagaggagagagactgattggtgtggagatatctaggcttgttgacttcgttgacgtcatggtgaccagacctgcatgagttgcgttggagggctgtggtgtggtgtggactgctgctactgtgttgttgcttgtatctttcttctttctcccgaccagagatcaggtttgtgtcgcctaccgcctcgttaacatctacgtgtctccgacatcggcatcaacttcggcttcgacttcattgttccgttgtgtgcaacttcggtctgatcacctgatcaagcacacatacatgatgacttctgcaactgatcgtctgcgagcatatctactacgccatcaagctttgggttgccgctgcgtcgccctctcgggccgcagtgttgccgcctgtggtccacggagagacgtcctcctcactgtggcctcaccgccgctggatttcacgtcgctgcatcaacatggagctacacctgtatcaccccttcgggtcatagtgtcgcccgtctcgtcgtcttcatcgtcgttcgtgcatcgacaacctcgtcatccgcactggtcatcgtcagccactcgagtcttctttgtctacttcgagcatcgccgccgtgtctccaagctgccactgtcgccgttctaggccagtggtctagctacctctacatagctaccgatgtcgctgtccaggccgttggtcctactttgccttcttcttcgtccagcatgtttcatcgccagcgtcgtcgtatctttcttgactacacttcgctcttcttcagcaactgcgcgctgctccggaattctccctctacgtcattctcacgccacgactgtcccggaggcattatttgctagtctcctccgacatttgcgtatgattcacggtggtcccttgccttgccggcacgatattggcaacactgttgcgcgtgtttgtcccgagttgttcccgagtctggcaaacccggcgtgacatctcttctttacagttcgactacatcggctctttggcatcatcttcctcaatgactgccgcgatcgggtcaccgtcatcgtctccagtgcatcctcacgcaccttggtccatgacgccctcctgtgcgtccacgaccactctacggcgccccatgcgcgctctgcggcttgggtacctcgacatcagcttcccgacttcggctacatcgaccatggctactttacgcacggcttcgtcgcccacgggtccttcgcatccttcgctttggctacatcgacatggcacaaagggcaatcattcgtcttgagcactcttgctggtttcttctccaatccaagtgtccgctttgctcacgcatggactacggggggatgttagagtatatggtagttagagtcatattaggataggattgatatgtgtggattccttccttatctcctccccttgtactcctatatataccggccccctgaggctcaatacaacgtgtctaatattcacagtatatctctctcttctactatccaacaatattcaaatgtgccggtttaggaaccggcacctttttggtcccaagaatccaaaaaaaagggggggggggtctcgatgcatcgagccgttccccatcacctcgagaccccatcgatccaaagcaaatcacagaagtttcacacactgtcaccatcgatccatccaagacatatccctcaaagcaccatctttgatccatccaatgatagatccctcaaagcacaaatcataaaagtttcacacaaatcacatgtgaaagaagctcaaatcacagatccctcaacaatttcatagaaacaaaatcaaatttatagtacaaatcaccgttgccgatacgtcgccggattcgtcgcgggagccgccgccgccaccgctccacccgcgggagaaacctccgccgccgacgccgaccccggatgcggccccggctaccgttgaggctagatccgtcgtgggagccgccaccgccgccaccactccgtccttgggagaagcctctgccgccgacgccgacctcgactgcggctccacccgccgttgccaccccggccgccgtcgaggccgcctcgcccaccgccgcatctgtcgtgggagagaagccaccaccgccgacaccgtatgtggggagaaggaggagggggcgagagcgagcgagcgagagagtgagagagagaggggcaagagagagatcgagaagcgagcgaacctcttatcccctcggccttatctcgtcgtggtggggcctgccggctcggctcgatttctgtgggtgtcagcttttaattaaccgatatctataatatattaaaggtaccattttttttaaaaaaaagggggcacctatagaataggtgtcggttcttatttagaaccggtacctataattgcttaaaggtatcgtttttttttgcgatttcaacctgcgaaagtggaaaaagacctataggtaccggtttagcacttccggcacctatagtaccgatatctatttgatgttttgtagtagtgaatttacattgcaaaatatagtagagtacttgtttagactgcagcagctacattacacggtaaaaaatgtgtagctccggctgtgcagcgcagccggctacatctgtaatgcagcattaccaaacagaaccagtaccactattttcttccgtatagtaataaaaaggacattctgtgttactatcttgctagctaaaccccagaggcggagccaatgcctcgcccaacaaactagcttatgttttataccaacccactaatcacataattatttaaattatacagtgtattagatcagctccaataccaaacattagcatatgcatggccagtcgtctttggccatggtgtttcagctggctgcttggctttggatgcaacaccacaaatccttccagatgtgttttgattattgctccaattttgattgatcattgttactctctcagtgctagatctacttctgcggcgttgtacatatttctatcttcacttgagcattagaatcctgccttgcttgcttgacccagttcaccacggatctgcgtgctgcatagttgcagtgcacccaggaggcaggagccgatgatactgatagccagtttcttcatgagcatgttatggtcagtatctattgcttagaattttgcagggtgatgtcttactgaatttgttatctttatatttatgatatagttggtaactctagtaaaattatcagtatatttatgatatactccctcattccttaaatgtttgacaccgttgactttttaaaatatgtttgaccgttcgttttattcaaaaacttttgcgatatgtgtaaaattatatgtatacataaaagtatatttaacaataaatcaaatgatagaaaaagaattaacaattacttaaattttttgaataagacgaacggtcaaacatttttaaaaaagtcaacggcgtcaaatattttgggatggaggtagtagttgataaccataaggctaaattgactttgctaaaaatatgtatttttctctccctattttataccaccatttgcgaaatattgtgggggtgtgtttttattttgtatgttccactaggtaaaccatcactactacataacacgtttttgcatacgggtgaaactgatttttgcatgcggttgctgcagccacatgcgtgaaaaggtatgtgaaaatcggtatttttgcatgcagctagcacaaccagcgggcgcttaagccgaccgcatgtaaaaagaaaaaaatcacaaaaatataaaattccaaaagaaaaaccctagccccactgccgcccgagctcccgtcatcgccgtcgccactgccgcgcctgacgcattgatagccggaacatagaaaagcagtacgtactaacatttagacctaacaatttctcctagcctacatagatcaaagtatagacttagacagttttccgactcttagcacaaaccaaaattttccttcgtgcaatgtacaacctagctataccaattaatagttttccattttttatcgaagggtaggtaggtgcaaccagtaaagcactaggttgcttgtggtttataattttcacatttctcgttttcttttaagtagatcaatcgatatatatatatcatcacaccactacacataaatacatacatgatggcaagatattggcatatggtttccaataattaagacacctcgacctcgatcgattccgttgcaaaagatatgcttaccctctctttcttcgtgttttccggggaacttaatggaataatggatgccgttttgggcatgtatccgttttctactggtactactttctagaggtgcaggtaggatgcttgcctcattttgtgcaagatgaccaaacagtccatgtgatttgtgctatatatgattgtttgatggcttgacacacggtatggaaatttggagtcaagtaaaccatcaaagctaaattggtgggaaaccactatccttccataacaaacaaaccatatctctctctggatgaagaaaatcaagtttttacatatggttgtggagccgtatatataaatcctactaatttttaccaacatctagtttcgggtggatgccctaaccatttatgaaaagaaattcgcgcacggatgctctaccacccgtatggacccttggtatgtggcggagcttatgactgccaacaataacctattttggttgctacaaaatatgtttttcgtagttgtgcgtgaaaagaaattctagccgcctaggaaacccttcttggtagtagtggacatatgattccgttgcaaaagataagctttgccctctttcttcctgtttcccgggaaacttcagtgagtacccttaccgtttctggcatgtgtaccttcaaggagtacaggtagattgcctgcctcgttccgtgctagatgaccccatgtggtttgtgttctcagttctgaactgtggacggcttgatccagcgtgtggaaaattggagtcaagtaaacccgtcgtgactgaattattccatggtaagaactagggtaaaatggggtcatgtagggttggatcacggcattttttatcctaacctatatttttcctttaatttaaaaccatgtacagatatagtgttagattagataacatatcactcatcccgtatcctatctcatattatttcctcggaatcagattcatacacggaaatctatttctatgtgcaattcatgcatattaaatatagatggacaattaaagtattaaaagagataaattaagaaaaaaatatacaatattacctatgatcttgtaaaatagtgattaatcaatattttatcatgtttgtagccttgtaggtggacttataatatatttccatatgtgtttaataacatgggaaata

SEQ ID NO: 55116 - DNA, 1348 bp, Oryza sativa
caaattttgctaaaattttggtaggatttcttatatagttactaaaatttagcagcaaactaaatatagccactttttttagcaactttactaaaatttgataaaataaaaaatgacattaaaatgaataggcccaaaatgaaacggcaggagtagcagcagtcgtttcagcatcaaccatcgtagaacaatatcattacagcaataacgtcccactaaccagtccagtaaaaatttacgccgcagtaaatactcctacagtacaaacctcaccagtataaaacgagaagctagcgaaccacctgcaggaggcgccaggcgggttgcaagcaaacacacaacccacccgtcgttgggtcagccacgtgcaccgcgaccgagccggaccagtttggtctcggacagtcggacccgagtcaatccttcagcctcaggtgcggcgtccgcccgccacgtgtcctcgcctcaccaatcatcacccatccttctcttctcggccccaccaactctgtctctctctctctctctctctctcgctgctcgcgcaaaaaccccaactgcgtcgccgtgctcgccggctcgccgcctcggcctcgccgcgcgctctctcgccgccggtgtctggacgacgaggaggtgagtccgtacgcctcgcctctgtgttgttcttcgtgttcgctgcttcggttcgtcgtgttgtgatgtgatggcgtgttggatgatgtgtgtaacagctaatttggtgcgggttttttgggcgtggtggtggtggtggtggtggtggggtgatttgcagggcgggtggcggcgggggatggatcgctgggaggcgttgatcgccgccgccgcgcggcggagcgagccgccgagaagcgggtgggcggagtggggcgggggcggcgacgctcgcgcgggcgcggccgcgcttccgtctcgctgtccccgtcgtcccgtggctgctgcgggtgggagaggcgaggggggtgatagaatgcgggggcgaggcggggaggaagggacgtggacggctcatggtggaggcggacgaggtgcggagcgcgcgggcgcggtggtggcgccgacgaggacagcggacgcggcggggacggggacggggaggaacgcggtggccgtcggcggtggcgcggcggaggatggtaggagaacgccctctgtttctgttcgtcacgtcctctgcttgggtttcgtcgaatgcctgggatgcgtgactgttaatttggtcctctttgtgtgttcagtgtggtgattgtatcagggcggcgatcggtgggcgagccgacgctggacgtctctgagatgctgctccaggcggcgcaggcatggagaa

SEQ ID NO: 55117 - DNA, 1188 bp, Oryza sativa
caggttgcggaagggacgccgctcttccactcgggcgccgccacggccgcggccgcgatggcgacggtggtgttcctcctctcgctggcaacagaactgatttgccgttggaagctgtggtggatggtggtgatccaattgcaaatgtgcatcaaatcttcagcaaatcttcgcatgctacggatgagaatcaggtcgcttgcaaagttggttcactggaggatgttgtacaagaaggggcagcaaatagtggtgaattgctggggtggaagcaagtgttagctcaagccgcgaatgtgcttcccaagaggaggatggtatccgcgacgcgccgcttccctcctggatgtgggagggacgttaagactggttcaggtttggaattcatggctgttgatgcttcttgtggtggtgtgtcaaaggaggtggtggcttcggatggcggtgatagtttggttagccaggaattggaggagggtgaggtggctgatgaggcatactctgatgtagattcacaaaatgttgctgtggatgattccatggctgcagctactgaagatgttaaggtgatgaacaaatgcaaagggaccttacccagagccgctgctgaaccttgtgctgagggtccttccaaagaacattttaagggtacgagggagtgtgaaaatgataggatgggaaaatcatccatgaatgttgcaacagaagtatttggtgattgtatgatgagaagtaagatactattgacagctagaaaagcagtcaagtcaccactgaacattctgcatagacgtcccttctctaagggaaaagaggagtgtgttgtaacaaatagtgctccatgtggtcctaagaagaagttgaaggtaaaaggtgcatatcaaactaaagatattcctatcaagattgtctctacacctggattagggggcaaggacaaccttgtcgacaaagaggctttgatcttggaagatgatgatattttgaaggcactagctgttcatgatggaacacttaagttgtatctcaatgcttcctcatctgtgcagcatcacgggcaacatggaagtgggaatgctgatgataggaggaaaaccatgatgctgtgcaggaggtttcagtttatacgccaggctcttgtacaagctgtcaaacagggctcgtagaatgttctaagagctgaccttg

SEQ ID NO: 55118 - DNA, 3051 bp, Oryza sativa
aagttacatgggcctggttgaaggtatgttatagttgcagggtatctaaaggggacattttactgtacccctattggttatggtagtagtgtagtaggaagcagatcatctaaagctatggctattttagtcatgtacttcgttaaggtgaaggggcaatttagtcttccgattatcccaatcgaagcaaaacaggactcgttggtttgttagatcggcccaagcctcattctgcatctcgacgcacgacggccaaaccacagcgccgtccatatttgtatgcattttccagaggtatctttgcgataacaaccatgcaatcttagatatatttgtgaaaagaaaaaagtgcatgcattggaatataaccgtttcttgccttgtgcaaaagctaccacttctccttcagtgtgtacttggatcatagaaggtgacaccttcaaaatgcaccagacaagatgccagtaacaagaacatgagtatgtggattggattgtcaatcaccaaaacccctgaattcagctgtgcaccacagctgccgtgggttagctcgtataagagtgtgcccaaatatgaaaatcacactcatgaaaatcaaaatcatttctattaacaagatgcagtaaaatcatgacaacatcctgaagaaaatttggttagctgatagaagtcatagaacaaaatgtatttcaaaatatattccatcactgatttcaatttcaggagcccaatttttgtactaactatttaactgtaggaaagcttactataaaccaatgaaaaaaagaaagcattatatgatgacttgtctgaattacagaatatgtggcgtagttgtccacttacaaatgaattcatcaactaattgatctcaaggttattccagattgtagataggagcacatctcaagcttcaattaaaaatccatccaaaatacgaattgaaggacaaaagtgaccagaattaggaatgcatactctaatactctattctcaggagtcaggacagttagataacctgctggctgttgtgctggtagccttggcattttcaccttcacgtgtcaataaaaaagagtaaatatgactttcgtggagaattgcttgagtacagtgtacactggatgggatcacctatacatttgtcgacaaattctcttctaaaaatttgacaaatgaaattataggacaattgtgatgtaggctgtgtttagtttacaccaaaattggaagtttggttgaaattggaacgatgtgacgaaaaagttagaagtttgtgtgtgtaaagttttgatgtgatagaaaagttggaagtttgaagaattattttggaactaaacacggtggtaatttcactgtaactattataacttgtatgtaacttttaaaagtttcttcgtagtatactatttcggtgaaacggaagtcgtgggaacgaatcctctgacatatgtgtgtgttatttttttccttcctcacttgcacaaatcttgaaacaaatctaacggtccaaaattatgtgaaagttatgtataagttagactgtagttacatgcaagttacagtataattacatgtaagttacattataattacattacgattgttctgtattacatctgccaaatttttaggagaaaatttatcgacaaatgtatagcaaaattgttttgtaatatattgattagaaaattctcaatctcactcttcatagtatggttttgaatctcaagggtgatgttttccggtggcgaaaatgggcgtgaagtgtcgctcgaactcctggaaggggtgagagtcgaagcactagaacacatgcgcaagtacacggaaggcacttcggcaacctataacaagaaggttcgaccgatagaactccggcccggccatctcgtactatcctaacctatatttttccttcaaatttaaaatcgggtataggtagtgccggatcggataacatgtcacttgtgccgtatcacattccatattaatttctcgaaatcggatacatgaaagaatttctatgtgcaattcatgcatattaaatatagaggggcaattaaagtaccaaaagagataaagcaagaaaacatttatgtaatattacctatgatattataaactagtgtaatcaatattttatcatgtttgtaggtgaacttataacagattttcatatatgtataataataatatgggaatacgagtggacacaacttttcccttattaaaacatatcttttacgaatttggattcgaacttggatagtatcgaatatccattttctctcccatgttcttgtgagcctcaggccaggcaggtggtcggaaaatgcccgtcccattttcgcccgtagtaagaactagaaaaaaaaatctgaatttacccctgaactattgacaccatccgagtaaccccataaattacaaaaccagacatatctacgcccctaaacttttcaaaccagacaacaaaacccctaactcaatccgaagcggtttggattttaggtgacatacatgtgttagtccaaacaacaaaaagtaataaaaaaatagtgggctcggtcagtctccctcctcgctttcgtccacttccatctctctctctctacccccaagtcctaacagaaaggagggaggtggcggaagctcagctgccggaggaagaccgtggcaaaggaggcgtcctcgggcatcgaggtgcatcatgacctcccgtggaggcggcggaggcgctagctagcacagagcacttgacgactttggtcttgcatcgatgcctcgacgcacgcgcgactgcttctaggatagatggtgatgtgctcgaaaatggctcaccaaagccatgatcttgatcacttggtggatctggaaggagcacattgtgcgtatcttcggcagagttcagcgccatggtgttgcagacctagtctatgtgtggcggtagctattagcggtttaagaaccttgaggcggtcttgctttaagcggtatgagatggtcttaccttggcaaaactagtttcctgagattttatattctaaa

SEQ ID NO: 55119 - DNA, 1383 bp, Oryza sativa
atcaaacttaaacgactaagagcaggtacaataacagactataagccagctataaatatattttaaggagataaaagaggaaagataagagcagcgggctacagatttatagctagctacaacacagactccaagacacatgtgtgtatgatagatgagaccatatattgattgtgtagtatatgtttatatgtacttcctccgtttcaggttataagatattttgattttggccaaagtcaaatagctttaagtttaaccaaatttgtagaaaaaggtagtaacatttttaacacaagacaaatttattatgaaaatatattcaattattgatttgatgaaactaatttaatattataaatattattatattttctataaacttaatgaaacttaaaataatttgactttaaccaaagttaaaacgttttataatctaaaacggagggattaactattgtataaattggctattaagttaattattaatgatttagagccaatagtttactataccattaaacttgcactaatgatatcatgaaatgaaacggcgggagtagcagcagccgtttcagcagctaccatcgtagaacagcatcattgccacaataatgcccactaccagtctactaatttacgccgcagtaaatactcctactccaatgcaaacctcaccggtactatataaaacgagaaggcgccaggcgggttgcaagcaaacacacgacccacccgtcgttgggtcagccacgtgcaccgcgaccgagccggaccagtttggtctcggacagtcggacccgagtcaaccttcagcctctggtgcggcgtccgcccgccacgtgtcctcgcctcaccaatcatcacccatccttctcttctcggccccaccaactctctctctctctctctctctcgctgctcgcgcaaaaaccccaactgcgtcgccgtgctcgccgcctcgccgcctcggcctcgccgcgcgctctctcgccgccggtgtctggacgacgaggaggtgagtccgtacgcctcgcctctgtgttgttcttcgtgttcgctgcttcggttcgtcgtgttgtgatgtgatggcgtgttggatgatgtgtgtaacggctaatttggtgcgggttttttgggcttggtggtggtggtggtggtgatttgcagggcgggtggcggcgggggatggatcgctgggaggcgttgatcgccgccgccgcgcggcggagcgagccgccgaaaagcgggtgggcggagtggggcgggggcgggggcggcgacgctcgcgcgacggcgattccgtctcgctgtcctcctcgtcctcgtcccgtggctgcgggtgggcgaggcggggggggggggggggcggtaaaatgcggg

SEQ ID NO: 55120 - DNA, 8782 bp, Oryza sativa
gggcgcggtggtggcgccgccgagggcagcggacgcggcggggacggggacggggacggggaggaacgcggtggccgtcaacggtggtgcggcggaggatggtaggaggacgcctctgtttctgttcgtcacctcctctgcttgggtttcgtcgaatgcctgggatgcgtgactgttaatttggtcctctttgtgttcagtggtggtgattgcatcagggcggcgatcggtgggcgagccgacgctggacgtctcggagatgctgctccaggcggcggagacatggagaagccggcgcacgcagcgcgaagcccgcccggacgcgcttccacctcgtcccgtcgccgcggatgggcgaggcggctcaggcgaggggaccagtagagcgcgggggcgcggcgaggaggggatgactcaagtggccgtggccggtggtttggccacgctcacgcacggcggcgagcgggatcctggcgcggcggtggcgacggaggagaagagaaatggcggcgaggtggggacgaagaaggggttggaggagcgggccgcgcgttcgccgccgccgctgccgccgcccaagcggagggcggtgtcggccgttcgccagtttcctccaggttgcggaagggacgccgctgttccactcgggcgccgccacggccgcggccgcaatgccgacggtggtgttcgtccgttggatcaggcgactgctcctcctctcgctggcagcaaaactgatttgccgttggaagctgtggtggatggtggtgatccaattgcaaatgtgcatcaaatcttcacatgcttcggatgagaatcaggtcgctcacaaacttggttcactgaaaaacggtgtacaagaaggggcagcaaatagtggtgaattgctggggaggaagcaagtgatggctcaagccgcgaatgtgcttccaaagaggaggatggtacccgtgacgcgctgcttccctcctggatgtgggagggacgttaagactggttcaggtttggaattcatggctgttgatgcttcttgtggtggtgtgtcaaaggaggtggtggcttcggatggcggtgatagtttggttagccaggaattggaggagggtgaggtggctgaggaggcatactctgatgtagattcacaaaatgttgctgtggatgattccatggctgcagctactgaagatgttaaggtgatgaacaaatgcaaagggaccttacccagagccgctgctgaaccttgtgctgagggtccttccaaagaacattttaagggtacgagggagtgtgaaaatgataggatgggaaaatcatccatgaatgttgcaacagaagtatttggtgatggtatgatgagaagtaagatactattgacagctagaaaagcagtcaagtcaccactgaacactctgcatagatggcccttctctaagggaaaagaggagtgtgctgtaacaaatagtgctccatttggtcctaagaagaagtttaaggtaaaaggtgcatatcaaactaaagatattcctatcaagattgtctctacacctggattagggggcaaggacaaccttgtcgacaaagaggctttgatcttggaagatgatgatattttgaaggcactagctgttcatgatggaaaacttaagttgtatctcaatgcttcctcatctgttcagcgtcacgggcaacatggaagtgggaatgctgatgataggaggaaaaccatgatgctgtgcaggaggtttcagtttatacgccaggctcttgtacatgctgtcaaacagggctcgttgaaggttctaagagctgaccttgaagctgataaaatcgttcggaaattgccgagctttatcaaacctggacctattgtgggaaatgttcgtgttgtcgaagttggtgacgaatttctatacagagtttagctagcccttgttggtctccaccgtccataccagggaggaatcgataccgccgatcataatggagtgcttgttgctataagcatcgttgcttctggaggttatcctgatagattgtcaagttcaggtgaactaatatacactggttctggaggacagcctactggtaagaagaaaagtgaggatcaaaagctagagaggggaaatcttgccttgaagaattgcatcaagacaaagacacctgtccgagtgatccatggattcaaaggtcaaaatggcaaggatgacagttattcaagggctaaacaaatctcagcatttacttatgacgggttgtatcatgtggtggattactggagagaaggtctaaaaggttctatggtcttcaaatacagactacaaagaattcatgcttatagatgaggtcgatcgtctaaatcttttctagtttgcttattgttaagtcttaacaaatgattcagacggtaaatggtagaatgatattcttttctacaccatggatgcttacgccaatctaaactctcttgcttgttaggtacagaatcaagatgtattttttgtcctgggtggtataattagcttagaaggacgagaagtggcatgggcctggttgaaggtatgttatagttgtggggtaatctaaaggggacattttactgtacccctacttgttatggtagtagtgtagttggaagcagatcttagtcctttacttcgttataaggtggaggggcaatttagtctgttccgattatcccaatcgaagcaaaacaagccttgttggtttgttagatcagcccaagcctcattctacctctcgacgcacgatggccacgccacagcgcgtccatatttttatgcatttttcagagatacctttgggataacaaccatgtaatgttagatacatttgtaaaaaaaagaagtgcatgcattggaatataaccgtttcttgccttgtgcaaaagttaccactttttcctgcagtgtgattggatcatagaatgtgacacattcaaaatgcaccagttttgtttgtagcagtattcagatcaatcatggatcgctgatacgtgagatcaagcaaatagacaagatgccagtaacaagaacatgatatggattggattgtcaatcaccacaacccctgaattcagctgtgcaccacagctgccgtgggttagcccgtataagagtgtgcccaaataacaacagcaagccaatacaactaattttggtaaataacctaatcaaataactataggcctaaaacaggtccacccacactcccacaggatgtcaggattatcatgtgttttagcaatttatcttccagggactgaattggcacaaaactgaacaagaacaaaacatataggatgtgagaattaacatgtgttctgtacttcatttttcaaggacagaacaagtgcaataataaataagaacaccattttttcttctagcttgatgactgataattctcaaaggcaatgcatttttatcttcatgatgataaaccaactgtttcatttgaaaagtgacaaataaattgctttcagcttcatgaactcttctggtcttcctccatatcaccttcaccatacattaaataaaattagagtggacaaactgctaatccaaaagtactgtatatacaagatcctcaaggtcaagtcacactcctgaaagtaaaaatcatttctgttaacaagatgcagtaaaatcatggcaacatcctgaagaaaacttggctagctgatagaagtcattgaacaaaatgtatttcaaaatatattccatcactgatttcaatttcagcagcccaatatttttactaactatttaactgcaggaaagcgtactataaaccactgaaaaaggaaagcattatatgatgacttatctgaattacagaatatgtggcgtagttgtccacttacaaatgaattcatcaactaattgatgaaaaatccatccaaaatacgaattaggacaaaattgaccagaattagcggacatcgaggacaaataataaaaaggaatgcatactctactctcaggagttaggatagttagataacctgctggctgttgtgctggtaacgttggcattttcaccttcatgtaggatcgaatagaaagaactaagccaaccaaagagagtgagtaaatggttagtatacctaaaaacccaaactttttgcggaattaaaagttactctcaaatcgatgtagatcggtctgaccgaagttgatccgccggtctaaccggtgtagatctcccagttggaccgccctgaaatcgcctctgtctcctgaagccgtcgccggtctgaccgccgtatacccgccagtttgaccgccgcgatgccaccggtctgaccgccggtgtctcgccggttagaccgccgaacctgagcaaacacaaatcaaagaattctcgaagtagatgacaactttattacttctctctgtgtttacaaagtgcaacaacagcactcctcacgaaaatcttggctaaattcgaaaccctaactcaactctcaactcaatgctcttaaaagcgataccgggaagcctcacgctccctctctatttatacatgaagtaggcagcctaaagccactaatcaaactcatactagaagtcctaatccacctaaccttcccgtacaagaaacaaactttacaaactccaatcataccaaatttggactccttcaaaattcaactccgtatcccatacgcacacaatatctccattgtatgccatatggaatcttcaccaaccatgtgtattgatctttagcctaagtattccacatgatatctgactgtccggacgtcatcttatctccaagtcgactcccgatccatcaccggcaatactctcctgaggcatcaagtcacctacacatgaatcaaacaaagaaaccatattccaataccaagctatctccaatttgactcattgttagcaaacaacagtattacatacgcatagtatccatctagaagccataaacaagaaacaatcacggatatccaaacaaacaacctgaaaccgaagccgacacagagtcggccggtcagaccgcgggctggctggtctgaccggcaaccactgcccggtctgaccggaccaactatccagcagcacctgtaaatccaatcatctccaaaaccactttgccaataatctccaaatatcaaaaccgataatcacagatgccaattgttcatcacagaataaagaatcaaaaacactttgattttacacttcacatgttaataaataagaataaatgtgaattccgtggagaattgcttgagtacagcgtatactgaatgaagtaaaatacatgagttaactttgtaacccccccccccctccccccctcttctcctcccacgcccattttctgtcgaagtaaatccaccagtggatgtactgtaacctccacaattctaagcacagaattatgccaccacgggtccaaaggtatgatgcaattttagaaatttaatgtggcgcagaatacaataggtctatccaaaatctgtatagaggagggctcataagcagatacatgttaggatagggaattacaatgtatgttgtcatcagaatgcatcagcatggtaactatattatctaccatccccaaagtagcaaacatttatagggatgataacacggatacagtctggatagttcaactttgtgtaatatcttggttagaatattctcaatctcactcttcgtagtgtggttttgaatccgattccctcaggtgaagtttcaattaatcagtcaataagagtagtatatttgattattggctttcacacacatcaaacaaatcaacaataatagagtggcacatcaaataaatcttgtagaagaacagaagattgagggcttcgaagtgttgtgagggcttcgaagttcaatcattccaccaaatgccaatacatattaagtgtccatatcaatatgaataaattatttagaatttacacatagctatgtcaaatcaaatttgttaaagttcatgatttgaatttgaaaaatacatggtatagctctgtgtaaatttcaaataattcactcatattatttaggagaagaacacacccttagctggtagatcctagctttgttccctccctgttcaccttataggatcgaacacaaaaaaaccaagcctaccagagagggatgaatggtacgaatatcaagaacaaaaacttttagcggaaacaaaagtttatcctctaacctgatgaagtccttggcatagccggtctaaccactgtatgcacaccggttagaccgctcatctacgttggttgtctcatgccagcaatagaagcagagtcagctccccctacctatgctattgcctcctcctcgacctccctgcatcatccccacctctcatcccacatgagcatcatcgttttttgtcaagccgagcagcatcgctacctccttgccgagccgaactatgtcgcccgccttctctcttggcctctccttatcaatgccactacctctctatcgagacaagctgctctactgcctctaggtctagtcctgatctgcgtacctagtgatctcgagctcagaagattccaaactcaacgtcgtttggcttgacttcattgcattcttcctagcaccacatcagttttgacctcgcccacctcctcccaaaactccatgggcagcaacaacagagagagagagaggcaaggagaactgatctttgtagtcagaacaccgtcgaggcaagtcttcgtcactagagaattgaagaaaagccaaggtagtggtggagaagagggcagggcaacgttgtcctagagacactaaaaatcccaagttcacctgtcttgtttaactagggaaggctggaaaggcatatattagagagtcaaaatagaaagtttattggagcacaagaatgagggaatcttttggcatggatggttaaatggagatttggatagccaaatttgatatctcttggagatgatgactgttatctcacttagaagatagtatatgcaatatgttagctctaggtgcaagtaattttattttattcattttaaactactctttttctttccttccctttttttatgcataagtcatcaacctctccttcagtaaaatatatttatctaaaatgttctacacctacaattacgttgataactagccattatgcaactaaaataggggcaactccttacatgtcaccaagcatgtatagttagtttttagtgccttgaaaggaatttatcaaaccatgagtggcaaatcaattgtgctcagaagcctcaataaacttctgctgatctgcactctaggaagctaatggttgatctgtatacttcctgcatttcatccacaacatctgtttggcatgtggtaattaagaaaaacaaataatccaattaggtgcaatcagcacaagtaccaataaaaagaccatatcaagagaacttcaacatccttttgtgctgcagatcacttggacaagatccattcttttcttttcccggtgacgatcaagatctgctgaaaaagctgaattaaaagaaaggcaatcaagcagcacaggaagtaataatttgacactactaagctgaataaagaaaggtaatcagcacacgaagtaataatttgacactattcatttttttcattcattcacacgctctgagcacattatcctcaatcctgctgcctttttcttctctctttcctctttttcatgttcagatctgcattctgatttgatgacatacgaaatgtgaatcttctgacatctagcatatggggtggaatggtaaaacagaatttgaggaaaatatggacgggcacacggcactacgtcaaactggttggcaacttgtgatcatctgaacaattgcaacaagagtacattgcaaaatcatggtctctgctgccattattccattattttgcaatgatctaaatatagacgacaagatgaacccgtatatgccatatccaggtgtgatataaaaggaatataaaaggaagctgtacacatttgctgatactgtactaaaataggcgttctgaattcacactgcacatcaatcagatccagatcaagaaagaccataaagaaaccaaattaaaactggatccttcagctttgcaggagtcagcgtgaccttgtattccttgtttgtttagatcaaacattatttcattaaattcgaattgttacaatactctctagagaaagttcacttgtaaactaattgatacatagcatttgtagaaaaatatgaccgtattgttggagccaaaccgcggaaaaagtagtacagttctcaggagactaataaatctaacttgagaagaagagaaacctcagcatatctcaattatcacatttgattcatgtcagcttgaaaactatgcagaacgagccgtagcttcagacccagtggactcatcaggcctgatgagcacaaaactttggttagtagttgattatatggagaaaaaaaaagcaatgaagaattagggataggtcaaattaaactgaagtcggatgagaaaattagcaagaaccataaagtaaaatcgcaaacaattgatatctaaaagaacatattgctttttttatgggccatcagtttgtttagtgcatctgctgttaaaggacaggaaggtttatagtgcatatgcacaactgcaaaaaattaatcagataaaattaccatccacccccaccaaaacccaaaaaatgctcaatccattgttgctgtgacaaatatattgtacct

SEQ ID NO: 55121 - DNA, 13861 bp, Oryza sativa
  unsure (1)..(13861): unsure at all n locations
catatttttgctccaaaagcacaacttcttcaaaatactttcttagtcggccttccaccattttctccatggccatttgggattttccagagctttcagcctaaaaagtttcagagtagtgtgtcactaaatcttaaataacttgaatgcagttcagtcatattccagatggatgtagcccatgtgtctccagaagatgacaaaagatattgctatttaattcatggaaaaataaacataattggtatcataaacttctaatatacggattcacattgtgttccattgcatagctcatctctgaattctaacagcccagctgtcttgcttacataaacataaaacaatgtgacaggaatactaattgagaaaattctattgtgagtcaacagtttcctttcattttcttttagttataatgagttaggacttatcacaagatatgcatttttctctcaactataggtcattattgcctatgtatgtttttctgttaagataacatcagaacacttggtatggtatgaccttatgatacctgatatctctatgtaaagcacacgcccatttcttcaattgtaagctaatcatatagaattacagtgatgctaaatttttccggtgcaaaggaagtaacatttatcagaataacgtacctgagtccggagtatgtccctctcattttcaacagctgaagcagagaccagttcttttgataaaaacaacggctttgtcgcaacgatgtgcattgcaatagatttcccgactctctgaagagcatcaagaggagcattgctgtcttctgcctctagtgtgatcaagccagcaagacgacccaaaccttatttcagaaaaaaaagaaaaagcttattcattcagtgaacgagaaattgcaccatttaccatatatcaatacaacttcatacttctgaagaacataaaatatggattgctgttaggaatcaaattaataatgcgagcaagcttggccagctcagtgtaagaggcaagtatcactaaagtcgtattactatcaatggttttacaaatgagcttgcatcctactaaataaataaataaataagaagctaaaattcatcactggacaaccctaagagaatagattaactataatttagattaaggaaggtaatgtccagaagtccaacaaatttagatttctgaacccactgccaccccaccccccggcacaaaaaaaaaaggaaaataaataaaggcaaggacaagtatgatccatgctcagtagtcactagaaaactttcatttggttatgtgcactcaaacttagccaagaagattggaaaacatgcatgctacattcttgataaaagccaaagggcagagatttgtgcatgtacctggctggggacatgtgtgcatataagagcaaacaacaccatgtgcagttgtggacataatgaaacctcttctgaatttgacattctccccaaccatggcagcaacttctgtgacagcactttggactgttgtctccccactaagtttaggatgatcaagattgacattaaggttctgcatgattgagagtttgagacaactttataatatctacttacacatggaaaaaaccaggaaaagaagataaacatatcatatgaagctaaccaaatcatatcatgggaacagcaacagacattactgtgtgcacaggataagaagctgtgccctctgtgcaaagggcacaggaagtgagagagagagagagatcctgggctcgcacatcaacgtggcttttctctgagagcatggctctagtggagggagatagtgcgcaacagttattctaagggggggctgtagaataagcctacccaaactaaatatctgataagcactaaaatcttcatgtagtttaaaaaagcaggatatatatacatatttacaatggctacaatatctacaatgtggttgttaatgctggtattgcaaacatgttcatttgtatcatgatcatctccacatagcatcctctgtaatactagagccaagtcacatttatcatggcatttccagtccactgccatgaagttcttgtgtcacatatgactaaatggttgagccattttaacttgtttccttttatatccaacataaacagtgtgctaaaaatcagctgtaggtagcaattcggtgccaggcggcagcttggcactgcgattagcactttggcggtgagctcggcagctgccccacctcaatagtcatcctcggtccaactcagactagttgtggcagcaagtatgcagtgaagagggcgactagtggcctaggcggctcagtacaggcgaggatataagtacctccccaccctagctgcccaacctaatccccaaattggagcacgtgcaacagcggctagggtttgggagaggcgatggcgattgaggtcgccatagacgttgccgccgccaccgtagttagatccactggcagctcgcctgctctgctgcgactcctactgctccgctgcgacttctactgctccatcgtccctctgttctccccgccaggcactcaccaccatctaccatctccacgccaccagccgcttggacatatgcaccagcacaccagcacagtgcacaattatggccaacactgaggaattgagcaagtaagccatgctctttggcctttgctgtgctacagtctattctctagtatctatatactgctctgttcttgtgtgctctgctactctactctacactatcagatattcttccacaatttgcttgtctttgctgtgtgggtgcggctggtggtggtggtaaattggtgttgcttgctgccttgatggaaagcttgtacttgcttgcttgctttgcttcttgctgcacctgctttctgtggtggactggattcgaaactgctttttcgcggctagtcgtgcgcaccctcccccgcgtcgcgcaaagaggagggcggcagacagccatgcttttccttttttttttccttttcctgtttctttccttttttttctgtttctttttcactttttcgggttttttttttcggtttgttatacaaactatgtatacacatatactaagtttgtatacatgtatattttttccttttttatacatacgtatataaactttgtatacgtatgtatacaaagtttgtatattttgtatacgttgtatacaaactttgtatacatgtatacatattttttatacatcaaaagtgtatgcgtatacatataaaaaatgtagggtatatatacaaagtttacacatattttatcgtctatatacgtatgtatatatacctcatatacatgcgtataaactttgtattgtggtatatatacaaacgtataaatactgagactagatgggtagcgctggtcgcgcgggtgtgccggcgcgcgaccaatcgcgtatcaaccatccccgactggattggcttgggggtggtggtggtcgtggtggtgatttagtcaggtggatggctggatgctcttgcagctgtgtggtgggtgttacataaatatgatcacaagtatcttaatatctctatcagtacagcacactgaatccatactatttgaaaaggtagtgtgtagtgggcttaaatacagatacaccattattgaaaagataacatgagattgatcacagcacctgttaaagtagaattttacatgaaatggaacttaatgaagacttagatcagttggtttcaaatttgtaaaatgacgagtcaatcaattactggtaaaattggtggtgcttctataaattacacaataaatgcgccataacccaaattaatatatggataacttcatacctccaaatagtcaggaccaaaaggaaaaaccaattcaccaggatcccttgctgataaagccaactttgctaaagaagaagcctgcaagtttgatgagatataaaaaaaaatcataaatcaagtttaactaccttgaaaccacgcacaagcacaagctgaacaatcaaggcagttaaataagtatgctgttgtgatgtctaagatagggaaaagaatatcctacaagatacacagctatcaaagaagttcaagagtacaactgcaacagagcataatgtcataatgttgaaatactcaaataaaacctacaaaagaaactgaaagttaaaacatggacaaaatgattctgttcatattttgatatgccacaaccaacaagctatacctacatgctcaaatacactatatgtttagcatgcacaaaaagtaggcatcaggaatggcataaagatactgagataaaaactaaccagatactggaaaacatcatttcttgccacaaaatccgtctcacagttaagctcaaccacagcggcccttttctcatcttgtgcaatagcaagcaaaccttcagctgcagtccgtgaagactttttggcagcaagaaccacccctctcttccttaggtccttctgtgcaacatctgaaagaaatcaacaaactgtcaataggattaacagatacaaacaagtatgccgatgaagtaatgctaatgcaatcagaaataagcacaaaccaatatcccagttgcaactaactaaggaagccttcacatctttgattggagcgctcgtcctctccctcagctgtttgatgagattcatttgctccgacgcaggaacttcggagctgaatctcctgagaagtgtggcgctttgatcgacattgctgctcgaaaggtgagcctggaacgctgaataagagtaaccccgagcagaatgttgttgggcgcgaaacagaagcccaatcatgggctttctagcactctgactccaggccattctcacaatgttctgcaatgcagaatatgcagtactgttggtaaactaaactatcatcaataaacatcagaaaagcgagctccaccgattaggtctcaactaaagaaaagagatatgtcatcccatttctgcaactaggcagcggcggatccaacttggccaaactttttggggaacaaacaacaaactgttacttgtattaaggttaaggctctgaaattaagagaggagcttcttccagatctagaagaagagctagggttaacgaacgcaagcaaattccagacaaaagtagtcccggtgggagagagagatgaatcaggatgtggatgctcaccaggatcccctcccctgctctgctcgccagatggagatcggcgcccctcccctgttcagcagagagatgacgcaaggagcggaggagacgagacgggatacctcggcgaggacggagacggagacgcggacgacggcggcggcggcggcggcggcggcggcgacgagtggagcgcagccgcagggacgggacagtgagggagacgagggttttgggttttccgtctcggagggctggtttgtacgtcgatgggccgagcttacgtgggcctattgggttgaagcccatttggtaaaacttcgacacatgtaggaataagtctaatatgcgtccctcaactcatgcatctggttgaaatgcacccctcaaccgcaaaaccaggtataactttcccctcttcatcccacgtggcatcgacatggcgtttacgtgacactaaaataaaaataaaaagaaaattttgggcccacgtgtcacatatgcgtaaccatgtatttgcctgccaccctttagaaagccaagtgcagagcacttgttagttgttagtacaaacctatcaagacggacaccttaaatccccatactgtcaaacaactctacggctactccaccacacccaatctgagcgtatccttccaccacacccaatctgagcgtatcctgtgataaccgtattccaagtagttgggcgcctgggcctcctgttgggagtgcatgaaacaccaacattgcctcatccatgctgcgaagctttgcatacaagttgataggcactacgttacctgtatacggcaaaaaaatcacgtatccatatcggatgatacggtatcggatacgctccgatatgtgtcccgtacgtatccatgattttcacaactaacaaataaaacaaagtaaatctggatatttcgtggatacgccttgatacatcgcttgaaatcgctgagcagtacaaatccatggcaaccaccatgtgagctggctcgatcttgttcaccatttgatgcccctacaagcgcatggttcctatgctgccgctgtcggacgccatagctccacctctgctattgggtgtggcactgacggtgtccccgtcgtagccggatgtaatgcttccccctccgcgagtcggttggccgccgttggacgtattacctccaccgctgagcgtggtcccgccgccgctcgggcgctgctgctgcctactgggcgcagtggggcctcctcctcagtggtcaggcgcagcgccatagttgaacacaacccatgcaccgctgggtatttgcttattggtttgttgcttctttgatttgtttccataaagtacaggcgcattcgttttttatgtagggtttgggagtagtaaggtacggctggtaatgttgttgcagcctacaggctcactaacagtattttatgaaacaatcaagcttcatcatatttctttttttttgtcatggacatgtgtggatccatctttatttgtatacgggcgtatcccaaaatttatagtttagaaaataaaatttgtataggtgtatctccgtatccatgttttctgaaaaataccgtatccccgtatctgggtaacataggatagacgtagtcccaacatagacattagcattcaggtccaacttgacgtcaatcccattcacttgcttaccgaataaaacagccttagattgtgtacacgcacgtaggaggcctcccagaaggcagcgaagatggaaatcgtagagtcatcgcgcccgtgctgtgtgtacatggagatgaccgagccccaggaggcaggagacaaggttccgatggtgcattagagcaactccagtgtacgagtaaaatcgaaccatacttgaaaaaccgaatacaacacactacagcaaccaactgttatatgttagagcaaaaatcgaccacagaaggagagacgaactcggcgatgaaaaggtaatttgcagtcgttggctggctgcacgagagagggatggacgcatgtgattagagattctttttctacgtgggtccatgatcaatgtcacacattgcagccaacgaatcaaaattttgctcgaccatgcttattcaacatttgaactatgactaaggtgccttagatcgaacaggtgggtacagactcaccccgtcccattcccctagctatccttatctctctctctctctctctctctctctctctctctatatatatatatatatatatatatatatatatatatatatatatatatatatatcagctattcactttccatttatattacacatagcttgcactaaaagttgattaaactcaaactttatcgatcgctcgagccgtcacttataataaatatgagtaaattgcacccacggtgcaacaacttggtaggtgggtgtaatttggtgtaataacttgaaaaatgagcgttctattacaacaacttggcaagaaggtgcaatttagtataagaactttataagtgatcgtataaatacagcaactttgcaaggtaagtacgattttgatataataaattaagaagttgtgtgacaacttaattatttggagcattttttatataaattcaaatttttaagtatttattttgacaatatactagcgtggatttgtataaacatatttatatttttatcctaataactaataactctaataactaataactgaaagttaattaaactggatgtagaaattattatatttggttgatatttgagaaggtgaagaaaacaaaaaaattcttaaagaaaactgaatgtaaattgtatgtgcaatataattcttaaagattaaattcaatattataagataatatccataggattactatgtattggcatattgatatcggaaaaaactcacctagcatatgcttagccaaattgattcaccaaaatactaaattgtcaagttcttgtattagaacgcacccacttgtcaagttgttgcactcggacattcaattctcaagttcttgcactatatcgcacccacctgccgataggggtggaaacgagccaagccgagccgagctcggcttcgtgaaagcttggtcaagaacaggcttggctcggctcggcttgataaatggaacgagcaaaaagtgcagctcggcttggctcatttaaaagctcgagccggcttgagccagcttgagagggtggccgagcggcactggggagggaggccggaggcagcgcaggggagggaggcggcgccgcggcggcatagggagtgtcgagccattgaccgtcgagtgtcgctggggagggaggccggagccggtgcagccgcacaggggagggaggcggcgcatgggagggcgggccggagggatgtggcgggccggcggcacaggggagggaggcagcgaaccggcggcacataggggtgactggggatgggggagggaagcggcgccgtggtggcgcggggagcgtcnagcgccgctggtgagggaggccggagccacgcagccgcacaggggaaggaggcggcgcanggagggaagcggcgagccggcggcacagaggagcgactggggacgggggaggaaggcggcaagccgatgggtggcggcgcatgggatggagccgaaggtggcggccggcaactcctctcgctagtgacgccggtcgtgcgtgcgtgcgccggcgtgcctgcacctgcgtgggatggggaatggggagggtcggacggagcagttagggtagggttctctgttgttttttatgggccagactgagacaacttgttaatgggctaggctaggtcatgtttttcacaggcttgacgagcctaccgagcggctcgtgagctagctcgggctcggctcgatttgcaaacaagctgtggagggagctcgggctcggctcgtttagtcttcgagccgagccaagctcacgagcctaagttttttgtccacccctacctgccaagttgttgtaccgtgggtgcaatttactctaaacaaaatataaggtaatctacgataataaaaatcagactaagcttaaatacatatttttccctaaaaaatattccgcgacttatctgatttaaataagataattgccaaaaaaaatcatcgcgaactttcaattgtaattacaacatataacaacggtgtaacattatataaatatagagtataaagttacatattttataatatatttacatataaattatattgtattatagtatagttatatttcaaagctttccactcaaaaaacgtgtcgtagtttttaataattcctcaaataacacttcaatttaagcatgttgtcgtctaattctgccatgaacactaacggctcgatcagaaaattatcgacaacggttcctttttaactacaaacacttacacgcacgagtacttttctaacacagttaaaaattcgaaaatgctacacgtacatccgaaatgtcacgccgttgtgcatttgctgttttaccatttagtcgtacgccggtgggacacctagttattggaaccgaccggaccggcggttggatcggaaaaaaccgaaaccggttcctttttaactccaaacacttacatcccgttataacgcacgagtacttttctaacatagttaaaaattcgaaaatgctacacatacatccgaaatgtcacgccgttatgcatttgctgttttgccgtttagtcgtacgccggtctagtccagctaaaagaccggttgtgcaatcagcctggtatataccggttgggccgcccgatctgcattgtgcgtggtcaccttcgcagctggagagggaaaagggtgggattcgatcccaggacctcatgtataaaagtaaaccaaccaaccactagattacgatataccttgtgttttgaagggataaacaatatatttacattagattgaaccgcttcaaaccagtggttcaacactttaaccagttgaaccaataaatcattgaattgagagcatcgctggtttaatgaccggtccggtcttaataattattatgatgtgacaaagaacatcggatgcatagcggggttcttaaaaattactcatgcgtcaacaacgcggttgcaagaaaccgttggctcacgccacccgcgccgcgctgcgacccagcctccgttcgagctgcgtgcgcgtgcaccgccaccgagccgaaccagctgtcgcctgtcgccgggctcggacccgagtcaagcgagtcaagccttccggtgcggctgcggctggcctcgcgtacggccgccacgtggcctcgccgtatcaatcacgagaaggggagaaaagtggggcgttgcccagaaaccccagctgcttgctcgccgcgcgctctcttctcgccgcctcggcctcgccgccgtggccgccggtgcctggacgaggaggaggtgagggcgtacgcttcggccggtccgccggccgcgccgcgccgcgcctctgtttgttctctgcttgggctcgccgtgttggcgtgtggatgtgtaacggctaatttggttcggtttttgtgcttggtggtggtggtgattgcagggctggatcgctgggagatgttgagcagcggcgcgcggtggcagccgcggcgaagcggatgggcggagtggggcggcgacgctcgcccggctcgctctcctcctcctcgtcgtcgtcgtcccgacgtcgctgcgggttggcgaggcgaggggaccagtagagtgcgggggcgcggggagaagggaacgactcatggtggagcggaaggcgagggcgcggtggtggcgccggtgagaacagcggacgcggtgccggcgagaaatgcggtggccgtcgccggtggtttggccacgcgcggcgtcgagcgggatgctggccaggtggtggcgagagaggagaagagacatggcggcgagttggggaccaagagaggattggaggagcgggccgcgcgttcgccgccgccgccgccgccgcccaagcggagggcggtgtccgctattcgccagtttcccccaggttgcggaagggacgctgctgctccagtcgcccgcggccgcggttgtgatggtggtgttcgtctgttggatgaggcaaccgctgctcctctcgctggcagcaaagatgattctgctgttccgggtgtggtggagaaggtggcgtctgtagatggtggcgattcaatggcgaatgcgcatcatcatcatcatgctatgatggacacggtcttgatgaaatcttcacatgtttcggatgagaatcaggtcgctcgcaaagttggttcactggaaaatggcgcagaagggtcagcgaggggaaagggaggacacggcggtgaattgctgggaaggaaggaagtgttggctcaagccgcgaatttgcttcccaagaggaggattgtatctgcgacgcgccgcttccctcctgggtgtgggagggacgctgtggctccacttgctcacagagaagagagtaaggtaggttcaagtttggaagccatgcctgttgatgctggttggggtgtgtcaaaggaggtggtgactacggatggccgtaataattcggttaaccagtgtgcctcgaacattgtcggaacagtaaagtgccaggaattggaggagggtgaggtagctgctgaggcatgctgtgatgtggagtcacaaaaagttgctggtcatggagaaaaacttgaaagtgctgttcctgtaacttctgctgttactgaagttttgacaaggtgtggttctgatgagatggaagggtgtagttatgctgcggaggcaactgaaaaacacttgtcaatgggtggtaaatgttcaattggtggtcctttcaatgaaattgtccacggcaagagagtgttggggagtgatggcattaaaagggaagttcctagtcttgcaatggaagatcatggcagcattgctcatgaccaagaactggtggaggttgagttaactacaggggaccatattcaggaggctcaagttgctaccactgttaacccacatgagtctacaattagtagacatgaggcagctgtttcagcaaatactgctccagaagtttctattaggcatttttctagtgtgaagaacggaaacacatcacagcatgaggagacgatatatgcatctgcagctgctgacgttgttaaggtgatgaataaatgcaaagggaccaaatccaaagctgcggctgaaccttgggctgaaggtccttccaaagaacacttcaaggctaagagggagtgtgaaaaagatgggatgaaaaaatcatccatgaatgttccaacagaagtatttcgtgatggtatcatgagaactaagttactattgacagctagaaaagcagtcaagccaccactgaatactctgcatatacccttctccatgggaaaagaggagtctgttgtaacaaatagtgcatcatttggtcctaagaagaaggtgaaggtgaaaagcccgcatgaaagtaaaggtattcctatgaagattgtctctacatctggattggcgggcaaggacaaccttatcaatgaaaaggctttgagcttggaagatgatgatattttgaaggcactagctgttcataatggaaagctagagttgtatctcaatgttccctcatgcgttgagcgtcacaggcaacatggaagtgagaatggcaatgataggagcaaaatcaggatgctatgcaggaggtttcaatttatatgcaacgctcttctacatgctgttgaacaaggctcattgatggttcgacgaattgaccttgaagctgataaaatcatcaggaaattgccgggctttactaaacatggacctactgtgggaaatgttcgtggagtcgaagtcggtgacgaatttctgtacagagttgagctagctcttgttggtcttcatcgcccataccagggaggaattgataccaccgatcataatggagtgcttgttgcaataagcatcgttgcttctggaggttatcccgatgaattgtcaagctcaggtgaactgatatatactggttctggaggaaagcctgctggtaaggagaaacacgaggatcaaaagctagggagggggaaccttgccttgaaaaattgcatcaagacaaagacacctgtccgagtgattcatggattcaaaggtcaaaatagagaggacgtcagtcattcaagagctaaacaaatcttaacatttacttatgatgggttgtatcttgtgttggattgctggagagaaggtctaaaaggttcaagggtcttgaaatacaaattacaaaagattcctggacaaccaaaacttcctctgcacatagctaaatatcagaacactaggctgggatcccaaggatggtgagaaccatcttgatgtagtgcttagatcattgctcttgattgcccttgtcgaactcggacatgaagagactataaatgagggagttaggcggttccatatcttcttaaaagacagcaaaactaaccttcttccaccagacactagaaaagttcagattttttcttaacataccgctatagtgtcacgtctttggtatctagtgtactaatatatgtattgatctgcaggcttcatatctttctatgatgcagactgttactacctccagcagaggtggtaatggtgctctccttaaaatctacagagaaactgctgaa

SEQ ID NO: 55122 - DNA, 4129 bp, Oryza sativa
  unsure (1)..(4129): unsure at all n locations
tgaggcaccaaacttcatggtcactgatgagtgatgaggttaagctctaaatttctgaacaaacgatgattcaagacagtaaatggtggaatgagattctattctacaccatggatacataagccagtctagtctctctcttgcttgccaggtacggaatcaagatgcattttatgtccatggtggtagtatattagaagtttgagaagttgcatgggctgattgaaggtatgctatagtttcagggtacctaaagtgggttatttatgttgctatctgataaacaacgcacagatttctgatatttatgaacgaaaaaactataagcactgttgtgatgctcaatatttttactgttatgaggggttcaaagttcaagttccaccaaatgccaatacatgttaggtgtatatatcaatacgagaatcaaatttagattttacacagagctatgccaaatcaaattatggtccttgagaaggtaccatgaggtatcactttttctattgtaaatttggtacctaggtactatgaggtatcatgaggtaacaaaaaaaataatgtaaaatttggtacctcattgtacctccttaaggaccgtaaaattgctctaaagtttatggtttgaaactaaaatagtcaaaataattatgaaatagggaagctggattatcaaaattcctttctaccgttcacgccaatatcgaagttagtgcaattgtgtgtatgttaccctccctggttgcataattaggtctctttacccaaaactggtgcaatcatttgttttgctcaatactactatcattcagtcctgctcttttagaaaaccagagaacaaatccaaaaggttttcccaagtaactctgtgatagttcagaacaaaagaaacacagtacttcatagaaaacgtgggaatcaacgttctaacagatgaagtgaagctgtttatgcagttgcaccaaataggagtatgctaatgagctttgtgtacctaccagtgcagcggttgtgactgagttatttcattatctaaaagagattagatcatcacctcggtgagatgaaagctccaaccccattcatgacgctgaatagctctgcaatttaagggaaatccagcatatcaaaatgaacgcgacatatttccacttacagaaaagatgccacctgaataatgcacatcttagaatgagcaaatcaaagaagttacagtaataagttctgttatttttaacaggcctgattctggagttcagagcaagttggatatctgtgaccatgagtccccatctatgcatgatgcaggaaaaccggttcatgtcttgaagacctggccatcaaattcactactatcagacttcgtcaatttctcgggtaagcgaagttacccccttttctctccattgctcttccttctcaggcactaaattcactccttcccttttatgtttctatttgttttctgcatgatcaggtcaccacggaggagaaagctactgaattttccgagttcttcgccggtgaannnnnnnnnnnnnnnnnnnnnnnnnnnnnnnagcaaagcctggagagggtccggatcagcccgagatggatcgagagcatcaggccttgctcgtacagtgcatgagctgcagcagcaggaaatgtaactttctgggctaagctagaagattttacacgcatggaagttcgtacaaaaatgttcttggaaaggttgtgcggttgggccaggtgtggccactactaaaaaaaacctagataggtgctcaaccggcacctagcaagcaggcggcacatatgagagaaatgaaaggaccggcacctttgaggtcccaaaaattcagaaaaaaaacagctgtcgagccaatgcatcgaggcatcgagctctcaatcatccatgagatccccatccaagaatacaagcacacaatcacgactaaaacaaacatccgcagacaaaatccattaacaaaatcaacgagaagccatcgccaccggggagagtggatatccgccgtgggagcctctgccactagatccacctttctggcagcgacgacggggatggcttctcctccgtcttcacccttatatcccatcgatataagggtgataccttacaatatcaggtatggtacacaagtatctatctatctatcttctattatatactaaaagtccattaaacattttataaacgctctcaaaccgccacgtggcactactacaaacgctcctaagtcgccacatggcactatctaatctcaccgttgattttcacttaaattgatggatccgttattttacacaattagattagatctattattagaaaataataacatcctcatgtttataacatacaagcgtacttataagtttgtacgttacaaatgccactgctgtactttccgtacgtacaaacgtatatgattgaaaacaaaactttcctaatctttgctagaagaaaaacaaatacacatatacataaaaaagacataaaaacatacattcataaaaatcaacggtatttaaaatatgactttctacaatataaagataaaatatattacttcacaaatataaatatattcagttaaattaagatctataataaatatccaatcaatattctttcaaagcatcttctaaatctatctattatatactaaaagtacattagactttctacaaacgcttttacaccgctacgtggctctctaataatttagagaaatcataaaaatctattatatactaaaagtctactaaatgtcctgcaaacactcctacattacattatcatgtgacgctctaataaaataagagaaatcctagaaatttagagtaaaaaaagaaaaccatccaaccttcaattttcacttaaattagtggaccagttattttaaacattggattagagctttaaagaaacggacggatttctcaaaaaaaagggattatgctactaatctctatcccggtaaaaaaaaagtggcgtgcttaagtcgtacgatcgtctccttcccaagaaaaaaacaaaatttaaatacctacaccatatatgatcgaaaaaagataaagaaaaaaataaaaagaaagcacgcacacgtacatagtagtatcggcaagaaatattgataaaatcatcagttcagcactaatttgttgtcaacaacctttaatctacgattttattaaaaataatactacatagatatgcacagttaaacttaatcgtaaacttgttgtagtgataaatatatcatggcaaatgataccaacatgtaatagttaatgcgataataatgtttcaaataatttcatatgatattttatggtttcaaatatcacttgacaaatatataacgttaatttgaatctacatatgtaaaaaattaaaataacaaaacctagaattgttttttaagtacatctatttaggtttatttaattttgggagaaattgagattctcaaagtatttggaatttttcaaaacttttcttatttgaggtgtcagaagcacaattaatagattgatgagaaaattaaattaaattttagcgagtggtaataaaacaacataattgagctttggtttttaagtggatctttttaggtttattttgggtgagattgagattctaaaactatctgaaatttttcaaaacttttttattgctatttgaggagtgagaagcatacatgatagatagatgtgaaaaaaaaataaataaataagattttagacaatcgttttgctagaatacaacccttaattcatcacaagaattatgtattttctttgccaagtagtattggcaaaacatgaataatccaataaaatacgcatcaaactacttatgatatttttttatagttgatagaaattctaatataccaggtataattgatggacgaatgttatacaccactgaacccatctataagtgcactctagcaaattagttagtgtaaataagtttgtgaaataagtacattcttagaattagtaaatgagtctcgtatagttataagcaacatatggtggaaacaaatttggcgctaaagtataaatctttatcaaaatataaataatgatatggtgttttgcagatttt

SEQ ID NO: 55123 - DNA, 26273 bp, Oryza sativa
  unsure (1)..(26273): unsure at all n locations
tactaatacaatttcatttattaaaagtgcacctaactcttaaaacaatgatagtaagtagtgatgacaaacaaccagtttatatatgaccagaataaagggatttttatttaaatctaagagacactcttatcacattagtagtatattaaaatctatcatctattttagggtaaacatatttcttttttattgtaggataatctaaattctcttacagtatatatatacatagtgatatatgattccttttagcactcctttttttaataaaaaaaaagatgcatgtgcatctgtacgaaatttctttccgatttatattctggaatgttgtacagtgtttgaaacacaaactataatatatgcccgcgcgaatgcgcgggttaccttcctagttgacttcataatatttacaaaataaaaggtcttatatacaaaatatcgtaaatatttactgtgccagaaatagctatgttttaaaacggagatagtattaaggtatatatctccattccccattgtgtgaaatctgatttcatcaacttatcgttccttcctttatggcttcctctctcggcgatggcagtggtctcccctcgacgattatagcgctggtgctccaccgtcctcccttgacatcactggcgccgccggtgatgttctcctctcgacagtgacggcgacagtgctccctcgtcctcccttgacatcgtcggcaccggcagtggttgcggcttcccatgtcctcccaaccattatagcggcgtcagtgacccttgcctatgcatagcattttctctgcagtaacgcagagaaagggactgttttgaacagtaattgactttgtgtggacggtgagcgcagcaatacctatagcaggccaaacgggcggcccggcccagcacgacacggcacgccgacggcacggcccactagggcacggcccgttaggcacggctcctatagcgggccgtgccgtgccggcccacgtgccaaggccacggcccaagcacggcccaagaaggtgctgggccgtgccgggccggcacggctactgtagtggcacgtgggctggtagccggcccactagtacatgtggcccataaaaattgaaatttgaggggaaaaaaagaaaaaaggcagaaaaaacataatataaaggaaaaaatgataaatataggataaatgtgaggaaaatttaggaaatatatcataaaatatatggtacaaataggataaaatgtggaaaaaaataaaaaatatgagaaatatatgggaaaaattagaaaatcgtaggaaaaataaatgggccggtgagccgtgccatgcctgggccgtgccgtgccggtacgctacagtaaacgtgccgtgccgtgccagcccacgggctgaggcatcggcccaaacacggcacgggataacggcccgtgccggcacggcccacaggctggcgtgccgtgccgggcctgggccggctacagtactgccgtgctcgggccggcccggcttggcacggcccatttggccaggtttagcaataccttaggaaaaaagcactgttgtatagtgatgaatttactgttccagaagtaagtattggtgttacagatagtgcatacctcctatacatgagtttatgacatacaaaaatacacatatctaatattatacaaaaagtatataaagcgagtaagaaaggaaactgcttttgcaggaatagaagacgtaaaagtttggcccagaagaggcaaggtttcctttgcctatatcctaacagggttcttcgagttctacttggagaaaaatgtatctagccgtataaatatacccctcccaagaggaaagagcattgaattgcaagcccaagccagagccacactaaaagatagccaggaggaagataagccctagtgcggacatcatctcgtcgagaattactcgacggatcctagttgatgggttagaatagctaacttgctcttcgattgtaactagtgtggtacttttccagagatatacatatgaaccggagtagtgttattactcatcttgatgacccaaactagcataaaagtcattgtccccgtcttcttactacaatctcgtgtataccttggtaccgatgacttccatactctacaaataccattctcgggtatagcccgtcgatagtgttgtgcagattcaactatagctatagtgatgaggatattactagcttggatatgaccatgattaccttatatattcataaaccaagtgcatgctttctatgtgggatttaagtgtcatatatttgaacaaacattattgcactatgagttttgcgtgttctcattttcaaagatatttgcttgggtaaaggaaaagagaccgagtgcgagagccgtgtcttgtcttgcacatactcggctcggtgaatggttcatcttcgattggcatggagcaagaaaacggattgaagcagagccagcacacctcagtgaatatcattatttaggacaagcacgaagaggaagagctttgtccttcggccttgaatcagcataaagcccctcgccgagccacttctttgacattacgttcgatttcaacttcatgttcctgagttgcagagaacaatccaaattgaggcaatctttccggatttgctccgccttacagccttgcttcccattgtcattcnnnnnnnnnnnnnnnnnnnnnnnnnnnnnnnnnnnnnnnnnnnnnnnnnnnnnnnnnnnnnnnnnagaaatacatggatgatcaaattaagaagctgattgggaccaaaccaagaccttccctaagtctactcccatgttaccacgtcacttttggtccatagaaagcaaaagaagaagttatacacgttttggattcggattcggtctcttgataacatcatttcaaacgggcctagctgttgatctagaaggaatctcggggcgcatgagtacttgttggaaagcttatggaatctactttttcagatggttttggtcctacatcaaaattcctatcgaggtgttgggagtctgcaaaacaagttacgtaccttatacagtccgagtttgatttgagccttataattatgtcatgggctaagcgcaaggaggtggagtcctagggcaaactcggacatcacttatcatatttattcaatagccatcatagtttagaatggggttttgcttagattatttatgccattacagttttgctgcttgctcagtttgtagaactccaaattgaagcgcttaatcattcatatgcaattaagttgcaatctaccttattcttgcttgtgttcttcgattcgcatgtacggattgtttgaggtcaaccgggcagtgcacggttgataaccagaggagacgtggtgctacaattacagggttcggatcgtgtcgatcgaaagctgaatcgtgtgtgtcaagtttccgccaaatcgagagttatcactacctattggaagatcgggaccagtacctcatcatatagttacttagcatctgaatatctaatctaagaatcaggatcctctgaattgatctacaatacccaacattagagggaatggagactgtttgatcagatggattagatcgtgcgctacaataaatatgctacaatactcatcaatgtttgacagtattttcgttaatggatcgacattgtttgatgcattgatttattgtgctactaacatgaatagtgcacctatgcattactgcagaggatccggatccctgatctagcccatcattttaaatcgagggtggataggatgggccattgtgcaaatgatataacttgcatcaataatattccaatgtagtttaaaaaaagagataatattctaatgcggagtatcccgatccgtactgctcctgctactaagcgaatgagcaattaagcatgatgtgtacagtagaaaagggtgagataaaaagtgtggatgatcttgtgtagatcattgatgtgaagggcgcgataatttatagaattactatcttcgtgttaaaatataataaattttaattataaatatgaatatataattgtttaaatttttagctaaacatatttatattttgagatggatattaccaaacttagccgaagctgttaaatagatacgctttcctgctgtgtgattgtcctttggatagtgcttatgaataaatcagcggcgctgcaaggaggacccaccggtaagtgacatgtttgagtaaccgacatacaccgttcagggggcgcaccaaagtctgtgtgtttgctgttggttttggatgattaatggggagtaaagattacgaagtatagttacggagtaacttgcatggtgtggctgatgtctaccagaatgtgaatgatcagtgggacccgtctctcatggtaaaaaaatagctgaattcagctatactcatgcgttgtatagctgaattttgctagactgacacgagtgtcaatgacaagtaggtcccgaataattatatttcttagcaaaataatgaaataaatacttagcaagagttttaaatataattgtgtccatttttaattaactggttcctcacactttaaccattaataatttcttaaatgttttgttttaagaaaaatacacgtatgtagatttgccttaaaactatcattaaatatcataaacttaacagtaaaaaaagacatcataaagttattcgatgtcataaatgtattctaatactaaaattatggttgaagtttaaaatttgaccaaacctcatcttaaacataaaatatttgtgattggagggagtagataatatgggattagccgtgtgaaaatcataattataaacttattatggaaaatatcttcacctagccgtttcaccattgtagagtagaatcaatgccgcaataacaaccatctaaaattgtatttacgccccccagtaaatgcactacagtaatggagtactagtaccgcggcgtcaccgactcagcgtcaccgcctataaaaagagaagcgaaggttgctgagacccccaactagggctatcaaaaaagctcgaggctcgcgagctgcttgagctcggctcgctgtagactcggctcgagctcgattcgtcaacaattcgagccgaactcaagcctagctccaagcttgcgagcttgacgagccgagctcgaatagctcgtcgagcccagatttccctctgtcaagttcttaaattttcaatgcaacagctagtactactcttactcccaatgaaaagcagtatagaaacacagagcgtgcagagctgtaccgtgcaggcactagcctactagtactacattactctgcagcactagcctattagtactactagcatgcatgcagctctatttaatagtactactagttgtcatattatgcttgaaaaagctactagtactagtagtactcgacaagcatgcatgcagcctcctttcatctgtattggttatttgagggcacacgagttaggctcgagaaagctcgagactcgagcgagccgaactcgagcccatttctaagcttgtagtttaaacaggctcgactcgagctcggctcgagttggtgccgagctcgagcctatataggtaagctcgctcgggctcggctcgttgacggccctacccccaaccgttttctcaccccactcgtttgcttgcgttgcgtgcacagcgaccgagccagtcggagactcggaggttcggacccgacccgacccgagtcaatccgaatctttcaggtgcggggcgtccggccgccacgtggcgggcgaacccatccctcccggcccctacccgtatcagtcacgagctcctccttcctcccattccacatttccacccctcacggccccacccactctctcgattctctcctcgcccaaaacccccccaactcctcgcaggctcgcagcctcgctccccctcgccgcgctctcggcctcgccgcgtcgccgccggtctctggacgaggaggtgagggcgcgcgcgcgcctcgggactacttcggcgcggctctgttctcgtcgttcgtgttcttctgcttcggtttcgtggtgttggcgtgtggatgtgtgcgtaacggctaatttggttcgggtttttgtgcttggtggtggtggtgggtgatttgcaggggcggtgaatcggtgatcgatgagcgggctggatctccgggagatgttaagcagcgctgcgcggcggcatacgtggaggagaagcggatggggggcggagtggggcggcggcgacgacgctcgctcggccgcgcttccggctcgctgtcctcctccccctcctcctcgtcgtcccgcggctgcgggtgggcgtggcgacgaggggagcggtggagtgcgggggcgcggggaggaggggacgagtcgtggtggaagcggagcgaggcgcgaggacgcggcggggaccgggaggaatgcggtggccgtcgtcgccggtggctcggccacgtccggcgcggagcgggttgctgcgcgagcggaggacggtaggaggacgcctctgtttcggttcatcacgtcctctgcttgggttcgtcgtatggattgcctatgtaacggctaaatttgttgcggtttgtgttcggtggtggtgattgtagggcggcgatcgatggacgggccgacgctggaactctccgagatgatgctccacgcggcgcagccatggagaagccgatgcacgcagcgtgacgttcgcccgggcgcggttcctcctcgtcccgtcgctgcggatgggcgaggcgagggcaccagtacagtgcgagggcgcgtgctggaggggacgactcgtggtggaggcagaggaggtggaatggagcgtgagcgcgaggtggtggcgccggcgagaaatgcggtggccgtcgccggtgatttggccacgcacggcggcgagcgggttgctggccccttggtggcgaaggagaagagaaatggcggcggtgagttggggacgaagagggggctagagaagcgggccccgcttccgccgcccaagcgcagggtggtgtccgctaagcgccagtttccaccagatttcggtagggactctgctgttccactcggccgcggccggggccgtggtggtggtgttcgtccgtcggatggggcgcctgcccgtgctgttctgggtgagaaggtggcgtctgcgggtaatggtgattcaatggcgaatgtgcatcatcatgctgtgatggacacggtcttgatgaaatcttcacatgcttcggatgagaatctggttgctttcaaagttggttcaccagagaatggtgcagaaggggcagcaaggggaaagggagcacacaatggtgaattgctgggaaagagggaagtgttggctcaagctgtgaatttgcttcccatgaggaggactgtatctgcgacgcaccgcttcactgctgggtgtgggagggacgctgcagctccacttgctcgcagagaagagggtaaggtgggttcaggtttggaagtcatgcctgttgatgttggtgggggtgtgtcaaaggaggtgatggttacggatggcagtaaacattcggttaaccagtgtacggcgaacattgttggagctgtcggtgttttggatggaacagtacagtaccaggaattggaggagggtgaggtggctgatgaggcatactgtgatgtagagtcacaaaaagttgttggttgtgattcttttgatgattctgcaggtgaaagacatgagggtgttgttcctgtaacgtttgctgttactgaagttttgacaagtcacgcttatgatgagatgatgcaaattaaggcattgcaagaagggggcagtgatgctgcgcaggaaactgaacatgacttgccaatgggaggcaaatgtgaaactatcttacctgatgcttctcctaaatgttcgtttggtggtccttcaaatgaaattgtccacggcaagagagtgttggggagtcatggcatgaaaggggaagttcccagtcttgcaattgaagatcatggtggcattgctcaaattgaccaagaactggaggacgttgagatgactacaggggaataccgtgttcaggatgctcaaattgccacccatgttatcccacacgagtctacaactggtagacatgagggggggctttgtgcatctgcagctgctgaagatgttaaggtgatgaacaaatacaaagggaccttacccaaaggtgctgctaaatcatcgatgaatattgcaacaggagtatttggtgatggtatcatgagaagtaagatactatcaacagctagaaaagtagtcaagccacctgtcagagcaagccataagcctccattgaacactctgcatagacccttctccacaaatagtgcttcatttggtcataagaagttgaaggtaaaacgtccagatcaaagtaaagatattcctatgaagattgcctctacatctggattggcgggcaaggacaaccttatcgatgaaaaggctttgagcttggaagatgatgatattttgaaggcactagttgttcatgatggaaagcttgaggtgtatctcaatgttccctcatgcgttcagcttcataggcaacatggaagtgggaatgctgatgataggagcaaaatcaggatgttgtgcaggaggtttcagtttatatgcagggctctcttacatgccgtcgaacagggttcattgaagattcgaagagttgaccttgcagctgataaaatcatcaggaaattgccaggctttaccaaacctggacctactgtgggaaatgttaatggagtggaagttggtgacgaatttatgtacagagttgagctagcccttgttggtctccatcgcccataccagggaggaattgataccaccgattataatggagtgcttgttgcaataagcatcgtttgttctggaggttatcctgatgaattgtcaagctcaggtgaactaatatacactggttctggaggaaagcctgctggtaagaagaaagatgaggatcaaaagctagagagggggaaccttgccttgaagaattgcatcgagacaaagacacctgtccgagtgattcatggattcaaaggtcaaaatagagaggacaacagtcattcaagagctaaacaaatcctaacatttacttatgatgggttgtaccttgtggtggattgctggacagaaggactaaaaggttcaaggatcttcaaatacaaattacaaaggattcctggacaaccagaacttcctctgcacatagctaaagggctgagaaggtctctttcacgtccaggcctctgcatagctgatatatctcaagggaaagaaatggatcccatctgtgtgatcaatgatgttagtaatgtccatccaacatcttttcagtacatctctagaatcaagtacccgtcatggcttacaaaaagacatcctcagcatcatggttgcgattgctcagatggctgcatagattctactaagtgcttttgtgctgtgaagaatggaggaaaaatcccattcaactccaatggtgcaattgtccatgataaacccctcatttttgagtgtggtccatcctgtaggtgccattcttcatgccacaacagggtaagtcagaagggtatgaaaatccacctggaagttttcaggacagccaataaaggttggggtgtaagatccctaaggtccatctcttctggcagctttatatgtgagtatgttggtatcctgttgactgacaaggaagctgacaagagaacaaacgatgaatacttgtttgatataagccataattgtgatgatgaggattgctccaaggggaggccatcaactatttctagtctaaactcttctggtggttgctctcagaccatggaagatgtgtgcttcacgatagatgcgtctgagtacggaaatattggaagatttatcaaccatagttgctcacctaacctctatgcacaaaatgtgctttgggatcatgatgaccaaagggtgccccatatcatgttctttgctgcagagaacattcctccactccaagagctcacttatgactataactataaaataggtgaagtccgcgacctgaatggcagagtaaaagttaaagattgccattgtggttctccacagtgctgcggcaggctctattagggcatggttgactgatagtactaggtttggtatttctttgaacaaaaaccctttgtaaagttagtgttttgcttgttgtcatttgagagctttgtagatacatggataacatggagtgttagtggtaaaaagcagtaaggttggtggtggttctgtacatctgttgtcctactacagcgaaatgcagattcttgcatagtactgtggtaatatatatcttgcccgtttgcgacactgttgctgagtccagaatatatgtggaattgaataaaattggcttggtgtttgaactatcccaagaatctggacaggactgcagttgaaagcaggtacacaatcaaacttctgttattttacataacgatcatttatgtcatttgtgctaacaatgagctaggacaatcagaagatggacaagatgtgtggtgtgcttttgaaacctgggaggtagtcttttggtctttggattcatgtgtgaggttggttactagtataacattattgccgttgatatgaatgttcaatgaatctgcttgatctgcaatagctattgtgctagcgaagcaatattttgaaccaatgtatgactagatgaatcacctttatctctgctagacgttcaatacctatctttgttataagaatttcctagttgtagtcttgttatcttgtagaaggtttttaagttgcaatgattgacaattaaatcttttactatatgactaacagaacacttagcacaacttaggagctagtcccctccagtaaaaaagaatgcctatgtatgctgttttgaattctgaatttcacacttgatgtacctataatcagtgagaaatcagcatagccatatgtataccactaaaaggatcatgatattacagttttgctgatgtgtggcaattaaatgaacagccaaatatgcattttttgagacataaaattgtcaaaataagtattgcaatcaacctactgtgcaaattcttttttccccattacattcttacgcatttttttcccctgataaggtgtttttaactctttgtacactgcaaacagatgggaacacttgattcttttcagaacattgtatgatagtgtggtaaactcgtaatgaaaaccattggcaacaaatggcattgatattttttatatttttgttataactgatggacttatagagggagctaattttctttcttgtagaatctttggtcctttccttgttactgcaagattaacttggtgcttgtttgagttcttgtcaagtttgcggctatgattgtatagcaatactgctcgtcaacttgcacttcaaaatatattactgtgggaactgctacacttgataaaaactatgcgaatcactatgaataccttcttttaacttttaatttaaatcatagaatcttcactgcacacaattcttactgatgcataatggcctgcacattcaacacatggactaaaagtaataacatttccattttgttttgatttagctaatctggtcaaatatgttttgatttatgtcaatttctttggtcactaatgatcttgatataacttcaacttatttcattctcatttcaatgcttccatagtaagcctattattggactaagaatacttacaaaagaataaattctgcagaggtggatgctgatagacattttttttcaaaagtaagcgatattcctctgaaaagagaaacatgtttatatccttctgggcagatttcaataaaaaaaagtaggttaaataaagaccaataaactatagagttaattttgcagtcaaacactgagtgttttttttagagaagggaattgaagtttcaaagtaacttgaaagcgggtatgatttatctggtttcctgaaagtttatgatggatttgctcggtttcttactttagaaaaacttggacagctttttttgatggggaagtttctggttgctgtgtgttcagtcagtatctcaattttcagatgatcatgatatgacttgtggatactgaaaccagatagttctgaattgttccaaccaataaggtgctatggtaagtgccattctcttgattccttgtcttgccagatgaggcttcttaactgaatatctgatggtgctgcttttatctatgctgctgaattaactagtcgcagttttgagcagatcttcagcacatggttggtgtttagccagggataataaaggtagtgcattatttacaaggagatgcacatacatgtgatgaaattagttcaggatttgggttttgcctaaacttgtcgtgggattacatgtgtggttatgatgttaaccattggttaccatttgctttgtcctctgcagcaaatagagtgttttactagctcatagcctctgaagtctgaaccctttttatcttcaatgcattcaggaatatcttcgaattttgactctcataattctttctaaacccctaaaattttcccccagttttctttcgaaaggtaattttcttgatgggataaacatttcctcattttgcaggccatgtgctgcaacctgtaccctaggtcgaggatcactagaagtcgcagcgagtgccgaggtagcaaagatgaactactctttgaagtcttgatcaatcggtgggcatgattactggttttggcggcaagagagtgaagttatcagtaaaaatgtggattcagttaggtaggatactgacgtgttgcatatcactactagctaggaacagatatacctttgagttcttatcatatctttctggttatcacaggaagaaatcggctgtcacaaaattctctgcatgatttgattagctccaacatgacgcagtggggttgcttaccttggacagctggatgcatcaagaccaggtttacagttctaattcatttccaaccgttgttaacctctgagattccttactgttactgacacgattatctctcgatgtgatatgatttcctcgttctcacaggctatgtgttttagaccgagtggctgatctgagaggcactggatactcaaatcagcaaccaaacatcgggtttttggcagctaggcaaaggttgaacgaacgaactcctcttgatcagatcggtgggcatagccatcagattcagcaatcagcactagcttttcacaactgtcgcagctcaaaagatgattggcagaactgcattaccgaaagattacctgctgctggtagtggttggtggtttctgcaaacccatagtttcaggctctagctttattttttttccccttctctctttagactgtggcttgactctgacggaagtaaagggaaatagttgcatcagcacgaacttttttaattttttgaaatttttaattttaaaaataaacccttctaaaacatatttctagaatctaaaccttttggtcacgtcagcgctctaacatagcaaaaacacgccgacatgccacacatagcgggcttaaatagttttgtcccgccatgctagcgaaggtggcgcgtgactacgtaacactgtcataccaaccagaccgcgtgaccaaataatgcttccatgtcaaccagactggcgtgacagtgttgttttttcacgctagtctggctagcgtggttaaaaagttcagattttaaaaataagtttcgaaaggatttatttttaaaattaaaattttaaaaagtttaaataataataaaaaacccatcagcacatgttgcaatcccaatctgaaaagaacaaaagaaagactagagactagagagagtggagttgtcatggtggtggtcaacaattttgatggcctgtgggggcagcttattttgatggccttgcgtatgacagataacagcggctggtacgtattctgacattttgattggtcaatttccattccgtacgtgttgctatcttgctgatgcttttggtttggggcccctgtttagaaatcagggtcggcttggataatagcagtttcctctcatctttgggtagccgatcaatcatcaacgtgtggtggtggtggtggttaagaacaaattttagtctaccaaattggataagtttagagagagcaggttagcgggagagatctgcaggcgtcaccgggtctgcatgtgtcaccaggccgctgctgcctgtactaaattctcttccttttctaattgctggtaaagaagaattgctctgcgttctaaggtatagtagcataactagcatttaaatttggcaaaatttaaatatccaaaatataactgccaaaaataccagatgaaatgtcaaaagacactccactcttatctctgcgaccctacctactttctattaagtgggacaaccagtgattggcaatttagccttttttttatctatcttcttactcgttattaaagactttaaaaacagctatattttaaaacgtactccctccgtactcgtataggaagtcgttttggacagcgacatgatctccaaaacacaacttttacttcttatttctataaaaatatttattgtaaagtgatatatgtatacttttatgaaagtatttttcaagacaaatctattcatatagtttttatatttttaaactcaacaacttgagagttattcatgatttatattcctaaggtttaacttaaatattatcctaaacgacttcctttacaagtacgggggagtacgcctcctttcataaatcgaattaattttgataatatgtctgtttttttcgaaaatactattatattttttataaacttgattaatttaaagcagtttaattagaaaaatatcaaataacttataatatgaaacaagcactgtactggataagataagatttggagggtacttcctccgtttcaaaaaaactcaattcctaggtttctgtgtctaacgtttgaccgtttgtcttatttaaaaaattatgaaaaaaatttaaaaagataagtcatgcatataagtattattcgtgttttatcatctaacaataataaaaattgtaatcataaaataatttcatataaaatggacggtcaaacgttggacatggaaatcaaataattcagttttttttttggacggaggaggtaaggtcaaagagcggtaaatttttaatagagcagtagcagcggcggcagcagcaagagcaaatatcatgattattcggagtactagtgtacaagctacctgtacgaataaaaacaagcagcagaaggtcgggtgcagaattattacagctttcaccttcggtgcttctcctctccgattctctcttgctttccttccctttccctgtcgcgagcttacgcgtcgttgtcccgcgggggcggagagagaaatccccactctcactccatccacctagtctaatccagcttgctgccgctgctgctgttgctgctgcgtcacctcagtacctcacctcatctcatccatcgtttgctccgtttctgtgggatttccaccggctgattctctcgccctcctcccataaagcgaccggtggttcgcaccggacggatgccccaatctttgcatcgaggggcaacgaagcgaggtcacggatgcgggcgatgccaccgccgtcttcttgtccctagatccatcaaggtatccatttctttctctcccccctccgtgttgcccgtctctctgccacttcttgttggtctaatcgagcaagaagggggatgatggtttgtgtggtgtggcaagaacatcagggcttgggtttcttggtggtggaggttgttgatcgattctcgttgtgccccccctttgctggaggcagatcgatctatgtgggcaccttctgttattaaggaattatattcctttttcacggttttcaaggcttcgggagcatcataaacacgtttatggtgttgagtgttttgggtcttttacatctgtacagttttatatgaatcctataaatggacttaaaactatttgaaaaaaaggatatttgtgagttggcaaatatggaacctagttaactcattgccgaatggtataattttgcatattaaaaactttcttcaaggatgagcagaaaatttgagttcaaaatcaaatccagttgcctagtactttgtctgcatagaagatgcagggcacaagaattggttatgtaatgctgatacttgaccaattcagttgattctttactgatattcatatgacaggaatacaggattcaacctatgttcctaaataacaataataacgttgtcaaattgcaaatatgagtcatcctccgggttctgattagatgtttgttcatcctccatgctctgattactgtgcgtgcagtgttaggaggacagagacaagaaaatgcttgtatatctgccaatatcgtgttcttggttgttcatatccttggtctctcatgctttcaagttggccttggccatcagtttatgctctgtgcattacctagctttgtttaatgtgtattggtcaatcccgagaaaaaggaactacatgatgaccttagttcatgcttattaaagcagtgtcatatctctcatttcaagccatggaactctttccattgaaaacctcatttgaaacaacggttgaagtacaacagtagaacacaagattagtatttcttaaaaattgaaatcctagaatttagccagcattttatatgcactgatatgcatgcttgcactttgtggattatgtgtttgctctgttgcttgagtttattttatcctccttctgtgtgttgctttgagcgtgcttctgttgttaaactgatgttgatgttttctgtttatgattcagtgaccagttctctgatcagtgagaataatggccgctgctgaagcaagggctgcttggcagcgtgctgcaaaccgttgcatcgttcaggaggatagaaaaagagcaccaaaactagcctgctgtccaccatcatcagaacagcagcatgtcaaaagcaatggaaattgtaggaattctgaagaccgccctgtgcccaatttcatgccattgagctggaatcccatgaactccagtctgccacctgatattagatggtggcttcagttacaaccaaatttaggagggcagaagaatcttgcaggtgagcacctatattttctgggaagagagatcagtgataaggaagtggaggattcagcacaaaagaatatacacgacgaaccattattttgtgaaatgttcgacaccaatcctgagaagattgaggatgtttttgagccttcgtggatggtttccacagcttccatgaagtattcttctgaaacaggcttacaagacttgaaaaatataggtggctattcccaagttccttcgaagtgcaaagaaaatgccagtgactgtttgttcaatgataaagaattcctggatttcaaaaattttaacccaccaccgtcgaagaacccacagaaggacgattttgatatgaatgcgccttggaaaggaggtgaaaggagtcaaccatggtggcagatcactgatgagaatgagctggctttactggttgcagaaagagcaatgcagcatattgagaattgcgatttaccaagacctacccagatagttcgtgttcagggtactgaatcacgcagtcatgaaaatatgggtaggtacagggggtcatcaggtccagcaggtacaatgtcatatcctgatactggacaatgtgaacatattgaatgcagttacagcacagcaagcacagatgaggtggatttaaccagtgatggagtttggcaacagcaggaaagaaatgttgcacgcaggtgtgtatttcttctgccttactctgtcaccaatttaccctgatgccataattgtaatttccgtaagcatacctaaattttgatgcacatctattttaatttcctagttgatatctgaagttcaggtggtgcattacttctgtattacaaatagaattgctaaatattactgtagtctgaattatttggtgctaagtaggagtttccctttgtgttcgctaaaatgctgtttggtgctagtgagatcttttgtctgttcctgttcagttctctttttgaaaggaaaacttattatactggttaagtttcagttttggttcatttcagagatacattgttgctcactgcctacaggataatggtgccattgcccttgtttgcaaaagagttcatggacttcttcaaaaaagttgcttgttatatttgtttcatttaatcaatacctagagttttttttttaaaaaaaattcctattgttgattgggaactacacaatttcacaatctacattcatctattttaagttatgttccataatccgcactcggaaacttcaaatgtgctccattatttttcagtttcttgtgtttttctggttatcatttcatccaattttcctgcagtgatgcacaagatttttctaggggcatcaatacagaaccacgaggcaagcgaacataccagaatcctgcagagcaagctcaacttttggaggcactttgtcactcgcaaacacgggcgagggaagctgagatggctgggaagaaagcacaaagtgaaaaagacgatgtcatcaagctatttttcagacaggcctcgcatctctttgcgtgcaaacaatggctgaaaatgttacagttggagaacatctgcctccagcttaaacacagagagcatcagatagcaaccatgatacctgatattccatggattacactaaagaaaaggactacaccagatcatgagaaagaagattggacaaggaagaaaggcagaaggcataaaaatgcagggagtttctgtgacgcgctcttatttgccgttggtttaggtcttgcaggtgcagggctgcttcttggctggacatttgggtggcttctggccaagttctgaagttgcccatagttttcaactgagactagcttagctagctaggcatgtattttgctgtgcgcctgtatgtgatgattcatagatgaaatctccaggtatactctccatattggagtgagatggcgaaattttagacccaagaatatgttcgtttggaagctctgctagttagaagacacgaatgtatagggagcatttgttgcaaatttgcaatttgtaaatatgggaggaggacgtctgtgaatgcttgtacatactgatcagtagagaaaaaatgtcatcggacttcttcaacagtactccctccgtcccaaaaagaattaagaggggataagaattaagaggggatgtgatctctcctaggttgatctccaggttgatgtatgtgtttttgggacggagggagtatctccacctgtacctattatttggaaaattagcagcgttactgcagattgtgtttttcaaaacagggaactaccaagcggcagttctgtctgtttttcagtgaattgcaggttatgtgtttttcagtgcaagcaattgttggttatttgcctgaaatgaaattctgtcacattctagttgtttctgcttggttcttttacaatgttcaaatatgtacagactatcttatttctttcttttaatatgttcacatttaatttttgtttgcctgcctgttttcttcaaacaaggatggtagagtgctagtggtaattaatatgttacttcacctcttctacgactacagtatacactggccttctatgaatcgcctcttgatgctccttaaagtttcataatagggattttgtatcatctgttcggggttttttttttatttttagcattcttgtcaattctgtaacatttgttcagcatttcttatgtttccaaaatactagataggtctcgccaagcttagaatcgaattgaatgcaacaaagtttcgcatttgttctgtttggttccctgagcatctatttttcctaagaccaaggagtgaggtattggtgttgaagttatcgtacactgctccttagttgtcattttatttcttacaaaaggttagtggataacaaatatccgagggactacaaagaattgaaaagattttatcatagcctcaaaattatttgttcacattcatgttaaagagaaattgggttcaaaatttgataagcatcgatcccacacaattgccgtctttttttagagatacttctgaaaaccccctttttaattttttttattgttcaccaaattttcgtttaggcaaaactcatacatggctgaggtaaaattgcacgaacataacaaatgagcatttgacagtatactcaccgtgcaccttgaaagatgatgtgttacttctttgcatgtccgcaatttattgatttgtttcccgagccctgacttacctctagtgtgaattgaacgtgaggactcatccgtcaattcgaaaactttcctacagggttagtccacagaagatatgtgtaacatcccgccttcccccaggccaggcccgcttacatctggcagcttttatataggtcatagactgccctcacagaccaacacatgtcttttctgcacactaagatgatgtgttactcctttgcatgtctgtaatttattgtgttaattcgaaaactttcctacagggttagtccacagaagatatgtgtaacaatcccgccttcccccaggctaggcccgcttacatatggcagcttttataggtcatagactaccctcacagaccaacacatgtcttttctgcacactttgtagaagatatgtgtaacatcctgccttcccctagccaggcccgcttttataggtcatagactgtcctcacagaccaacacatgtcttttctgcacactttgtcctcactcgtgtgcacccgggaagaatttcccggtcggtcactcatcccaaattgctccaggccaagcacacttaaccctggagttctttggaaatcggcttccggaaaagaagtcttaaccctggagttctttggaaatcggcttccggaaaagaagttgcaacttgttgatatgagtattctattaattctattaagccctgggccggaatgtcacaatatgcatcctatgtccatgaaagtactagctctaatggttcattaatcgaattcaacatcatgtctaatttaattaacgcagaccattttgacctaagcaccatgcttaaatcaaaaaccctatggatgtcttacgaacacacccaaactagagcatacaaaaataaacaaatgaagcataacatatacgatcaagccatattcacatggtggtactattgagtaaaggtttggtgaaccttgttttatcttttacataactgagtgtacttaccaccagcataatggatatgttgaaatctttgaaacagtggcatggtcacatatgattgtcgatctctcatccatctgatgcggattgtagcggggcaaggcactttgaccatgccaagccaggcagctgtaacatcctgaaagttaactactttctaattatgcatcatgccagttcttatgttcttaatacctgaaagtgcatctaggcccctaatgattttgatgattgattacaatgcgattagagaggaataacacttttattcaagcaaatatgaaggttgttatgtcctcgacatgttgtaatgagatgcataccccatgaatgcaacatcacgatgcaatgcggcaatgatcaaatggtatattgtatcttttaccttgcattgtgtcgtaggaatgccgtactattaagagggataccacatgcatataattggtagaacactagtgctcanaatgcttcatctttgtgtgagttgaanaacctaagccaaaattntaatcccgagttgtttcacttgtcacaacacttacaccgggtttctttgcaagtttttcaacatatcttgaaggttttggaccattttttatgttgggtttgatagcccacgaaactagctttccatagagtccaaaatcttcgaaatcggagttcggagtaaaaagttattgcactttttacttgagcaacattagactatccgatttgaaatcagactatccgatgtatcggactatccgatttttcacagaacttcactctctgtctttgtttgaaaaatcctttcgagtgagtttttctatttgtcggagtatctgatgttggatcagatagtccgatgatacagagactctgaaatttcatggaacttgagtctctatttgaggacgaagtttttgcttctaaaatatcggacactccgatttaacatcagatagtccgatgtctcggaaagtccgaaatttcatggaacttcgttctctgtttcttgttgccttggaggtttaaaatatcggactatccgacgtgggctgaaagattcccctccaatggccacattttttttttgggggagggggggttctataaataccccccacctaacccttttctagggttacccaactcatttcattctcattcactttgggttgagcttggtgctaaggtgctttggatctttgagctcattctccctctctcaaatccctcctcgttcattgtgtggtgtatcttggtggttgtggatttggtatttgagggcctagtgtgtgtttcactcgatcttgagcactagggtttgaccaagagttgtgtggtgtttgttactcttagaggatgaggactcctagacggctaggtgtcactcccgagccaccgatctacgtgtggttggccgggagaagtttgtgaaggcccgatctcgcctccgcaaggaaagagataccccttagtggaaggaggagtgcttagtgtaacctcttgaggaaagggttagcaaagacccggctcttagtgagctcctcaacggagagtagaatcccctgaaggatttgactccgggaacaactccgtgaacttcatcgttggtgatatctcttcatcctctctttagctttgcttaattgtgctgctatagatctagtcgttgtttgcgctatactcttgtttgtgtgctagatctgcttgttgtgattgtttagtggatcagacaaactgatccaacatcagactatctaatattttcggatagtctgactgtggatcagactttccgaccttaactcaattttagtttccgcataaagttttaaattagcctattcatccctcctctaggcctaattgaccctttcaataaccttctaaacctaggacattataattagagggccaactgggctttcacattgtccaccatgtgtcatgtggtgggccaggtgaatcccggcctcaccaaatggcgccacggctctcttcttgcccagttggccgaattgggtgttgccaggcatgtacgacatgtgtccagactcgcatcgtccctaatgactcagcgctactgtcttttccacgtcttttcagtcccatcggtttggaatctttttcctaaatttgtttcatttatggatgtgatcgttgggttatagctggcgggggggggggggggaggggtcagggccttgactttttcaagtcttcggccttgcccctgtgccccttagcagggagattgagtgtttttaggctagcttctcgaagatgtctttgatgaacaaatgtataatatgtagatcttgtatgcatccacggtcctcttcagaaggaacgtgtagtgtacaaggaccaaggggggcgggtcccagaccagatcgggacctaggctccatccagtccataattttaatatgtagatcttgtacgtttccacgctcatctcaaggaggtatgtgtaacctacaaggacagtgtggggcaaaagtctgccgcaaagacttatggtatcttagagtttgttagagataagtgtcgtgtccgatatggacatagtttgtaattctcgggtataaatagaccccggatcccatataatcaatgaacacacgttcaatacaatctcggtgcatcgccaccctttttactttcgttttgtttcgacgagttcttgctttcgggttgagctgcatcgatttcgatcttcaacaagaggtaaaacttgttatggcggcttgcattctcgggattagtgcttccatctttatgatactctaatcttgtttatgtaatttgtcgagttatcatatatcttacataatctctagcaatatcgctatctaacctacaatcggctaacatctgtcggtagagggcaaccgattaggttagacatcaatgttgacttagattatataggatattcaccactctatgaaactttcaatggcttgattgtctagatattgtccttcttttcatacttatagctgcatcagttgagtttgatcttataagtcatgattagaatctcaatctctagcctgcttcttggttgccgattagggtagtatcggggtttcagctgatcttacctgatttaactatatttactccatatgcttcgttgatatgttaaatctgccctttatgttaagatcttgttgcatttaagtatattaggcctttgtttgatatattttacttgctttaatatcttaatatagagtggtatcggagtattagccgatacatgctagatctatctgatcggctatgctatgaacatatatagtcccgttattaatatatattttgatctaagtgatttatactgtctcggcatggcgaccgatctatcccaatcacttgatttaagtatatatcgatataaggagtatatattgttaatatctacagccgatcgagtagatttagttccttcttatttattcatgaccgccgatcgatacatatatgacatcggcccaaagataaatgatatgtcatcggcactcagccgatcggctatcgtttataggtttaaccgcggtttctttgtctttgtttcttgttgattgtaggatcaaatcaactggcacgcttgcatacccgaaggcgagttttggacctgcactggagttaagcagatatcccaggcctcgtgttttatgtcaacacgcttttggtacgcctggtgggacagatcagaagtcagaatcacaacaacagtttttcccatggccgagaaaccgccagcatcgccgtcctcggctggtgaacctggctatgttaaagccaagatccacaagctgggtctatctgaggttgatgaagccaacattgtgcccgtcactatggataaattgacacccgagcagcaaaaggatcttgaggcaatgatgtagcaagcacggaatcagttcttgagctcattcacggagacccgcaagggaacacttgttcaaaagtacaaagtaaaagtaattggtgatgttcctgggacaggttcttctaaggatggagaagtgaaacaagctctagatgacgcggctcaaccgagtaataaaggtgctgcagatggctttcaaggagatcaaggtgatggctctcaaggagttcagggtgttggctctcaaggaattcaaggtgatggtgttcagggagttcaaggtggaggtcttaatcaagatggcaatgcaacacagttacagtttaacaacttccaggatcaggttgactatgctatgcaccatgctttgatcaatcaatctggaatattagtcaacactttgtcaaacatggtgaagataatggttgatggttcaatggctgaatatcaggctacatgaccggtttatctaccaggaggggtattcctgaattatcggccattagtcactgataatcagccagctgttcaatcaattcctcttaatgcaccatcggctcagccgacggcaccagtatcggctcctgcacctgctgcaccgtcatcagcaccaggtcaattagtgaatcctcgattgttggtgagagagaaaccacagcatagtggatagaatgtgaatcggctaacgcaggatcatgttgcagctatgttcttatctcctcaacctactgttgatccaacccagcagcagccgattcagcaaataccaccaaggcagcaggttgtacagccgattcaacaaacaccaccaatccaacaggttgtgcaaccaattcagcagacgccacctaggcggcaggttttgcaaccaattcagcagacgccattaaggcaacaaattattca

SEQ ID NO: 55124 - DNA, 1231 bp, Oryza sativa
ggtgtccttctggtatctttataaagaatcagaagagaagggttcaaagattgaggaacagggagcacttttaggaggtcgaacaggaaatcaatcatcggctaaagaaaatgaagccgaagcaggagtggcgagttaagaatcaagctcctatagccgatgaggccgcgccgatgaagcaaagagattggctaaagggaaaagtgttgtaactgcatcggttaacatggttttcacgttgcctgctgaatttggggtcaagcaagccgatgtcgatgaagttgaagaagaatcagctaaattgattttgtcaccagagcaagcaatcttcgaaaagccggaaggaacagagaatcggcatcttaaaccattgtatataaatggctatgtcaatgggaagccgatgtccaagatgatggtcgatggtggggctgcagtgaatttgatgccttatgctacattcaggaagttgggcagaaacgctaaagatctcatcaagacaaacatggtgctcaaggattttggtggcaatccatcagaaaccaaaggagttttaaatgtggaattgaccgtcggcagcaaaactatctctacaacgttctttgagcatcgatgggaagggttcctacagcttgttgcttggaagggattggattcatgccaattgttgtattcctccaaccatgcattaatgcttgattcagtggcaaggcgacaagattgaaattgtgccagccgacaggtcagtcaatgttactagtgccgatttagctctttgggagatggatggtcttgattgtttatctggaaaagtttaggatggagattttctaaaagtgtccgattctgatatacaaccaattgaagatggagaacctaagctattattttgagggcgtcgtggatgatctcgatgacaaacaaggacagggtttcatgtcggccgatgatttggaagaaattgacataggtccaggtgatcgaccaaggccgacatttattagtaagaatttatcttcggaattcagaaccaagttgatagagctgttaaaggagttcagagattgcttcgcttgggagtattatgagatacccggactcagccgatcgattgttgaacatcggctacctatcaaaccaggggttagaccacatcaacaacctccgagaagatgcaaagccgatatgctcgaacctgtcaaggctgggattaaacgtttatatggtgctg

SEQ ID NO: 55125 - DNA, 4843 bp, Oryza sativa
atgcaatcaagaagattcagcctccagagaacaagacagagttgcaggagatgatctgcaagataaattttgttagaaggtttatttctaatttttctggaaggttagagccttttacaccattattaagattgaaagccgatcaacagtttacttggggggcaaagcaacagaaagctttggataatattaaggaatatcttagctctcctccagttttgattcctccacagaaggggataccttttaggttatatctgtcggccggtgagaagtcaatcggctcggtcttgattcaggagctagaagggaaagaaagagttgtattctacttgagccgtcagctcttggatgcagaaactagatattcccctgtagagaagttgtgcttgtgcttatatttttcatgtacaaggttaaggcattatctattgtccaacgaatttactgtagtatgctaagccgatgttattaaatacatgttatcggctccaatcttgaaagggagggttggaaaatggatatgttccttaactaagtttgatcttcgatatgagtcaccgaaggcggtcaaagggcaagctatagccgattttattgttgaacatcgtgatgattcagtcggctcggttgagattgtgccatggactttgttctttgatggattagtatgtactcatggttgtggtatcggcttagttataatttcccctcgggggggggcaagttttgagtttgcttatactattaaaccttatgcaacctacaatctagctgagtatgaggtagttcttaaagcattgcagttactcaaggaagttgaagccgatgctatcgaaattatgggggattctttgctagtaatcagtcaattggcaggagaatatgagtgcaataatgatacattaatagtttataatgagaagtgccaagaactaatgaaagaatttcggctggttactttgaggcatgtatctcgagagcaaaatattgaatctaatgatttggcccaaggggcatcagggtataagctgatgatcaaagatgttaaggttgaagttgctacattaacggccgatgattggagatatgatgtgcattaatatttacagaatccatctcaatcgacttctcataaattaagatataaagcgttgaagtatactttttggatgatgaactctattatcggacgattgatggggtgttgcttaagtgtttgagtgccgatcaggctaaggttgcaatcggcgaggttcatgaagggatttgtggcactcatcaattggctcataagatgaagtgattgcttcgacgtgcagggtatttttggccgacaatgctggaggattgtttcaaatattacaaagggtgtcaagattgtcagaaatttgaagcaattcagagggcaccggcgtcggctatgaatcctatcattaagccatggccatttagaggttgggggaattgatatgatcagcatgattaatccaccatcgagtaaaggacataagtttatattggtggcgaccgattattttaccaagtgggtaaaggcgattcctttaaagaaggttgattctgggaatgctatacagtttgttcaagagcatataatctatcgatttggtattcctcaaaccattacaaccgattaaggttcaattttcgtgtccgatgagtttgttcagtttgccgatagaatgggtatcaaattgttgaattcttcaccatattatgcacaagctaatgggcaggccgaggcatctaacaagagcttgctcaaattaattaagagaaagatttttgattatcctcggcaatggcatactcgattggccgaagcattgtggtcttatcggatggcttgtcatggatcgatccaagtccctccttataagcttgtttatggacatgaggctgttttaccatgggaggttagaatcggctcaaggagaacggagttgcgaaatgatttaacagccgacgagtattataacctcatggccgatgaaagggaagacttggttcagtctagattgcgagcccttgcaaaggtgttgacagaaaacacgaggcctgggagatctgcttaactccagtgcaggtccaaagctcgccttcgggtgtgctagtgtgccagttgatttgatcctgtaatcaacaagaaataaaggcaaagaaaccacggttaaatctataaatgatagccgatcggctaggtaccgatgacatattatttatctttgagccgatgtcatatgtgaatcgatcggcagttgtaaatagacaataaagaactaaatctattcgatcggctgtagatatttccaatatatagttcttatatcgatatatacttaaatcaagtgattgggatagatcggtcgtcatgccgagacagtataaatcacttaaatcgaaatatatattaataacagggctatatatatgtttatagcatacccgatcagatagatttagcatgtatcggctaatactccgatactactctatatcagaatattaaaataggtataatatatcaaacaaagacctaatatacctagatacagcaatatctcgacataaagagcacatttaacatgtcaataaagcatacagagcaaatatagttaaaccagataaggtcggctgaaactccgacgctaccctaatcggcaaccagaaggcaggctagagattgatattctaagcacgacttaatagatcaaactcaactgatgcatcattaagtatgaaaagaagaacaatatctagacaatcaagccgctagaagtttcctagagtggtagataccttatacaatctaagtcaacattgatatataatctaatcggctgccctctacagacagatgttggacgattgtagattagattatgtaagacatatgataacttgacgaattacatagacaagattagagtgtcgtaaagatggaagcactaatcccgagaacacaatccatcataacaagttttacctcttgttgaagatcgaaaccgatgtagctcaacccgaaagcaagaactcgtcaaaataaaactaaagcaaaagggtggcgatgcgccgagattgtattgaacgtgtgttattaaaattacatagggcttgagtctatttatacccgagaattacaagatatgtccataacggacacgactactatctctaacaaactctaagatactataagtctttgcggcagacttttgcccaatcatatctccaaggagattacataaaacaccctaattaatagatgcaattgccttctcaggactctatccatgtgcggcaatcaccttgaagcacctcaatccaacccgatatcatatatcaagctgcattgtcggaatcggctgtatcggcttacctagtccgactcagacccatccgatcctaatcgtagccgatttggactccagctgattcctgccctgtttccgaacttgatctccgcctccgattttgcttcgatctaatcttctttcctgatgctaatgttaccaaattcggttgttaacaaaaggttaccaaggataaggaacgagttgctcggcattacaacaagaaagtggtgcccaaagcttttttggaaggtgaacttgtatggaagttgattttgccgattgggactcgggatagcaaattcggcaagtggtcgccgaattgggaaggaccgttccaaatctatagagttgtctttaagggggcttacatgttgcaaggcctcgatggagaagtttatggacgagcactaaatggcaagtacttgaagaaatattacccaagtgtttgggttaacacagatcggctgatgttgccgatacataagccgatgtgtttgcatcgccttgagatggtcgatattgttatatcacccttagttgttttcatattgtaatcggttgtgatttgccgatgtacaatggccgatattgttatatcacccttagttgttttcacattgtaatcggttgtgatttgccgatgtacaatggtcgatattgttatatcgcccttagttgtcttataattttatcaatgcttttgtcattgtaaaattaggggggcacatatatgaaaattgcagatttttgagcaaaatatggagttctattgaatcggcataaaagttatcaagataagttcgataaagagccaaagtttcttagccgattacaaaaaatttctaagacctattacacaagatatcactgagacaaatgttgctggatagccgaaatagccctttgcctgatttgttctacttcttcaatggcttgggcatcttgagcgtcgattctagggatgacttttaaagacttggtgagatcagcaacattcttgatagccaattttagtcttgtcttttgttcttcgacagattttgggagatcggctagctttttatgttccatatccagctcggcgttgcattcttcaagttgtgccaagagttcaatcttacgagcttcgagccgatcaatgttagatttaatcgggccctcagatagttgatcaagtttggccttctcttcatgaacaagctatcaattggcctggattgtggcctcgatatccttgcgctcccgacgtttagctaatctcagcttggctttctccagcttgaattgatgctgctcaagatagacggctggagtacggacatcggctagctcatctgggattagagcttgaacctcgtgtagctgagtcctaattgagccacaatcaaccactaagctgtctaacgatgatgcctctagccgctgagagatatcttcaagaattttcttcacatcagggctgcagg

SEQ ID NO: 55126 - DNA, 6043 bp, Oryza sativa
  unsure (1)..(6043): unsure at all n locations
aaagagagttagagctaaatagacctagccaatctaaattcttgtctcaaaaggaaacttactaggatagcaggagcagttggttgttcttcttcttcaatatgatggctctctatagccgatggagtttggtcactcgatgattgttgtataggagaaggaggaggaggaggaggctataaaaaagacaagtgttagataaaatcggctgagatcaactagtggaagagttaagaatatcttactcatggagctggtttgagaattgttattgccgatttcttcttcacagcagttttttcttctgcaactataaaatatgtgagtaatcggccataaaatgaagtgattacaaaaggaatcaagggaagttgtttactcttgaaaaatgggctggggcagaaggagttggaggagtttgcttaggtgaagccgatggagttctttcagtatcgcttatttcatctgcggcttgatcaacatcctcgccgatttcttcttcatccagagcttgttcaatggatggatctagggcaggcagatcatcagttggcttcgttttctttgacttgactttcttctttggagcttgagccgatagatccgcagtcgatgacctggtttttctctttttaccggtatcggctggttctctgatgaacccttggagaagagttgaagtcctgggggcacgataaccaatgacatggggagatggcccgcctccattaggaatcagacctggagcatattcgatatttctaccactattgctctgatgaggaggagagaattctgtcgtctgcaagtcaaaaagaaaattagtcaagttatgaatcggctaagcaattattcagacaaagttaaatcggggcatacctgagggataacatctggaaagaggtatgtcatgtacatggaagccgattgatagaataggtgcagtttccattcaccccaccatctgttaaagtttttgctcctgaacattgccagctctatattctcaatgctgcccagaggaggtccttgaaggttgagcagccgatccatcatcaaggttgatgaaattaaccttgagctcccatcggactttaggtttgaggacattaatcatgaaagataccaaaagtccagggaagttttctcagctgcaatcagcccatgcatccttcctgtcggcatccatcaggaagaaatatccaagtctcttatgagttctatcatccaatgagctcagctagacaacttggaatgggccaactcccaatcggcttattctttgccgataagatccagtgccgagtggaacttacctcagcgtactcggctgacagcgcggcagacgggctatcggaggacgacatcgccgtgggcagagatttggccaaaaatgaagtctcctggggatctccttgtgcgtcggagaaatcgccggagagagagaagacagagttggcttcggcggtgaaaacggaagaagacggtgtgagatttctcgggggtaacggttagtatttaaagcgatggaataacagtcgaaaaacggcaagagcgaatttcgctcggagttgatatatggcaaatccgaaacattgctaaatattccggacttggggggcatgtgttaacgaccaaatttggtaatatcagcattggagatggagattagatcgaggcagaatcaaagatgaagatcgtttaggaaacagagtaaaattggctggagtccaaatcggctacgaccaggatcagctgagtccgagtcagactgtgtgagccgatatagcccattccgacaatacaactcggtatacgtcctcgggttgagttggtatgcttcaagatgattgccatgcatggatagagtcctgagaaggcaattgtatctattaattaggatattttatgtaatttccttagagatatatttgggcaaaagtctgccgcaaagacttatggtatcttagggtttgttagagataagtgtcgtgtccgatatggacatagtttgtaatctcgggtataaatagaccccggaccccttataatcaatgaacacacgttcaatacaatctcggtgcatcgccaccctttttactttcgttttgtttcgacgagttcttgctttcgggttgagctgcatcgatttcgatcttcaacaagaggtaaaacttgttatggcggcttgcattctcgggattagtgcttccatctttatgatactctaatcttgtttatgtaatttgtcgagttatcatatatcttacataatctctagcaatatcgctatctaacctacaatcggctaacatctgtcggtagagggcagccgattaggttagacatcgatgttgacttagattatataggatatccaccactctatgaaacttccaatggcttgattgtctagatattgtccttcttttcatacttatagctgcatcagttgagtttgatcttataagtcgtgattagaatctcaatcttagcctgcttcttggttgccgattagggtagtatcggggtttcaaccgatcttatctgatttaactatatttactccgtatgcttcgttgatatgttaaatctgccctttatgttaagatcttgttgcatttaagtatattaggcctttgtttgatatattttacttgctttaatatcttaatatagagtggtatcggagtattagctgatacatgctagatctatctgatcggctttgctatgaacatatatagtcccgttattaatatatatttcaatctaagtgatttatactgtctcggcatggcgaccgatctatcccaatcatttgatttaagtatatatcgatataaggagtatatattgttaatatctacagccgatcgagtagatttagttccttcttatttattcatgaccgccgattgatacatatatgacatcggctcaaagataaatgatatgtcatcggcactcagctgatcggctatcgtttctaggtttaaccgcggtttctttgtctttgtttcttgttgattataggatcaaatcaactggcacgcttgcatacccgaaggtgagttttggacctgcactggagttaagcagatatcccaggcctcgtgttttacgtcaacacttctcaaggaggaatatgttacttacaagggtaatgaggggccgggcccttcataacctacaccttttaagatataaaccttataggcttgtacactcttctctgcgaagaacataagccctaaggatagatggggactcaggatcctaggccaagttgggctcctggtcccttcctacttgtaatcttaagatgggagccccctgtcccaagtcaacttgagctctcgggcttccttcatgaggcgggggcgtcggggcctgtctcgaaagtgggtcccatgcccgctatcgttaacgtgcacttaacttaatggtggtttaaatatggtttgttattttagttaacaaggaatatgtgttaagttcccgggaaagggtaccccaattcccgtttcaccaataactgtagaactgatctttcgtcatggtacctaaaaacacatactccgtatttctcagatccactaccaaccggcactaaatattatttttagtaccggttggttttaccaaccggtattggtattaaagattaacactttcgtatcggttgttgtcaccaaccggtgctaaagcttgtcacctttttatatgccttattcttcctccagcccaagccattgctgtcaagaggaggaggaagagaggtcataccaaaattttttgctaaagtattttggtgatattacacaaataaaaaatatccaaaaggttagcaacttcatcctctatttcagtcaaaaaaaaaacttcatcctctattgatgtatggttaacatattacatttctagctatgttttcatacgtcattctctcaaaaacgtttacagaaaaagaggagacaataaatttgacgagaaaataagagcaataattttagagacattggatgaaaatgtaaaacaagaatatcaaaggataggaaatgaagggaaaaaaagaaaactaagtccatttaaaaacactaaaatagttagaaataagaagaatacattaaaagtatgtttataattttttaaaaagatttaaaaaataaaataaagataattcatgaaaaaattatttaaaattttttaaaacttgaaaaagtatgaagtccatttaaaactcattgaaatagttagaaataagaagaattcattaaaaatatgtttataattataaaaaagatagagcatgaaaaaatatacttacaattgcgttgttttaaattattaaatgattattatttatttattttcactttcgttgacttcctttaaatttcattgtttctgttaacaacggaattttgcatcagactcggagaagaagagaaaagatcgaggcagatttggttcggaatcgagttgaattcagagtcggactgcgcatcaactgcaattgtatcggctgaaaacagggcaggggcttgacttagccgatatggcaagtagccaatacaatattacttgggctcaatttgtgcctagattggactaactgtcattgccaattagagatagagcttgattaaggcaattgtatctattaattgggatatttaaatcggtttgtcagagatttggcaagagaccgccatgtgatcttgtttgtatctaatctttaggaaagtttgagtcgtgtccataatgtactaagtttgcactcggggtataaacatgtaaacagcctctccaaaagacatgcgtgcatgatcatcttcatcttcatcaagggaaggtaatatggaattttgaagatactactggttgatggcattaactgcatagatattcagccgtagctggatgaaccaccaagggcccccatgtttgacagataagcccattaacaatctagtcgatgtctggctcaaagtttaatagactgctcctagaagatattttcccaagggaatcggtttcttctcatgaatggcttgggctagatgctgaaggatggctgtgggaccacaagttgtgccgcagaatacaaatctctctaaccacaggttgagaaaggcgatgtgttcttgatctgtcactgggccagtacccatgttattggttgcatatcctaaccagccaccaccaaccttggtctttatcttatattcactcttgattttcaacctgatggggttggctgatgaagtgatatctaaaccagttagcatcttgatgtatagaacggttggtgtcattggcccttgaccaaatatgaaggagttcagagtatcagaccagaaataggtcgcaactgataacatggactcattttttggcatatcggctagggatagtgacagacacttagctattcccatctttttccacaaggattgcttagaagctgagattctcctgtaccattccttccattcatctaatttagatggccgagacccgaagactgtgggccaatgggctagttctggctttgtttctctaaaagggatcctattggtctcaacgttaatgaagtaagttgggtttgagtcacccattggaccaaggaaatagtgtgttgggtcatgcagaacaggaatcacaatttgccctctaagatgttgaatcaagagatttgaaagggcaaaccctaagtgacggaatgaagcaattggaaaacaaaggatgataaagaatgaagaatttacctcaggaacatcggaagtggtcgccattgcattttgcgcagaaccgcttgagaacggagggattcaccgccaagagccatgtcgccagagacagaggggatccttgaagtaggagcacttgtggaggacttagccggaaaaggagattttgaagcagtgggcactacttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 55127 - DNA, 6951 bp, Oryza sativa
  unsure (1)..(6951): unsure at all n locations
gtggatccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcacacgcggcggctcccggtcgtcgctggccgacttgcgcagcagcgccggagcaggaggaggtggcggccgcgacgccaactacgacacgctcgtgccgccgtccttcgtgcgcaccgacggctgcggccgtggcgaccgctccccaccggtccacacgttcggcttcagcaaggaccacgacgcggtggcgatgcacaccatcgccgaggtcaccggcgggacgttctccttcatcgagaacgaggcgttcatccaggacgggttcgcgcagtgcatcggtggcctcctctccgtcgccgtgcaggagctccacttcgacgccgagacatggagaggaccggacagaccacgagcgtggccggcgacgaggaggcggagtccggcgtcgccgagcgctccgtggaggtggaccaggagatggtccgggtggaagccatcgacgacatcgcgctggagcagggattagttatcgttttttctgtttcggtagtagaagatgatgtgaccatggctactatggatacaaccattgctcacatcatgaatcaacaagaagacatcaagatcaagtcctccatgtgctgcaatctgattcggccacgtgttacattgctgacttcaaacggccgccaaatctacatacgtgctccgttttgggcccgtgagtacttgatggaaagctctcgaagtcctccttccaacggatctagcctcatctcggaattctatctcgtttggccgcaatcacagaagcaaggtgctgcgtcacctgtattgggccaatgggcttgtaactttgtttgggaccctggcccatgtggggcccatgtggggtgcaccccaatctggtgaagcacgacccttggaccctcttggtcgtcctcccacctctataaatagttaggtaccccttcttgggtttcttgggttttgatagattaaagtttagccattgctacttgcttgcagcgcgcgtgtcggctagaccgtccgtctgcttgttcttcggaaccccaacttatcattcgtatttaactcctatttgcaattcagattgcttttatcttgttcttgcttgtttcttcgatttgcttacaggaataaggttgatttgtaccggcaagatcaacaacccacggagaggtgtatcgatcgctaaggcgcaacgcaacgtcttgtacggttgtagtcgggtcatcaacgtttcttccaaatcgtagttatcatcaactcaccgaaagatcgggccaagaacagccttgagtgtcgagacgaactcagggtttatcacgtggtatcagagctttcgttgctcggtgagtttttatcttcctataaccagaaaatagccatacaaaaaaaaatccgtatcatttacctagccatattgtgccattgtattgttcttttcagtttttgctttgttaaattttgtgttgcatcgtctcgtcgtgttgctagtcttagcgtctagttcgtttagagtttcgagttctggtcacgttttataccagagtcgtcgtcgcctccgtgtctctgttatcgtcggaacctacgaaaacggaatcggctcgctgccacggttctatttttgtagttttcataagtttctgtcggttagtttttgaagttgtggagctgtatctgggttccagttgagtggttgcgcactgtcccgtgttttttttctgttgcgcgcgaggaggaagaaacgcgcaaggaaggagaaagacgtgaggaaggagaaagaaaggataacaaatcggtttttggaggaagttttgcagattagatcagtcggttggtttgtcggttggtttgtttccttctcggttggtttgcttccatctatagccgagtctgtttcctcctagtccccacccccacgtgattcccgtattactatcccacttcggtggagtccgactccctgtctctcttctctcggtttagatccataccgtgtcttcccacatagctaggtgagaatttttgaagtgtcggattggagatccgtttgcaaaaacggaaccttcgggacgagtacattccagttttgtataattttaattttgagtttggacttttacatttgagtccttgtaaattttatatttacgtttgagtccctgtaaccttacattaaggtccttgagtcagtttttgttaaaaaaatcaagaaaaaaagtgagaaaaaaaaggcagaaaggtgcataaaaaaagaaaagaaaagaaaagccgcacaaaaaaaaacaacagaaaagaaaaggaaagaaaaaaaaagaaaagaagaaagaagaaagaaagaaaagagaaaatactgttatgtttgagctgaacttcatatatcagagttgtgcatgagttgttcctagtgctatcttgtggtatcgtttgtgtctaggctcgcgtctctagtacgttctagctaggaccaacacggtacttgactttgaaccattattcaactttgcattctctgatttgagcatttgctatccctttgctacatatttaagcctacccagagctccacagatctgattgcagccgtacagcaagtgtttgccaacgcatcgatacatccaacctccattggggtgcttggttaagtcggtgtacatcaccattccgcttgctttggtaagaacttgtaagagcttggttaaaagcttgagtgtgtgtgatatttgagctgccactacctagtagttgataggagcgtgcatatttttgtgtgtttcttgtttgcgactaaccatggcaggattgcgtaagggaatacgagaacatcgacttctacaccttcgacgagatatgacgacttctccacgtgatgcatatgaggtacacgactataattttgaacaagttgcatctaaattaccattctatgatgggaagtatgattctgttgcatacattgattgggagctagcagtagacaatgaatttgatatatatgatttttctgatgctcaaatgattaaggctgctagtaataagtttacctcttctgcattattttggtggacttatgttagtaataaacctgaaacttaggatgaattgaaaaccatgatgagaaaacgctttgtgacatcttattacaaatgtactcttcgggagaaattagaacatctgaaacaaggtgatagaactgttagggagtacattcatgaatttaaggtctgtatcatctacagtggtctcaaagagtgcaatgaaaatacaacgcgtagatttttcaatgggcttgattctgaaattcaggttttgcttgataatgtgacatataatcatattgggcttgctcgtagcattgagagtcagatcatatcaaaggcgaggatgcatgaccaatgtgatttatctcctatttctgaatccccaatatacttatgtaatgatgatgtgcaaacattggaggagcaatcttttgtctcccctgttactaacgttttgcaggaagatcagcacatccaagaaaaggagaatggtatacttgagaagaaagaggatgaagcacctgcgatgtctgaagaaagttcgcaaggtaaattaaatggtgctgagagaaatgaaggtgagtattctcaaggtgagctacacttgtccacttttcatgctatagtagagcaaccattagtggaatcaatttctgagttgcctttgtcacaagttgatttacttgctgttccttgtgataaagaagagttgtgtgataatgtttcacttatatccatgctacaactagtgaatgaacatgttagttctactatttctttgtgtgctgattctaagcatgttgttcacattgctaatgaagtagaggaacgcgaattgctatcttctttaaatactttgggctatgttcagtttgatgatttttgtgagctcgataatttgaaggagaaattatttgctaaatctgatttgccatgtccaactaatgctatttttcatatctttggcgaatataatgatagaggaatatttttggtgcatagagtttacatttgttcggatttagaacatcttgtagttccggataaaatatgcaagctagagagacatgttactgctaatcatattgtctcgagtttgtcttgttttgattgcaagaaacaggttgttttcagtggactacgcgaagagcaccatatggaaaaaccgaggacagttttccgtgaagaaggggaggatgatgtgaccatggctactatggatacgaccattgctcacatcattaatcaacaagaagacatcaagatcaagtcctccatgtgctgcaatctgattcggccacgtgttacattgctgacttcaaacggccgccaaatctacatacgtgctccgttttgggcccgtgagtacttgatggaaagctctcgaagtcctccttccaacggatccagcctcatctcggaattctatctcgtttggccgcaatcacagaagcaaggtgctgtgtcacctgtattgggccaatgggcttgtaactttgtttgggaccttggcccatgtggggtgcgccccaatctggtggagcacgacccttggaccctcttggtcgtcctcccacctctataaatagttaggtaccccttcttgggtttcttgggttttgatagattaaagtttagccattgctacttgcttgcagcgcgcgcgtcggctagaccgtctgtctgcttgttcttcggaaccccaacttatcattcgtatttaactcctatttgcaattcagattgcttttatcttgttcttgcttgtttcttcgatttgcttgtaggaatatggttgatttgcaccggcaagatcaacaacccacggagaggtgtatcgatcgctaaagcacaacgcaacgtcttgtacggttgtagtcgggtcatcaacgtttcttccaaatcgtagttatcatcaactcaccaaaagatcggggcaagaacagccttgagtgtcgagaggaactcagggttcatcagaagagatcaagcagggatcggatcgtgggatggcacggttagtcattgatccggcaagatcgcgcatgtaacaacctcctgtgtggagaagaataaaaggaagaagagaactcagaaaagctgcacaatattgcagcaccaaaacattgttcttctctggttttctgcattgtcgtttttcgtcagacactattcatcattctgaaaccgtcagacaagctaggatagccactgaaatcgcgtgtgtttgctgatagctccgtcgtggtctccttcatgcagcggccggcgggaagctaccaccatgtcgcctgccacgacggcttcaaggtgctccacctgccgtagaaggcggcaacgagcgacgacacccacaacgacctctagctccgccgccatgggcaggagttcgacgatgatctcgggttcacgctatgcaatgattactactcgccgccgccgaagttggtggacttcgtcgccgaccatccgtttgcctccttctagctactccacgccacgaccccttcccgtgcggccgctcctcggcgctgctgcgaccggccgcctcgccgcgtgacgccttgcgaagacgatggattgcgacctctcctcgacgatgaagccctgcaagggcgaggagctcgcctcgccgccgaggtgttgtcctgctcgtcggcctccacgcgcgttcgtcgacctccctccgtcgcctggagagaaaggagaggagagagagatgaagagaggggagatggggagagataaggaagaagaggaggggtgaggatgaaatgtggggcccacgtgggccccatcatttttattaatttgtgtgtgaaactgacatgtgggtcccatgggtttattattatttttggatcgaattgccatgtaggcgccacgtcaatgccacgtcagatgaagaccgagtcaaattggccatgtaggcgccacgtcagccaaaaccaccctcaaaaccgccgaggaacctaatctgcactggttttgatagttaagggacccattgtatctggtttttcggttgagggacgaaaatcggattcgttgacaaattaagggacgtcagataaacttattcccacagatattagcctctctagaaatgggccgataaattgaactaaattttctggttcatttgttggtatgggccagtatttgcattcccaaccgaggcctaagatcacacgaaaattcttagcttgaaggaaatgttccgtttaaaaaaaggaataatgcttgctttgggtttcggctccatcggttggccaaatgctcattataagccgtgcagcttatcacagtaaaaaaaataatttataggtaaattttttatatatgttttttagcaatttaaaaatcaattctgaatgataaactacaatgaagaacctcaaaataaacttcaaatttaattcttttttaaaattcaaattttaactacggtttaaacaatagtgcaaaagatgagagacgaaagagaactgtcgagttgggcctgtacaaagattttggcccaactcactccaactcttttcttggagtgaaacatagggtctgtttggtacagctctagctcctaaatattgttccaggagttgagtctagagtggagtt

SEQ ID NO: 55128 - DNA, 11661 bp, Oryza sativa
accggctagcggagccgctttagatagaacgatggataactacccgtctcgtgggcaaacgaaaggtttacaggacaaacctagaaaggattccgcacgatttacgacgcgaatcgataaagatggacggactagaataaaatagattgaaacattgaaaaagcgattcaattggcttatgtgtagattgtagattgtgtatgcaattgaaccggccttgtcccttatataggggttggtcttgcgtcctacaggtcctcctccacgtccaactcgagggtagaaaccaatggaaacctgaaacataccttcccgagcaaggaaacccaatacccgatgaaaacagacttgagctcggactctgccggtcttaccggccacatgccgccggtcagaccagccctcaagccacagtctgaccggcccatacacggcggtgactttccaaatcttggcaatttttacttaattcgagcctacgtgccaaatttgggtgcaaacaaaaagtttcaaatctaactatagtataattataatataatttcactataaatatactataactataatataacttgtatataaatattaaaataatatatgcaactttatatctaattaacttatatatatatatttcagtgtagttacactatagttacaatatagctacaatgtaactatagtgtaattacattgtagttacactacaactatactatagttacatttgaaagttttttttcccaaaaagcttgcgtacagttttttacaattccgtgaagcggaatcctatatttataacatacatctagatcatattagaaccctaacctcatgtagcgctgcgctttgagcacataacacacccgcatgtatatatacactatctcccggtcaaattcgttgaaaatactagcactagatattgatatagtattcgacataaattcgccacaactattctgaatatatgttcatcaaaactattaaaattttaattatttggatgtatttttgtatgatggatagactttatgtcaccacaacaaacaatttttagtacatatataatatatttatattcaaagaggttaaacgtggttacgtgccttctaaaaatctaaagtgacttacattggagatgggctatttagcgagtgcacacctctttacttgagagcaaacattgataacacaagtgttttggtgtgtataagagttatttgtgaataactctgtataagaattatatatttaaaaaaaaataactttacaaaatttgaatgcatgtttttaaataaggtatgtccaaattaatcattctgccaccatacacactctcttgcagtggtttgatttactagtctcaacttcgatgctagatatttttcacccccaaattctcttcaaaccagataaactataccctcaatcgatttggaggcgttttattcctatgcggtacccatgtggtattgcattaactatgcggcaatcctattagtagcattgtcctacctcctcctatccctccccctccatctctatctaaccctaatatacagtttcactgggagagcaggcaacagcgctcgtataggaagaaggtacacaccttcctctcttcatgctaatcaagaaggtccaaagaagacgacctgacaatgagcttgtagggtccaaccatggtgctagcttgtggcgaggagatcaagttcgatggccatcattgtcgtctctgtggctccatccttcgcattgtaccgtcccatggaggacaacacctgatgacctcgctaagggcacggcggaataggcttgtggagactagcaacaagcgagcttgtcaagggtggtggtggagagagctcaacggtagtagggtgtgctcatggagacccatcccttctcttccaggggtagcgcaacacattgaggacatgccacaagaggtggcagtaatggctcttcattatgccgccatgtaccaatgcccatttccctctttccctcggcagtcagcttcgtgcacgaattgttgtaacagtggaggctcaggacaggcccacaactgtggaggtagcttgtcccgtagatcagttcaattggcaatagagggagtggctacagagatggaaaattcaaggagggatgagaggttagagttggccatcagggaaagtagcacccaacttagaccaaagctttcatgtctttcctcactagtgtccgagtagatgtcgctagctagataggtagatttgggaagacaaattggggagaggaagaatctagatttggaggtagagatgggagagaagagaggaacaagattatggataggctagatataacttttaaatatattttatctttgttgcctgaacaactacatggtaaaactgtttccatgctttcatcgtcctcatatagcttgaaaggggaagggttatattaaaatagaccattttaacagttgagagtttaaacatctggtattaaagttgatggaaaaatcgtcacaaccgtatatgccatatatgttttgtttttgccatggtaggtctgtgatggtggtgctcatcataactcgttacaggacatgacttatgccagattttcgttgattcttagaaaaaaatgtgtgtagtccacaaagtattgagggtataaaatgtattcatttattaatcttaaaaaatctatattttcaatatgctctggttacaagatctgtgtattcatttatctaaaaactgcggctactcagtgattctttgattaaattaatggatgtctataaccacgcattccatttgtttgatagaaactgatttatcactaaaaatctttacgttttatatcgtgtggtggctgagagatcgtgaatatgctttgtagtagtagttggtgattttattatttctatcctaaagaaaaaatgatttaaatataatgcaaaatttgctttactaactaactctcactttctcttctaatttcagtgggccatgagcagtagtgacattagagacttcaccctacaaatgaaaattattatttatacgatattatcatgtctatcgagcgtattttgggcattatatgcttggttatttaacctaaaaacaccaaattactacatgataagtgatcatcccgtcactattatatataagacagtaggtcatttttattgttgtttttgtttctttactaattactaagaaatcgacacgctgattggtgtgtcaattgagtagtatgtgtgtacggtctttaaaaactacatagttaacatactaatattttttttatgatttggagcatcagtgagattagatttggcatagaactctagatatgaatccaacaccggaataagtgtttgttttatcataattgttgtgttttttaaaagttgaaagatttacgtattatttattttataatgtaagaaaaacatatgtttagaaaatggttatcaagattatagagtttgattcaatcctagaaagaatgagcaaattgtttttgtcatttagttttctatctattatttttatttttagtttctcgaaacataggatatgtagtcacgatacttgccccgaataatttgtaaagaattttacgaaaagtattttttctgtctttttttttcttttcctctctcttttacgtgtttgcactagtccggtcacacactgttgggttgtggtaccgtgtggcctagctacgcacatggaacagctttttttctctttttttttcagttcaccgtcgtatcttacgcacttgccaattttatagatagggtttcttacccggagctctttctgccacttgtatctcgccatgtgtcgctcaactaatggatggtgaggacaaccaatcagctagcacaaaaccaatcagtatgagatagatatatgcaaagaggaaagatattttgggaagcctctgtaatctagatgttgtgccttttgtttgcttctccgtatttctttttttattgatattctatatttatctcaaagaggataaataattgggaagtctctaggatttgtatctattgttttcttttggctatttttttatgcatagttttattagatttatcacaaaatttaataccaccatgtggcctaatgagacgagctagctttagaaagatagattggtcagaaacaagatgcccacagttcagcttggggcttagaccattcacagtaggcctccgtggcattcagcctcaccaccaaaaatagaatattcgctgccacgtcctccatccacacaacctcctcaagtccgcgtagccaaagttggctacgggttcctcgcaggtttgcaggtgggatccactgtcacaccctgaaaatcctaaatttataaattgttgtttaaatggaattattagaaatgattttaaaagcctagaagaaaagatttaattataaataataaattccaatataaaagtgggccagataaaattttattaaatacttcactcgattctatagttcctagatttttctgggatttatttgagccaagaaagtatttttaataaatggaattgcatttcatgaataatttataaaagaaacttttggctttgggccgaaagtcggcccaagtctctctctctccccgacctaagcgcgcccggcccaagtcagcccgccgagccgagccgccgctctccctcctctctcccgctgacaagtggggcccacctgtcaggccgtcttcaacctcccgccgcagccgcgccctagccgcgcgcaagccgccgccgcctccttccaaattcgcccgcgtctttccatctccgagcaaatcaatagaggggaaatgatcctcgggatctcctcttccttttctcttttggaaatttcatctaaattcgtttggaaatcccggatttgatctcgattcggattcgttttttttccctaaccctaaaccttccttctcgccgccggccaccgtgggcctccatcgccgccccctagcccctatataaggacccccgggacctcctctcttcgccgccaccctcgccttagccctccaccaccggtagagctctagccgcgtcaagccgtgcgccgccgtcgccgccgcaagtccagtcgtgcgccgccgccgctccggtcgtcgtcgtcgctcgggaaggccgccgtcgggttcgccaagtcgtcgccgtcctcgtcccatcctttgtttccgccgaggaccgccggaacatcgccgtcgtcgtcgacccgaacgtctccgccgcttcgacctcatcaccgtctccgtccgttgccgtccgccgtcgtccgagccttcggtgagttcgccgcgtcaccctctacttgttggtgccctccgtttgcgccgccgcgccgtcgttcactggcgagcacgaggtgccgagccgccgctagtgatgacgtcatcgtcgacgtcagcgcctggtctaacaatgtctttcgtgattagtctcacagctctcaccataataaatgatgctgtaattggtaataacttgtttagctcctggtttggagatagagctgtgcagccgggaatggttgttcagaatggttgggcctatgcaacgagtatgttgtatagtgttggattaatattgtttaagtaaatactttactgttttattaaattctgaagtatttattaaaggccatttatgcaaatgagactatattataccatcctttgttatcccctgcatttgcatatttgctgcgtggcttgttgagtatgtcatatactcaccttgcaatcattcatcagaggaggaattctacagtgatgctgaaggtgtggaggattaggcgtagccctggtcaagctgcttgtcggatggagacgcctacgccgtttatcttattttccgctgcttcaatttttattgtttgagaggaactatctacctctataatgactttatatttgcttattaattagagtaataattgtactctattattaatttgttattgtgtgtctcggctaattcttggacgagggtttacacacatgtaagcgtttggaattttggatagaaattctgggcgtgacacccacactcgaccttcgtgccgtcagggaaaggaaagagaggagagagacctcgtcggcatccccgcactccacgccgccgagctcactactccgctcgacgtcggactgtgtcgccccattctacgctacggcagccagaggaggagggggaaagcgcggcggaggagatgagaaggggagagggaggcatcggagaagcggatgcgctcgaggtcgaggccaacgtcgattcggagttggcgccgtcgccgctcgggccgccccgcgccatcgccactcgggccgcccggcaccagcatcgcgcgccatagctcagaccgccccgccggccgtcaccgctcacccctggcctgtgtggggaaagaaagaggggggagagagagcggagaggaagatgaaaggaaatgagagagaggagagggaggggaagatgaaaagtgaaaaaaaataatactagtgagacccactacaagtaacttgtactgtggagcatgtagcctatcttgtttttaggtggtgtttaggatgagagggacttaaataagtccaaacagcaccttaatctacgtgacatgaagaacagcaaaaatgaatgatgccctgctaatgcccggctaggggcgtatccaggtcaggaccgtacatctagagataaccagcagccacatagtacagactacagagactgctggtggggcctgcttgcaagatgctagtggtactaccagtactgcatgcacacttggcgtagtacgaacgagttgactgcgcatccaatccaataatggagcgaagcacaaatcagcaaggggtatcctccatcagattcctggactgaaccaatcaggtcttcctcctccggttgaattgctgcatactagtagtactagccaggacaccttttatttacgcttaattgctttctcgatcggaagcaaaacgctagagcaggtccccatcactgtagctcaacatgacatgaactgagccctctctctagttactgtagctgctaccaaccaactaatttgtagacgcagtagtgcttccaatggtctgcatgatggagattacacgtcctaattgtctagaaaccaattaaagaaactgcgacgcgcaatcaacctgcactaggctaaagaaaattaaggtactaatcaccgacaatatatttctttttcaaaccatcgtactcatcggtgttcatataaacagctggtgtaggggctacaagattcattttcttattcaaacagaatatcagtttgctatttaatttgtcaattcttaatttttatagtttttagtctcataaatttgcacaacacagcctaaaattgtaatgtacaaaggaggtgcggcattatagattgatgccaactaacatatacatacactagtacataaagaaagacacatacaagttggcactatagttaccagaacagctaaaaccattgcatatagcgttcttctcaccttcacatgctgaaaaaaactaatacctttaagtgactatagatgccggttctaaagaaaaaaatgacacctttatcttaggtaccttttttttaaaaaaaataaaatgaaccagaacctttaatatattataggtgctgtaaaaaccgagccaagcatagatctgattttttttggtgcacatggccctgggaggggggcatcctcatccaccagcgccctcctctcgcccatctctctttatctctctatctctctctccaactctcctccgttttctgccggctccctctcctcctctccttccgttgcacggttgatatttcttaatgacattactagaaatataattcacagcactgacatagaaatattcatggtatattaatggttacagatatgatccgcaaacgcacggatataccattataacatttcacccggaagtattccaagatatcgtatttatttaatcccaagagaagataaccgaatactcggacattaaacccataccattgtacctctctggtaggctagctacacaactatatcggtacaagtataaaataaagtcggtactcagataatataaatggaataaaatatcgaagatgtataaaaaagaatattctattacttcaatgagtcttacaaaagaagagagaaaatccgctagagccatacccgaaatctcctgaagactcgaggactaagaaaactattctattcctactctactagcactaagatactactaaacttgcgagagggagagagctcttcttcttgagtgtgtgttgaagtggagggagtgaagtccttatatagcctcccaataacggttgtggcggttggaatggacgaaaatgccctccaatcgtcattggggagtgatccacaccgtccatcgcaaaccctacatcgaacggcttcacggtgggttcggccgaaccatgggctgggccattctgtcccatttttggcaggcagcctccttaactccttccttatccagaacagtgaattttgagcctattggatcgtgtcaattatttgttcttggcccatttatccataattctggatctcgacaacgtctgattgattgatcgtttattttttgtcgattctcctccatttatatgtgcttctcctgcatacatgttagtagcatagtatatagtggaaatagatattttatttagaaattatgcattgcaagcatagctagtcttcattaattgggtaatattgacggtcgaaattggtcgataacgaccttcaacaacggtccactgcgcccatggcctctcacccaccacacccgtcaccatggcgacgccggtgctggcagctggcgaccaccactgagctgaagaaggaactgaggaggatttcggtggaggtgtacggcaccaaggccagcgtcctcaacaccgactgtgccatctgcctcggtgatttcgccgacatcgataaggtgtgcgtgctatcaaggtgccaccacggcttcacgaccactgcatcaagcgtcgacggctgcttccgtgacgtatctagcattgccagcatccccctcacctcccctgggaagtaccccctcacctcccaacagcggcggcctcctctcaccttcccacgatggcggtgtcgagtgcgaccagatctgaccactgtagctcaagggcggcggcagtggacttctctccttcaactccttgtttttacttctttggattttttttggttatgtggacgttgattttgtttttgaatgttgattgtgcgattgtgttcatgttgatcgattcaacggtttagtggtgattgggagctgcttgattcattggatcgattcgagccgatgcatcaactcgcctttttttttattctttggacctcaaaggtgccagttctaaaaactggcacatttgatttctctcattagtgccgtcttttaagtgtcggttgggtaaaacgacacctatgcggggtttccaaccagcatttgtgttttttactgttaaattgtattctttttagaacatagataagtacatataaagcctactgcacattctggttgaaactgtttgttggaaaaacctatcaagaaacgctggtatgacataataaaatcgataggcactactacgaaaaccatctttcgtggcggccatattgggttttcgctagcggaatttaaagccgccataaagccatggccagtgaaaatcaagatcttcgctagctgttatcgatcgccagcgataattcattttcgctggcggtcgtcttaagccagcaaaaatgaattatcgctggtggttggcttaagacaaccgccagcgaaaatgaattatcgctgatgggttacactgtgccagccgctagtgtaaatgctagccaagttaaaaaaaacgacagatggagcgacaacacttcacccgcctcccttcacataaatttacccaagcattcaaaaatccacaaaaaattacattcaaaaatttccattcacccaagcattcaagcatcacaaaaatttgaagtcgccgtcgcggcgctgcccccgtcatcacgacgcctcccctatcggcgtcggtggcagatccggcctcccaggtcgtcgcggcagcggatccggcctcgcccgtcgtcgcgatggccggatccggccggccccgagctcatggtggtagaggcgacggcagcccgcagcggtggtggcgacggcagctggcggtgatggaggagggagagtgagaaggagagcccacggctggatccgtcacccgcgtcgttgtcgtcgccgagactggctgccgccgtcgggtccgtcgcccgcgccgttgttgtcgccgagactagatgccaccgagcccgccggatccgtcgcgccagcaccgtccccgccgcagagcccagtcaccgctgccacccatcccctttgccgctaccggagccgtcatcgcctacgccatcggtggagagggatgaggagagggctgcgcctcggtggggagggacgaggagggaagagtggatctggaggatagagtggatatgggagaggggagaggaggggatgggagggcagtggcagcgcggggagccgccggtcgtcgccgtcgccgtcgccggtggggaggccgagagggaggaggggataagaagaggaggggatgtggagagaaggagaagaggatgaggtaggtgggtggttttaatgtgaccagatatttttggtatgagctgggttttctctggcagttctgtttattggccgctaggaaaaattcgaccgccagtgaagattatctattttcgctagcggcgcacctaagtgaccaccagcagaaattgtcatattttcgctgacggcagtgttagacgagccgccagtgaaaattcattttcgctggcggttggtgccccccaccccctcgttatgactttgctagcggtttttacatttttccgccagtgaaaataataggccaatgccatgaaaaatcgtttttctagtagcgaggtctgaggacaatctgaacttagttgaacattggtaggatgtgattgtcaggtaaaacgattaatcaagaaatacgagtttgtacgtgagagttagtagtaaaaacttaaacccttcccccacaatagccaacttgaacttagtcctctttccttgaagataaaaagaccacattgaaaatcccatcgtttcgctcatacttatacttatccacttatccgtacagcttattaacaatagaaagataatttatggaaaaactttttttacatatacatattcttaacgattcaaaagtaaatgttataaaataaactacgatgaaaaaccataaaatgaacttaaaactaaaatttttagtttataagtataagtataagtgggacgatggggctattgactataagtacacataacagtctcgttgatgctggatataacagtcgcatactgttatagtagttacttactaggtaaccaagacttgcatggctttttattcattatttagtggtattagctagggctgcagg

SEQ ID NO: 55129 - DNA, 3304 bp, Oryza sativa
ctgcttcgaagatatggaatggcgtggtcggcgtatagctcggttgaatagtgtcattgcacatttgcactccaagatactcgtattttacgggctagtatgagcttactagcttagcattgccacaagttttaaatgtgcagcaagcaacggttctttttgctgctaataaatcattcctcactgatgggatcaattttactcaaaagtagattgtgtttagattcaaagttttgatccaaacttcattccttttccatcacatcaacctgtcatacacacacaatttttcagtcacatcatctttaatttgacacgagaagaaaagtgtgacctccgcggctatggcagtgacttgtgaagcagacgtcagtggagcgagctgtatgcgcgccactgagccacagagccaatgctgggcggtaactagctccagtggaagtgcaggggcggcaatgccgatgattcgaatccgcgtcgctcccgtggatcgctggccgtttgttggccactgcggcaaaacgctagctggacgccgtggacgggagcgactcggcggcgtctttttagaacgttcagtaccagtccattgcctcccctcttttgcctgccagtggggcccacagggaccaagggacattgggcccacctgtcaacgacagggctaatgatggtctagctcatgggcccagaggcctcggggcagggagatgaggggaagaagaagcagtggatgagaccatgagacgagggtcaatcattctttgactccagcggggtgtcgcttttgtcgacagatgtccgagccacgaagccgttttccgagccgctgcttgtcgctttgcgtggggagaatgacagtgcgcgaataaacaaatatacaattcgatcgtgctgatatgctagaggattatttattggtcgccgagttcagactttaatacatccgtcccataataagtgcagtagtagatatccgtgtccacgtttgaccgttcgtcttatttaaaaaattgaaaatatttaatcacatataaagtattattcatattttatcatctagtagcaataaaaatactaatcataaaaaaatttcaaataagacgaacggttaaacgttaaacgtgaatagtgcaaaactgcacttattttgggacggagggagtactttctttcttcgattacgattgtttttggattaggacacccgcaatggttatctatagactctctacaagagatctatgtcagcatatttttctacttggaaaaaattaaatggagagagagcaaaactatctactaatttagagataatctataaagaaaaacgaggcaatggattagagagctatagataccaatgtagacatactattgagatggtttaatactaatctagtttgttgctgagatgtatatgttttatatttaacattacgggtgctcttacaggagcctgccttatcgaacaatgctcccacagctcgacgtggaaaagagaattccgatgtgtccctgtaaccggaaagagacatctcttcgtgtaccggggagatagagctgtataggagacttgttttgagctcagtgaagatatgttagatttggttcgattaagcttaaacagatagatcttcatccgccctccatatactcggttgtgtgtagcagagttccctgggttccattttttgacaaatcggccaaattagttctacagcaataattggtgcatctaactcgctcatgattgttcgctctcaatgtatccatgcaatacatgattgcagttcatgatgtccgccgatggattatactatatgatcggaacatctaccatctatctacccccacatcgagtgcaccgtattgtcatatacgcgtacgtggctggaataatggaacgaacagacggcacggcggccggagaggcttttttccgctctctcgccatcttttctgctagtagctcgccgcgccgcccaccttttcctcgtctcccgtaagataaagaaattgcctcggcgcacacaacagagcagtccacacacacgcacgcacgcactccctcggttggctcctccactgcgatgtgcggtcgaagcccctaggaatggaatgcgcgagaggagctagcctgacggattaaactagtcaacgtgagggcttatcgcgaattcaaccaacacgttgcccatggcgtaccaacacatgcgtagatatactggatagatactccagggagatgagctgctgatactgcctgcaccagctgtggttggtactggtaagccaggtcgcacgcttgcttgctgcttgcggccatatttatatccgccagctgactttgatcctccatgccaggtacagccaagggcaaaacctgcaggcaggctgcaactgcagcttgcagtctgcttgcatttgcaactgcagctggcttgcatgcggccgtctcgtctgaccagacttcatatttctacagtagtagtaccatgcacagcacaacggcacagcacgcaatttgcatacacaggacgcctaaactaaaacgtggttttcgacatatctagtcagctctaacacaatcttatctggaataaataaaggcagctgtctgtgctaatgagatagagatggagtatattgttttgttaagttgtcagtgttagagctaatgatcagtctttggatattatattctctggctagttcatcgtcatcactttacttttgcatggccatttcgctttcgcacctcttattcgggcacacgattgggaagaatgggcaccccatgggccatgagttccctgcagataagccctcccggttcaagatgtcctacctgacacggcaggtgcccaaatggaagggaatagaaattgttaacgtcgatgcagctaagcttagggatgtttggaaattagggactaaactttagtctctctcacaaaaatataagtctaggaacttatatttttatgagagggactaagggggtgtttgggagagactggggtgtttggaaactagggactaaatttagtccctctcacaaaaacatgagtcagccccactttagtccctccaaccaaacaccaccttagggggtgtttgagaactagagactaaatttagtccctcttacaaaagtataagtccctatggtagggacttatgtttttgaaaaacataagtcagccccactttagtcctccaaccaaacaccaccttagggggtgttttgggactagggactaaatttagtccccctcacaaaagtataagtccctatggt

SEQ ID NO: 55130 - DNA, 35460 bp, Oryza sativa
  unsure (1)..(35460): unsure at all n locations
cccttctctcaaaaacataagtccttaggggagagaattatacttttgtgagagaggttaaagtttagtccntagttcctacaccccctaaagtttggccttctcttccaaacacccccttaatcatgcaagcccggcgagtgctacgtctgcctaacctaaagttttaaagggctagacaattagtagtagcttctcctaacctcgcagcaggacaattgacagtacattgctaccatgatgatgagtttagtagagcaggtacaatagcaaacatattttaagaagataataaggagagagaagagcagcgggctacaaatttgtagccagctgtagcacagactccaagatacagtgtgtgtatgacaagtggtaccaagtattaataatgtagtatgtaactattgtatgaatgaactattagattgactataaatgaattagagttagtatttggctatactattaaacttgctcgtaggagtcccctcaaaagacttgcagtctactcgcgggtccaaagtgatcagcagaataaattcttcagtccaataaggcaataatgtgtctaatttgtttaataatcaaccaaactaattaatactattcatttggatgatgattgtaattagcggagttggaataacacgatcgattaatgataagaaatgccgtcattgcatatatatatatatatatatatatatatatatatatatatatatatatatatcagctgtgccagcttgcatgtgttatccgactgaaaaacttcctaaactatttcaatccgggtggtcaaaaactgtcaacacaaactcaagtaacaggtcgagattatgaggtatgcagtgcagcgtcagagatgggccggtgcccgtgccgaagatacgtaggtagtagtaacgtacaaggaacagtccaaaaaaaaaatgtacgcggagaacggcgtaccaaactgcctagccagtagccactcgatggtgccaactggtcgatctcatttcagatgagagttgagagaggtccaggctattgaggatgctatacacacaatccaaacagcttgcattgcttgaatccgatcgagccgtgccagagccgccgcgaggaccaccccccaccccagaatccgtcgcgattccccggccgtatacgaaatccaatcattcgggggagaaggcgaccgatgatcaaccagacaaaattccagcgccggatggacgaagggcgtgcaaaacgccggggccgcgcgcgccgcgcgttgttggatggatggacgccacacagtgaaacacagcgcagggatgcacggccgcgcgtacggccgggggtgacgcaaggggaagggccaaaaaaaaaaaactgtggctcgatcgattgatcttgatcacatcgtgcattcgtgcgtgcgctggatcagtgaatgcggcgtactacgttggggtggtacaggagaccaatgacacgtactgtacgagtacgtcctggccagcgattattgattgcaatcgatgcgatggaggtcatgttcatgtccaactcagacatgcgcatgcaggcagtcaggcagaggcgtagtaggagcagatatcattgcgctgacgcagactcggattcaatggcctgcatgcctgcccgcccggaatcatatggacgcctggatggacgtttacacgtcgtccgtcccggccctctgctgatttggacctcaggccacccatactcctatcctctgcagctgcagggcaccattcatcactcatttccgttctagaatttttgttttagggtgtgtttagtttctgaaaaaagtttaaagtttaaagaaaattaaaagtttatgtgtgtaggaaagtttttaatgtgatatgatgtgatggaaagttgggaataggggggaaactaagggcctgttcactttgatgccgttttcaaccttaccaaattttagtaaagttgtcaaaaaagtggctacatttagtttgctactaaattttggtaactatataaaaaatcctgtcagttgccaaaattttgataactatgccaaaatttggtaaggtttttttgacaacaaagtgaacagggccaaacacggccttactttttcatactttttgaaagctttagtttataaatagatcactgtaaaaaaattatgttataaatggaccatttttctcagtgtcaagcttcaatgtctaagcgacgacaccctcgtctagtcatccccctaatagccaaactgttgatgtgaaggggatcgacgttaaagatttattattattatttaaaaaaggattaaaatgtaaaaaaaatcttacaaaactttaacgtcgatgacatgtttgtaataaaaaattagattgtagtcttttttttaaaaaaaattacaaataggtcctaagcgctaatttcttaggagctaacccttctgtatctcggcttatggggatgagagtgtcgtcactaatatcgttgatgctcagacgttagatctcggtgccaggatcactggcggcaagaaaaatatctattcctaaaataagttttttatgaatacatttgtaaaataattttttaaagagagcaaaatatattttaaaaaaatccagcatttccatttctcccgtcttcatctcttgcgcggcgagagctgcttgtcgctttcacgagcatcgatcttgcatgcccatcctgtcctggaacagccgtcagatggagacgcccatacgacaaataacgtctgtctacgaaaaaccattccaattcagcgggggttgctcggtcatcaaagacgggaatggaaggctgcctacactgccaaacgccaatgcagctggctagccatgcatctgcttgtttggttgcgacttctttttctatgcatgcgtgcctctgctttggatgtgcatatcttcatatgcatgccccgaatcgatcaagccgtgcaatataattgcacagaaatttaccgtgcctcaagaggtaacatgttcggttgttacactaaaagtaacttggagttcattttcgggaaaaaaaaacagcttggagcacttctcctggtaccagaggtaaattacgatttactgtttgtaagttgtatcgtgtcagtcatgatgaagaataaaggggatgctgctgacgacgagcgttgcgtttatccatgcggttctgtagttgctttcgccacctgaaaagctgtgttaactttcagttttttgaggaatgaatcgctatgattcagacaaaaaaagcaattaatactcctactacgaactttaagctactatctgtccaaacaacgccattgtcgtccagcatcagctactactcatgaatcatgatcagctccgtcgattgatgcttatagtgcaagaggcccactgcatagcggaacgatatgcaaggggagaagacagacagacagagtcgccttcgccagcattatggcgattcatcagaagaaatatacatttgatgtcactgctctcataactgatcacattttcgcgtcacagttggcagtagtacaatacggagtactacagagcaatagtactagctagcaaagtgactgagttgagtaggggtgtgggacttgcagaaactatctttgcaactctcctactctctccgtcctgaaaaaaaaactcaatcctgagtttgaatctggacatagtgtactcccttcgtctcaaaaataactcaatcctgtatttgaatctggattgggtttttttggacggagagagtagtcctttagctatggagcatgagtgtttgtttgggttattattgggtaagggccagtgtaattttctttctgaagtgaccatcgtcgagattattgtgcatatcctttcagggtgttcgatactttgatgtatatacgataatacgacttggggctgtagcattacaacaccactgctctaagcttgctgcactcgtgcaggttaagccaataagactgcaccggtaaacagttgtctgacagtaactgaataattattctttggacacaatcaagcggtcaactgtctgtacagcttaattggtgtccgagaaggagagtgtgtcatactgtcatgtcattatacgtcacaatgtggggtttgaatccaacgcataaacgagtagagtcccattgtttgctcatattttctagtaataagttaaaatggcttattagaaaacaaaaataattttataggtaaaacttttatataagtgttcatgataacttaaaaattaatgataaaaaataatgttaaaaatatattaaaattaatatcaaaattaagtttaaaattcaaaatttgacttttcctttaactgaatagggtatccgatgggagccgtagtctgtaaccatgaaaatggctgtaccatacgtttgctactcaaccataagatgagcgggtacaaactggctaatagtagccaaccttcgtctacgtgaaagagagagaaagagtgtgtgtgctggagagagacgctatgatcgaaggtgttttccctttcttcttggacacccccggccccaagtcccactaacgcatataagagtactgtccctgttgagattataggcatataatgatttaatatattccataaataaatcatgacattacagacgaaaactagcatgaacgcattattagatctacacatgtaaactacacaatataacatgaacagatcaaatatgcgcaacatattgaacacgtaccgaggtggcggaaagaccggctgttcggtcgaaacttttcgcaggcgtctacgaaggcacgcagcacgcgagcgaagaggaagacgagccgtcacggacgaacagggagcagtcgcgcaaagcgcttcccaaaaaccttattgccgccttctctcggtgcaggacgtcgaaggcagaggttccggagacctgctctcccaatcgcaggtgcacgccggcgagcaggatggagtaatctacgagcgatggcgcagcacagagtaggaggcaaaccctagattgatttcgcgtgtgttgcgtgaagacggcgggtcggtttatatagagaagggtcgcttgatcagggagcccgcacgatctccactgcgcgtaaccgaaccggataagtcacgcgtaacttatccggactccacgccgtttgtacgcaccggattttttcggaacgtttccaaaaacaaaaacgaatccgaatttgcagcaaaacaaaactgcaaaaggaggctgcatctgcgcaaggtgagggaccaattttggcggaccattcgacgcttacgtcgtgcacgcgcgccgcctgccctgcgaggtgagcgagcgcgcgcgtgtgttccccctcttctctccaccacacatgcttcaagtggctaggagggcatcctcccttttaaggaggttcccctatcctagaataagtaaggtggtactaaactccacatgcatgtcatcctacgaggtgggcttttgtgattttccaaagaattaattttcaagtgggctaaggcccattcattaattccaaaagtcccatgtatgagtgatgatctctcgtacggtaagaattttttgttcccaaaaccctaatttctccatcccatgaaaacgtttgaagaaactcgaaggacaatttcaagcccattacaggatgatccacaaccaactaccgtcgatgtcttcggcatcactggcagccaaggaggtgaaaaattacggctaagagcgtaagggcttcatgttctacatccggtcatttttaaccgccaagtttcaattagattacagttggtgatcggagatcttgaaactctccgaatgccacacaccaaatggaacctacccaattttttccctacaatgataacgatatgtactacaatttttcttagaatttgttatgattatttttattggtgtagatgaattgtgcacccaaaactttgcataggatgtgttcctacttatctgaaggtctaacgataagactggtcaacatttggaataagtctactttgtctccctcaactcttgcgcctggttgaatcgcacccctcaaccgcaaaacaggttataacccatcccttaatttccaaaaccgttgcaaatcgactctctcggcagtttcgtcctacgtggcccttatgtggcgggttgacttagtcttcatcccatgtggcatcgacatggtattaaaataaaaacaaacctgaatgggaaccacatgtcagtgagtaaaataataaaataaattttgggcccatctgtcagtcacctttctcctccctctttatccctagcggcgagcgagatggagagagttgcgcaagctcggcggcagaagcgatggagcggcgggacctggagtagcaggagctcggcgggagcagcaggatagtggagcggcggggcgacgggagctcggcgggagcggcgggacggcgggagctcagcggagcggcaagagcttggcatgagcggagagagagagagagagcagaggtgaagaagcctcgccacctcatccccatcctcgcctcctcggcatcgccgtggcctcttcttctccctccctgccaccgccgcctcccttctcacgcctctcctccgccacctcattcacgtcatcgccttctcctgcgcacaaaccggcatcccgatagagactgccacaccaacatgtccaacatagcctcgacgacggcggtggggtcacctcctatactctatctgggtcgatgaaccctgactcagcattgttcgccgcgccgatgttgttgttgtcgtcctccaccgccttgcctctcgcttgtgccgcgaccgccacttgctggagctgcgtgtggagcgccgccgcggtggaccgattaggcaagcgccttcgtccgtagccacgtcacaccgcattcgaggcctccgcctccttctccctcatccggcgtgcctccgccgcgacgagcagcgaccggtagtgtcgccaccttacctcgcccagcgcgcggatgcggtagtggactgcgcatcactgttccgacgcggacggagccggaacaccgccgccgcaacctccccgagctttggcgtcctccatccggcattcggcgcttgtctcgctgccgccacgagggatggaaaagagaatagaggaagaggctggtagatgggactcacaagctgactcagctagtcatcgaagtcagctgccacgacatatgaaatcgccctctaaaccaccaagggaggtgatttgccctggtttcaaagctgaaggaggtattatacatggtatttcggttgagggacgtgattcaaccaaagacaaaagttgagggagtacaaatagacttattcccctagcttttcccggtcgccagcccaccgggaggaaagccttgacgaacgaactgtctcgtgttcccatgatcccatccaccacacgacttttacgcactcaaaatccgcgtagctttggtcacgtctttattgcgtgccaattatttcgtacactagtcgcggaaacaccacaagtccacaagacacgcgtcataggtggcactggcacagatacaccacctctaagagcaagtttaatagtatagcccattactaactccaatttatctatagtcaatctaatagctaatttatacaatagttgcttactatactattaatatatggtcccacatgtcatacacacactgtgtcttggagtccgtgctgcagctggctacagatctgtagcccgctgctcttctctcttatcttttatctcattaaaatatgcttatagctggctaatagtctgctattgtacctgctctaagagcaaggtcaatagtatagccagtagttggctctaattacatccatgtcattttacagttaataatagagccaacctatacaatagaatggctatactatgctaattacagtttcataatccgggaattaattaagcatgcacatacttgcgtatgatcaagagtgaactctgtctatgtaggtagttgtgttgtcgcctgaaaataagtaccagtgccgcgccatggcatgaatctggcgcatgggatcaaaaggggtggtgatgaggcccacaatatgtgtttttaatccgtgagatcgactgcacgcgagctttccgcatgggaacttgtgctatcgccgggctgcagatatgtcgctcgctttattctctctccttcgtttttctcttctccatgtaagaatagcatgacgtggaaatttttgcagcctgctgtgtcagcttattgtactgctctaatcgtcacgcgtctaggtaatcaacgataattctactagtatactgtttataaagaacctgtgaagattacattacattaattaaccatataaaaattccgcaaaactcttgcgccctagacccattctcgtgtggggacagttgacagtgggagcgggctgccctgtgcgacgcgcgatgcggcatcacatgctgacacgccccccgttccagatcgcagtcgcatcaaaaggtttcaaaccgtctcgcggtctcgccaaacgcgaaaagggcactctcaaaaaaaaaggagaaaaaaaagtagtctcggcatatccccagttccccacgctttcttcctcctcttcgtttgagcccctgaaacacggccacctcccttccctgcgcgccgagagcggaaaaccctagctccgaatctccgatctcccatccgcttcgacgcggaggtcgatcgcaagcagcttggtgagcaggggctatgacgagtggcctctgagtgtgcgagcgagcgtgtggttagatctgagggcctcgtgatggcgagggcggcggcgaactgggagcgcctggtgcgggcggcgctgcggggagagcggttggcaggcgccttcggggtgcccgtcaccggcatcgccgggaatgtgccgtcgtctctcggaaacaacgtccacatcgacgaggtgcttcgcgccgccgacgagatccaggatgaggaccctaccgtcgccaggattcgtaagtttcgttaccatttctcgctccgttaggcttgtgagctgtatgggtcgccgcggctcagaattgccctacctatacagttattagtagtgttcacttagtggtgtttttcctggtattttctgcagttagcatcggctacacgaattgattatgctagtccattaggagtacttttgcttttttttttgcttgttacagccttttgtactactaaatttcgtcaaccgttatgatcaggcttagtaccatctaccgtatttaggccctgtttctttcagcttgggattattataatccagattattgggagcaagttgaaagaaacagacaacttattgaagtagcttattataatctggagtccagcttattataatctgataagctcatttaggtgagctttttccagattattgggtgaaaaattacccaccatgccaccccgctccctctttagacttgcaaacccaataatctatgctctaataatttaggaaagaaacaactaaccgcttattctactacagattataacaatctagcttatagtaatctgactcaataatctagatcataataatcttaagctgaaagaaacatggccttagttgttacagtcggactaatgctttactggtttcgtgctcctactcgcctgagtttgctatcaatcaactcgttgacatggttaaagtgacttttcaaacttgatttgctctgattggatgtacactgaccaatgtatgctagtgccttacaatccggcattctgcaattagcaatctgcatcacctgtcagtctttagttcttttcattaagctaaattgaaaatcagtcaacttactgaatctgctgcaaacaacccataattagtccagctatgttctgaaatctctgtactgggatactactgcctatgcttttggcaatttctccagtcagttattaatagtaaacttttactaactcaaaggagattagttagtatttatccctgtttaggtaaaaaccgatgttagcttaaggttgttttatcggtgaactgtgcttggttgcttaaggttttttcctgttttcagccactaatctggcaatgaatttttttatggcttttgctccacaaaatcgaagggtatatcaacgatatgaattgagtcagcttttagcaactgaattcactttcccatatgaagtttaaatgcagttcggtgacaatttcttgtgtttatacttcaatgtgcagtatgtgagcatgcatacacactagcccaaaatctggatccaaatagcgaagggagaggtgtactgcagttcaaaacaggtttaatgtcagttatcagggtatgttcatactgttctatatgatttattattatttttcataatcacatgttattttgtacatctggcacaacctccaagatagaaccttattgagtttcatatatacagtcaaaccatgtcggtaaaagccatacatagagaatacaatacaaataagtgatttcacatctttgttttttaagaagtagaatgatagtatggacctatggtgtcaaccgccacaatcttatgctctaccagcgctacaaaagtatatcattttgaactgttcttgtgatggatttacaatgtttatttcatatggccagcgctctagtgttttaacatacaatatcgccttgtgagtcctcctcatttacaacacgtcacatctccggaaccatggcttgttgaattatacaaattaagcagatgggtttgacatttaaattttatttttctaaaagtgattatttctatctcaatttttcagcaaaagctagcaaaaagggaaggtggtgctatagatcgaagtcaggatgttgctaaactgcaggaattttataagctatacagagaaaagcataaagttgatgaattgtgtgaagatgaaatgaagttgagagaatctgctgtgttcagcggtaaccttggagagtatgtatttctctatgaaattatgtctgtcacttagctaaaatgctgaattggtagtttaattttttttcaagatgcttgtttttcaagcacaattgttgaacattaaatgtcacccatagtatgtgatttaaccaccctgattgtttgagtaggttggaacgcaaaactctgaagcgcaagaaagtccttgctactttgaaggtcttatggtcagttatagaggaaataacaagggaaatttcacctgaggatgcagaaaagttgatatctgaagaggtttttgttgctcaccttgataatatatagttcatgctatttttttcctactaaatttcaattatgttaaaaaaaaaggaaacaaaaataggtctgctctccatgccatgtattttggtattatggttgagtggttagtatggaatgggttttaactactggtctgcagtaagatactggtaaagtgttagtgtatcaatgtattcactaaaattataagagtgaagtgatgtacttttatgtgtatatagattttcttttgaatggaaacagtgagggaggcccccatggtatttttttctttattcaagcctgaaattcgctctcttggggagccgaacccaggaccagaagtgctacttgagcactgtaaccgctaggctatagccactttcgcatatgtatagattttttgtcatcatagatagtctcctccgtcccaaaatataacatcttttagcctttagaatttgtcccaaaatgtaacaacttctgcaacattctcttcccaaccaatcacaaccctccatcattcaattttctctccgacctccacttctcatctaatcacaaccttcccccattaattatacctactttcttaataattgtgttcaaccctaaaaatccttatatactgggacgcaggtagtagcttttactagaagactattgtagtattgttctagttgcaaataagtaaaattaacaagacaattgctctgacaatcggaattcaacacgttagtatatttactgtccatgctatttatagaacattctttaataacacaacccttatggacataatgttgtttgttggtcaaagttgtatcttctggtctctgaacagtaaaaagtaataatttctgtctggcaaggaatattattctttctgacattttgttgctagtatgatgtgttgaatgcaaataacctcaggtccgcaggcagtagtaccttttctcgaatgttttgttaccagttaacagtgagttcaaacagcactgttgaatgaattcgttttgctccttttttaacccattttgagatcaataaaatgtttcatatatttttttgtgcataaataacatccctttctgttatattcagatgaaaagagtcatgcaaaaagatgcagaaagaacagaggatgttgtggcttataatattattcctctagatgctttgtgctaaactaatgacattgtgaattttccagaggtaaaatttagagtcgatccttttcgttagtatttaccattttttagatataaccgtggtctgtggttgtactacttccatgtcgtttcatctcaggtaagggcagctatatcagctttgcagtaccatagggaacttccaaggctccctgccaccttctctgtccctgatgctaggaattccgatatgctggatctcttgcactgtgtatttggttttcaggtctgtacctttatgacgcacctactgtagtaaactatatggattgtggtttcaaccataaccacaatcatattgtaggcttataacttagtgagtccattgatgatactgctaacagaagatatgttttaatcacaaacttaagtgaaaaagtttctgttagtattagtaatcactactgtatgttatgctgttactgacttactatcatgcatgattcagtttgttttaattgtaaatatgctgttcaatatgattgaggaagtgcaggttctctctttttttgtaattgagttttgccatttgcaaagtacttcctccgtttcatattataagactttctagcattgtccacattcatatatatgttaatgaatctagacatatatgtgtgcctagattcattaacatctatatgaatgtgggcaatgctagaaagtcttataacctgaaatggaggtagtagttttatatttggatgctctgactaactgttggagcataggtacccctatcccctagacctagagtgttgggagtaggctagaaacccaatgggaaatgtccaaagagtatacttggaggatataccgatggagcatgccctgtatttcgtacgatatacgaaattatccttgcttgggctgtgtagtcaaggggcagaagggggatttccccttatgccaacctctctatgaatataggatggtcgaaccctagaatgggacactctctcactttccacatgacttggctctgttctttcccctaagtccaaggatacatgtacccatctgttgttttatgttacaacagtaaccatgaaatttatgtagaaatgtgcagcatatacatttgagatagttgaaactgtacatttcaactaatttcctacctgtagtttcttctttattttgctccctgatcttggatattacattctgtcaaccaatattataatgtgatagaaaacataatgtaagtttcaataaaccagactgttgtagaatgtggtttctgagcatgccattctatatggtcagaaatgctaagagctaataaacatccatggatgtaaactcacatttagttcaagattatgaccaagattttattagactgttgaagatgaggggaaaaggaaaaagaaagaacatttgccgtaatttccttgatcttgatatttttcttttattttgttctctgacttggacaatacattccagcaagcatttaattttgatataaaaagaaaacataatgtagagcgttctatatggtcagaaatgctaagaagtaataaagatccatggatgtaaacagcatctagttaaaaattatgattaatattacagacggttgaaaatgaggggaaaaagacaatagatgtcagcctgtgttattctgaaaatatttaagaaggaaatgcgtcatgggagacaaccttttagtgtggatctgcagttacaacttcctgggtcattcttgatacatgctgcagtatttcagaatcttgttgccttcatggaactgaaatgtcacaattggttgcagaaagacaatgtgactaatcaacgggagcatgttgttcacctgttggcaaatgaacagtcccgactggggaaactaccagggaatgaaccggtatgcatactttgcaccctaattttttatgtcgtacaatattttttttgggggtagaattggttccatggcatagagtgatccctattctagatatttactggcaaaagttctgggtactttttaataccactgaaatattgcaccgtttaataccaggcctggtgcaaagagtactcaattgcatgttgctttatgttgttaatattttcatccttagttcgttagcattgttgttatttgttggcagaaaatcgacgagggagctgtgcatgttgttttctccaagtcccttgataactacatcaaatggtgtaattatttgccgcttccccctgtctggaacaagtatgatttgtcaatgttgatcaacatatttaatttcttattcctgtctatatcttatttatcaccaagagatttacctgattttctcttagcaccgagtcattgacgaaagaaaagaagttgctatatgtgtgcttatactaccttatttggggagaggctgctaacgtacgatttcttccagaaggtttatgctatatatttcatcatgtaagtttgcagaagattctgctctgtactattttttgtgcatgcttaattgattattgcaaatgtttacaatcgtgtagtattgcacccaaagaagctttaggtcgatctgcgcctgtttttctacgaacatgcctatgccagtttaacatacaaaaatattcttctttggttcttccctccctgatctactactttgttgccaaattagcgcactgttgtctatgcttggaatttgaattgttttcccctaatcattagcatattcttcattttcagtttctaaagtgatcatgtcttcttctaagtaaagaaatctgcaaaattctgttcattctgatggtcttcaattcttctctctctgtagtcaccgatactcgaaacacttctggccaaacttttcaaagattgactatcagtttcctttaaatattttgaattggaatatgaaagtcatgtgtagatttgtctgtttagagacaatataatttcaatatgtttttatagcgtataacaatagaaatactgttcaaaataatacttatgaggccattcagatgtccaaaatgacaaatatttgtgatgtagggaatggttgttagtgtgacatatccaattgatattgaataactaatcacctttgactaacttaatttgtataagatatcaaatactacctctgaaaatataaaaaaaaaagggcttggacacaggcattaaagaagtaggtggaattaaatagggtaagattgtgattggatgagaaaaggaagtaggtggagaaattaaatgggggaaggttgtgattagttgagaagagaatgtaggtgttagaacttcaatggttactctcattgagaaggggatggcactcgagatggggcaattttctggttttcttcattcacaaaacacaaagccataccttcccgagggaggttggatacatatatataaccatagctggctgcaagcctattgctgcaccctcctagtctaaaaattcgaaatttgaatgggatgctgtcctagagggcatccaaactgaataaagcataaaggaggcataaaggagatgctaattgctgctgtcctactaaccgcagctgtcctagcaactgaaaatatgctaaaggagtagatgctgtcctgaaaaggtgaaactacccaaaagcaaaaagaagaaatcaggaccaaggaccaaagacttatccatcagtaggcggagaagttgctatatttcggaacaaaatttgaatgctagaagttactatatttttggatggagggaatataacttttattgttgaaattcatgctcctatatttcttacagctagcaagagaactggaggagattatacggagacagactgcagagcctgctgaaagctgcatttcaaatggtggcgtatcatttcttgaccaagtcatttctcctatgtatgaaatcatcgcagctgtaagtggggtatctgcttggagctactttagcttgctacatttggttgtacttctattgagtggtttgaatgctgggtactctacaggaagcagccaacaatgacaatgggcgagcgccacattctgcgtggagaaactatgatgatttcaatgagttcttctggttggtagatcaattgagctattgagttccattaatttgttgttattttcatttttttccataaagatccacactgtccttttcaggtctccgaagtgttttcagcttggttggccatggaagatcagcaatccatttttctctaaacctagtaggaaagagaaggtttctttctgctgatcatatacttaattgtttgtattttggcggaactaccaagctaatacttggacatctcaggatatcttttttttttgttatttttgttgtgcacatcttaaacatcacgtagttacttggaacacagggttattcgtgttgaggaaccgagtgcactacctattgagaatatggtatactggggaaagtcttactaggtgcagaaaagtgaccccaaaaaaattactaggttgatgatctcaattacatatgaagcattaattacacaacatgagtatcatggatattgcactgtagttttgtccatggaagttctacagaaccacctaaaattatcttgcatatataggctatttggattgagagattagatcatccatccattcaagattttagtgggatggcccaattttcatttttctacatgtgcttttgtgggatgaggtggtgaagacaaccctttccccccttaccaaacagatggttcttttgcagggcttggtgggtaggaatcatcattatggaaagacatcttttgtggagcacagaacttttcttcatctttaccatagctttcatcgcctttggatttttttagttatgatgtttcaggtataaatttttgttcacaactggtctcactatcttgcttgacatttggcatcacatactcacatttaaccgtgtgcctgaaagttgttttcattttcttgagcaactgaggtgctagatgcaaaataaagggttgtcttttgtctatttattttggaatgggaaataataaggggggacctgccttcccgtgtgttcagtttttctggagacatgtgacagaatcttaacttttgtccgaacaagtgcttaatgttttttgtatgtcacattttacatggcatatattttactgagactaaccaccatgttaatcaacaaccatctggtgtttcgttcatgtacaacttttatagtgaaaagatgctgcaaatggtagcttaaagctgatgtttttaaggagagttgaaccttttattattcttatttggtatgatatttccttggatgattagttgctcaatgttaaactaagtgtttttgtgttcattcagggattaatgatcattgcttttaaggatcgtaaatttgacaaaaaaacagtattgacactcctcagcctgggtccaacctatgtcatcatgaaatttattgagagtcagtcacagaacttcttatttagttactgtattatgatcatctgcacaatttctcttctaagtgactaatttttcttgtttctttttcccttttttttttctgtggaaggcatattggacattctgatgatgtatggcgcctattcaacatctcgtagatctgcaattacccgagttctttggcgattctgttggttcaccgcggcttcattggttatttgttacctatatatgtatgttttcttttcatatctgagaccagagggataattgccaaaaaaatttccgaaaagcttttttttttgttcaactatgaaaaagaatacatggggtctttgccctagtgaattgctagacgtccccaacattgatttcagaattcaggggctggcgcaccaaattccaggggatgatacctaactcctttatgtgtataccactaatttggaatttttggttgcttgattgtttctcagcaaagcatttcaagatgggacaaattcggctacattcaagatatatgtctttgtaattggtgcatacgtgggcgccaaaataattatcggcctgcttatgagtgttccttgctgccacggtttgaccgattattgctaccgctggtctgttgtacgccttggaaagtggatgcatcaggtcttgcttgctgctgcattttgactaactaaaagctgtcttttgttaagtcattgtaatccaatatcttttgctaatattttctgacatttggtttatattgaaggagaacaattatgttgggagaggcatgcatgaaagaccttctgactacatcaagtaatcctttgggactttgaatcacagtgttgtgatttttttcttccaaagttgaattcagactagtgctaactttatttaccatgcagatatgttgctttctggcttgcaattcttggcgcaaaattttcattcacttattttctccaggaaagttttagtttatctagttcccctctgttttttccagatcaacttgcatttcaaaatagtgtttcttatgcagatcgaacctcttgttaaaccaacaatggaaataatcaatttcaaacgcttagagtatgcttggcatgactttgtttcgaagagtaagaatatcacatcctcatacaacttgatacctaaatattcccatattcttgtgtagctgaaaatagttgtttgagtcttatctctttctaatattcatgttttaaataattttcttagtatgttcttttaagttgcaactgtcctagatgtttgtgggcaaagcatgaaatctacttctagttgtctaccttgtttccataggttccttcatgtgtaatgatgcactttaatgtactaatatttgaaacttttcttaatgcttacagataaccataatgctctaactattctttctttatgggctccagtggtatcagtaagtaaccttttttgctcctaactttgtcctatacatttatactatgtcccatccccttatcttgttctctctcaactgtagtgagttcagggtcatcatgtccttgcattgagtaaataatctaattctggagcagtaataatatctactccctccatttcatattataagtcgctttgacttttttcctagtcattttttttaagtttgactaagtttgtagaaaaatataaaaacatttctaacacaaaacgaacatattatcaaaatatatctaatgttacgtttaatgaaactaatatgatgttgtagatattgctagatttttctataaacttggtcaacactaaagaagtttgtctagaaaaaagtcaaaacgtcgtgcaaatatgaaacagagggagtaaatgacaacatgccaaagcagcgcataactccagtgtgctgaacctgaaaggatggcaaatatatttataagttttgttctttaacatccaacatgagagagatacttatacttagttaaatctaatgtagctaacaaataaataggaaacaacttgccgatacactattcaacacaatcagaagtaaaaaatcaaactgggcaagttcacattctagttgtttaacatttcatccgctttgcttatcccacacttactcgtatttcttacgcttatttgtgctacaggaagctgctgaatttgcagtgaacataggaaaaatgcatctctaaagagaaatttcatttatgcagatttaccttttggatatccatgtattttacaccgtgatgtctgctatatgtgggtttctccttggtgcacgcgatcgcctgggagaggtttagcttcttgacttttaacttttgagctattgcaatgtgattctctcttgtgtgtaaaattgttattgtttatgcgaggaaatctttgcttgtttaccaaatcccaaattctccagcatattgaaatgttcaggatgtttctacctatgaaaatgcattatttgtggaaaggcacttgaaaataattttgtactattaacatgcacatatgaaagtaattgtaccaattttgttaagcccatttatgtaaaatgcatgtttttttctagaccattttccttggctcttcatctgtgtatagctagtacttcgattgttattttgctttttttttttttgtcaatttttcttatctggtggttgtatgccattttcagattaggtctgttgaagcagttcacagattctttgagaagttccctgaagcattcatggataaactccatgttgctgtaccgaaaaggtctttgatgtttttattgtttttgatttatacttgagtggtatacactaaagtggttctaatctgttatacaggaagcagctgctatcatcgagtcaggtactattatcttgttacctgtattttgcttgtttacttattctatcttttctgttggtggagctgtgggacattatttgttatctttcaataacgctcttaagttgctttatttatatgatattgtcctttagtaaaaaacttgtactttcaaaccagctttggctaactgccatccgacaatataagaaagttcgaaaaacgaattcggagggatttctatgatgaaagcactttcgtgatgagcatgcccaattttcttatagctcctagtatttgtaaacggatatgcggttaaagtaattgttccattttgcttgaatttctacatttgtggagtatttcccccctagttttttattttaaaaaacagaactagagtactactccgctaattttatactaggtaataagaagtatggcattgtggttccatttgtgtatttccattaaaagattcacttaagtagataggcattcctgaatgttgtgtatttccacataactgtctttttcctctgaatgttgtttcatgattactctcgtcctaaccccctcgattaccagtcatctgctgcttttgccttaagtcacatcctcccttaatggcatttttttagcattttagtatttgcaggttatctgatacagtttttttttataaatattttgttttcggttgtcctgcttgtatgcatgtgctatgtagccatgatttgttgaatgaaatatctttgtattgatttgagctcagatcagttgagctgttcctgagtgttttcatcttgactgctatgcgtgtttagagtttagacaagctagagagatcttttgttgttcataaattatagatatagcatgctttcttccagttctttatctttacttccaataagttgacactggtattcacaatttaacagcatccagaattaaacaagtttgatgcatctaaatttgctcccttttggaacgaaattgtgaggaatatgagggaagaggattatattaataacacgtaagtaaagtttcttggaatactatgttactgttctttcaaacgtcttaattagatatgagttttttctgatctttcatccttacagtgaactggatttactcttgatgcctaagaataatggatctcttccaattgtgcagtggcctctctttttgcttgctagcaaggtcaaaagtcaaaacttattttagcttttaaaaagctctccctgcatgatttgatgatttccgcatcttatgttcgttttgtcactttggcgaccacttccattttcattgcaggttttcttagccaaagatattgcaattgattgtaaagactcacaagaggaactatggctaaggatatcaaaggatgaatacatgcaatatgctgttgtagagtgctatcacagcatttattatattctgacatctatactagataaagaaggacgtctctggtaagggattttatttatgttcatcctgttccttacttcttttcatctagttcaacagatgtttttttatccgtgggagggatgtgttggtgatgattttattttttttagggtggagaggatttatgttggtatccgagaaagcatttccaagaggaacattcagagtgatcttcatttcagcagattgcccaatgtcattgccagttagttgctgtagcaggaattttggtaattactaccccccctatagctacaaatcgtaataaagttcttgtatgacctagcaaggttgaaatataaaaaggttgactgtaaagattctaaaacatagaagaaaaatggaggctggagtgagtataatgttaaaaaacttgaggcttccatctgccatttttatactgtttgccagccttccagtgtgaaatatgatatatttatgttgtttatttgttgtctgctggaactctaataaccttgaagtttttttgtggttcatcgtatagacatgagttatcaacactagcatgccttttttgttctgaaccttgaattatttttgtctgcggctgggctggaccaaagtcctgtacttcagagatacatatttataaaaaagtttgttatagttactaagggcatgcgtgattgaatacctacgggatatacccctgtgggtttgattgcctggtttggggatccacatggtgaatagtttcccacatggcctagcccagaaaaatcacagataaatttcctttttctggggccagtacagtgagatgccaggttaagacaatatatgacatgcttagtgcacagtaagggttattattttatattaagttggaaaacaagggtattaaattttattaattatttaatactaaatagatatcttcttacgttaactagtgtttcctacattcctgatgatccaaacaaacaccatcgcacaccaactcacgatctcatgtaaagcaaccaaaccacatctcttgcattgcatctctgaagttccctccatcattgacgatttttctttgtacattttaatgaatcatcaggacttatggtaatatccacatacgcacaaatctatttccagatggttaaaccactatgaaattgagccttaaaggttataatatattgatactgacttctagaattgtgaaggttagatacctggtttaaagctcaggggacccagtctttttggaagtactgtaggggatgatatgaatcttaaatattttagaagtttgtaaaagttattttctgttttatgcctttttaggcttgaaaattttatccaggctcctctagtatttgttaatgttaagatgctgctttttagaaagaaaccgagtctgctgatctgaggaaaggggcaattaatgctattcaagatctatatgaagttgttcatcatgaagtgctgtctgttgatatgaggtctgtttttttttacaatttatcctgttctaatgttctgtttataatatttcaaagctgtgttctgtttataatatttcattcctaattcttttgtttatgaattctagtggcaatattgatgaatgggaacagattaagcaagcaagagctgaaggccgtctcttcaataatctcaagtggccaactgactctggattggtattttgtcttaacactggtttttcttgttaaattttaatgttcttacattatctgcttgtgaatctttataaccattaatttaatctgtgttggtttcatggaatttagaaggacttgatcaaacgattgtactctcttctgaccatcaaggagtcagctgcaaatgttcctaaaaacctggaagctagacggagattggagttctttacaaactctctgttcatgcaaatgcctgttgcaagacctgtttcagaaatgctttctttcaggtgagacttctctacagttttctgcttgttctatcagttcagagttgcttctgttcagtgtctcatcctacagaaatgtgccgatagtctgtagaaacagcctataaccagcctccccttaatttattttctttttcttagactagtactcactcatgtgtttaattgctggaatcaaagaataatgataaacctggttagtaatgtgttcaaagttgaccacaagtcgcttcagaccttgcattcttgagtctgctggccatcatgggcaaccttcgttgccttgacgcctagtctgaccttgcccaccttaccaacttgatgcccttggcgcctttttgtctcatcctgtggcaacgttggtgcgtatgcgattttagcgtccaccaacatattctgagactgagtatgactttgaagggtagttgtggtcaaagaggtgggtggtatggcacactatagggtgcctaaggtcataagcgatgtttttggaggtagggcatgatgatgcatgtggtagtggcacggtgtgccggtatggcgatatgggggctcatcgtgcaactctgctaaaattttttgctgatgaaatttaggaaggaacgccatatagatatgaattcctgatattattctatatacaaattatttttttgttcaaagccatgttgagatgactaaatctcgtgaatcttgatgttaaaatttctattatttgccgagcattcctttttgtgtgtctatttttcttggttcagttgctcctgttttctgtgcctatgatatgcaccacttcgttttgcagcgtatttactccatactactccgagactgttctttatagtaaagatgaactccagaagagaaatgaagatggtataagtacactattttatctacagaagatttatccaggtttgttcactctccctccactgttactattgaaagcattgtttggatttctcttgtaagatggctttcctacagtttgctctagaaggaaaaattgtggcatctactgccaatgcctaaaagttagtgcaagtgcctgctgctatctgtgatttgtgcttgaaggatgcaatgcaatgtaattacctcttccttattatggttgcacagtctaatgaagttggcttatgtaaacagatgaatggaagaacttccttgctcgcattaacagggatgaaaacacaactgactccgaactttttagtagccctaatgacatgatggaactacgtctgtgggcttcttaccgtggacagaccttagcacgaactggtttgttatctttcgaaacctatatggtcatgccatatactattttgctagtgtttcgtttccatggtatttatttcttactagcatgattttttgatgatttgccaccccaaaggttcacacttgttaaaccgtgaaaattgtgtccattatatactttttaaaaatattaattgtggtgatttgaagatacattcatttactgttcttttatctgatgaaagaaaaccttttggttctacaagttcttcaaaatgtcactgtttttgaactatgttaatcctgcagttcgtgggatgatgtactataggaaagcccttatgctgcaaagttatttggagaagttgcaatctgaaggtatttctactactgccctgtaagaaacattaatgttgtttatgaagtaataaataacctgctgtgttgttttcctttgctagatattgaatctgcagttgctacaactggtcttggtctggctgatatacattttgagctgtctcctgaggcacgtgctcaggctgatttgaaatttacatatgtggttacttgccaaatatatggggtacagaaggcagagaggaaaccagaagctgcagacatagctctactaatgcaaaggtactcttcactttatatgttagacatatttgcactctttacttgctttcatgctaaatgaaactttcctccactttgtagaatctggggagctctttgctctccttttattttgtgcgtgtttcatagtactacagtgcgtataagatttgttttattattatctttctcagaaatgaagcactcagagttgcttacgttgatattgttgagagcgttaagaatggaaagcctagcaccgagtattactcaaagcttgttaaagctgacattcatggaaaggacaaggtcagtataaattaattttaagtttgttttctccgcctaattgttgtttacccttatcttatctattgaaagaaccttctccattaacactattaattgttttattaggtttcagacgttattttgcctttgtacactcttactgctaacaatgtattctgctgcttaagttagttttaatgccttctgtgcattgtttttcatactgttttcattgtatccaacttgacacttgatatccataaaattgtttatttatgctctcctatagtagtataccattctttcccttgttaagtaaatatcatcagctaaagtagtttatatcatgtttggttatttgagtaacgtattaattcttctatgcaccaaataacttggctgcaggaaatttattccattaaattgcctggcaattttaagctgggtgaggggaagccagaaaaccaaaatcatgccataatattcacccgtggaaatgcagtgcaaaccattgatatgaatcaggtatgctgttgtctttatattttgattattgacgagctctcgtacgaagtttggtccttatacatataggagcaaatattatgtatattatatttatttgatggaccttccttggttttccccaatatttaaataaaagcacttgctcagctcatttctttgtaatcccttactatatgtttagcctcttttattgaatggtacagatctaaggtgactcaatatatatcaatacaatgtttttcacattttttgaagtttttattatgcgcatattttttttatttctaaaaaggctatagttatgggaaaaaatgttattgaaatagctcctataccgcacctcttcttactattgccaagataccatttttgtttctgaaatagctcctgacttctttgttccatcagttttgagtttttcttttggttgtcctattgaaggataactattttgaggaggcactcaaaatgagaaacctgcttgaggaattctatcagaatcatggcaagcacaagccttcaattcttggtgttagagaacacgtgttcacgggaaggtgttgtttcactagatttttgttcagtcgttttgttgtggctttacttcagtagtcatctcagttcaaacttacaatctctcttttgtagtgtttcttcgctggcctcgtttatgtccaatcaggaaactagttttgtcacattgggacagcgtgttctggccaatccactgaagtaagtgcttttacataatatatattttctatttcatgagtcatttcaagttacatactgtcaacatttggaattcttttgcagagtaagaatgcattatggccatccagatgtttttgatagaatttttcatataacgaggggtggaataagtaaggcctcccgtgtcatcaatatcagtgaggatatttatgcaggtagggctagtggccttattattctgtctttttctcaattctggttgttgcatgtttagtctatttcaggttgcattattaataatagcccattacattctgtgaaattggcatttgctgtgtggacagcctgtgtgctagttagtagggcaaaaatgactttatacctctcttctcgctagtgaattcgatgtagtattattctaatgctcagcgtgtgtttctgtaaatgaggctatttggtaacctagagactaaaaaatgagtataagctgcttgcgcattgtaaactatcatatttttacctgtagttctctgtgttgttaatgctgtgcatattcttatattgttttagttgtagggggtctctctctcaggttctgtcaatgcatatttttgtttggttataaccatatcactttgtccatatatgctcaataatcttcctgtttctgcctaccatttacaaattgcagaccacaacagttagctgtaatttagttacattcatggtattgtatctttttactgatgcatctatgaactccagggttcaactcaactctgcgcttagggaacataactcatcatgaatatattcaggtctgaattttcttcattcgtgttttgaattttctgcgctaacatctagcttatcagtcaagaataccttaatctctgaatggtaggccagaaaaatcttaaaaaggaaattccatttgttatcgcctatttgtcaattggtctcataatctgtttactttttttttttttttggggggggggaggatgttttggtatttaaaagtaacataacagaggattgatttaatagcaaaagtgaattgactcatttacctttggaagaagtatgtcatacatcattgatgttcatgtaaaatgagatagttaaaactcttgatctgaggtcatccagtaatgtgaagaagtattatcttccatttggtgacagctagctatcgctatcagtatctgaggaaaattcacaatgccagagttctctgtaattggacaaattctggggtttcttacatttgggagttaatattctcagtaaactcaagactacatcgatttgcccttgatttgttggcgattccaacatcgcactgttgatttgctatccaaaattgttcgtggcgttaccacaaatactaattattgttcgtggtgatttttttcccgaactaattgttgctggtgattagggagagaattggtgggaaaagccttgttcacctggttcaaaatgttttattacctgcaaccttctattctgtatgtacaccaggagttctatgctgatattgtttcacaggctctcctgctaccaatgtgaaacaaacttgttcgctgcaccatctactctagcattatataactgttgccaacactcttgctgtcttgcgagcattatattgatgttccaaacataattctgtaggttggaaagggaagagacgttggtcttaatcagattgcactgttcgaaggaaaagttgctggaggaaatggtgagcaagtgctcagccgggatatatacagacttggacagctttttgactttttcaggatgttgtccttctatgtgacaactattgggttctacttctgcaccatggtaattagattttccttgcttgttattccctcattcacgaatagatgtcactttagaatgtctttagttgaacttttaaaagtttggctacctccattttttatatggcgtaatggtgttgattagttcaatgatgctaaacatcatataaaaaatggagtataatgcaaaattgaagtcagtagattctcttttttttttcttttgaaatagagaggtctgatctccatttcagtagaactggtaacggccatcaggttacagctcaagaggaaaaacaaaaccaaaatgccagcagcttgtcacaattgtgatgccatccgatccctgtcacaactattgatgccaacaagactaagaaaactcaataaagttgctacaaacacaacctgggacgatctgaaagcaaaccagaagtaattctgggggactggtggttgatcacatgattatcctgggcaactaaatatctcaaggccttcgataccttgtgcctgatgatctattggttaatttggaaagaaagaaatgcacatatcttcaacctgaagtacaaaacagcgaatcaacctgtggctgagatcgcagatgatattttagtctggagagaagcaggtcttttcactttagaaaatgactaatcttgctgcttgaggctgtgggggtgctggtgctgacctgggcactgccttgtaatttctctctcgacagcttactgtttgtcctctttaaattttctcccacaatcttaatctattaggttggcctgttcttcggccaacccagctaaaaaagatttgaaattcaactagacaaccaaaggaacaataagcccagcaactacttcccaggcagacaaacagcagcatctttcagtaatttctaatttttacctctctgccttcgggctccatccatcattccagccatctagcccctggtctccatccaaatcttgataattagacctcatctgctaccttgattagtagcatgatgccccaacgtagcttttctgccctttcttgcgacatcttcagtattgaccaggaggaaatctaaaaacatatgaatctaatcagctcaattgggtgatttagaacatatgaattaaaacatgcattattccttgacttcagattgcccacaatacagcagcttgacctaaaacaattaatatatgcataggattttgaacggtaccatttttattatattattaagtacatgcataaaattaaatttgtacaaaaatagattattgatgctacatattgatcttgttgtaggtgctatccccctgaatctgcaatcatgattctattattctaaaataaattctgatcttaagttgtttgctcttttgcagctaactgtttggaccgtgtacatatttctctatgggaaaacctatctggtaaggcagaaaatcagttctactttctttgatattaacatctctctataataacatgtcactttacttgcttattgtccaccttttgtaatgacttcactcagattgctctatgctgtcaattgtatgaagtttgttattaagatttttttttggtaattaacgcatcttgcttgcattgttctatgtctgctatgttctttattttatcttttgtatattaagttggaaacattcctaaccacgcaagacaatatattttttaagtaaaatgtgctggaggcataagcactgttttattgggtggtgcaacgcttgcatgctgtgtgccttctatattctacttttgcacctgtaaagctaatagatgttataacgcacgttaactttcttgctagtaccttctagaaaatcctgttataaatgttcactcagtgtgttccttttatgttctaccctttcacgattttgcactttcgttaccttacgttccagtttcttgggttcagtttgtgacattttttttctgccatatctgaccaggatattatattgtactagttgacatattccttctatatttgtttcgtaggctttgtctggagttggagaatcaattcagaatagggtggatatattgcagaacacagccttgaatgcagctctgaacacacagtttcttttccagattggtgtatttactgctattcctatgattctgggtttcatcctggaatttggtgtcttgacggtattccttttatcttgccaacaaataacctaagctgttccatctgagcactcatggtcaattatcttccatggaattattttcctaagaaatgttttcaacatcttcttaatgcaacacagtatttgatataactcaagtcatttttcttctggtatcaacaaagtcttcatttattcaatcttgtgtttttgaattcaatgtgcttcactgcaacataaagagtcttcacctattggctgttgtaataaagttggttgttgttgagtggagcttacctttctaatctcgtatagatttttctgcatttgttagctttatttgcctatgttgttttttattgtctaatatattttgcctggagaaatgcatttttacatttgaatgtgtgacacaggcttttgtcagcttcatcacgatgcagttccaactttgctctgtattttttactttctccctgggtacaaggacccactattttggccgcacaatactacatggtggtgcaaaggtagggtcctttgtttttaagtgatgcttatctacttctgatttttactctgtattgatctgatgtgtttcttctggattaccagtatagagcaaccggtaggggttttgtggtacgacatatcaaatttgctgaaaactaccgtctttattccaggagccattttgtgaaagggtttgttatcacctgattttgctctcaaaattgtgtgcaactacagtctgtgatgattgcttttgtttttcacaggttggaggttgctcttttgttagtgatctttttagcgtatggttttaacaatggtggagcagttggctacattttgctttccataagtagctggtttatggcagtttcttggctttttgctccatacatattcaatccatctggatttgaatggcagaagtaagctgctaagcattctatgcatgtgttactctgcgtaattatatttgaaattcgaattatcaggattaaaatacctctctcagggtcgttgaggatttcagagactggacgaattggctgttttaccgaggtggtattggggttaagggagaagaaagttgggaagcctggtgggatgaagaactggtaactgaattttgcctgtatatgattagcatttttaattgtgtctaatattttgttccatacaatggaaaaactagttcttttcactagttcatatgtccacaaatgtaagcattccagagtgctacttgtcacataaatcacctctcactcaagtttagtcccatcttacccccaaccatcctcccatctccatccatccctcatttaaggagggccaccaaagtcttttctcctcaaccttaatatctactaaacagcttagaaatgcttatatcgtggacggagggagtaatcttattgcagcttgacagtatcatgagaatctactgtcacatttgttgtaaggtcttgaggccacttttgttattcttttcgttgattcctcttctgcagttactggcacttatattggcttctatttctactcttagcatatgactgaattgacgaaagtaatgatgagctccaaaatggatgcttttaccaagcttgaagtcattgaatgatagttaatatcagaacatttctttttcaggcacatattcacaatgttggtgggaggatactggaaactgtactgagtttaagatttttcatcttccagtatggagttgtttaccatatggatgcaagcgaatcaagtaaagcactattggtatgttttcagcatccatttgatttgcttgttggcatgaaattcgttgaccaaatatgtttcagtttttttttttttactttctgaaagtattttttttatttgaatgtgctattaatactctgatattgaacacaaagaactgatatatttttgtaatcagaaatttggtaacatactatttgattatatattttgatcttcacttattggtctagttaatggagacaatataatggaacatttaatttgatttgtagatatattggatatcatgggctgtgcttggtggcctttttgtcctcttactggtatgtgaattccttattactgtatgaggtatctgagtaatatcacatatctggatattaacttgttttctttattgtattaatctgcaggtattcggtttgaatcccaaggcgatggtgcatttccagttgttcctccgacttatcaaaagcattgcgctactgatggttttggcgggcttggttgtggcagttgtgtttacaagccttagtgtcaaagatgtgtttgctgccatcttagcatttgtgccaactggctggggagttctttcggtgagtttctatagaaacatcaatgtccatctgagacaggatggtgcaaaagtgaactcagttttgaaaattgttcctgcgtagcagataatatgtttcatgaagttcactattctcctaaagtatttcacagaagtactcaacctcccaaatttcttttggccttactccttgcactattaaagctgctttctctggtcaaatccctagcgtttgatgttttccagataaactttggaagctttgagtatcaataaatcgtgaagtgcttggtttgaaaacataaaattggtagtatagatttgtcttggaaactacgcataatctcatattttagattttataaactcgcctcgaagacagtaaaaataaagtcgagcttcctatatttttctatactgttaaccggagggagtagttatttacccaatgccaattgtcctttttacttctctttatacaagtggtattttaagtttaaattttgtactattttctttgtttgaagcacctaacacctaccccctccgtcccaaaaaaaaacccaatccggttggattctttttgggatggagtagtacttcatgttcctttttgtatttgttttctatcattaatattcgtgcccatgcttttttttatatataatacagatcgctgtggcgtggaaacctattgtgaagaaactaggtctatggaaaacagtgcgctctctagctcgcctgtacgatgctggcacaggaatgatcatttttgtcccgatagccatcttttcctggtttcctttcatatccaccttccagacccgacttctatttaaccaggctttcagcagaggtttggagatctctctcattcttgctggcaacaatccaaatgcgggagtatgactgtagctgctcccatccatctaagcatctccattcagatcgtggagctttacaatcactgttgttctctcttagcagtaggatgtatatatttcatggacggggagtcgtggatgtatcctgttggccacattgttgtattgatcttagtgcttctaattgtgattgctactgttgttttgtagctttagttgtggagttagcttttcatgtttgctaatacaactgattatattatcctattagattttgttgatgtatttcttttgatcgttaatattttgatacgtagaatgaacaaccattttattaacttagagaatgattttttcgaagttcaaattacctatggctccaaaatgttctttttttcggattgcatgtaaaacgttgaccttgcgactgtttcctgttcttactactctacgggcgaagcgaaattcccaaattcctagcgaagctattttcgcatggctgttatataagcatagtgtgccaaactacggaaaatatctaattaccgtgttattctctaaaagtgagtttgggcagtgt

SEQ ID NO: 55131 - DNA, 30568 bp, Oryza sativa
acgagattctagcataccatgcgtgcaaagcggggaggatggattcagccatgcggattcttgatcagatgttcttggagaaattgacaccgaggattacgattcacacagccttcatcaaggggtacttatacgctggaagaatagatgatgcttgcagatatgtcagtgctatgagcaccagggacaggcgctcagtgaacaggaactacagcctgctagccaagctactgtgtaaggcagggatgatcgttgatgcaggaagaattctgtatgaattgatggagaaggaggcactcttgcctgaccattctgcttacattagagtgatcaaagatttgcacaagattggcaagggagatctggctgctgaattgaacttgattttgcagaagctcagtgtacatgcagaatcagcgggatgaaatttcaagtagtcttggagcaagtgatgagtcttgtcttgcgtcatttctgtcctctctctatgatgtggatgtcagaaggacttgatgtaaatcagagtcacctggctgataaagaggagagcagacatgaatcatgcacaaatggtgcaagctgttgtcatgtagagagaggaccatgtgatttcctgcagaaaaaaaaagacagtcactaggcaaagccaaacaatcgtaccactggattgccacattgcttccttggattttaactccagtttcggtagttttttcctactgaaggtagacagaatttggtacttctatgtgcaaattctttgatagggacattacttatctacaggattgcagtacaaatgaagatgagtggaacaagtacttgaatatgcaaattctttgataggaaaattacttgtgttccatactgccattacattcagcctgtagatggttaaggacaggtgaacatttgtgtgacactgttttccttttccatcactgattagaatagtgaatctgtgttgaagtgtaatgtggtaggaaatcacattcacaggcgaaatttctgctcgaaaaataattcacaaggaggcactcttgcctgaccattctgcttacactagagttatcaaagatttgcacaagattggcaagggcgatctggatgctgaattgaagttgatttttcagaagctcactgtacatgcagaatcagcacaatgaatcttgtcttgatgtcctctccctgagatgttctgtgatgtagatgtcaagaggtcttgccgtaaatcagtcacctggctgttatagagaagagggcagacatgatcaggaacaaatggtgatatgaaaatcaccatcgccaggcaaagccagacattcataccactggattgacttagggtgtgtttggttctctgcatcgcacctggctcgcatccacgggtgcaggcctttggtgtttggttgcctgcacggccacccgagcctggctccacgcgtgcaaatcgggcttccgagccaggtccgagagaaacggtcgatctgagcttcgctcctcatccgggctgagcgcgtgcaggcgggggacgcgtgggtgcaagctcggggacgcgcaggtgcaggaggcgagaggggttccagcttctgctcaccttcccatctcatttgtcgctcggtgcctcccgtctccatcgccgcaccgtcgccgtcatctccatcatcgtgccatattcgacaaagccatcgaagcttcctcaaccagaaccgctagagcccctcccctcgaagccgccgccgccgccaaatccagccccgcttgaagccgtcgaagtcgaatccggctcctaccaaagatgccactgctcttcttcatccgaatccagatgtgacgacgagagagggttgtcactgctgacgcccggatcttcctcctagtcgccgctgtcaccgccaccatcgccaccgccttcgtctatagctgctgcatcgggccctcttcctctcccttcttccgtcagatccagagcccaggagctcgatctggtggcctcaggcttctggttgccggatccggacgtactgatggcggcgaaaatcgtcaggatcccgctattgccggatctacgccctgccaccgcggcgtagttggctgtctcggcgacgaggccacagtcacctgccttctttttccttttatttatttgctgttttttctcaccacttggatgaattaattgaacataacaaagttgatgcaatactgtagcacccgatgtggttcatatactattttattcgtcagtgtaagaaatccaatgacttgattttatatacagtgatacactgactaatacaatcctatgcatatttcgcatttgttaaaaatcgatatcatatactgtaaaacgatcagctttgagatgatagaaaatttcatccattagttatagacggtaatcttaccctcaaagaaaggaggtatccatacctccaatctataacaaccaaacagctacatatgtatcccctcaaccagatcaaactaagccaggatgggagagatgagccaggctagatggatacgagcaaacaaacacacccgtattgttcttttggatcgtgccaaaagctacagaagatatttttttttagataatggaaagaacatggcctctacatctatttcggatgtacacagccaaaaccttcagaagttagatagaatctggtacttctatatgcaaattctttgataggcacatcatgtatccgctggacaactgaagatgagtggagtaagtacttgagtatgcaagtacttgagaagccaaacactcataccaaattacctattgagattaacttcagtagtattctcgttttatttttcttgtgggtatagcattcccagttcttacttggactgtatcatcagtttcagtagttcttctatgtactgaagatgggtaatatctggtatctgtatatgcaaatactttgatagactaggtacttgtttgcaatacaaagctgaatatgagtacaatttcgtactttctctgagaggtgtagaatacatcactagactatgcactctttgatataccaatttgctgtctgtgtacatagctgttgtctcttatgtgtacatgagaagtagagaactttggatagttctcttcaaaatatgttatgcgttttggcaaatgcttgaatcatctactgaccatatcttcagatggcaatccatggatggtcataacaaacatttcacagttttttgacacagttttcgttttccatcactaactagaagtgtgaatctgtgatcaagtgtagtttttttttttttgaaatgaaggcaagaaatttgcctcatatactgatagaaaagaagtgaaaaggtgcacaagtatttacaaagagtagaacaagtacccaaccaaagcaagagtagatgcaagcccacagctaaaagcccaagtccaaaggagaaatcacgaattccagcccaagttttgagcccggtcttcacaaatccgatgacgccacgtcatctatccggccttctcacgtctaaccaatcacttctctccatttacgaaccacacggatcgaacccctcctccccgccacgtcaccgatccgtcctcccaagccgtacccaatcatacccgtccatttccgatccatcgcgcgaaacccccacctcccacggatcgctccattttcacctccgcgcccaaacgcctcctcccaccgctataaataccccgcccatctcctccgcatctcacaagcaaaatccccaaatcctccagatcgtcttcgtcttccacctcgagctcttacgcatcgtcagccatgtcgggccgcggcaagggaggcaagggtcttggcaagggcggcgcgaagcggcacaggaaggtgctgcgcgacaacatccagggcatcaccaagccggcgatccggcggctggcgaggaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgagttcccggccccctgtgctcgatccagatctgatgccgttagcgttgcttagggtttcgttgcggaaattgtactacttcgttgtttctgcttgtgcaaagtgaatggatggttggattaaatgaatcattttctctcttgattagtacatccgacttgctgtcttccaaaaaatgatccattggtcgctttgaaatgttgtatgcgctgatccatttttgaatttgagaggcggctatcttgaaaatttcgttgcaaactgcgcaatttcgcgctccatgtgaatgctcgtaatttgaacgatgtatcagctgagtggtctattggctttcaaaattcgagattcgaactggcggttttcctccaaaaaaagttcaacgggtgggtgggaaaaatccaaattgggctcttcgggactcgttggtatctgggccgaaagcccaactgggagtccaagcccacagcctcgttgccgaattttgccacctccccgtcgcggcggcgacagaggcagcgatcacccccaccggcgaccaccgccggctgcgccgccgccgctccggtgttccacccccattctctcccctcgtttgcccatctccaagggacccgccgcacaggcagagactgcgccttgacgccgcgaaacggaaccctcgctgcaagggcacgtggcctcctgctgctcggcgctctcgcgccgccgggcgattgtgggtggcgccggatttctcttcgcctcctcgtatgccggcgcgactgtgttcgggctggctcagcgtggccgctcgtctccctcccctttgcatccccactcctctccggcctccattgccactcccaggaggatagtagatcggtcgctttggcttccgagtctcatctcgggccagccgcgctggtctcctcagcgagtgaactcccctcatgcctcgcggccccaatccgaatgctctcgctgttaccggaggtggggtgcaggaggcatattgtgccgccgatcgaacaacaatgacggttgcgtactggaacaggtatgctgctacacccatcacctctttctttctttaatttggggctgtcaatgcagcttgcaggtatttgattctcagttgggcacgaaattagctctgaaatatgaagtactgtatgggttatttggcatgaggttgtggcactttagcatctccgacattgttgcatatgggcgaaatgagaaaatgggatgtcggatagtatttcaagaaaacaactgcccattgcctttttgatttggttatgcagagacgttctctgaattaagtgtgtgttgcactgatgcttgatgtcgattcaaattaactgtaacttgttgtaagtgacctattcaatctttagctgcaaaatttagggaccatttgcattgtctttacgaagaatgtggatttcaagccatgtctataatattaaggatttgtagttgtacttgtctatttagaaggttaactaaaaaaggtaaccttatttaactcttgctcacagctgtgctttgccacatatcaccattttgataactgtcctgaaccaaatttatccatatctggatgtctgattcagcatgaagtatgtaatgcgaatatgtgatacattatacttgtaaggtatcacaaacagaaggaaggcgcactgataacataccgcgcacttctatcttttgcagaatatctcacagctttccactggttggtgggtcggcatgactggtgagtggtggctgctgtgacagtttttgaacacgtccgctttccaatttttccttctgctaaatccatgataatttccagtttgtacaattggtttgtgcgagctaacatatgccaatcaaatatggggaccaagtttttctggtgcatctgcttactttgatggcatataacttgttttagatgtgtactgttatctcactgcatggttgaagccagttgaaaattgctgtgcacctcatatacatgaacgagagctgccattgttatcaattacaatttagttccatgtctgtatagccacagtttttcgtgtagtgtttagtcagcgtcaggcctcactgtaatgtatcaacataataaagaagtaccaatcagtgcgctaagagttgtgggtggtccttgcataagataaattctcctggctatggaaatttccatgaaagtgacttatctttgagagagagaaaaaatgtgtgtccataagctaactatgatcattttagacagtttaaatgtttaattgttattttgatgcataaacttgtacttgcacaactggatcttaaaggggggagacttgtattgccatgcaagggtatgataggaaaatatcagttgtttaatctattatagtttgaatgtatgttagcagtcatgagaaagctatgaagtatccataatgtaggatataaacatcattacacatcacatataattttaaccgagaacatgactggtatatggaaaaacaaaagaacattgtggactggttcataatctagccttttaaactttataactctacatataacttgaggcgaagtcactctttatgtttgaaagcgtaaatataatattcagaaaacctgggtttataacgtaagttgcatgcattttgaagaaatctgcttgttcacagggtagttacggacttgcggagttatattgcagacttagctgcaggctgccagcctaccacaattgtttcatcgttcttgtgttaagttgaactttttttcttatgttagtctggaaagaaaaccggaagtgctaagggtaatgtgggcaaatataagccctcttaacttatgtgtttggataatagcagagattgaacattaccataataagcatgcaagtaggagttgtttatagtaatcgcttggggctgtatatcttcttatataaggttttagtagaatcttctgagtacatctaaaatcaatgtgtttgttgattaagttcaatttgtgcttctaggatcacgaaatcatggccaaaacacatgtgaaagccctgctgatggcttctcatacagaaattctaaattctagtacttgaacataagtattgtttaaaattcaattcagtggattgtagttttttttttaaaaaaaattaatgaattctgagtttctgacagttattaaacacaagaaaattctgaaattagaaatgtaacagactatcagtgtaaactttttgaactgttcactctatttaggaacttaatttaacatgtcatttactttgatatttgatttattggtttatttccttaaccgcaatatgagtccattcttcttgttttaatgctctatcctatttaacaaggtgggtttatttctttgcctcagaactgaaaatgacggttccttttcaccactaccaattttcccccttttcattttagctatatatatactatgatgatgccggttatcaacttatcatgatgcttttttcaagaggtttcacaatgataaaactaatagacagagtgctctggtagcacattgttcgtttcaccttgaactgtatcatattcaaatttcagaagctcacaagatatcttgctttctcaaattgtcaagagaaaaggaagcatgctaaacatgtgcaggttcctttattatagcttagaagcctgcagtatccaatgaacaaagacaattattctaacttttggttcgatagcgacctcagttctataattgcttttttcctgttgaagattgcattttgacatgttttcctccatttttgtgcttgcgtttacctgctgcaagctccaaaaacctgcatctctgtgttccaagttattctgtttaattgtgctaaacaagacatacaatgagaacggaccaaccgaccaagtttattccctccctgtatatgtatttgttatgatgtttgcataacttagcttcaaagtatactgtacaatgctgtaaatggtaaatttcctgtcttctcttacttttgcagtttctaccaccagatatgaagctggcaagcagaactgcagtagtctgaactggaaactgattgaagttaatgacaatttatgctgtgtcttttggctctccaatgctatgtaagattttccttgacatacatcggatcgagctagtgttctaggctcctagctgcaatgatatagagccaagataatggtccaattctgaatttagaatatcagaatttgatcttttttttgtcatctattaaggaagatacaataaattatggtacagagtggatgggctgccaggaagataatggtccagcaggcagcagcaaggttaaatcagaacatgagttcttaattcagattacctctgagcaatgctgtcagagtgagtcctcaaacttggcttattagatttagtgtagtaagtgagccacaccttctgacttctgagtgttggttcctactgttagtgctgctataaaagtgctattactgattcttgcactcactatggccagcaaatcagagataataaaccatgtgaaagcctcacgtagtgactggacatgacataagcaaattctttgcgagttgtctaaactactttactttacagggtacttatcgtcttatggattttaatcatcagtcgagaaaatgacactggtgggaactgaatttggagttttggactgctacaggagaaatacgaactttatgtcttatggattgaacagcaggaactgtctacaatggaaacagataaagttttctgccctggttatattatcatcataatatttcttcaggtattcagatttctttccttgtctgggtacaagaagattcttgtggaaggtactatacttgaacaagggcttactttttgggctttcaaaagttgggaggctaagggtggcctatcctttcggctacactgttctgttttcttttcttttgattcctcttcacctataatcagaaccgacactgcattcagctctgcaacctttgtgattaaataacttttgtgaaatgcttttgaatggaatatatctcagcatatcttaattctaactatttccgtatccaggttgaagtactttgcttgcctctggcagaggccactgatctatccgtggatgacaatgtgggcactcaaggtctgatcccaacacccccttcaatgttctaagaattattctttggcacagttaatctattgcgggtcagttatttttcatcaaaactggtactgctggcaagctagctatctgaacggtgaactgaattgtgtagtcctcaggggaaatatatcgaaagttgaagttctatagccagttacgcttattcctcaaattacattacgatgtttaagactatatgtcatccaattgtaggcttggtgtttaagaataagacaaaaataaagataggttgtgtgttatcatacaaaggcaaacagtttagatgtagctatcatagaacaggctctagtaaagaccttaagcccctaatcattagtttgatcagaacgtaatttgtctctggcaatctgtcatcattgttaagatacattagctgatttgctgggtccaggtgggctaaattctccctttatctgctcttattccttaaaagccatgtgaagttgtggagatttgtgcctcctttactaatcaagctggttgatcgtacttcaccatttcataatattaagtaaatactaaatcactgcacttttatattttaaatagattgcgtcatgtgtgtccttcctggtcactctaagctgtcggatcgaccgacttgttttaccattcatgttacattacattggacaccttgttcctttttcgtatcatatcgttgccacaaatcatagactcagttaaagttgtgccattattcgtatttactaatgtacttgtacatgatacgcttgaggcaggagggagctagatacgtagaatagcttccgatgggatggttttggagatactcgctatgtgtggtggggagaagcataaactcgaaaaggggaaaggaacctaaagctggggcggatggattgataaaaaggaaaagtggcccacaagctatgcatcagcagccgcaagttggagggcctcaaaagcgcccgggacccagctcttgcacttgccatgtaggcttagcagaggaacgtgtcgaaagcctggctatcacagtacatttgttggataaccaccttttctttttgatagctgctgagagatcgtcaccatcattggttcattgcatacctagctagaatgaattggagagtataattcgatcatggaccaaccaattgtgttgtccctaaccatagttcaaacgcatcctaatcagtgatctcttttattctgatatgcccatgtttgtaggataaaatggctcttttagcaggctcttgctgacttcagtaaaaggacggtggtttgtggatatattatatttactgaaaaccatagtaaaatgagataactgtgggtcaaatgtgaacgaaatcattttggtattagtgggtcctattttcaccttggatttctggttgctcactagatccaacagaagcctttttcaatcctttcagtgtggacagttgtgagcacaatctttagagcaagtttaatagtatagccaagtactagctccaaatcatctagagccaatgtaatagccaattcatacaataattgcttactatactattaatacccggtctcacctgtcatacactcgttacgtcttggagtccgtgctgcagctggctacagatctgtagcccgctgctcttccctctcttcctttatctctttaaaatatgtttatagctggtttatagcccgctattgtacctgctcttattagggtcctttgtttctggcaaatgggcttgccaaatttgtcaccttggatggatgcttgccaactgtgaaaactgaacaatgcaagtgtcatttgattccttgatctcatggctgttgcatttttttagggtcatggctattgcattctagtgttatggctgttgcatttttcataatatatgttgtttatgtactattttaaatcgtaagccagctccttgaagtagttttatgagcattcaccaattatatcttgacttccactgcatgcatgcatgcatgcatgcatgcatgcacattcgttcagagtactaacctgaagtttgcacaatatacagaaatcaatcaaaatatattcaacactaacttttctcttgatagtatctccacaggtgaccagcttagtagcttactgtcggccagcaggctgcatccatcacatcggttaccgagcatggcatccactcttaaacacccagaacggaagaatgtacaggtaaacttgagctcagcattgtgcttctcagttgagagacagttaatcagctccttgacaaagtattagtactatagtacatggattagctgctaatcatgcagggcacacgcatcgaggcagggcccccggcaaaatctacatgggggcgcgtgtgtgaacgtgacgtaaaccgtcaaagggaagggggggaggctgccaggggcaaaaaagcgcgcgaatcgagtaccaaccttgggcccctcactctttccaacgagagctgactaggcacagccatggtggccccacaaagcaaccaatggcatctctccatctctggagctacagggcctcactttattggcagccaaagacaaggagagaagattgggatatttctctattcaccgctaaagctaactgacacaagacaacagaaagcaaaagcacccaaggtgagagagagagacatagagagcgagagagctgtacatggaggagtagtagcttcttgagaaagttggcaagaatccaaacatatacataaaatactctcggaaaacttgctataaagcacactccctcccgcagcccctttccctccctctcttgttcttcctctctcatgtgccattagccaatagcatcaaggtctcctctcttcctcctcgatcctcttcattttgtcttacttgcatgacattcttgttaactcatctatgtgttattgtatgttgcaggtttttgtacattgtagctgattataattcattcatatagctattcaaacaagttcggtggctgtccacattttagctttggatagccggcttgccagctgcctgcctagctataagcatctcttgctgttggagttttgagaggaaggctagaggaagcatatggcgcccgtgagtttgcctccaggtttcaggttccaccccaccgatgaagaactaatcatctactaccttaagcggaagatcaacggaagacagatagaactcgaatcattccagaggttgatctttacaagtgtgagccttgggatctgcctggtatgttcttagtttgcttgttctaaagatatctattcctagtttttatgttgcttgttggtggtagaagttagaatgctgtagcccatgctaggatatatatatttcaatccaaccctaggcccatgcagctatcaccaattggcgttcttatatatcattctcttgctatataggagtaacagtttctttctttttgttttaagggtaggaatagcagtttcatgatatataatttgtatgagacttttgtataaatgctataaggacaagttttaagtttatatgcatgttaaaattcaggttaacaattaactataggcaagcatgcacctttattgttctccaaggaaagcacatatataggtccagtatgtttattggatgccgtgttatgtagacactaagcaatcttattcaattcttatactattatgccctcccaagaaacaccagtgcctacactacttgaggaaagaataaccacatgttcccttcttgatgagcacttcatctagctatttgtagttgaaatgtatgtaataataatcactaattaatcctggctataaatgtgtagctctatctgttgttttagtttttcttttatttcacataagtagcttttatgtcatttatgtcacaaaagaaaaggtttccatgattaattcgtaaattttggtacatttgaattgctagttatatcaaagcatatttgattttttttctctttatatataaaaaatcaagcattgtcaaaagcgatgtttcactgtcatagctttgtgtgaaaacaagattaatcatactgtgaaatttgctttactttcaaacatcttatgcacaccgaaaggagggatattgatagatcttgatccttttgtcaaaagaaatttaccttcaaaaagaaacgtcaaatttctgccaagtgtaaaggtgacattatatacgtccatgcactgagatacttgaaatggaaaataaatcctttatatcagtaacatcaaagttaaagtttatatattttggaccatgtcacaatcacagagagatttgaggaaaagatatattctctctttatccacttgctgtttgctttcaagcttgacagtttactacaaaaacaccatgtagcattcaacattctacgaagcgagtgctgtaaaaatatcgaataaaaagagaaaataaagatgagccttttttttggggtgacaaaataaagcaagaaactaagaaaggaacttgtgatgaacatataggtcaagaagatgaacaaaagtccgcacagcctccaagagatataaagtgaccttggtctaattttctttcagctatggtgggctatcatgttaaatagccatatcttaactctgtcattagatccaatcatgatagtagacaagtacttcaatgtttatgctgcatgcatgattatgtatgactttttgtttgtatgacaccccctaactgatcgttcaatattcagaaaaatcctttcttccgagtaaagatctcgaatggtacttcttcagccctagagaccgcaagtacccaaatggatcaaggacgaaccgtgcaacaaaagccggatactggaaggcaactgggaaagatcgaaaagtgaactcacagaggcgtgcagttggtatgaagaagactcttgtgtactaccgtggtcgagctccacatggttctcgcaccgattgggtcatgcacgagtaccgcctcgatgagagggaatgcgagactgacactggcttacaggtgtgttactattaatcttgttgcatttttaaatctacaaccataatatatggataaaccatatatgttatatttagcccttcttttctgaaattataaacctagagtaaaatatgttactagctgcttgacatggacgcggcctctgatatgcaacctctttgcatttgtgtgtctatatgtaggatgcatatgctttatgccgggtgttcaagaagacagcgcccgggccaaagatcatagagcattatggtgtggtgcaccaccatgtcgagcaacctcaatggatgacgagcagtatcgatcgctccccaacgttggacgtgtcgtgtgatggaagaggtgatgactttgagagcagcagcttctctttcccaacagagacgccaatggactccatgcacggtgggtttggaatgcagatgagtgcacctcacgaggatggcaaatggatgcagtttctgagtgaagatgccttcaacgccaccaatccattcttgacgaacccagtttctgccaacttctcatgccttccatccaaggtacatatacatatatagtcaaaaatgaaggttacttactggtacagatgacatgtatattcaggcaatgagttcttaccggtgcaatgatattcatatgcaggtggatgttgcactggaatgtgcgaggctgcagcacaggctcaccttgcctcccttggaggtggaggatttcccacaggacgtcagccttgacacgaagattggcatacttcgcagtaaccccaacgaagttgacattctccaagaattcctgtcagttgcgactgcctctcaggagctaattaatggctccaccagtagctaccctgaaatgtggttaggagctagcacaagcagtgctagctacgtcaatgaactgtcctctctagttgagatgggcggcgttggcacttctaaccaccacgaatccgcaaggctacaggtcgagatcgctgacatggaggtgttcaaggacgagaagaagcgggtggagaaccttagaggagtcaagttggtgaacaatgaccttggggaggtaattgtttgcatcatacctatacaagtatattcccatcattatatatatactacatctcatgagactgattactttcatgcttcatttgtctcaagcagattgttgtagaaggagatgaaagcaatccaacagaagacatcatcgcgcagtaccctataaaagtcactgcagataattcaggtatgtaatatttaattttggctgttttacatgggctccacagaagtaattagcagtattccatattcgatacagactgtatacagatacagttcttgcatgcactaactcagagctagattgcaggagaagccggtcatcgcatgaccgatcccactgacgtaggcggcatcgacactgccccgatcttctcgcaatctcaacctgacgactttgctgctggtttcgacgacgtcaaccctaatgcatctttcgatctgtacgagaaggttgacgtcaaccacaggctattcgtttcaagggtcgctgcggcgaagacattcttccaccgcattgagccatcgaagaaggtcagcttccactcgaacccggcagcaaccgccgtcagtaaggcgaccgagaagttccatttccccgttacgaccaaagttagtggtagggtttccatttttagcaagttcaaggcactcataagggacaagttcttgatgatgaggccatcacattcataccaaaggttgggcagcaaagaaaccacagtgaatgagctgctgcagattgtgtcactccttttagcaccgaagcaaatcaatggctgccctactgagcaagagctggtcaagaagaaggcgaaagaagtgatgaagccgggatggggtcgtgaagggagcaacaaattgtggcttccgctctccaaagggaagggcatttccagcatgtttttgagtgggaaatggacgtttctaacctccgcgttggccatcagcactccagctgagtgcgatcactaaaaggtcttttccatgactgtcaattaatgacactactgttatataatctgctataacctcagtagcgcgagcctagctagtgcatgaagagaaggttaacattaattaactgtcttcgtgtctctgttattaactggtgtataactggagaatgtatgtcaattaattattatttgttcgtcgtccattctaagtctaaccctgttgtatcaaaatactatcgttaatttgtaagtgcaaatacagatgtatacatatatatacatgtaaacacacataatgttcaatattaattgtatttgtttcattcacggtggcggccaatttgagctctgaatgtcgtgataatggttggcattgtatttggcggtctactgaatgagagatgccctcttggtcaaagctagactcacattgactgtagcatgtttgatcttagctagatgtactcgtctgcagcaagcggtgcagatgttctagtgctagtgcggctgatcgatttgtttggttttcacgattcgcacaccacacacgctgccttacatggtgcggcgagccggcgatgaaccttaagctagcaaagctggcagctcttcttccaaatgctactgcacaaagttaagaaaacctatcctatcagcaatacaactgtaaactgtaccagactcatctctcctaggaagtggatcctcttaacttctgttcagggtgcagcgtttccaccacttcgccgccatggagatggacgcagagctgtggcgcttaaccccgtccgagaaggcagagctaagccatcgccgcaggccgaccatggtatggtggcaagcagatcggagcaacgcgagccaccattggggggtgaatttgggggcggtggtggtggcggctcccgccccagagtttactttaccgccagtaaccgtgcggttaccgcggttacgggcttatcgtgggggcacggtaatataaatactatggtaacatctttaaatttaaataaatttaaaaaaattaaatttttgataaaatttgcacggcttttcacggttacctaccgtcggggtacggtaaacccggtcctgacggtttgggaaacctggcccgcccccgcgcgctctccccgacccggagtccacgcgacgacacgcatatatcgtctttacgagccatgagcctatgacacctggggacgacgacaagtactctccacaaccttttctgcccagtaacgcaacaatggcgaagggatcgccgacgcggccgatgaagcagagcagagcgtcgctgcctaatgcgtcttcgctactgcgaaatttgtctcgggagtcatctctgctccatgtatcgttgttcttcgctttgtgaatggagtgccgccggcttgcgagcagcttcctccagttggatcgccggcggcatgcgtgcagcctgcccaacaacgttgaaagactacttgtgcttttgtagccgatgtcggcaagaacctggtattccctctcttcactgcgtggattgctgtgtttgcctctgctatgcatggtcgccaccaccctcgtcgccgccaccctcgtcgccgttccggacagactcgtccaccaagccgcgtcgtggaccgtggccgaacaccttacaggcgcccgggaacggctcggcctccccttggggtcgcggaacgcgccccggcccacacgtcagcgtcagagcccccatgacagcagctgtcagcctccctagcccacgcgtcagtggccgagcgccaacagctctcacgcacacgggcccacgcgtcagcgcgcacacgcatccaatcctgggccacgctaagcgcgcacagctgcgcgttgggctgcccaaaggccgtcgcttcccaagccgtcgtcccccttttgttgggccgccatcccttatcgggctgtctagccaagctgggcagagccgcccatttgttgggccgccgtttcaccttgggccaccaaaccattttgtgccggcaccttcactaccaaatcgaatgaaggcaggtacatgcccccagagaacttttgttgataaatggcacaaagtctagatgtcatttcttggaatgtacgaggattaaattcacctgcgcgctgcaacacggtccacgagcttatgctggacacaaagtgcaccttagcctgcttccaagagacaaagctccagaacatagacgacggactcgctcgtttcctaggaggctacaagctcgataaattcgcttttaaaccggcaagaggcacgagaggaggaatcctcctcctttggaacagtggagttttggatgtccaagaggttcgaatcggccgcttctcagtctccgcacaagtgacgcccatagtcacaggaaccacgttcctactcactgccgtctacgggcccactaggcaccatctcaaggacgctttcctccggcatatcagaagactaaggcccagctccggggaagggtggctaatccttggagacttcaacatgatctaccgagcacaagacaaaaataatagcaatatcaacctagcacgcatgagacgtttccgatcagtcattgacagatgtgagctccatgagattcccctgcagaataggaagtttacctagagcaacgagcgtcgaagggccaccctcgtcaaacttgatcgatgcttttgcaatgaggaatgggaccttgctttcccccaccatgtccttcatgccttacctactggaccttctgaccattgcccgctggtcctctccaacccgcattgcccacgcagtccgaggagattcaagtttgaaaatttctggacaaggataccggggttcaaggacaaagtcaaggctctctagagccagtcatcgtcgcacaccgagcctatgcaccggctcaaccaaaagctccagcgcactgcggtcggtcttagagattgggcaaaaggcatctgcacggaggccaagctgcagttccacatggcgctcgacgtcatccaaaggctcgatgttgctcaagagcacagagatctatcacctcaggaaatgtggctgagagccgccctcaagcgaaaaatcctcggactcgcttccatcgaacgagcaaggaaaaaacaggcctccagggtaacccacatccgggaaggcgatgcgaacacgaaattcttccacctcaagatcaatgtgcgtaaaagaaaaaacactatccagagactgcgaaaggataatggctgggcggtaacgcatggggaaaaggaatcaacaatccatgaccattttgcgagcttcatgggccggtcggggccgaggccaaatgaactgaattgggaagcactggacatcatgccggtcgatctagccactctggggaaaccgttctccgaggaggaagtgcatagagcaattaaggaaatgccagccgataaagcaccaggaccagatggcttcactggggctttctttaaagcttgttgggaaatcatcaaggaggacattctactagtgttcaactccatcttcaatcttaggtgtgcgcacctcaacctaatcaactcagcgaacattgtcctaatcccaaaaaaggatggggccgagagtgtttcagactacaggccaattagcctgatccatagcattgccaagatcttctcaaagttgcttgcattgcgtctcaggccccacatgcatgccttgatctcggtcaaccaaagtgctttcataaaagggagaagtatccatgacaacttcctttttgtgtggaacatggccagaagttatcaccgcctgagacgggcaaagttgcttttcaagctcgacataacgaaggctttcgactcggtgcgttgggactacctcctggccttgctgcagcaaaggggcttcccgacaaggtgggtggattggctaggggctctgctatccacttccacctcccaagtcctcctcaatggctcgccggggcaacgaatcaagcatggaagaggactccggcaaggggaccccctctcgccgcttctcttcatcttggcgatagaccctctacagcgtattctctccaaggcaacagagctaggcgtaatctcaaaacttcggggaagaacgactcgactgcggatctcgatgtacgcggatgatgctgtcatcttcattaatcccacccgaggcgatgtcacggctttcgcggacatcctacatcgtttcggcacagccactggacttgtcaccaacctccaaaaatcacaagtagcggccatcagatgtgacaacatagacctgactgaggtcctccagggcatcccagcaatgagggcaaattttcccctaaaatacttgggcctccccctagttctgggaaggatgcggaaaacagatttacaaccagtcttcgacaagatatcagggagggttgcaagctggaggggtaagaacatggaagctgccgggaggaccacgctcgtcaaatctgtgctctcagcgcagccaatttacctcctgactgccttgaaggtgacaaaggagtctttggagcaactggacaagcagcgacgacgattcctctgggcaggcacgagtgatatcaccgggggaaaatgtaaagtcaattggacaaagacgtgtttgccgaccagccaggggggcttgggagtcctaaatctggacaagttcactagggccttgagattgcggtggctttggcatgaatggaaggatcctaccaagccgtgggcgggactggagacgccttgtgacggtttaaacaaggaccttttcgccgccgcgacaaaggtagccgtcggagatgggaatacggcacgcttctgggacgccgcatggattgatgggcaaagaccaaaagacctcatgccacttgtctatgctatctccaaaaatagaggaaagtccctgcgccaaggaaaagagggtgacgcctgggtgaatgatctgaccttcgatgcggccacgcctatcacaatcagccttgtcgagcaactggtctgcctgtgggaaacggttcggaatgtgcatctaaacagtgaagagccaaaccagattgcctggaaattcacagctaatgggcactacacagcctcctcggcctatcatgcgcagtgcttaggggcgccaaactcaaatctaaactccctgatttggaaagtctgggcgccgggaaaatgcaaattccatgcttggctcatcatccaaaatagagtttggacatctgaccgccttgcaacaagaggctggcaaaataatgggcattgccctctctgccgttctgaacctgagacaggaatacacctagtcggcaagtgcagatacacgaagagaatctggagcctagttgcttcttggacgggttatcagcaattggagcctaatgagtgggaggaagcacggtcagtccaacattagtgggagagtttagcaaatacacctggcgtcccaaaaaagggccttcgatccctcattatgctagtcgtctgggaaatttggaaggagaggaacagacggatattcgaccacaaagagatggcaacaggcttcctcctatcaagaatcaaggacgaggctagtctttgggctctagcgggagctaaaagattgcgcgatctagtcccgcactttgtatagtgtataccatagttctctttctttacccttaggggttgtattttctcctgctctattcaatgaaaaggcacatctgtgctgttttttccgttcaaaaaaaaataatggatggatcctccattattttcacgagaatcctaccgattccgcgccgtgacaaaaagaggccgccactctccagctcttcttccgagtaacaccaccacacctgtctgtcacgtacggcctccctcgctcacgggctccctatcagacattcagactagactactactacaaccacaatgcccgacaataatgccaaaacggaagaaaagaaaagaaacagcaatgcccaactcgagctagtcttgttactatcttatactagctacttcagaagttttcaggctcatccgagtaagaagagatcggtgatgggttataagtgtagtagctgcctgcaggcggtggtgctgtggcagttgctcctgccgtggacgcacattgcggtggcggctggcgcgaagagctcgtcgccggcggggaagccgaaggccgcggcgccgccggtggtggccgggccggtgtccaaggtggaggacgccaccaggttccagatatactacggccagagcttcaaagtcgtcaagaacaactggaacggcaagagctaccttctaatgcaggtaggtacagtacgcattgctcttgcacaaaaaatggcacataaacctctgctgattttttgggatttggtgagctgcgtagaacacatccaagatggccaccaagaccaagtattgcacggggaggattaagtcgttcgttatccctcttgccaattactccgtcgacaccacggcttctccaggtagaaatcaagcacaccctggattatgtatgcatttatgcttgcactgaagtttaatccactgttatatagttgttatgttaaccattcgatattaatatgtgtacaaagtatgatctagcaaagactgcatttcaattcaaacggtctctgttcggagtggcgccatagcttgcaacagttacataatgcaaactgacacactgaaagcagcacatacgaaacttcaattcgatatttttcgttcaaatcttcaatttgtttcatagcaagtacttagagttgctttttcttttttgtacacaatataggaaactgatcagattactgttctttcctgtttcatctgcagtgtcattcttcgaggtgagcaatgcgggacaaattaagtactgttcaatgcggaatctgtacaatcgtagataatgaagcaaaagcaacagctgaaactgaacaggaaaaacatatcatctgtagaagcaaatgttttatgcctctgactctcatattaattgatccctgcagcactttttgacactctatgcagctacttggagtattacaaaacttgaaggggataacatctgatcaaattgcctcccagtgtgtgctccaatcatatgcaagtggaaatgtccagctttttaacaagaccgatgcacagatgctcacacaatttagtgcacatttcttgagcactacagatgaaggctgcaatttcgcagcttatgtaccctctgaagaggggacaccattgcaagtaaacaatgattattttttttaatgctccatttgaaatattacagcattcaaacacactaatattgtgtttcaaacgtctatgtccagagggctgagtggatcaagtacttgggagctttcacaaattcagaagatagggctaacacagtttatgacgcagttaagaccagcaaatttaactttatttgcattgatatgaccatgcaagaactttgtcatttatgcgctcataatgcatttactatagtaccactttaaagtaactgtagtttgtaatttgctttttgttgtaaaggcggtgctctgacgcactgcatttgtacagttttccccttttacttaatatacatcggtcggcattcttcgccgtcccggcgaaaaaaaaagtaactgtagtttcattagcacaaagaaactagtttaagaccactttagtttgcaatgtccaatcaagtacctatagacaattgatctcatttatctagcatgtcgatgcagataaaggcaaactacttatgcttaagcaaagcagctgcgaatcttagcacaagattcaaacctatagtggcatggattgaattcacacaggtaagcagtttactaaataaaatcatcactttctggtccatataagtaacttttggaatgcaccatactttgttgtcaatatgttccttctaccactgtagggtatgtggacatttgttagtgatggttggattgtacaggtaatgtcatttgtttattgcagcactttgaacataaaactgtcaactaaacaaatgaaatggagacaactcatgcgcatttggtatttatgccataagcagtatgtcacagatgcaggagcagaggttgttgatgcaactattactaataagagattcaacaattctgatccagaggatatggataacttccatgctattctttgtgtgagtatcgataatacataactgtcagagtaatcatctgtctcactatttctcatgatgcactaaagatccatcgtttctttttggagagctggagaactgttacttagttaaaataatgtcagaatgctaatactagacaagggcaaaattggacatttctatgaaacaccaaaggttttagtacttcacaaaagttttaaatgaccctcacttgttaagcatctaacattaagctttggtttatgtatttttcagacagttgatgtggtcatagatcagacatatgcttcagatcctgcagagtacaaactatccacattcttggagagcattaatgtggaccgtgactcttgttttagttttgtagccaaccgtagcatatggagatttgataaaagaataggatattcgaagaaacttggtaattcttttctctatgctctacactaggtctcttgatatagttttgtttttgtgtttttacaaaaccatgctcaaactccagtgccatgtttttcaacctatgtaaaggtctaatggagttttgcttttgcttttctttttttttttaaaaaaaagattggttcgatggagctatctcccagccccagttggttcttgctgatctaatagaaattttctttccaacggggaattacacacaatttacttcaggaatctaatgaaggtattgctgctaatgcccaggctaactattttttttcttaatttaaactaattcactcactctccagaacaaggttacttatcagtaaaacaatgattactcaggatgaaggggtcactgaagttgtccccgaaatgtgtagtagaagcatatcaacacccatggagccaacaatcttgccctgccagtgatgaccttagatgaatatgaagacagaggaccttacagctactgtacccacaaaactatggcaattaaccactgagaccattacaggttgccgataaagtgatttgaagttttaaacaaagcagactagattgcatatttgagaaagaatcatggtgacaaaggacaatgatgtctaaggaatactatgtatctatctcatcatttgacaatgaaagaattgttctcaatatatgatatttcatatcttcttgaataatctcctaaatatagtataagattgaggtactaactgttgtaatttcagttactgttggttacagtatttgggttatctttgtgtgatacagacaggaaactgtgaaaagagcactgaaataatgagtactatagttgaactctgggttaatttatagtcagaaataagttgaacaactcctgttcttgtcaagtaaaattggagtcaacagagtacactgtctcatgtattctcatgcctatggacctatcgggctatcacaaacacgttagataggaatcataacatcatccatagattcaggtaaaggaatttcacattttacccattgaaatgatcctttattaaatttatatatcagaaaagagattccaatctattagtttggacggtctggagtatctctattccatgacaagtacgaggggtctccaagagtcctgaaaggaatcaagcatgattttcttagtgcaacagttcgaagttcaaatttcttcaaaaaaatatacatggtatgttcggcaatatcaaccatgtcaatgctgaacattgcattacgctggtccctagagctcaggtttcctacttaggacatcctcaatgttgaagatcaattgagccataagatgagacccacattcttatgtttttttacctatagtacatgctacaatgtactccctccatctacttttgataggtatatttcaaaatctgaaaaatttatttttgataggcatatttcaatccaaccacctatcctcttaatgattttattggatttaatgcgtgactctccattcttccacacaagattggctacataggcatcgagaaatgtaaatattaatgaatcacttgtttacgaggaataactagtagcatgtttaaatggatgatacgtagaattacttatccttggtcattgtgccaagatgaaatatgactatcaaaagtagatggagggagtatatggtagcttcttgaccttaaggtgggacccactgagaaaaaacacatatttactcaagattgaaagtgtgcatgcatgttgtaaagccatgatatatttttttaattcttatggtatagccttaagcttaaggttgcccatagcactattctctccctagctcatctcccaatgtataaaggtacaacaaaaattactactttattccttaagtttagttttcatgcacattgtggttgccctaaagcaacgatggaaataaatagttctatatcgcatcttcgtaccaaaattagcacaatgatgaagcgcgtcatacataatcaggtaaaaatacatggaaataacagaatagcaggctccccatgaagggatcatgtgcgagggaggtaatcctcaaaacatgcatgtgtgcatatgaaatagtagcgagcacattataccagcaaggcagcaataacatggcgtaccttggtttaaccatgtagagaagaactacgaagcccactgcaaggaaaatgcataggcctccgatagtcagatatgcaacaccaatgaagttgtttttgcctccaatccaagaagtagttgaaaggaccaacgctttagaccctccaaaactatatgtgttatagttattctgtataaccactgttaattgatcatttgccataatatctgtctcgattctgccataaagctttctgaaagttgggagggcagcggttctcatccaaacaatgaggtcttcttgctcacttaactatttatgacaggagagacagaaaaaacaaaatgtcaatgagacgaaaatgtatgaaataaaggtaacaaaatatgccatgtcgtacataggggaaaaacacatacaggtatgctctcatttagtttacccgcctattagactgcccttctgaaaattacttgggtaaatatcactgccaaatttatcggtcttgtcactcttccaagctatatcctttttattcacttcaatggccttcttgttcaccgaaattgtatatgtatcattgaacaagctccaagcaataaggccacatggaataattggagcaccatcaacagtattaccttcaggatcacaatcctttgtcaagtgcacagcattcttataccgcaattgtttatcacttcgacttttcacatacctatatacataagaagtcaacaattggtcagattatatcaacataagtcatgcagacaggatgctctcaaagtacacataattcaaatcaaatgatgtccagtaagaatacaataaatttagggatcaaatcaaaaggtgtcaaaccggtaatttcatatttcttataaatcccaaactggaataaaaaaggaagtatttttttaaaaaaaacaaaatgaggaatgtcatgcacgaattaccgtcgatggttttgatagaagtcgccgatctggtaatatatctggattgggctcttcatatgtttaggcacctaacacatacaacaaaaagataatccatcatggatctttttttttctttagcaaaaacaattgaatgcatatttctaagagatggtaagggccaacatgataagtggtaggcaaggtatattgacatttccattcgatactcacagtcagtgttcttgtgcatgtcttgtcagtatcggtgttctgaatgaacccaaccttgtcaagcgtggacacacaatttgtgtcatatcgatccaccagttcgacgatctacaatgtacccgagtaatagaataaacaaatgcaccataaaaatgacaaaagacaacaacaatctggccacgcaaatttgcatttacctcttgcgatgcagatagagacgcgagcccaattgggacaaatatgataccaatcagcaagaaggtagcaaccacctatgtattttcacgtacaatcgcataaaaggaactcataaatctaataggtagtataatatgcatatttgaagatagtaaaattggtgatgggcaagttacaattccaggagttagtagtggcttgcatgctggaagctcctgttgcgtaaacttagaatctgcatacaaaataaatcatcaaccccatgaaacaatataaaaatccctaaagcaatacaacatgtattcgaggccaattaaaaaatggcacggggacaaaaagagagtacatttgggcttattgttggatttctgtgagccaccttcagattccaaaggatccatctgtatgagaaaccaaaatggaagcagaaacttttaacaatttacacacacggaaatggaaaacgaaacaggagcccgacacaactggattagtgagaactacagaacacagaatcttcaacgccatcagaatcaaaacctgtggagtttggggtgatggggacccactagatactaaacaaaaccctccatagaaaaagacagtctcttttactcactaatataatggcccatcacgatatgactgctctttcatgctttatctcctctgtctctgtctaaaccgtgattacgtgataatgatacctttaaccctaccaagaccacacccatatctacgtccgccaatcgcatggggatcgcgacatctcaccctaatcgcgcacaggagacctaatttttctccgtttcacatgcatccgcgcacccccgagcggcaccaaaattgtgattacaaccaaacagtacaaggccatagatacggaatcgaatcggagaaatcgagggagggattggagctggcgagatcgaagcatagggaagcttaccgcggcgaccccgatcaccccctctgcttgatgacgagggggaggaggaggaggtgaggccccggtggtgggcgacctccggtgtgggtgggcggtggagaatggcggagagcgacggcgagagtgggagagagagagaaccgagaaatttcattatttgactggcgattcgcaggccttgcagggcagccgactcagtgcgcagttcctttcaggtgtttgtcacgtgagatagcgaattcctttattccgtgccactccgtcgccgatccgtccgtccgtccccaacgccagcttttccgtcgtcttctccacctcgtcacgctcgtcaccggcgccggcgtgggctgcgctctagaggggctcgagctcagattccggtgtggatgtcaggaaccagtcgtcttgtaatctcgcaaagcagcagccgatcgaaacgggcgagccgagacgcacgaggcggggccagccgcagacgtcgcggccgccctccacaccgcagaatcgttgggcaactcggagaagaaatttccagcgtcttccacctcgacgtagccggcgagcggccaccttcgcgaacccgggccacatcgggaacgaaggccatatctaatcccgcagacgtgcgacctcagcaccaggcagaactgcagagctaatctcttccatgccataatcagcaaaaaattgttaatcttcccaaacaaatgcattgagaaaactgacagaggaatctactgttttcattgataaactaccaagcgtgctcctcagaagtcagaacgaagaagaaagaaatcacattacgcaactaattgatgggagagaacgaagaaactagggaagaaattagcgagctgcaattaacacacaagctatatctatgcacaatcagttgctgctgcttcgcaagattagagacgactggttcctcccatccgtgccggagtccgagctcgagcccctccaactctccaagagtttggcccacgccggcgccggtgacgagcgtgacgaggtggggaagacgacggaaaagctggcgttggggacggacggacggatcggcgacggagtggcacggaataaaggaatttgctatctcagtgacaaaatctgaaaccagtgtgtattgagtggcttgccctgccaggcctacga

SEQ ID NO: 55132 - DNA, 16258 bp, Oryza sativa
ggcgcctccattgatcgtctcgtcggaatccgcttgaacagatcgattagacgggggagaggagatcgatcggttgatggcgggcgctgcgatttcctagccttttatagcgcgcggagaggatgactggacgagtggcaatctgtagatttgaaagaggcacggagagcactacaggaaacaatttttagccttttatatcatctccatatatggcttttttcgcatccgtccatccgggccatatatggcttgtgtacgtgggtttacaaggtaaaagtggcagctttcttctaaaacagtcaggccctggccctgtttagattttaattttttttcttcaaactttcaacttttccgtcacatcgaattttcctatacaaacaaactttcaacttttccgtcacatcattccaaattcttcaaactttcaactttagcgtggaactaaacacagcctaaaatttccccctccccaatcgaaaccaggcttgatcgcgctgcactctgaataacagcgagatttaattcctcgtcgtcgctacgagtaataatatatactctctccgtctcaaaaaaaggcaaaccctgggtttccgtgtccaactttgactgtccgtcttatatgaaatttttttataattcgtattttcattgttgttagatcataaaacatgattaatattttaggcgtgacttatctttttaattttttcatatttttttaaataagacggacgatcaaacgttaagcacggaaaccagggtttgtcttttttttttttgacggagggagtagttatgcaggtagatacgccctgattctatcagtgaaatcgagaggacaaaaatggcgactcattggcattgatcactgaacgatgaaccaaccagtagcgaatattttacatggtcgtgcaaggagcaagtatttttcttctacccaaataacagatgatcatggcagagtgaagaatcacaggcaccagcaccagcaggagattgaggaaggtatgtgcccggttttccggatctgagccgcctgctcttcagttcttgctgcttcttggttcttcctggactcagcggcctccctcctcgcctctgccttgtgccttgcagctgccaacttgctcgaaagcctgtcctgctcgcgagctctcttgatctctatctttgcctgcaattcagtcagaggtaggtgattgtcagaaattgaaattgcctgaagcttcttgggtttctgttcaattctgtgtcttggacttggatagatgtgtcatgagataaactcataaacagtcccattccaatgcagaataagacacttttggtgctaatgatgtactcctagcccttttgcagagaaagtttaatgattttgacaagttactgaagctattttatccagtgataaaaactaggaaactgcatatattggcctggttgaagagtatacatggtatcatcatcaaaataatcaaagggagatcgatggtctacctccatcctcttcatttcagcttcaatttttgctttctggtggttttcccaagcttgaatctttacctcttccctctgaaacctagaattgcagggtaggagaaaaaagaaagataaacatgctgtcagggaaatgtgcaaattcttcagataagcctagcaatatgaagttttgatttccttgccatgcgttatatttctacgagatgggctaccctagttgttcttaaatcttaatattaatcaatgcaagcttgcatgttttccctacttaatcctgatttgagaattatcacattacaagctcactagtatctgttagtagatagccaagaatgagcacacaccttgcaagatattttgctttctctgcctcctcccaatctgcagcacgagcctctctgtcgatttctacagccttgtcggttatgacatttgcgaaacttgttgtagatttctcttccttgctagcccatgcagctatagttgtctttcccagccgttggccaagatccatgatttcctttcttgtattcatttgtagttcctcctcagacatttccatcttatttggaccaaattcaccaatactgatttctgcattacgttgtggtgttggtgtccgagaggaggttggactagaagctataataggagtcccagtccgagagggctcctggctggcaataggagtcatttctgtgcccatgtctctcatcgaaacagacctaactgcaggagctggttcatcaactatcgaagcactttgtgcaggattaaatgaaataggctgtgcgagagctgcaaacaaaatagaacaggacatttccgtcagtggcatactgaattttacaaaaggtagaagcatagaggaaacaaaatttatttgctgtcatctaagaagtataagccagagagattttgaattatagcaactagtaagtgaaagataaactatccctggaataggcattcacccaacataccggaactgttcatttaaatgggcgatacataaggcacatagacttataagcaggtttatctaatgaaaacagatggatttgtttgctttctgattttatatttaacaaatttgtatatgaattataatattcctcctgtcatgaaaaacagctaaacatcaatttcagaccctttttgcaccggctactcacaatgttacgtgtcttctcaattcactctactccacttcaaatttgcctacctaacactacgagtctccgaacaatacttggttcaacctaacagtaacagactacatcacaaacaatcaggagaaatgctaattcaacctcttaacttgcagacaaagataggctgaaattctagtcacaccaaaccacagatgtggctctcacaggtcactagaacatcatctaaaacttcttgattacaccacaaatccacaatccttatcaattaagatattcaagagcacaaaaaggaaattaaaaaaggcatggtgaagtttcttgcttaccaactgaattcttcaccaaggttccagtgttgatggggacctcagcaaccaccttagcaacggctggaggccggcttacatgttcaggaaatgccagcgccgatttcttcggcgcagccccagctgcactccccacacggccaccgcggttcgccgtggggctagaaatccacttctctgcatcatcccacttcgacggcgtcggcctagagaacggtggcagcaaggcggtcaccgccgccggcctcttcaccgtcggcgggcccgacgagctgctctcggagtcgaagctgtcgtcgtcctgagctcggtttcttgatctgtggccactgttgctcgacatttcggtggaggtggagcactccatgctccctgttgacgcaattagcgatttggtgaatccgtaaatgagaatgattgagctgtgcaacaccatttctggggtagtggacttactctggtcgtccagctcgccggaatcgttggcctcaggcgatgtgtcctccccgttgtgctgatttttctctagtccgagaagcattgctcgtagcttagctggggagaatccacccgactggagcaggaagaggaaagaaggaaagattttagtggaagctgaaagaaattggggaaagctgtggtgaatcaaatcagtaaatgaggcaaaattaactgcgaaaattgccaaattccgacggaatcacagcagaatggacaaaaggatccaaactttttagtgaagtgtgcactcagataacccaacctatctcaatcccctccttaccaaagccaacatttgaaagctatggcacagaaagcatcacagaaattgagacaaaactggcagagcagtgacccggtagagcagcaaacaggataaaagcccgcaaacttttcagcaaaatgcgcgccgaattagccacacaggcgatcgttccaggcctgaacattgttggccagtggccaccaccacaaaagtacagtgccgaccaaaatgtcaaggcgaatttgagaggagaatggaagagacgaaaaggagcactgcaggggaatctatcaacggcaatatcccgaccaatcgatgagaaaacatcgagttcagcaatggcaggcgtgcctgctttccaagaatattagcaatcattaaaaaggacacacctccagtacgaagaacagcacaactccacgatgaaggaatcgagcaaaatttaccaaatcgaagcaagataagtggcgctaatgcctagtatttcagttccagccatcgaaggcgagaggcgccatggactcggagatgagctcggactccgaatgggtgcagaccgccaagaaagaagaagagcaaaccaagaagaagaagaaagtcgaaaaatccgggaagaaagagcaaattcacacgggaatcgcggggaggaggccacctgacgttggagcggggggccgtggatgcgctcgtactccattaatggcgtgcgcggcctgaatcggttggtggtggcgagatggcgtgggagttggggagaggagaggagacaagaagcttggaagggggagtgggatgttagtggactttgcgatttcgtgctatgctagtgtatatatgatctatttgtaccgtattatagtgtggttagtggtagtggggctcattaagctgattaattaaggcttcccttaggctgagttcggatgggggagatgggaacccaacttctgcgcacggaaaacggagcagtccattaacacgtaattaattaagtattagctattttttttcaaaaagggattaatttgatttttttaagcaacttttgtatagaaactttttacaaaaaatacaccgtttagcagtttgaaaaacgtgcacgcggaaaacgagggaaaggggatgggaaaaggtgaatgcgaacacagccttagtgctgatttggttggatcctttcttccttgtttcgtgaaagactattatttagtctataataggataatagttttttttttgttgcaatgtgcttggatttggagcaaattacacaagcattttttatgaggcatttttatcgatagcaatatgctcaccatatatataccaattctgccgtgaagtgttttacaatgttctaatgggtaaaagaactaatttaagccgttttttttctaatctaatatcatactaccacatcaactactagtaaaaaatattttgctaatagcagaaaatgatatcacttctactgcgataatactaatactctgatggaggatatgtttgtgagaaacaattaatttatagttagcttttaaaaatatagaaaagttaggctttatagcttttcgtttctagtttatttctaaaattttataactacatttttttaaaaaaatctagacaaaatgttgaattgtttagaggagcttctggatttgggagaaactgcggttgtcagaaactcttctaacaaatctggactatcataccgtagaaagcaccataaaggtgctctattgccattcatatgtttcctatgttacttgaccctgtttgaatcttatttcattttcaataattgatatttttaggtaatcaatattttggacgtactctctattaaaaagtcaacctctaactacgaatataagttgattctttttttaaaaaaatactacagaggtagtaagagcgtgcctgaaggtaggagtcgaagttgtcacgcatgcctcgacgttggaagcgagaaaacaggcctgaatgtagcaatatctcgagccgtacaactttgccattgcagcaagcaagcgagacagacaaacgtgctctccaaacttcttcaggttagggtgtgttttcatgctaaaattaaaagtttaattaaaattgaaacgatgtgatggaaaggttgaaaatttgtgtgcagaaaaattttgatgttatgaaaaaattaaaaaaaattaaaaaaagtttggaactaaacccagctttactttttagttcgagtaaacaggcctgagtgactgctacagctccaacaaataattgtagacaaactgaattattgctgcagctctaacaaattactgctacttaatccaacagactttacgagttgtgtgacactgtgacaggagatgcacgtgtggagggcaatctgaatctctgaatctgagtgacgtgctaattaattattagtccattaatatgtgaaagaaaacttgggtaggacgaaaatatttgtgtcatatagtgatgagacgtgaccggagaaccctaggggctcacatcaacgtgcagccctagccagtaggcaggcacatgcttcagcgtccaggctcttgttgcaatacaatgctcgggtttttcgtttacaactctatccgtgcacatatttcagaactacgagaatactccgttgttcgtatatcttatctttaggccatatttatactgagataaatggagtataactcaatgcttaagttagagacatattgtttgtatatctctaatattccttctatttttgatttctcaagtttccccctgtgatataagttaccaccctttgatcacttaaatataactatttctagtatttaaattttattttaaaaggattgtttcgtatctagacaacctccatccgactatcatcaatcgggacaattaataaagagtaatatagttcttttatctttgttttttattctctatcaaagtcttcagaaataaatatactctctccatttaaaagtttaagatatatttcttttatcatcaagaccaagaaaaaaaaactcatctaccatatgacaaatcaagaaactactcctttcgttccactgactaagcttgaggtgcagtcaaagttgtaacaatttttaaaactaacttttaactttgaaattcttaaatactacgatgtttatagtaacaaaatcacaattatatgaaagtaaattcaaatatcaatccaatgaaatatttatcaaataaatcttaatttataatgaaatatttatcaaataaatcttaattttataatgaatcttaaaatgtgtgcgtgccttgttcagtgggacggagagggtacttacatgcatgcaaccaataagtattaaaatgacttcttatgttttagttaacaatttaattcggtacatataaactataaatatacctatcttatttaaaaaactaaaaaattaaatataccttagattagatttttggatgaatgatgtattttagaacaagggaatggtatttgtttgcactttcgtcggttgcaaacttctttgagactgtcttcctagcgtaaaaaggaaatgccattttcaccctctcaattcctcccgtaaatgttatgcaacgtatttttattacaccattttccatatattgttcatgttccgtatcttctttaaacaaaaacttatgcctgctctttggttcatgctctttggcacgcccttttccaaaggtgtatgattaatttttgggcgtgcaaacattagctcagggaacattattcttgccttcttggtttctggtagcaaaagcatttcaatgtcagcaattttttttaagaaaaaattctgtcctcctttagaaacaggtggacgtgttctactactacctgacaaatgacaacaaggatctgcatgggcagctaatcaagcataaattgctccgacaaagatgcctaattgtttcttagtgggaagcacagataagaatgctaaatgctcaacttgctgatatctagtactgttgtttcgcattcctggtcagtgttctccttccatggctaacatcataggataatcagtgggttaggttcatgtaattatgcaatcacctaatgataggcaatacatgactttgaccaaaaagggtggctttgcttagttgtcccgattagaagaagtgtagttgtggtgtgttttctaggcaaagtattgatgtttacaaatggcaatgaactgtgtacatcagataaacaggaacagatatgagagctaatcaatgaattcagctacaactactagcctactacgtaaattacggacaatggaatttagtttagagatgatcccaatgttaaccgagtactttttttaatgatcaagcaacataggagtaataaactactctagccacatttcagattgaatccaaccagaaggcacaaaaatgcagtaataagcttatcatggataaggtggccaagaaccatctgctacgagctagtggtaatttataatcaaaatccatgccgtctgaattcgaaatttaaagggagtagcaaattcaggagtgtaaggccggcattcgttcaaaaaaaaaaaaagaagtgtaaggccggccggcaccaactacctccatagtccactaattcctgcaaacgcataggtcccaagttgggagctcaacgcatttctggatggtgatcttccaactaccactacatactactttccaaaatataagcgtgcagggttgtctttgtaggttttcacctttgtgtgtggatgtttgctaagctactctaagctaggccattttccccaaatgtaattcagtggtcaaagcatcatacttcagccaggaaaaatatatcaccggcgagttaccgctcgttttgttagcactaatcagttcagtaaaaacagttggggaaaaaacattacctgaataatgtgttaagtgaccgttgctatggcatctaaaaagagtttttttagaacagagggagtaatttgctactttggcatataattaagggaaaattgcaaaaatcaccccataagtcatttgaagtttgacattccaccccataaattattttgttgcaaatatccacccacctactcaattttgttgcaaaaaccaccccggtaaacatatgcttaaccgaatcaacatatttttataaaatgtgagccatcaatatggcctttgccaaaactaaatacttctagagtattcgtgatacattttttgtgagattccacatataaaattgttgacgagagcctaaacattgttgcactgagttttgctatatgcaaaaaaaaaatcaatcaaatatggaaaataagtctaatgcaagcacttagacaagattgacttggctagcttagcctgtggtaatcctacatcagcaataacgaattgattcggttaaacacgtgcgcattggggtggtttttgaaacaaaacttagtagcaggtgggtatttacaacaaaatgacttatagggtggaatgtcaaaattcaagtgactttcggggtggtttttgcaattttctctataattaataacatgaccacaataatgtttctgaaaggaaaggtgtaggtgtagccgttaatcaatgaatgaacagtaccactatcagtgtatatgtcccatttacaactactgcgagtccctgtcgaccctggttagcaagggtactacgttaccctgctgaactgtactgtacatgagatacgtgttgtctgtctgtggtacaacttaccaactccgcacttgcttagaagtcaatcatccacggtaactactcatcagaaaatgcacttcaataaaagaatcatgcattaaaacacacacacacacacacacacacacacactatatggatgacagcatcagccaaagccatggattcagtattcagacttgagcatgatggatggcctgaaggagagagcatagcacaagaagaagaagaacatcaaatccaagcaaagaatccgtggatgctgaattcgctggggccatgcggtttctatggagatccatttcttgctgtcaaaaggtagccgaggaatggatggataaacactgacacatctgctgcccaaagcacagcaatctctcactctgtccggtgtctgcacacgagtccttcctgttgggcccgtcctgccgatcccttccccctgccggcatccgagagagcatccaagcattttactgtcttggaccagaatcctgtgttgcatgtagcagtagtagatgtagaatggaaatatggaatgttcaaatttcacaagatctttacaagaatttcgtcagagtttgtccggacaagtaaagcagagttggaattactaattcagacgtacaatagttcataaacagtccagcagggctggtccaacgtcattaacgctactactcccaacagaaacgggaaatggcagttagattgggagttgaatcgcagttggattgagatattcccaacaggaacacacagctaccagtcagaatagaagcctctaaaaatgcactcctaaggcctaagatgaagatgagctttgtttataccctctccaagtctccattcctctgctgtcaattggacaacctgttcgtgtggttctgaatttgatgctcccggtatatacaagctgtcgacctgattgacaggtgcgtgctttcattttctttcatatactcatttgttccttccacgtattcccttcatcccaaaatctaagggatttcggacgggtaagacactagattttggatatagtgtcacatccgtccaaaatctcttatattttgggacggacagaggactaataacactggtaacttgtacctggaggttcgtaattttctccaacctccttaggcctatttgtcgctcgaaggttgcaactctagaatttgctactccttattatatgatcatctgccactgttcgtaatatgatttgcttaacggcggtttcactcatgattcgtcaccttcgatgtgttctctttttctctctttctttgatcagacaattattagggattcgaccaaactggctttggttcattggaatcaatctggtgcctatatctcatacccacccaaacatatttgacaactgggtgatgaaaatttgataaatttcttgaatgtcaagggctcagcacatctgtcctgtttctaccagtttcagctaatgatcaatttgaaaatgatctccagattgaaaacaaaggaaactaaaagtaatacataaaactcagcaaattatgtatgtaaataccttttgggtggcaaaacctataattgcaatgtttgatagcaaaacatggatctatcttctcttctcaacagttcattgctagacttcccgcactatgatcaactttggaatatcagttgctcaagtttacagatgttaacgaggcccaatgtctactacacatccaggcccatcagagcttgtataagcaatccagtgaacaggaaggtgtaaaagggaaaatactctgccaaggaacacaacattgcccagtattgtccaggctaaaaaaaggtagtaatgaacaatgtgtaccactggggagtcaggaggaagcgtgcaaggggctttttaccaggaacaataaaccaaagctgacattattacaaataatcaaacaaataatcaaagcatatttgtccttcagtttacagaagaaaacctgtagttgcagaatactcctgggtcgcagtacagcaattgcaggaatttgggatgacgggatgttagactttttacaaactatatatatcccagaatttttgttgagcttttttcacatgaaaaccaagcaacctacctacaaagaaatccgtggttaagatttacatttctgtactcaccagtttgaaggaacaatttgcaagggcacattggggatccctggactgatctaatggattggatggtactgtgtgatcccccgtttaggtggtagtttccttaatatgaacagcaccaaagctgaaggtacaatctcaaccaactgccaaagagaaaatgaacgctatcaacaagcactcagtaagtacaattattggtctagacatattcaaaataacacgacaaagaaattgcttttgcagtttattcttggcaagccattttttaatgaccattcttacaaaagcaaataaatatggcagtgactgtcttgagtctcaattacttcatacaatctgaatatactccaacagcaaaagcattttgtaaactcattcggcaaaatcaatatgctatagtttggaatgcttatgcacagataagcacatacaatttctgtgttctgccaaataaatagctttcactagtttcctctcttgttttatacaatgtagcaaaaccatttttccttgagtcacattcccaacagaatttcagttcagctctttttgtaaacacaatcacttaattaggatatcagcatacccaccatgtgccccatgttccaatcagggtaaaaacaagcaaaagaaacatatcttccacaagtctatatcacattctagcattatcccttgtttgacaccagttaaaattatgtaagaaatgatttcctcgatgtgaacattcgaacatggcaaattaaaatgaccaacacagagcctctaacattaaacaacaatgacattagaggagatcaagatataaatgccacgagataaacaaaaacaatgtataaaactacaaggttgagtacaaagcaagtgaacaggaagacataccaagtagtagaagaagtttaggattggatggttcagaacatcaagatcggcttctttatcaaacgcatttaagcacatctgtaagatgctctaattaagtggagtaattaaagtctgaagacctccctaacataatattgacataggacgtaccattacgcatctgatcaagaagccagaaaagcatatggttgtcacatatccaacctatgaaaaagtagatgtgttagaaatgcaaattatctaaagtattaattctggaatagaagccaatgataaaagatagtacctcattcaactttttacgccttccttttgattcaactggaaaacgctgtaacatcagaaatagcctacaaagataaccacaaaattacactaagtaacatgctatgaaaagaatcaccgcaaccagtacccaataactgcacacccacccaggcatgcctacttccaatttccaaataatccaatatacaaaagctcatggacataacatgtgggaaataacttcagaagcatactaatttcttgtccataattcaaaagacaaacacccaaaacaacaaaaataagaaaaccaaggacagcttacctccctccatagagaagaaatccaagggcagcaaataaagatgtcgctggcaaataactttgtattagtagaataaatgataaattatcatgtataacaagaaaactcaaaattgcactacgcctggtttatcatgactcaatgtatttccttcatgttcattaatatttaggggatgtgaggaactaaacgtacgcgagaatttttttaacttatgatcagatagttttcccatctatctccagctatgatttccacaagctctcattcaaaataaaaaatccatactaactgcaagacaaggcaaattacacaagatttacctgcaaagaacatcttagacaagatgaccattgctcgaactggtttccaccacaacgccatccaaagtattatctgaaaatcatgcaaagatcagatcattccaaaagtacttcaaaaaggaaaggtagcaaaactttgtgtaattctatgtattgaaatatgctctcaatacggtagaaatttgtgaacatgtccacactgaaaaatgctctgaatggcaagtggtaggttaatttgacatccatgcccaccaaaatgtagcacaacagaaagtgtacatccagggagtccccacaagctaacagccatcattgtctccacaataaaataaactatttgtgcaatgatgagtaattgtacattatgcagtcaagatttagtcagttggaatcatgctacgctaactaacttatttcgagggttttatgatagtgtttgctttattttctctgtttaaccttttttctgatagcatactatcaaacataacaattcaattgggactcatccaatcactttacattatcaatggatgatccgtccagtaacaagttttccaattgtcatgataatgagtttcatgtatgagtttgtagagagaagcaattatatcaacagtaagaaatgtggatggcaaagtcacctggattgcatagaccactccattgattgtataaaaagctggtctgagcccatcagtagacattgcccgtgcctaacaaatgccatcatgaaccaatgagaacaaaaacacccatgggacaaaaccaaaatatatccaagtaaaactaacctgatagtaaatctcagcccagaagagcactaacagagcataggttgtgaagaatgcaagccccggaaaatcaatgagcacatgttgaaatacctacaatgccatatggttacgcatcattcctactttgcaccttcgaaaaaaattgcagaaacaagtcagagaaacataaactgttccccccacaaacctcaggctgcacaagttgcacatctcgtcggagcacaaacacgattgaccgcactgaaacaaaccagtccaaaatcataaactgaagttccgaaaaagctagcatgtatcaatgaagcagtggcaaagtgcaaaagtatgctcacctccattcacaataaagttcatgaaatggaacaccttctgtgtcgtccatccgtactcaggtactctacattcgattctgatcaattggacctgcaaaaattctcccaaaagtgcaaacgactcaaatgagactgatgcccatgtctccatcactatacaattcaagcatacggtaagctacaaagttcccgcacaaaacatcagcttaaatcaaatctaagccctcgatcgagacaattaaagacgaaacttccaaactgctcggctacacgacccaatatcctcccctattattagcccatgtttttcaaaacctaaatcgattctaacgtgtcccgtagggctagggcttaccagcgcgacgaacgagacggcgccgtatagcgtggcgagggcgtggaaggagcggtcctgccacatcggcgagttgttcacgtcgttccaccagtccggtgccaccgccgccgccgtcgaagccgccatggccgcacccaccacaaccaccaccacctcctcgccaatcaggggcgcgccggaggcagcagaatcaaatcaaaattcagggctacgagatgcggcgcgcaaggcgtgatgcgtgcgagaggattgcgaaggtttcgacgcaatcaacagaaattttatcgaaaagcgagtggattctggattggggattggggatttcgggaaatcggcgtcgatttcgtcagcgtgggagccttgcgggaaaggggaaaggagcctttgccgtgcggtgaggaggagatcggccaagttttttccggtttttttctcatccgtgttcagggcttcaggccaatatgctactcgaggcgtcgtcacggcccatgtaaacatatgggccgaaattttagttttttaatttacagcctatacacacgtgaattggagtagaacgtgaggagatgagcttatacatgaacaccacaaaaaccacctgattttagtttgaaacctcaaagatagattgaattcttatgctcaaacgttcgtgtgtgttatgatttttgagagtggaatttctgaatcgagtgcctatatatctgataaagttggaagagtgaactcagggtgtgattagttcacactaaaattgaaagtttggttgaaattggaatgatgtaatagaaaagttagaagtgtgtgtagaaaagttttgatgtgatgaaaaagttagaagttcaaataaaaagtttgtaactaaaatcggtcctcaattttgaactgaagagctcgaagctagtagtaagccttttaattttagggtcactattgttggcggctgagttttggcagctggtggcctggtgtatgttccgcaggctccacgaacaccatcatgctcccgtcctattcccaggctttttctctctgtggtggctggagtagtactatccatcaaatcatcgtgcagatgcagccagcagtggagaatatttaaactggcataaccacaatcaccaacgaccaaacctagctgctgctagctatagctacgagcacaagaagataccctggctggcatcccattcgttgctatactcacacggaggaacatcatcacatgaattgtccatggaaacccgattctcagaattatccatatttatgaatttaactacggctgtgtttagatccaaa

SEQ ID NO: 55133 - DNA, 2452 bp, Oryza sativa
  unsure (1)..(2452): unsure at all n locations
ttatccaatatgaatcgaagcccatagtagtaaaaattggcaatttaacatttgtcatttggaagtctagagtagcaaattttatcaaaaaagcacgttgggagccgtgctctctctctctttgctagtaaaatgacaaaactttaccatgcatctatgcaccaattagtaaaacttcaatgccaaattttttaccgccaaaacttttgccaaaaaaatttgtcacaacaaattgatctaaacccttagttgccaagattcaaaaactttttatgataattgagatttgcaaactatacctctgagcttcatgagagcatgcttcacgaccctctcgcagcctgagcagcacatccgaaccttgagctccactgtctgggggaaaacagaggagacaaccgttcatattttactgtatgtactcgcatgcagcaattcaatcaatcgcacgcatgaatgatacatacacctactgtagtattttgctactggtacgagtacatttttactgtctccaacaccggcgcatgcggcaagccgagggaaaagtttcccttgtcctatgtaagttgccctttttttttccttcaaccttttatcgctctctttttcgcacgcatgcatgagcttggtttcgcgggctgttctagacagcaacgtgcacagcagcacagattatcgctacgagcatatgctaggaaattaattagcgttaagctaggagacagcatcagaagtggcggacaaaaatctgaggagaataatctgaacacgactagtcgcaatcgcaatatcgcataaacaagctagcttgcaaatacgtattcatctgaacaaagaatatgtccgtcttctgcatgcgtagcatagctaaacagaggaagcgaggaacagagcaagcaaagcaagaacgaacgagcaagctgaagaagaacaaatacctgcagtgacagtggcctgctcctgcccatcctgcgtccggcgaggccaccctcgtagtagtaggtgttggtgctcgtcgggtggctgctgtagtagtacgcgccggcgcggtggccgtgccggtggccgccggtgggggagaagcagcagtagaggaacgacgacagcgcggaggagacggtcgacatggccggcagctcaccgccgcaccaaattataccaccggaaaagagacagtggagtgcacggcaagctcgagcaaagcttaagctaagctaagctgagctgagctaacctctcgctgcaggttaacctgaatcttagccaagagggttaatcttctgcttgctgcttcagctgtaactgcaaggagaacaaaacaaaaatgctcaaagtgttttcttgcttctgctactacttctgcttttattctcctcgatcactgctactgccttgctcgatggtgcaatggttttatacttttttataggcttttttttgggggaggaagaggagaagagggtgttgcagtggcagtgtagtgtagaacccttgcctttccccctcattttattgcttgaaatgggggtgaaagggggcccccggtttgtgaggaaagggcgtaggattgatccagtacacctgttctgccacatcatccgtggattaatccttggaatcttgttacaggtaagtactaattatgctagaaaaagagagacgagtattctcaagatgcagggaaatgagctggcgaatgatgctcgtgtctagcctttttgcatcagaacggacacgaatggcagcgagtgtcttttggtgaagttcacatttcagcgttcccgtttcttcatgtttctttacaaattacaataccaattgtccaacaacagaacaatggtcggaaattcagaatcacgcatgcaaggtgtcattttttttccctttcgaaactcacgctcgattgcaacgcctactaaacactcagagacactgtcactgcaaagcgtgggagacaagagattatgtaaatgcaggcttatcaagtgtttagtatcaagagtgtttagtgactgatttctctgcaaaaacgaagtgtttgcttagtgattgaccggctgagagaagtggtgcagaaggcaggaaaagtgtttgttggaggaatatatgtcaggtttgggaggaaaggcaaagttctctgaaatattctaaaaaatctcgcgactctttttttcttctcttcttcagatttcaagccagtgtcgctttggaacgagttccaaagctcgtgcctccctcaatgatattatgccttgtgcttattctgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 55134 - DNA, 1015 bp, Oryza sativa
ctgcagcccttgtattttggttgaaattagagatgatgtgactgaaaagttgtgtatgtatgacaggttgatgtgatagaaaaggactgaagtttagatccaaactttggaactaaacacagcctactaaccagtatttatccatatttatgaatttaactagtagtatttaatagagacatcaatacgatgttggtatattagaaacaaaaaaatactacttttaaaaaacgatattcgatcaattggctttagtttcgggcccattgacaatttgcagatcgacagagagtacgtacgtacacagagcctggctttccattgtgtaacccgtaaagggcgccactactcattcgatattgccacactgactgactgactttagcatctgctactactactactccatggacacacagcacactacctgacctgtcaccacggcgccgagcacaagagagaacacacaatgatgatcacacacactcgatcgatctcactgctactagtagtagtagtagtacgcgtgcaatgcgaggcgggcatgggaatttttttacatgatggagcaggcgttgacgtcgtcgtcgttgaagaggttgctgacggggtcggcgccgcggtggggctccgggaggtggccgtgcttgtcgccgttgtagccgtggcggtagtagttgtagctggggcggaaggactcctcgtcgtggaagtagtccttggccgacgtgaagtagagcggcaggtctgggtttggccagaactccgccttcttccccgcccgcctcacctccttcagcacccgctgcctctccacgtaccccgtcaccgtcaccttctccatctccaactccacctccaccgaatcaacccctacatgcatgcaaatttcaccaaattaagccatgtttagttgctccaaaatgacaaaagttatactgttttggagcactttttatcaatatgaatcgaagccatagtagtaaaaattggcaatttaacatttgtcatttgg

SEQ ID NO: 55135 - DNA, 4142 bp, Oryza sativa
  unsure (1)..(4142): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcacagtcatggcgagcagcaggcggcagcagcacaagggttcgtggtcgtggacgtcgcgggtggcggcggcggcggacgcggcgtcgtggtgcctggcgctgtcgctggtggcgctgctgctggtgtgctcgctcggggccggtggcgccgccggcggcgagcagcggggtggtgtggcggcggtgttgcgcggcgcggcgctgtcggcgcgggcgtgcgaggagatctacgtggtggcggagggggagacgctgcacagcatcagcgacaagtgcggcgacccgtacatcctggagcagaacccgcacgtccacgaccccgacgacgtcttccccggcctcgtcatcaagatcacgccgtccaagcccaggtagattaccacaaatcacatcgacacgggatatggactccatcgccactcgagggatgaactggtcaacgtgtatgaaacacacaagtgttcgtccgagagcatcgcgcaggcctggaatggatcgatgcatcaaaacgcgcgatctggattcgatcgatgtatctctgcaaatgtaactggcaaggaacatcagttctgatatgtgaatatacacgcgatcctagtgcaattctatgagtagcttcctctgttgttttggtccaaactccaaaggaaactcttgtttccttcggcatctgtttctcgcatgacaaggcggcggtgaccgcggagagagggacacgcagcggatggggtggtggcacgtaagaccaacggctacgtacgtcgtccttagccgtttcgttagcttgtccttacatgtgctgtgctacagttgagttgatctgatctgaggttgggtgtaccggagcagtacacgtgctgtcgtatgcaggctcttgcctgtatctaaacaggtgaaaccaatggaaggaagattccagctactccctttgtaccgttggagagaggctccagtgacagtggagacccggccccttcagttgccacttgccagacgagggccccgcgtcctcgacccaaacgtgcccgtaggagtaaccggcggtgcggtttgtcaaatttcatccggatttaatttttcaaaatgaagagaaaattcagaatataatcctgtaagtagtacttaaattgtaatactatttggtgaagaattcttttgtacaaaagagaaagttaacatagccaaactggtaatgacttaaaatgacaaaagaataaatgggattcttaattcaattgttgaatgcaaaaaaaacatagcaaaggtcatgccgaattttcctatattacatcaataggtcagttctacatgttctaaatgtctcctatatatattcttataattttcgccctaaattttctacgtactgcttttttttttttaaaaaaaaaataaaccaaactgctctggaccataaggtaaacgttccaaaacagtgaaaccaccgccggcttaaaaatattgaattccaattttttgaacgctaatttcacggggttatttgcgctgtattcatgataccatgggaagctagtgacagaaggccctattcagtggatgcacatcctctacagtactgctgctgcaatagcagtggctgacatgtggacccgacccccacattagcgtctgctactgcatcagcagtacggcagacaatccctactgtgattccgttaatctctctaacaagagaattaagggggatttagaacgaattaattccacatctattgtagcgtggagatattccaatcaatccctctaaactaacaaacagccaaacggtatggtaacctggccggtacgcgtgcaaccaaggcgatttcaagccacacgctagctgcgttcataacaggataagatagctcaaggtcaggcgaacagaaatagagagaacataactacctgaacctccctttcatgtaagctcagtcttcagaacaaaatcatggctactttatgccactctgctcataccagaacattcggaaagattggcaggagaaatgcagcaaaggtcctctgctcaacgcagatgccgccatctcagagcacaatcaaggtactgtgggttatgacattatgaatgttcttctctaatagcactgcaacttcctctgaaggcaaaatctggtggtatattgaaaaggttgttatcattggggcgacaaaagagattggaagaacggcaatagcggcagtaagtaaagcaaggggaatggagcttgcaggggccatagattctcagtgtataggcctagatgcaggagaggtattcaccattcactcaatgcgccatttcccttgtaattaggctgtctccctgctgcaatagctgcttgttctttgtctcttacagtttataaatgccggcattgttcttctagataagtggcatggaagaagccctggaaattccggtgctcaatgatctcacaatggttctgggctcaattgcacaagtattggcctcttcattgtactataaaatgcttatatccacttgtacagttgtactgttatacacttcacgggtttgctatttgaaacttatgttctttcagaccagagcaactggagtggtggttgattttagtgaaccttcaactgtttatgataatgtcaaacaggtaagcaatccacctacaagatggggaaaaaagtaagttacattgtaaagtgagattgtgaaataccggactatacaaagtacgcaccaatgtgatccattcaacgggaagcatcatggcaatataactgaatcttgtccaaagtataaccttattaatctagaaagttacattattatcgattcatgagtatatatgagccaaagaattatttgttttatatgagccaaagaattatttgcttcataaccaaataacagaaaaatgtaacagttcacatagaatgagctatccagtaccagtgaccaggaccacaggagtgcactctaattcaataagcacactgcccaacactgataaagaagtataatgccattcagattctgtacaatcctctgaaatctaattctgtacatggttcataaacaggcagcggcatttggtttaaacagtgtggtgtacgttccaaaaattgagttagatacagtaactgagctgtcagcattctgcgagaaggcaagcatggtaacactacatatcattattgcatttatcatatatgtaccgctttaacaacattggttattatcagggttgcatttatcatatatcttgtgctgatttcattatcagggttgcttggtcacaccaacattatcaattggctcagtgctcctacagcaagctgctatccaggcctcgttccactacaacaacgtcgagatagtggaatcaagacctaacccatcggtaataggcttttccatgtaactcttaattcaccatataaatatgccttctaaaaccaccagatacagaacatcatgtgcaataaacattgtatattctaacaatcaatcaaatgccaaaggaaaaggcacaacatcatctatcagcattagaagaactcttgtcaatacttagttacatactagacaagtgctcaggtgtgcaaaggctgatagactaatgtttgaaattgacaggatttgccatcgcaagatgcaatacagattgcaaataatataacagatcttggtcagatatacaacagggaagatatggactccgataatccagtaagtgtgagaaaaatattttgcattgctatttatctaatgatacagaaacgggcattgcaatctgttcagttcattctaaaacagtgaaagtacaaactggaatcagttttcacctctataacagcttacagctgcacaatattgtttcacaaaactaatggacaaatgttttggaaaaggcaaggg

SEQ ID NO: 55136 - DNA, 5415 bp, Oryza sativa
taactggcgccaaactttctgttgtgcagatgatataatgcattttcactgaagaaaaattctatcttttgcagaacttgatttatggtctggagaagttcttgtaggattttattagaatgctggtaggaattttcatcccacatatcaagagaaatacaagctatggatattcatggtaaggataatgcaaaacagtaagaaagccagcaggtattacaagactatgggacaagaaagatgcgaagaatggctccaccaaacatgactgaatttttttatgcagatgttacccaagatacacaatcttgctgcaagttcaaggtggaaaccaaacacatgtcagcaatattcgggaaagcaaccatggtgataaccattgtcaccaaaattgagccaattaataaatgagtggttgaattgactcaaggcctcaagcatatgagttccatcacagaacataagggaactctagctgtaaggaactatgtttggtcctgggtgatgctgacgcaaaatgtttataacaatgcatggtgcgttgatagggaactgttttgatcccttgagatgaagtgatgtccccttgtttgtaaaacccatcaaaatagttatgagtaacctttaaaccaatttgcgccattcatacagcatacatataccactccacgaaatcttaggtctaaactcaactcgcgcattaagacatataaaaaagaagacaaattcagcgtatgaataatagtggtactattgttctttttcccctcaatgtataggtcgaatttaaacatgatttttggtggagagatagatgttactaaactctacattgttaaaaaaaaaaactagatgttacccgtatatcacatatgcacaaaggcaatcatcaacaaggtgacgcagtctctagtctgtacaggagagttgcttaccgtagccaaaatgtgatgactgatcaaccggggtcaccgtcttcactcttcagttcttcacgaagcaatcgcgaccgccaagaaaccgaaattctttaagatagaaaaccaaagaccgatggttcggtctaaaccatcggtctgattgtggcgaccgatctggcgtggaggtagccggtaggcagcggcgcggcggctggattgcagtgcagaaggcggcggcgcggcggagatgcgggagtaggacgaggtaccgcgcggggagccgcttgccgtcgcggtggactcacggaggacgccggagtggtcggagcgaaaaggcggcgctgattcctgctgctactagacgccgacgggcgacggcaagcacgaagggaagttagcggcggtggaggtcggactcctccgggaagcagtccacggagggttttgctggccgctgccgacgttgagctcgacgccatggctgcggcctttcgagccttcgaggaatagtagatttgggcccaataattgagtgatttggcccagtccaggaactagtaagtactctgcagagtacgcagaaaaatagtctccacgttggtgaactcgttgcttgatgggaacgcatgcaaaggctctgatcgacgctgatctcaaatatttcgaccaccattgcccgtattcctcggtgtccatctttgacatctgctgcaccctaattggtatctactcctcatctaatcgaatcgcaactcgtcatgtataaattaactccacacctcctcctttatcttcaaatctcaagattactctgccaaaatggcgcctggtcataggcacggctcagtgccaccagtggtgttactcctactagtagccactgtgcttggctccctctgccttagcctcaccgcttcacccgaaggtacatgagaaatcacgtacgtgttgctcatgtgttgtgttttttttatagaactttgacaatgtggtcgtgcgtgtgtcgtggcagcgcaaaaagggtacaattttcggttcgcgaggcacgcgcgggacgcgccgctggtgtcatattacaactacatcgtcgtcggcggcggcacggccgggtgcccgctggcggcgacgctgtcggagcggtcgcgcgtgctcctcctggagcgcggcggcctcccctacggcaaccgcaacgtgtccagcgagtaccacttcgccgacgcgctggccgacacgtcgccgaggtccccggcccagcggttcgtctccgaggacggcgtcgtgaacgcccgggcgcgcgtgctcggcggcggcagctgcctcaacgccggcttctacacccgcgccagcagcggctacgtgcgcgccgccggctgggacccccgcctcgtcaacgcgtcgtaccggtgggtggagcgcgagctggtgttccgccccgacgtgccgcggtggcagtgcgcgctgcgcgagggcctcctccaggccggcgtcacgccggacaacggctacacgctcgaacacgtccagggcaccaagatcggcggcaccatcttcgaccgcgccggccgccgccacaccgccgccgacttcctccggcgagcccacccgaggcggctcaccgtgttcctccgcgccaccgtgtcgcagatcctcttccgacgcaccggcacgtaatcgtcaacttgcatggtttgcgcaaccattttttagctctaaaactgacacgacaagtgtttgcagagggcacggcgacgccggtggcgtacggggtggtgttcacggacccggcgggcgtgcggcaccacgtgtacctgcgtggcggcgccaagagcgaggtgatcgtgacggcggggacgctggggagcccgcagctgctgatgctgagcggcgtcgggccgcgcggggagctggagaagcacggcatcctccccgtgctggaccagcccagggtcgggcagggcgtggcggacaaccccatgaactcggtgttcgtcccctccccggtgcccgtcgcgctctccctcgtccagatcgtcggcgtctcccgcttcggcaccttcatcgagggcgtcagcggctcgcagttcggcatcccgctccacggccgcgccgcctcccgccgcgcccgcagcttcggcatgttctcccccatggtacgttaggctagctagctgcatgcagcgtgcaaactaattaatggatgtttcattacgaggcagacggggcagctggggacggtgccgccgaaggagcggacgccggaggcgatgcggcgggcggcggaggcgatgcggcggctggacaggcgcgcgttccgcggcgggttcatcctggagaagatcctggggcccatgtcgacggggcacgtcgcgctccgatcagccgaccccgacgcgaacccggccgtgacgttcaactacttccgggacccgcgcgacgtggagcggtgcgtgcgcggcatcgagacgatcgagcgggtggtgcggtcgcgggccttcgcgcggttcacctacgccaacgtcaccgccatggaggccgccgtgcttggccgccgcgccggccacctccccgtcaacctgctgcctcgccgcgccaccgacacgcggccgctgcagcagtattgcagggagacggtgatgaccatctggcactaccacggcggctgccatgtcggcgccgtcgtggaccaggactaccgggtgctcggcgtacgtggcctccgcgtcgtcgacagctcaaccttcaagtactcgcccggcaccaacccgcaggccaccgtcatgatgctcggcaggtaatttaacccaagtgcatgccttcattttcagctaaattttgtttggtttggcgcttgcttggatgaaattcagtcgaacatgcattgcgcacacaggtatatggggctgaagattcagaaggagaggtggacgaggaacgacgagacacattagttagctcttctgatcacttctgcttgatcttattcacggtggcgtacgataatttcttcgtgtagttggtagctttgagagacccagatatttctttcttctttgatagagattgataatagtctgattgtggactaggatctgatcctgtgatccatatgtacttgcagtctagcttgcatgttttctgcattgtttgatagcgttatttagacatgaccacacatccaacattcaattagtattttggtggatatgtgtttgcaactctgcgtcaaatattttcgggattgcctatccatttgtcgggtaatttctagcaaaaaaatcacccaaattttttctacccttagatttacatccaacgagctaaaaaagaaaataacaaatatatatttacttacacggtatttttatcaaaattacagtgtacttacatatcatatcaactgaatttataaatgtaattttagctatataggactgtaattttatattttaaagaaaataacaaatacatatttacttacacaatattttttatcaaaattacagtgcacttacatgtcatatcgacggaatttacaaatgtaattttagttatataggactgtaattttatattttaattaaaataacaaatactcctttcgtattttaatgtgcgatgccgttgactttttgacaaacgtttgacctttcgtcttattcaaaaaaatttatgtagttataatttattttattatgacttgatttatcattaaatgttctttaagcatgacataagtatttttatatttgcataaaatttttgaataagacgagtgatcaaacgttggttaaaaagtcaacggcgtcatacattaaaatatggagggagtacatatttacttacacatcatttttattaaaattacagtgcacttacatgttatgtcaactaaatttacatatctaattttagttaaataggaccgtaattttagttagagaggagaacgtacgagaaatgaagagtgattccgggcggagtttgcgagagagagaagaaagaaacaggcaggcgtgcaaatagaaaatccgtaccgtgaaaaaaaaaaaggggtcggagcatcgaaccacgaccttatcaacatgtgcacaaatcttgttggcttggtgcacacatcgtgtggccgaaatatccgtgaaatcgctggaaacaaatcacccgacagatttctagcgaaatcgaatattttcaggtaggaatccatgtattgaactgtacatctataagcttcagaggtacacttgcccaggtgggcccattcatttatgcgacagcagcaacggcccatgggccttagaaatcacctaatctgcacaaaatgaaatgaaagagcactttggaccttttttttttaccaaagtttcactaggccttgtttaggtcccaaaatctttttttccaaaaacattacatcgaaactttggatgtatacatgcagcattaaatatagataaaaacaaaaactaattgcacaatttgcatgaaaatcgcgaga

SEQ ID NO: 55137 - DNA, 24508 bp, Oryza sativa
  unsure (1)..(24508): unsure at all n locations
ttcgtctcgcggtttccaggcgagttatgaaattagttttttttattcgtgtccgaaaaaacccctgtcgacatccagttaaacattcgatgtgacacccaaaattttcttttcacgaactaaacaaggcgtatatatcactattatccagtattttcactttggaatatatattttcatcttactaataaaatgctcattactttaccatggataaaatgtacgtgcttatttaaatatatgttattcacttaatttaaataaacattagactattatatgatataaaaaatgtcatgaactaatttataggataagcaaaattagtggtggtgagctagtggccaccaccactattgtattttatagtaaagtatagatcgtaatttggactacccaagctacttcttcggcacatcagcaaagctcaaacacattggcgaacttccctacgctgccaaatgccaatatgccatacctttgtcagagtagagattagatatggctaaaagaatagggctgggttagtttaaagtagaacaaaacaaaagctgattagtccaaagtaaatatattaaataaaaagtgatcaaaagtgaaactatagcgataattcaaactacaattcactggaaatgcaacgagtgtagaaaacacaaggaagctttgataagctccttgaacttctccgacggcgagtcggcaccgaataatcacaaatgtaggcgagtaaattatgggcttgtttggtttggagccaatttttatccaaccaaaatcttggtagtgccaaaacattggtaaattttggcactaccaaattaagtagtattcaacttaaactattgtgggtagaatttggtagcaaaccaaatatatacttgctactatttaagttaccaaaattttggtagggtaataaattagaaccaaaccaaacaggccctatacaactgctatacataagatcagacaaagctttcaatctcccatgattcgtcgtggtgtggatggatcaatgatcaatcgatcccgattcccaatctcaagctcccaacaagaactgaattgagttccggcgcgcgttcacgtcggcatacacgtatatactcgacccactcagtgtggcaactgccaaccaactccattgtatcgatctcctctcccatcccatggccctgcgcctcagcctgcagtttcctcctcgtagctttagcacaagcagacgagcaccacctactacctggcacctacccaccccgatccttaacactccttgtgaaaaatgctgctacagaccgcgaagaaaatagtactactagtactatgcatctccccttgtttgtcgtcattgattgtggtcaatcgtatgggtcgtgatatgcagtttgaaattagtactacctccgtcccaaaataagtgcagccataaatatccgtatttagcgctttgaccatccgtcttatttgaaaaatctatgaaaaatattaaaaaaattagttacacataaagtactattcatattttatcatctaataacaataaaaatactaatcataatcttttttcaaataagacgaacggtcaaacgttgaacatgaatagtgctaaaactgcacttattttgggacggagggagtactagaactgttgctgagaaggaggaggaaaggaagtactgtgagcgtgtggaaccccgcatgaatgaagatgctacaatctacaccacccgtgagggaaggcgaacatttgagacttgagagcagagcatagtgtgccgttgtcgtagcgagactccacgaaatcgtgaaatcgtcgattccaattccgcctttctaatcgaaatcaatttaatcgtttggcccacggctgataagaaactttttatgttggtgtttcgtaatctaaagactaatattaaaaactaaacgtgattaaataaacttcaaagtctaaaattttactactaggccgagtttagttctaaaatttttattcaaacttctaacttttccatcacatcaaaacttttctacacacacaaacttctaacttttccgtcacatcgttcaaatttcaaccaaacttgtaattttagcgtgaactaaatacacactagctacgacgcaactgaatcttagggcctgtttagcacagcttcagctccagctccaccccttctgtaggtggagctcagctcccatcggatggcccaataagccaaagaataagccaaattttgaattttcaaacttaattttgagattgatttcgagatattttcaacatagttttttttcaacattggcttttaagttacaaagaacacatatataaaagttttatctataaatttatttttattccctaataaaccgttttggtttattagaaaaaaagccaaccgatggggctttcacaaaataaactagagttatggagctgggtttagcagctacacaacttcactcctaacccaacttctaaagctaaatttagtaccaaacagacccatagctgcaagacgggggatccgattccagtatagaatcatgagacagaatacttgtactactaccactcaagggtctttaccgtgacgccatcagtctgttcatctgcagggtgcttgcttgcatggcagcatggagtcccagactcatcatccagctccggccggtcgacgcaggggaagatggcgccatagatccagattctgtccacgtgttaggatccgagggcaaccagcgaatcgaaggcgataccaccgagggatgtcagctgtcacctcagtaattaccaaataagaacaggtagactattagtcagctacaaatatattttaattttaatgagataaaagataagagaaaagcgcagcagaatacatatctgtagccagctgcagcatgaactccaaaacgtaatgtgtgtatgacaggtgggactatatattaatagtacagtaaataactatggtatgaattggctattagattgactatagacactaaagttaagaaaagaataaccacacacaaaaaaaaaacacaccgtgataaataaacggactgaaggaggaggcggcatgcacagtaggaggcgtatataaaaccgaccggtgcgagaggagaacccgcatcacatccacctcctcctcgctcgatccgctcctgtaggtactcgtactactccaattctttctctcgcctacgccttcctcccaatcttgttgtttcggcggcggcggcggcggcggcggtgagggagatggcggcggagaggaaggacgtgggcattctcgccatggacatctacttcccgcccacctgcgtgctccaggtcagccaccaatcgatctcatctcccgattcttccctactgatcaacctcgtcgatcgtatcatatttctcccactacaatccgtgtttttcttttacaaatttagtcccatgttttcaacttttcataacttgcaaacacgagtgcaatcaaaacaagatttggaggaagaggaatccttcaaatatttttagaagaaaacatgagcgtattgagaattgaacacattatctcgagttaaaaccacacacctcttatcactcaaacagagtgcaatcgcaatctagtcagatcttttgcctttggataaccctttccgttttctcgtttgttcgggagatcgagtaaaaaaacacacacaccctttgcgtgactttctctgcgtaactgtggtggaatcacggttggtgagaggtttactttactaccggtttccggtgaagattttccagctttccacccccttcttcgccagcatcgcagcggggagaaccagccacgtgcgcctgggccacctccgcgcattcggtgaactggagcagagagcaaagaagagttcagagttgcgattccaagtttactccatggctggactatccgtgaaaaaaaaaaagaaagaagcaactaaaaaataatttaccagtaaaacttttataactttggtctcagtggtttaaaagccaatgctaaaatatcaaatataaaccgcgatggaaaaaaatatatatcaaaatcaactttaaaattaagtcagcaaatatatgattgctgtagtgagtactaatcgtgctactcgttgtagcttacgttaccatttaggagtatagtacaggggagattaaagctgccgttttcagggaggcgtgattaattgctgaccgcttacgtgtggaatgtttgcacctgcttctgcttgagttgagagaaattaattaaaatgctgttccgcgggagaatttgctgtggaagatgccaattgaaacagcttggcacagaatcagtagggccttgactcgtttaagattgtgttgacaatcgatcaaatcactagaactagatggtgatggcttccaagacatggcggcttactatgcacatgtgtacattgaattgggtgctgataaaatggtttatgttcttctgccgacgaccgggatatgtcgggaccttttctttatggtagtagttctgtcagtgatataacttgtacagagtggttgtgtgttggcaatatctcaatgctgtacatcatgtcgatattaataatctttatttcgtgtttcacctagtattagactgcaaatgcatgtgatgtttgctacaggacgagctggagaatcatgatggcgtgagcaaagggaagtacaccattgggcttggacaggatagcatggccttttgcactgaagtggaagatgttatttccatgaggtatgcctgttcctatgtagaaaagcaccattggtgtggtagagttgtgtgtcctaccaggctcaaatcctattcctatgcattttcagagaacatgtgcaacatagtatttgtgattctgaagacaaatgtgaccctcaagtgtcctatccgtgccctataaagtcaaacagtgataaactatgctagatccttagccaaggattttatgttgaaattttaatttcaggaataaagacattaatctccattattcatttatcccttttttatgcatttaattgatcgagagtttaacgcagcttgacagtagtgaagtcactcctggaaaactataagattgatccaaaatgtattggacgtttggaagttggcagtgaaacagtaatagacaagagcaagtctataaaaacatggctgatgcaaatatttgaggtttggacctttcagcagaacataggagtacatattatggtttatgtgctttcataaggcttatgacaactttgtttaaatgcaggaatgcggtaatactgacattgaaggagttgactcctcaaatgcatgctacggtggaacagctgctttatttaattgtgttaattgggtcgagagcaactcatgggatggacgttatgggcttgttgtttgcacagacagcgcggtatgtacaactccagtgttaattgggaatacttttcctttcatgtactcaatttcgtactgtacagattaccagtgtacaactccatttcttttcctgggttactgatgatggctatatgagtacatgtattcatatatatcacgtccttgtttttctcattttttttcttagtttctgttattgaccaccaccacaaatccacaagtgtttttccttaagtactgaaggcaagcataatataggtttgctactatggttctcatgcttacattttgcatccaatattaattctatagctgacatttgtctctttaggtttacgctgaaggtccggctcgtccaaccggtggtgcagctgctattgcaatgttgattggaccaaatgctccagtttctttcgaaagcaagtatagaggatctcatatggcacatgtctatgacttttacaagcctgatcttgctagtgaatacccggtctgcctctggcccacacaattcttacacctcaaacccaagttcggattagcacatagagaactagcttgaaataaactggaattgatttatttatggcatctgcaatttgttcaggtggtcgatggaaagctatcacagacatgctatctcatggcattagattcctgctacaatgtcttctgcaaaaagtaagctgtattccatattgctttaacacattagtcaagctgagcctgttgattgaatcagaacccactggttttcatctttcaggtatgaaaagcttgagggaaagcaattttctattcatgatgcagactattttgtatttcactccccatacaacaaggtaccataaaaatctcatatcatgtaccttagtagcatcttggtggtatagtggattacagccacaattgtgcagacacttgatattcacacttatttaaggcatcttattcactgaaagaaatagggcatcttatttaaaaaacttttcaaataaatagaactcgaggttcccgacatgagtagtgagtagaatatatgcatatttagactgattcttgattgcatactgtcacatgacatggatatgctgatcttaccagtctgcacttcgatcttggttaggagtcgcatgctcgcataacttaccttgcccttttgatatgttgatgtaattttcagaacttatttttttcctttttcattgttttctgcagcttgtgcagaagagctttgcacgcctatactacaacgattttctgagaaaatgcaggttggtcggtcatgcttagcatattaggatataggaagacagttgactggagtaatattgttcagtttttagtagttaactagaactaactataacgattttttatgcctgttaattagcacggtggaagatggatcaagagaaaaactggagccttattcaggtttgtcatccgaggaaagctaccagagtagagaacttgaaaaggtgcgaatatttctgcttggtcataccatctggttctggacttttaataagctgcgtggttctgatactaactttcaatatgcaggcttctcagcaagttgcgaagcacctctatgattcaaaggttcaaccaactacattaatcccgaaacaagtcgggaatatgtacacagcgtctctatatgctgctttggcatcagtgatgcataacaaaaatgaaactctggtaaaaaaggaaaagaacacttagccttgtcttcattatattttcatgtgataagattaccacttctcaccctccccttttgacatgtccaggcaggccaaaggattgtcatgttctcatacggcagtggcttgacatcaacaatgttctctttcaagatcaatgaaggccagcatccattcatcctatcaaacattgcaggcatactggatgtctccaagaaactggagtccaggcatgtggtaagtgcagctgctgaccactgcttcatcttgttgactgaaaacctgaaactagtagcttgacatgaacggatgaacctgaattcctgatcaacaaatgctttgggccgcaggttgcgccggagaagttcgtggcggcgctgaagctgatggagcaccggtacggcgccaaggatttcacgacgagccaggacacgagcctgctcgctccaggcacctactacctcacccacgtcgactccatgtacaggaggttctacgccgtcaaaggtcaagccgtcaccgaagtgtccaatggccattgaaaaaattgtgttgtgatgtgtggttcattcaacctgaagctgcaataagccaacggcatagagggttcagggcgtgggtgtaccaagttttctgatgaaagcttgtaaagggtgctaggttagagctgttggattagttggttcgctattcgctagtaaggcttacttggtgaaatggtatctccacttcgttaatgttcttcagtggaacacacggtagcgagctgtaagaattcttaataatctgccgtcccgttcttttctctcccacaagagtaggatgaagattaagattttcgtggcacgcttttcaaactgctaaacagtgcgttttatgcgaaaactttttatatgaaagttgttctaaaatatcatattaatctatttttcaagtttgtaataattaaaactcaatcaatcatacgttaatatcacatcgttttgtgtaaaaaacttaatcttcatcttcaggagaaaaagaacacaccggatcatgtcatgttgattctaagctctatgtttccagtatatcgcctacagatccctttacaaaatattagaactaaaaaaaattggtgcgacgatataagcatttctgatgcattgattttgaaatcgagctatctattttatgtcaaatatttcagttgaccaccaacaaaaaaacattaatttgtacatggtgaaaaaaacataatcccatttgaaatgtttaagaataatgtgaaacacagtgaaatacatgttgaaacatttcgctatcacgcgtgcaacattaaattttaacaattaaaacacatgtttttctttcaccggaatgcaatcacataacatcttgttataaagatttacaacggttttgctatcatgcaacattaaaatttaacggttgaaacacatgatttcctttcattcgaatataatcacatgacatcttgttatgaagatttaattgtaacgaataaaacagtgtattccacgttacaaacctgccgtcgtattagtctctcccttttttccttgttttttttggtcttttctctcttcccttggcataagctggtctgggctggttgcgttgtgtaaacaaacactcttttcttctaatatattgatgtgcaatttttttgcgcgttcgcgaaaaaaaaagaatacaacgatgtactcgaattgtaaaccggattaataatttaagagaagaaaataatttaaagcttaacaatggaatatggttaatttacacggaagaagagaaaaggggtgggagagaaatactagcaacatgcatatgagaacgaagaatatgcggaggaagtagctagtgcgcccgtttattttttggctagatcggacactcgacctgaaccattctgaagagaaatctaaacaatttataattcgaaatttaaccatcgagagaatggtaagaaattccttaagaaaattactattgctgaacagcctagaatatttaaccatcgagtactactgacagaaatagccaaaatggccggcaagtctcagccctaatatgctgatctgtgccgtcgattgcttgatcgaacggtcaggatcatgactgcgttgatgaaaaggggatatgatacgccgccgtggcccgaggccgccgctgcacgcctgcacggtatccccattccataaccattccagcaacagctgtctccttctctctccgccgccggcgaaaccgcaacggcgcagaggagaaaatgtgggaagccgaggagatcgaggacgaggaaactctagaggcgcttctagaagcttcccgaagcgcccagggccgggccgcgctctccgacgccctcgccgacaccctccacctcctgccggcctccacccaccgcctcctgctcctccgcctccgcctcctccgcaacctcctcgccggcgacgacctcaaccagggcaccttcgtcctcctctccggccccgccgcggtcgtctcctccgccctctcctccccctccgactcccccgacgtcgcgcgcgcgggcctccaggcgctgggcaacgccgcgctcgccggggagcaccaccgcgccgccgtctgggatgcgctcttccctggctcgctgctggagctcgcgcgggtcagggagaagggagtcctcgacccactgtgcatggtgatcgacacctgctgctccggcgaaggcggccgcgggaggctcgaggagctctgccacgaggagttagggctgcccatacttgtggaaatcgtcactactgcctggcaaggtgcgtgcgccgcaattagttgatgccttttttttttattcagtaaattcatctggtagatgtcctgcaagctttacacaggtcacacttgctattgtatgatcgtgggagcacgaattgtttagctgtttgtttctgtgaaactaatgtaaatcaacatgagtaggatgtgtgtatgtacactgtaaatcacatcataaggagtaagtaagatgtgcattctgtagacttcagcaatagaaaagtttgcgaactgttagttgttcattagtatgacaggaagtggtaatgtgctggaaaagtttggggaagtaacttgttcattagtatggacaggaattggtaatgtaatatctgggcctttgggtccaattgggtatcagatgctctcctgctagtatgttgagtgtggatagaggaaacggaatttagtaacttaagagggtggtttgtgatatggcattgttgaaatttttagattgacattttggcagataatgcctgttcacctacttcatgtgtggaaatatatcgccactgtgttgttttaagtaaaaggagttcggaccacactatcacaggtttcatatgttacattgaagtaaaaaaatatatatcagtgattggagctgtgatcatgtatatcttcacatagttgcctgcatcatgtctaaagtgctggatctgtgtttcctcacatattgagggcaggatttcacgtaactataacttgagaaataatacagtcatattttttttctttattatgtaactttacttcatagggactccttaggctgttgttgaagttcacattttgctctcaggttgttttatttgtttacatttttaatttatggttactttgatatgagtctaatccgaggtataaaatgcagtggggcatgatgaagaatggttagaatggcttctcttcaaaatctgtgttgaggagcaaaagtttgaaacattgtttgtagctttatgctcacgcaatgatgctgagcacagtgatggtgatgaatgcaaaactgagtttaatgctaagcatgcatatcttttgggtaaattgtcaaaatgtttggctaaccgacctaaagaagtcagtgtatcgatcagttttgcacttgatattttcaatgcacagaagcatgctgctgagattgtggattttacttgccgagttaactctcctcttccaactggtcaccctgcaattgatgtacttggatattcattggtgctcttgaaggatatatgtgcttgggaatcccctccgtcagacacacaggctcctgttgactcactgatgcagactggtcttgtaaagcatcttctaacgtacttacgtgagctagaacccccaagtatgatcagaaaatctatggcaaggggacaaggagatcatcaaccagccttaggaactgcaaaagtctgcccatacattggttacaggagagatgtagtcgctgtgattgctaattgcttgcatagaagcaaaaaagtgcaggatgaggtgaggcacctggatgggattattttactcttgcagcagtgtgttgttgatgaagaaaacccatacttgagggagtggggtctttttgctgtgaagaacttgcttgaaggaaatgaggaaaaccagaaggaggtatctggacttaagatgcaagaagctgttataactccagagattgctgacataggtctaagagtggagatagacaaggaaacaggacatccgaaactggttaataactgatgatgtaagtatctcggaccagaagttaaacttaattacatgtatacatcaactgtatctgcattttcttgtcatcttgtaatcctatgatggtttttgatatatggttggtcccacatctagttttgtagtatttcaaatctcacttatagttctgttatttaaatttgtgcatatattatcttgtgattggcaactatgtgcttgattcataactgagatgtatgttcaaattttcatatgaagaaatttggcttgcatgcaaacattttagtatcttctggcttctaaagttgctgaaagactggtgtttgtgtaaccttggtatgtcaaatgttgcattgcgttgcctgacagcatattttgttgtgcagactttccattttgatccttcatgtttgaggtgaaaagaaaagggagatcagactcacgtaccgacgttcctctcattaacggaagcaaactaatattgccgctgccttctgcacccccgggaagataggtgttgctttttttcattaatgttagtcatgttaatattgatggcgagcatttgaaccaccgggattcagatactttcttggagaaatgaatgctaatggttttttacgttgcatcaaaacagtgatgtgatgagatgtttctagatccactcttatcataggcgtccgttttttaatcctcggcgtgtgctgttatttggtggctaatatgttgatcctggtattctttgatagcctttgggtatttagctttcactgtggctgtcagatttccactgtaatcgctttaagcaaagcatgattcccatgtttggctttcagccgtcctgtttcttatacgtcggcggagctgcagcatatcacagccaatgcagtaacagaagataaaacacaaatttgatgtcatcaccttccaagttcatgttggatcagttacatgctttagtacaaaggtttgtaaaatggaaaagttagccgttcgtctatagcatgctcaggtctatagtacttcaacacaagcatggagaattctccagctaagcaaatacaacatcagaacgaagcacatacttgatattctttttcacaacccgtgcttcatgcagcatgcatttggcaccatgaagatggagtagagccagtccttgcactggagcaacctacaacagaagtaacctcaggttaggggttaggaccagcttcgacggtaatggcagcattataaattgtgatgcagggtagactcatgccagcataataaaggtgatatcatcaaccccatatggatcaccaaacttcaagtgggcaatctcttttcgtcagagcaacgtagtttttcgacaagggtgtcattgatggaattgccaatggagtagatcttgctagtttttgtatagcataagaaattaaatatgtagagggagggtgaatttcgtcttatttattctttatgtatgatcctttcagtttcatgatcatatatgcatctcaacctctttctgacttagctagaaagaacatgtgtgcacattaatttcaaggttaacttccagatgaatgacagactaaacatacaatatatagcttgataccagacccaattttccatagaaccaaacaaaaaacatatgaaatggtctagcaaacagttgatcttataaaacatattgcaatttcagaatcagaaaatacctcagcgacaactcctccacgatgatcataaaaaacagtctcccctccaacaagagcttgccctgatgattcctttgcacttcctttgccagagaggtatattagcaaagtatacaatgttcttgaaccatctccaaggtcgacactctcatcaatatgcctaccgaatcgctgaccttcagtgtacctatgaggatgagcaacaagcagcaatcaagaacagtggcaatttgtccaacagtgtggtgctagtgcatcatctttgttcaacttttgatagcacacatacctgtagaacctgatatttggattcaagctggttgctactttgccagagatgctgatgtcctcaaatattttgtttatcccagattcccaaatggtctgagcaagcaaaggatctgtcacagatatccggtcattatctctataagcttcacccttcaggggtccgaggctgccctggtgcgtgaagccaatattctcagcaatgtcgacaaaggccttcgcctcagcggaagtgaagaagtttggcacctatttcagtttcaagtaaggcaattgtccataaataatagggaaacaattatcaactctgtaatgaaccctgttatgctttcttagtaaagctgggcgcactgcccctgatctaaaaacaattatcaactcagccaaaatattgctatgccaactgaacggtctcttagcattttctccttgtgcatcaaatagcatttcatcctagcatacgcttcatcactttgtattcaggaaatctatttgattactgcatttagaatcaaccgcacaacacaagtagagccaacccagatgattccctaacactcaaatcaaaattggcgctcctggtggttcgcggaaatcaagcatctagtctctaatcgccttctagaagcactaattcgagcagcagtatactagatgcagacatcagaattcagacatggttggggtcaaaaggggaaggtaggcttacggtgaggaggtgggtgcccttgaggcgattgacctggagatccttcttcggcttgaccggtggccacctcccgccgcctccgccgccggaagcgccgcccttcttccccttgttggccgccgaggatttgttccgacgctgctgctgcggcggcggcgcggcgtcccctcccgccgtctccatggctgcagccctcttccgcttcggtggcatcaagctgtgcagcgacttggctacgcggctggtaatcccctcatcaccgttggattcagaagattctcccttcctgacattgaatctggaccgtaggagttgattgctgggtcagatttgaccgcaatcttgacaaattgaaccttctataaaacttatttcaataataaaaccgcggcaaaaattattttgagagatagatcgcgacctagacatgaggtataatgtttttagcaccattatatttgacatgaacatattgaccgatgtgagtatgtgacataatttgttagatcaggattaatcgtgtcacgttagataatatatcagcgcaaatgttaataacattgagatgttatatcaacgaggatggcccctaggtcacgatctatttttaaatagcttttagcgtggtgtattgttgaaataagttttgaaaaagagctattttatcaaaatttcggcagatatgatccaggattccaatctggaagggggtgaagttgataatctaacacgtaggaagggctcttatgcaaatagaacttataaatcatgaccgttcaatcaggatcgaacggtgtacgaatcacgagttcgtgtcggcgagcgtccggcctcacgcgacgggagccggtggagctccggcgagcggcggaattgtatgcgggaggcatcgccggcggagaaccctaatccctcacagggttcgatcttcgcggcagcccgggagcggctggagaccgtgcgccgctgcctgagatcgccggcgagaagcggtgtataccctgccgctgctggagaccaagataagaaacaatctcgcggcgaaatctaagaaatctgtgttgatcccaacccaaaatttcacatcctccaaatcgtaacgaagaaaagagaaaaatctgcacatctacaacgaatgcaacgcgtccagggctgctttcacaagaatcccttctcaagaatcgcaaacgaaaacatctttatcctgtttcatatggtgaggttttcttggatgggcaggaacgtgccgcagatgttgccgccgaggtccgggaacgcggcgcatcccggcaggggcttcaccttgccgtcgcgggcgacgctgacggggtacttgacgaggtgccctctcatctcgctcacctcgctggaggcgaactgcctccagttctgctccccgatgtgccgaacctgcctcgtgcactccaggctctctgggcaactgaagctttcctccaccgctccaatgtgctctgcccacagtgacatcctgtacccgtagatcttcgagctcaccaaaaccaatccatcagcgcaactgtgaaatctgtggaattttgggtgatcaagggatcatttacctgtccacgaggagcagaaagcatgtttgcccatgtgtactggggctggtacgctcccatggcgatctcggtgtctctggttccttccatggatctctggttaatgttagccgatccaattatcacgtattcatcatccacgatcatccctttcgagtgcacatacaccatgaacctccggttcttcttagcttgatcctgaatgtacaggtcgcagcaagacaaatctgaactctgaatgtacggatggcatacaatttgagtatgctgcgagagaagcagaagtactgcagtctcacctggggattgttggctgaacttgatcctctgcaagtgctaggactgccgcctgcttcacgattgccaagacagaagaagttcaggtaatcctgtggctcatatgtgttatccagccctacttctttcaatgccttgtgaattacctcatacatcatttgcattgtttttttctacaatgacaacaacaatgacaacaaataagttacattgctatactgagagaagttagctctgtagaatgtagtagcagatagtacacagttgagcagactagaagacaatgctagagagacgctctaacctgccagtaaagtattctctgtgtaggagcaccagtaggattaccttcaggccacattggaattactatgtacgctgaaaacctctcattggcataaatcttgttggcaattttgagagctatttcaatcggtattaagttattagcacctgcagcagaacaaattttaagtcctgaaattaggggcaaccataagtacttgtcgtatttatttacgtcatgataagggtcaagaaattttgaattattctccaacataaagcagcaaattttaaatgaagttactattagagaacgcaattggaacgtgccataaaaggccagaatacattgagttgaacaacaagatttgaagcaaacaaagctcatgcttacctacatctttatgtgaatcccaattaaatgaagaaccaaggaaatactgattttcaatatagatgaagtgttgagctcctcggattgcattcacataagcggtttgtacgctcatatcaattagtacgtttttcccacaaacgagattctgtcaaccaaaggaaaagtctgtgtcaggtaaatacaaagaataaccaaacatagcataattgggtgaaatttatatcttagttaccttactggttgcttctcttggatttttgggaaaacccttgacagaatttgaatcaattgaccggaatatctgcttccaagttaatactgttcagtgctgtttggtcacatactttgtttatctgtagctgtgaaaacctttgaaggatcttacctgaacatcccatcgctctggatcattgtcacttgaatacacttcatcgtcaatgcttgcaatatcaggtatccttccaatccatagcaatgtgtcattatttgcctttgacaattttttaaccccgctgcgcttggatgcctttaaccagcgctcctcaaagtttgtcaagacatcatatgccgctgggccatcaatcttagaatgcaaatcatgccatggttctcttggcccttgggcatcaagtacctgcaaatacaagatgcgtcaattacaggaactattttcatgtgtataaaccacatacagtgatacaggcacatgaacaataggacaaagtaatctcaccgcaaagtttgggttataatagtcgtccttgtgcaatgtctggagagaccgaaaaagaggatgagtaggtgtatcatatcgtccaccgcataaatcaaggcctccaacaaaagcaactattttccttttatggttgccggcatcagcatccagaatcactgttttctgatgatgtgtaaaaatggttccggtctcctggttcaattttcaactgttaacatcattacatggtccacaagaacagctattttgactaaaaagatgttagctggtgacatgtgtctatatgaagcaaattatggcattcagaggagacaaagcttactgaagaaaacaaattgtaaataaacaacctgctgcttaacccagctgtgccttttcccagcagaacgcgggcagagcagtatctgaactgaagaatgcttgaaaaatctacgggtctcctcatcccgtgtgcccatgtaaccttcctatagagaaaactctgacaacaagtcaagctgtatttgcatgaatatattattcacaggttttcagagatcaatgtgtcactccatcaaccccaactaccattagacaaagcaatgaaatttggaccagaagccaaataagtggtgtgaccatcagtttgatacaagaaacaaatagccgaaaattaattttgtgattgcatgttgcattgtgcataccatctggataccaaggacgttccttgacgttggatcgtcccagacgaggagcagcaccctcaccccctcctgcgacttcctcttcagcagatcgcccagcgagacgccggcgccgccgtcccgcacaagctgaatggtgtggaacaccgaccacccggtgatatagatgagcctcctcgcctgcgatatcgcgtcgtagacatcgtgccagcattggccttgccggtagagcgcgccattgcccagcctgatctccggcagcgagccctccggcacatgcgcgtcctggtacagcgtcacccggccgccgcggcgcagcgggaagtaggtgttggggacgccggcgaagtccgggcccggggtgacgccgtggtggtacatggttagcctcgccacggggatgtactgcaccgacagccgcagcacggcgccgggggcgcacggcttgccggcggcgggatcgaggaccgggtagacgccctcgacgtgctccccggcctcgagctgctcggcggggacgacgacctcgccgatgagctcggcgccgaagacgtcgctgtccttgacgaggaagtggacggcgggcgcctcgtgcgcgacggggatgaggaagtgctgcgcccacacggggttctcgtcgtcgttgacgacgtaggtgcgcgcgacggtggcggacgcgagctgcacagtgacgtaggggtcgctggtcatggcgccgttggccgccttcttcttcttcttcgtcccgaggatgtcgacgacggtcttggagacgatgtccatgtttgggaggttccgcgcctcgtggatccatatgtcaaggctgccgtggagcatcgccgaccgccgcgacgccgacgacgagccccagacgccgtgcccgtgcggccacaccacatccatcccgctccaattcgacgatttcgcgtcaactgttcgtgctgttttaccttgatcgatcgatgatctcgttgcatgtgcctcgtgtacgtcgcatgtcctcctctcctcccggttgatcgctgcttcccctgaaatggaggggagaatgaatgggccgtgggcccatggacaaatgccgtctgatctgtatgtactctccagggcccacttgccgtattgcattgcaccgcgacaagtttgtaatgctgtgccagatcagccgtacgatcaggtgtaagctctgaatcgggacatcacttgcgcgtgcgcttgttgggctcaaaaaatgatacctggggcccacaatattgcgccacgtcagcggctcagggttggcccatataatcacatgggcctgactgccccgtgtgcttggaaaggacgctactcaaaaaatatccaacacaaacacagtgtgtaccccctggaccatatatatcgtcacattcaccgctggcatccgtgtgcatttgatttgattttcatctcttttggtcctctccctgacgccatgggggtgcctttttgcaggtcagtacggtcggtctgtgaatgcaccgctgttgctggctttgggcgcctgcgactcgatgcgagctcatgcctcaagtgtgaggagatcaacaagattctgggagacgcacacgcgcaccaacagtgtcagcgtatgtactcctcggctccaatgctctcaagtcttctcatcaggctttgatcgatcgatctgtatcctctctttctgctgctctctgatgatgtactgtgcagatgatgcgcatctcgtgagctgctactgctctttctgttccaaactctgtgctgagaagttcaatcaacgggcctgaatatatagccatttttggtgtattccgatcgactttttggaacgttttgctgatagggaggagggaatgccggaatggtaggtgcccagcatgaacgtggagggcttgagcgagatgcctggtcataacccggcggatcacgcgagcaaacaccaccaaaacttcggctccacctcctgtttaagcgtggctaaccttttggcaggctggcaggcagctgccaccagcaaaagagtgtacaaaatgagggaattagggatgttgtacctctcctgagaaaatgtgatgccttttcatgcagatccagttctgtttttatctgaaaccatcatgggttatattcatgcgcgccggaggaaagcacaactccaagcaaagttgcttgtactacgtactgtatttgatacctctcccttcttgttggtgatctcgttcctctctacgagcacataggagtagtagaagatagtgacagacaacccagctggttctttcctcccagatgctaaaatgttcgattagtacaaggcgatcgaaaggcacttttctctctagacgaaattagcggtccatgaaggtagcacatgcctcggtttttcgtttttaagtacaccatgtttaatgtttgctccctattagcagctttccaatctcaatgcagcaacagcatgagcaaggcttgtagtaacaaactttgaggtttacaaaccaggaagttaattagatcctacccaccaaagtgtggctagttaatatgctactactaccactacgaaactaaatctgaaacagtacatctttttctttagacctgaacaggcatttgttggtgccatggtgtacctagcaactgttcggtgtgtaggagtatttgttgttaaccgagaaacgagaacagcttcagaaaatgcagcaacacgcatgagacagtacaagtccacaaggtcggaacagtacagaattgctcatctcgctagctcagctcagctctcatgcgtgtacggtgtcgcagcgaatgaaagttacaggctggaaaaattgatgttgccgtctgaaagtgaatgtgggggtaggaacgccataaaaacgaccgagagttatgatccctgtgcgcgtatgacagaacgcgtcttcagtaatggcgaaacccgggctagctatgctattgctatgcatctctgtctctcgttattactcctgtgacgttttctggttggcatacggtccatacggatcgagcaaagcagcggctccataattttacagcagctgcagctggccatcatcagttcacggccttcaaactcgatcgagcaacccaaaggaaaaatctcaagcaaaaaaaggcggtggttttagtgctccatctccgatctccaaacgcgttggaattctcagtgcacatcttaaagcgtactccctccctccgtcaaaaaaaaaaagacaaatcgggaaaaaaagacaaaaagaaaaaaaatttatgtgtccaattttgactgtcggtcttatataaaaattttttataattcgtattttcattgttgttagatgataaaacatgattaatatttttgtatgtgacttgtctttttaatttttttcataattttttcaaataaaacggacagtcaaacgttgggcacggaaaccagggtttgtctttttttttagacggagggagtaggagtactagtccaattgattttatgatctgtaccagtactagattcaattaaacggaatgattgaaatgccggatcgatcgagtcatcttacagactaaaaatccattatttttccagtatttacacaactccgttgcagctgagcttgctgccgttacaacgatcggtagccctatacaacaaatcgatccgtaatacgcctacgtcgccatacgttacgtacaccggacacgtactctgagtgcattctactctcgtcgaacacgagcagagaagctgctgattttgctgctcaattcgatccactacacgacggccttcgctggcggtatcacgatcgggctcctcacgacgtgctcgtcggagacccacttgaggttcccctcgacgccggcgacggccggctgccctgcccaccgcacggtcaccgtgaagctctgcttctcgtacgccctggagaagcgcagcaatggcgggtgcacggtgaccgcgacgttcttgggcatgtccaccacggcggtgtacacggagttggccttcccgacgttggtcacgatgcggtggacggtgatcggctgggacagcagcttcaccaccagcgacgggtagttgagctccgcctcggtgatggccttgagcttggcgcaggagacgcggcggtgggttatctccttcacgccgtcgtcgccgatgccgaggccgcagaggtaggcgatgtagtcgttggtgtggaggtcgtagacgaggcccgggtcgacggcgcgggacgggttgacgtagccggcgcccatggtgtagaagctcgcgctgcggtactgctcgtccttgatcggcacgccgtcgtggtcggcgacgtcggacgacgtcatgatcgccgacttgatcgccgccggggaccatgtcgggtgaaggctcttgatgatggcggcgatgccgctcaggtgcggggtggacatcgacgtgccggactccatgaagaaggagaggctgacgccgtcggcgaactcggtgtgcatctcgccaggggcccacgcggcgaggatgttcatgccgggcccggtgatgtcaggcttcagaacgcccgggctggccttgttcggcccccgggacgagaagaacgcgacggacggcgccggcgacgaccccatcaccgtccccttgaatgtgacgctcgccgtcggcttgggagtggacttgatgtaggacaggatctttgacccggcggcgtagctcccatgcgacgccggcagcacgtgcgcgccggcgaatgtggtgtatccttcgaccggcttgttcatcaggatcatgccggcgccgccgtacgcggacacggtctgtccctgctcgacgtgctcgacaatgctgcggctttcgcagagcaccactttgccgctcacctcctctttgaccagcgtgntgcagtctcgtgagtgggagtcgccgttcaggcccgggaacaccagcggaagctggcgcccggcggtgttgttccgcggctggtacagggactcgccgtcgaacacctggccgttgccgagcgtcaccgtggtgcgtatcgcccggtccatggtgccggccgcgaccgtgagcatccatggcgcgccgttgcccacggtggcggcgactgggccatcattgccagcggcggagctgacaaagatgccatgctccatggccttgaacgtggcgatggcgacgaggtcgtagttgaacggcgcaccgggggacgcgccgatggagaacgagagcacgtcgacgccgtccttgacggcggcgtccagcccggcgatgatgtccatgatggagcaccggctcctggtgcacaccttgtatatggccaggtgcgcgtgcggcgccatcccggacgccgtgccatgggcgttgccgcggacgtcggcattctcgacgaagttgcccgcggccgtgctcgccgtatgcgtgccgtgccccgcgtcgtccaccggcggcgccgtcgcattgaccgcggcgctgccgaaggcgcgcgcgccgatgatcttgttgttgcatccgccgccggagatggccttgaactcgcaggtgcccttccacttcttgggcggcggcggcatcccggcgtcgccgaacgacgggtggctgggcaaaataccggtgtccaggagcccaatcaccacgccccggccgaacccggagcggctccagaacccatcattgccgaggtgaagcccaaggaaccccggcgaatgggtggtcgccaacggcaagaactcctcggggtacagtctgatgcacccctccttcttcctcatcgcctcagcctcgtcgtcggtgagctgcgcggcgaacccggacagcacgtggctgtacgagtaaatgatcctcgggccatcatcccccgccgcctccggcgtggcctccggcagaacgagcggtgccacagctcgaccgagtcggcgacgccgccgtcctccctcgggtcgagatgaaccacgtagttcttcctctcccgcgcgcaggagacaacggccagcatcgctgaggaaacaaccatggacactactacggcgaggaggattcgttgagtcctcatgatgtacactggttggatgctggctcagtggctctcacttgcgacttgtgagtaaaaactggagctgatatgatttgaacaatggggtgcagga

SEQ ID NO: 55138 - DNA, 2341 bp, Oryza sativa
tcctgcacccacattaattttgtatcataaggcgttgatacttgatgcctcgaaattttgtccagatgcgttttgttgcgacatctttgattggagggagcattgacacagcgcaaatgtacattgtgtttgttcatgtcaattcatgtaaatgatccatcaaactgatgatgtaactaataatattcatgcgacatatttgtggcaattagtgcttgcacacatatatttttcgttgatgagatctccatgtcttctagatatgacacctcgatcgacctcttcatgtaaatcatatcgaggatgaacacgagcatatcataaccttgtcagcaacaaaggcggcgtgaggaaggttatctatttgtgagcaactgttttttttttaaaaaaaaaggattataaagcccagttcaaatatcatcctgagtttgagtttgagaaaggctacctatttgccgagcaacacacgggtgcttgtttatcacacacgcttggtgatctgaagatatatagattcaaaatgttaattaatacatgcaaaaatatatagatatacttgccctcataaaaaaaatctatgacattcaaagtgtcatatattactgatcgaagagagtatttatcccctacatatggtgcgtcctgtttcgtacaaccttttgatttttattttcaagtcaaacttactattttttaaaaaaaatagcattatgcgtagcattaaatattttgttccattaaatccaatatgagatatagtttgataatatatttgttttgtcttccaaaacttgataatatatttagtttgaaatagaaaaaaaatcaaaatatccgagaagcttgtagctaccaacgtttataattttggtgaaaaccaaaatttctgatatttcagtagtaaccggaatttcaaatattttgggaatttatttttttaacgaaattatttaaaaatttaataaatttgactaaatgtgaataaattttaaccaaattcttacataaaaatatgaaaaaccaaaaattccgtacaagatatttgcttgccggtgtgagttcgcagggatttccgaaattactgaaattaatttcagatatttcgaactgaaattttaaacctggtagcaacaaactaagggggtgtttgggaactagggacaaaaatttagtccctgtcacaccggatgtttggacgcaaatttagagtattaaacatagattaattataaaatacatttcataaccttggactaattcgcgagacaaatcttttgagcctaattaatacatgattagcctatgtgatgctacagtaaagatttgctaattatggattaattaggcttaaaaaattcgcctcctggattagttctcatttatgaaattagttttttttattagtatatgtttaatactctaaattaatgtctaaacatccgatgtgacatggactaaaaaattttaaccccatctaaacaccccctaataagaaatactttctccgtttcaggttataagacgttttgactttagtcaaagttaaactgttttaagtttgaccaggtttgtagaaaaaagtagcaacattttcaactcaagacaaattcaatatgaaaatatattcaattattaatttggtgaaactaatttagtattataaatattactatatttatctgtaaacttagtcaaatttaaagcagtttgatattgacaaaggtcaaaaacatcctaaaacggagggagtcctaaaactaattaatcaagtctctgctcggcgagctgctacgtcgccgccacctccatcttcccggcgtcgagcaccaccagctccgccgtgcccgccgcctcgtcgtggaccatcaccaccacgtgcccgtcgtcctccctgcctccggtgccggtgccggacgtcgccgacgtcgccggcacgaacgtgggctcgccgctgaaccgtccctcgccgtactcgtgcacggccgcgagctcgccggtgccaaggtccaccttggccacgccgcggcaccgcggccacggctcggcgacggcgaggtaggtgaagcgagtgcggcggccgagcagcgaccggttcaccgtgccggcctcgaggttgagccctggcacgagctcgcgccggctgtaccgccccgtccggaggtcgagccggacctcggacaggacggcgcgcacggaggacaagagcgcgtcgggcggcgtgatacaggagcagacgatgacgacggcgggttcgtcccaggcgttccagatgtggaagcagaagcagcccggcacgtcgaaccacctcattctagagacggcggcgcttggccggaaa

SEQ ID NO: 55139 - DNA, 2515 bp, Oryza sativa
acaggtgggccccacctgtcagcgacaaccaaagaaggagggacacaaaatggactagagggcccgaggcccaatggagagggaggaagcaggccgggaggagacaggatgggacgagcctgagggataggaaacgaacttgggccaaaaatggcccaaagacaaagaaggtgatttttattttttttagatttaattatgattaaatgaactttgtgcttttaaaattatcttttgagctccgaaaattcacgggggattccagagagtatattaaggcatggagaatattacaaaaatatttctagctatgattttttaaaggaaatatttaattcactcattaatttcacttgataaattgcatttaattttaatttaatttctagaaaatatattatttaatgatttttaatcccgaacgaaaatcgaggtgtgacaagaggattggtagtattatgaatctgatgaaaagagaggatgcggaaaacgagaaggatgttggagatgcatcgtctgacgaggatattcccatggtttgcaacaaggatttttcttgcctgattatttcagatggccatcacatgccatgggagtataaggagaatgaggtcgtgcaaggtgctcggtatgctagattggaggatttgaaggaggcggtgaaacattttgttatttctttgcagggagagtttagggtagggaagtcttgcaaaactatgtatgaggttaggtgtgtgacggaggtggactgtccatggcaggttcacgcatacaagggtaaatggaaggattgctggcaattctcgattgttacgaagcatgtgtgccacttataaggagtggagaagtactaccgtaatattacatcagcatccatagcagctgaggtgtatggccatgttatgaagaacctaaactttgaaccaatgtcaatcattatgcacataaaagaaaaaaaaatacaagcacaccatcagctatgcaaaggcatatagggcaaaacagaaggctatagagacaaggtttggcacattcaaagcatcttatgataacttgctgaaattgctagcaataattcagtttaggaatccaggcacctgtatcgaccttcagcactattcatcagctaagaatgatgagggcaatgcaagcattctgcagaaagcattcttctcttttgcagcttgcatcctagcatttgtgcaccgttgcctcatcctttgcattgatggcacattcttaaccggcaaatatagagaccaaattttgacaaccataggtgttgatagcaacaaccaattgttaccagctgcttttgcattcgttgagagtgagaacactgataactagtattggttcctaagacgagtcaaggaacacgttgtgatgggaagaccatatgtttgcttgatacatgactgacacataggcatgacgtgggctattgatgatttgaagcatggtagctctgattacggtgcagccaagtggccagatgttaggaccagatggtgtatgaggcatatgggtgctaacatctacaaacaatttagcaacaagagagtgatggaccttttcaagaggttatgtttacaaaaccagcagaagaagtttaatgagttgtggtacaggttggacgacttgacagctaagcaaacagatgagaacagatcgaagccatagcctgaaggtgatgatgctccagaggcagttggtcatcttacaaatggtccaccacgaatgaagaggaggaaagcatcagaaatttctaaattttcagagtggattgagaaggaaccaaaggagaagtgggctttattgttcgataaggatggttcacgctacaatgtaatgactacaaacttggcagagctatacaactgggtcatgccagacacacgtgcgctcccatttattggcatcgttgagttcattttgcatggcacttgcaagtactttagggattggttgataacagctgggccttccatgttagacaatgggttgatatatgcccacaaagtaaaggagtacattgatgaggatataaagaaggctcggaatcatctaacaatgcctcatggtacgacgaagcatttgtatgatattcaatgtagggataaatcaaggcgtggtatcaactgtaagagagcgttgcaagagtgtgtcctgaaagctgatggaacatgttcgtgctcttgctaaaatccatatttacttcacaagacatgcacacttgtactcgccgctatagcacgcccaaatcaacgctggcggcatcgccagcttgcggcaggctcagtcagtgggacatctaagtaacagggatacaactccaccagattgctatatgctttatagtagtagaattccaattacgatatggacactcaccagcagtgcctgtcgacatcttgaaacaaggaaccacaagaaactaagttcatacagagaatagtaccagtaacaaagttaaaatcacaaactttatgccatgctgggctgcaggaat

SEQ ID NO: 55140 - DNA, 1800 bp, Oryza sativa
gaggacggccagtgtgtgatggctgcgcagcgggaggtgatgtcggtggaggtggagcccggtgaggtggtggcatgtggggactggccgggggagggcgtcggtgcagtgtgcccacgcaccggcggaggtctagatggtggtggagcattggtgtatctgtggtagattggcaggtggtggacggcgggtgaaaacccagctcgtccttgctcggaccgacaacgatggtgctcgagtgtcattccccctcctgagggcgttgtcgtgccgtctcacccctcaagggtggttgccgggcgaaaggtcattctctgcccttttgagaccttggtggatggcggcggcggtgttccgtcgcttatctccttggagacgttgtctaggcatcccctcgccgaaaccacccgagcaattggtgcaagcacgctctagattctcatcctcttgtggtggcgtcttagtttttagaagttggccacgtcggagggcttaggggaagaggtgttccatcttctctctcaccccctctccctatatccttaagacttggatagagttggactttgcgttggttgtaagggtcaagttttgggcgatcttggctgtgttccgttgttggcctagcggcggttagtcacgcttagcggcggccggtccggtgctagcctgctcctggacttgtatgttgacactatcggtgtgtgggtggtagtatattttttcgtttttcctggttacgatcttccatggttgtaattatgtaattttttcctgctttatcaatagaacttcgcccgtctcgtgcgagtcgttaaaaaaaaaaactttatgccatggttcgatgtgttcaaaacagtcttacttttaaaaacagtcttgcttctacagcacactcttgctttgcctgagagctcttgcttctgctacatgaacaagcatcaactatatatgcaacaagcagctggatgcagcttgttagctctggcctgtgaggcgtgcacacagcaagcaagcggtgaggcgtccaaatgcagcgctcaccttcctggagtggagctgcagcatctaggtgccatcaatgcatggaggaggaagaaagaggtctccaagtaaccagaggaggcagcgaggacaaagccgttgccgttcccaggccatcaaaggctcacctcccacgtcgcacggatctggagcctggcgtctttcactcctccgcggtggcacggagcactgtcgacactgcactgggctgaccacagcatacgatacgaacaatctgacggcacggatggaccgcgcgtccctgttcctctacaccacggatgccgcctcgctcctcacttaaccgcccgtggtggggctgcgtcagaactaggcggcctggatgtggaagccgccaaactcgctgttccccgagccgccgccgcatgcaattggttggccctcccatctcgtccgatgcggcgatggcgccagcaagaggtaaggactgagcaactcctgtcgtcgctcaatctggccgtcaccgatcaacatccctggtgcagaacgaaccaccacgccggcacccctcgtcgttaggaacggctcctcgtgcgccggcgaatctccgagcgcgcgcgcggtagggtggagaagggaggttgcagccggatccgagacgccgccaccatcgtctcctcgctgacgccgatcacttctccccgtaccaacaccagatccgcataaatcggaataaataaataaagaaaatgaaaactaggatttatgatgcactggtaaataggtgatgaaatg

SEQ ID NO: 55141 - DNA, 2145 bp, Oryza sativa
accagatccgcataaatcggaataaataaataaagaaaatgaaaactaggatttatgatgcactggtaaataggtgatgaaatgcaatggtaaaaagggactgtccaggcatcactatggtgaattttttttttagttacactcaaatttcttgccgtacgatggagaaacgtgcacgatctccctatcccgaacgagaccctccccgatcgcctcctgcacagtgcgtgcggaactataagtttgtaacccatcattattgcgtgctcgttttgttttgagaaaaagccccgtagatttgcaggttcgatttactgagcccagattgcattggcccacattgcaggaacaaactggacctagatttgtagggaaataagttcacttggactcccatagctagtgaccgaatctgattcgtatctctgaaccacaataccggatatctcgatcactcaattatcaaaacaggtgcaatttgactccctcgacggttttggaacgcagtttcactgatgtgccatctacgtggcggtgttgacttggttttcatcatacgtggcgcttaggtggtattagaattaaaaaatatatgtggaacctatttttcattcaaaaaaagtattgtgggacccacatatcccatatgtcagcctcgctctttaaccccccctctctctctctctctcttccccttgagccgtggcgacaacagagtggtggcggcgggcactggagcggtggcggcggttggcgggcgagggaattgcagcagcgagcggtggcctgcttatcgtcgtgccattggactgaaagggggccgccaatgcccatcaaggtcctcgtgaccttgatgagaataagaagaagccccctcccggtgccgctgccgccgccggcagccccttcgctactccatcgaccatcggctgacccctttgcttacaaaactaacaaaactaggtataggtggtagctctgaagtaagcactgttagctaacaaaactaatctccatcgactgaaatctgctaggtactaacaaaactataaaaaagtaggaattttacaaacaaaactataaaaaactactaatctctattgactgaagttttgtaggcacaaacaaaactaaaaaaaggtaggaattttgcaaacaaaactaaaaaaatactaatctatattgactgaaatttgttaggtactaacagaacttaaaaaatgtagtacaaaactagtactatgtattcattggtgaggcccctcctccccttcctctctctcccgcgccgcttagccgccgcgccgtcgcctagccactcagccgccgctagcgccgcccgcgtcgccgccgatctccgccgccggtcggtcgccgccttgcgccgccgctgcgtcgagccgcgccgccgcgcaccatggccgccgggccggcttgagccaggcccgtgcgcgccgactgcgtgccgccccctccgccgtccgattcaccccgagtggatcggggctgcccgttccgccgccagcgtggtcacctgcgtggctgctgcgtcggtgccacatcggcgccacgtgtgtgccacgtggtgcacctcctttccccgggccgtggacccgatgcaccatgagctggcgcccaaagccactgccatgtggggcccgcatgtcggcaccacccgtctctccctccagggtttaataattgcacaataaatcaattaaggatttttctgtttatagtaaaaacacagtgaatcttctaaaattcatagaaaattcatccgagctccgtttaagcccattcaaggctcagtaaatcaagaaaaatacaaagaatccgttaaaaatggttttgttctctgtttcagtagccttatagcctgtctgcattgtttgccttgtatgtcgtgtagaatccggctctcccgacgctccggtgtacttcgaagttgtagccgaggtcccttcaacagcggagcaaggcaagtcatgcttgtcacttggacatgttgatcgtatattgcaaatgccctattgttttcctttaaatactgcattattttacaatgctaccatgagatgattacctactgtctcagccatactatttgttaccttgttcctttgttagcttggggatataaca

SEQ ID NO: 55142 - DNA, 5489 bp, Oryza sativa
ccaatggtgggttgtgggtgcatggttttgctggttcgcgggacgccctggaagaacttatcgtacttaccacaagccaacgtgggcaacggctgggcttgtagtgtagctttcctctagccgacgctcccaggcaagggtgggcatgatggagcggggtgggccctgcgacggcttctgtcgcttccggattcacctaggcacgagaggggactgcccgttgcccgctggggacaagggtgaaacctgaggtgtggtgtgcttggctagagggggttatgcgaagggtcctgtcatggcctctttccggtatgtcgtggtggcatgtcggcgcacggaaacgtgtcatggggctgtgtcttgtgggtacagttgtacacctctgatcagattcacctctgtgtcttatgggcggtcaacctgattcaccgtgattagtctcagcctagcttagtctaatggaattgaatagttcaggtggttggttgggcctgttgcaacgtggtgtagtgttggacagtggatggttaatattgattaattactacaactgttttactattttcaactactgtttataaatgctagctttatgcaaatgatcccctttagccttcctttggttatatattgcatcatatcctccgttctggtatgacttgttgagtacagtggatagtactcagtcttgctctatctcccaaccctcaaagttcgtgtgtgcgtccgatggtggtttctctgaggagtgggcttcgtccgtgccatcgaggatgcctgtggggtggtgttccggcgacaatccaagtcaaggcttagctcctgttatctttaattttccgttgcattcatgtaagacttttataatgtttgtaagacgtggatctgtaagacagggattttaatgtacattctgcttagaattctattcgggaatttctgggcatgacaagggtcttgtatttatacccacagatgtccccttgtccaattagaaccaagtagacaaatatggatacgatccgagtagtccttgtagtttccaacttgaactttgctcctccctccttatccaaaacaccttccgtatatgaggcatgattccgtataagatttagtatattagaccgagcccaacccaagatcgtggggtatgccttatccataacactgacaagtatctttataagttgatgtgcatattgggatgctaccatgaacttggctaaggctgtccttccaagaaaagcgttgtatgtcgtgttgaaatcggccacatcgaaagtaatcttctcggtacggaagttactggcagagttatcttccctagcagttttgaagacgattcaggtgtgatcttgtggaagggttgttcagaaggctttagctcgcttctggggattcccattacgtcgagggcaccggtgaagagaaggttgattaagctgcccccgtcaattaagacacgtggaactttaatatttctaattgtgggctcaaccactataggatatcatacaggagtagtcttcatggtggggtgatcatcatctgaatttaatcttttgatctgaccaccgtagtttgacatttggcccctaggatatcaaacagacttcacgtttcacctttttgcattctcttttcgaagagtaaggagtgcaaccactgaagatatgagcaacgtggtgaaaggggtctagaaagttagcatcgtcctcggactatggatggctatcctccctctcaacaaacatactcgttggtctcgtgtgagcgccatctattttgccatcgccttctgaaaaacagagtagccagccaaagagtgagaacatgtcttgtttattgggcaccacttttttcctgaagcttcaccttgaatttcaaatcagcactgctgttgggggctcttggtcaatgacgagaacttcggcctcagccttgttctttttgttcctcttgaaggactgcttcgtcttcttgctagttccaggttcttccttctttgctggcaccttgtcatcggacactttctcattgccatcgtttcgtcggagagcttcgtcagcgtcagcacatctgtcaacgatctcgaatagattcataacagaatttattctctttgttgccagctctcttgtatgatataacgatctccgactctagatttgaatgccctgatgacagaagtgtctgtgatgtcagggatagtattacggtattcattgaatcaccgtataaaatccctgagaggttcacctttttttgtctcgtagcatgtagatcgtccttgacctcatgtcttttgtacataccttggaaatttatgacgaattgctttcagagatcgctccatgatccaatagacgacttgagaaggtgtataagccatgagcgggcataacctttcagcacagtcggcaagtaatttcccaacgtgctatcatctatgccagctccgtagaggacggttgaatagacatgaagtaactcctcaggatcggtgttaccgtcatacttctcaacgggtccggaagtttgtgggccatcggacttcccatagataaggcttgaaagctctgtagccacctccaggttagaaatctaatcgacgatcatcatctcgagaacatctccgtggatgtctacttgatgaacatgatgatgaagaagatggatcgctgggatcgggatcccggtgattattgccttcattacgtcgtgggggtgaccgggggtctcttcatccccggttctctcggcggttgcaatttttatggtaactggatgataccccgcgcgttgccgctggaattgaaggggaatcgaagtcaaatttctctaggttaatataaagatcagtatatttgtaaaacgtaacagtaaccaagagagaaagtactaagatatgaagagaatttggagctgtatttgcatggtgatacattagattaagtcatcaagttagttaaatggggaatatccatataacatttattcataaaatgtatatgtaatcgttgcattgtgctgtctggcaaaagtgaagtgatgcaatccaagtcagacatgcacgaagacctcttttatcttaattaatttgctcattatctttttgttgggcagtgtactgcacactgtagagcgtagacgctgagttcaggtatcaaattatcaatgcaagtttcttttaacttaattataagaaaaaaaatgactattgggactaatgaatctcagaacagcgtatgatcgagtagacaacaaagctcctctagcattcttatcatgcacaattagataggaaaaatattgactaatgattatgatcagaatcatatccaacaccaagtaacatttctaattcagaaaataggacagcaaaattttaatggcacgctgttagtagcaatacgtgaactaaaaacagccatagcttaggctgtatagaccctcacaaggtgtagaggccgggtttattataatccattatctaaaaaaacagccatagcccatagctaatgcagaataacggtcctagtaaagaatagatgcaaaattgaatttaccgagaaacgttaagtataaaattaatctagaaaaaaaaggcaaaatcaatcgaaagattaaatccatagcaaatgaagatgcgccaaaactttcagcatccacctaaggactcatttaaatctagcggacataacacacaacacacacatcacatgatagcgaaaatagtaagcgcacctgaggttctgcttgctagagagattagttgccatgcgtacgaatgacctcgctcactctgtggtatctagcgaagtgcaagactccagccgccgccggatgacggcagactcctctccttgcagtgaacctccgatcctacaaccgccggatgcatgtctgggatctggattttggaggcactgcggcacaggcatggcgattgcaggcacacatgcaatgaggatgaatccgactcgtagagatcgatggaatcatatagtaatcacgtagaagagtgcgaattaattaaggatattaattatccgacgctacatctacgtaactggtgaaagttgggaaaaagtgtattgctgttcggatgcatgagttacgcaggatgaagagatgaagcgacgcaacggcgaggcaccaccactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtaacaccaaccgggactaaagatcgagctgaccttttttttttttttgcatggccctgttgctgcatggtttatatatatatatatatataaaccatgcatatatatgtttcaatacatatatatgcatacatatatatatgtatatatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtagtcgctgctagctcagaagataaggaccggtgaattgtgtttccgtcgtagtagaattcacccttgggatcaaggatttcttcgttgatgaatcccatgagttgttcttgaaccgctgcgataaatttcttgtgtgtgatcaggttatccctcatgcgaataaactatatgaatgtatgaaattgattagtaattaaacaagaaatcgttacgtaatgaaattttgaatttatttgtacgtacatcgagctctcttgtggtgatgatttggtctgcaaggcagtggcaatactcacacacgtagtagccgcacaagttagttccctgcttttgctttgcgcactacaaataaatgacaaattaacggcgtgagatctaattaatatactatacagttgtatgtattaatttgaatcggagaaatataaatgtagagcatgtgtactcacaggaaatttgaacttccgcctaagtctttctctccatttgccgcggaccaaatgacggaaccgataccaagcccaacatggagtttaaagctatgattcgtagtagcaattaacataacaagattttcttaattaacagaggaacttatgacggtacctgtctataagttcgaaaaccttgtcaaacgtagactcttttttatccattgagtcatatacgttgacggtgcaggccgacaggtcgaagagtaaaagcacccagtggaatctgcaatgtgcgtgggatgcattacatatgaaacacttaggaagttcgtacgggaatgaaatttggtatgtaggaagacagtaaaat

SEQ ID NO: 55143 - DNA, 2952 bp, Oryza sativa
tcctgcacccctatgaacgttttgtaatgctgcgccttcaggagatggacgagattgtcctctgtttcttgtggatattggtcgagcattgcgacgtttactctccgagggtcgatgaatccagtatcgaaaaccctccgccgtcgggccctttgaatctccattctacaacgataaaagggagtattttattttatatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaatggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaaacgtcaagctcctcttgcgtgcaatcataccccgggtccttgttcttggcggcgtcaactttcgccttcttcgttgcccttgtgtgggcaggcgatggagctgggggggcccttgactttgaaggtgccggaagaggagcttgcggaggagtaggtgtaggagcccgaggaggagtcggtgcaggatcctgaggaggagtcggtgctggagcctgaggtggagacggtgctggcggagcatgaggaggagacggtgcaggatcctgaggaggagatggcggagccggaggagatggtgcacgaacgccgcttgtcgtccagggaggatgatgtaccacctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggataggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggacatgcgttcatcaaccttccttgccacctcttcttgcatgttgagttcgtagctcgatacccggaactctaggtatgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatactaccagaacttcgatcgttccggccaattggctgttgccggttcgatacccctctcaatcaagctagcctccatctcctcccactttggcatcgcgacgctatagcctcctgaccccaagtggtgatggtacttcttcttggcggtattttctttgtttctttccatcatcgcctgcccttgttcacctgtcttatatgcaacgaactcgtcccagtgatcccttagctttgggaatgtgtcgaagttcggtgtatgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccacgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattatatcgtacaatatctgttcctcatcgcggtcagccatctgttgatacaacaaacatctgctaagtcacgagacatttatgttttaagactacaatagtcaattgctacttgtcgcaccaa

SEQ ID NO: 55144 - DNA, 2825 bp, Oryza sativa
tttaaaaatatattaaatttaatacttttaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgatggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtctttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacatgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctactgtcattattgctttccttccgagagttcccttttcccgtagtctcccttcatggcgtgattcaggtaccccgattgggcgaaggtcttcgataaattctacgcaaaattcgatgacctcctctgttccataacccttggcgatgcttgcctctggacaagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaacttaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcgagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgtgatgtttaggcttcgtacggtggtcggccttacgttcgaagtgcttgcctttcttccgtaccgggtggtttgctgcaaggaatcgacgatgacccatgtatacaactttcctacagtgcttaagatacgtactttttgtttcatccatacagtgagtgcaagccttgtaccccttgttggactgtccggataggttgctaagtgcaggccaatcgttgatggttacgaacagcagcgctcgtaggttaaacttctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgc

SEQ ID NO: 55145 - DNA, 8949 bp, Oryza sativa
aaccaaccgggactaaagatcccgggggggcctgacatgacctgacagcattcgaaccgggactaaagatgatctttagtcccggttggtaacacaaaccgggattaaagatcaaatatgcccgttacccttttgaaccgggactaaagatcatctttagccccggtttttattgcatccgggactattgtggaaatcggccgaccgacgaaagatggtttctccaccagtgcacaaacgaatagacggacgatgacgctcttggcctcttgggctctcggcttctcgggtcgccacgcgttagggttgggcgacgtcagaaggaataagttcacttcgtgaccctcaaaagtgatcgaaatctaatccgtgaccctaaaccacaaaatcggatatctcgacccccaactcttaaaaccgatacaatttgactccctcggtggtttcggagggcgatttcgctgacgtggcacctacgtggcagtattgactcggtcttttgtccacgtggcgtttgcgtggcacttaggtggtattagaaataaaaaatatgtgggacccatttatcattcaccaaaagtatgggtgggtcccactgacacgtggggctcatataaatcatatcctcccctctctttctctccgcgagtgtgggacgggggccaatggcgacggagacccaggagcggcactggagcggtgacggaggcgtgcgggtgagggccggagcggcggcggcggcggcggagatcgagaccgccgtggaaggttggccgtcggaaggaagaaaacgagccacgagaacggccgtgtcctcgccatcctcggccccgccaccgcactatccatcgctgcgctccacgccctctctgccggccacgacgcaccggcctccgccgttctcccgccgcgcccacgaacgcgtaagggtcgcctgcgtctcgccaccgcgactcgcgtcggcatcccctcgaagatggcggcatccggcggtggcttcttatgcacctgcgtcggcaaccactactacaaaaatcgtttttctgtacgagtgggtcggtagcttctatgcgggccgcttttggcggcgcctgcataaaccgccccccgggggtcggttgattagccgcatgcgaaaataggcccattatcgcatgcggctgatcttcgcatgcggctgtcctaagcagccgcatgcgataatggatcttcgcatgcggctggcttaagggaccgcatgcgatgatcggccatatatgctcctccaggcccgagcttgaccatttgaaaacgaagctttctctctcctaaagcaagcaccaattaggggggaggttttcaactcgaaatttttgcttgaactctatacgaaaggtgaagaactctctatcctccttcatttggctccatttttgttatatttcgttggtggaaagtggagtttttttaatattttgacaaggtttgttctaactaatttttgcaaaatctagcttcaaaatatatgttttgatgggcaaattttgcatgtaatcaattgtacatactagttacatgtattgttgtatttttttttggagacaaatgcatttaaacttttgtatgaaatacctgcggtctatttttttatttgtaacttttttgcctttatataattagatggatcagtcgtcatggatgtatgagatgtggagaacgcagccgatatttattaaggaagcatctaaatttattgatcaggctaaggcgcatgctttgagggagaatatgacaaagatcttttgtccgtgccgtcattgcaagaatcagaaattgttggtagatcctggtgaaatattgggtcacataatggagtacggattcaccgccaactacaaggtttgaacctatcacagggaattcgccaatccgaaagatgacgatgaagagttatgtttcgagatgaatgaggcagagaattttataatcgaagacatgtcgcgtgaaagaatggttgtcgatgtttccaccgatagtgatgatttcgatggtagttttgatttagaggatatgctacgccatgttaaaccagaggtgctagcgggcaggtcacgaggattggagaattggcaggcattagagaaggcatcgaaggatcttctttacgatgaaacgaagggatgtgataaggatttcacagtcttgcgttcagtgcttgaacttctaagattgaaggctaaacatggatggtcggacacaagttttaatgatctgatgagtttgttgcgtgtgttgcttcctaagcctaactttgtaccatcgaacacgtatcaagcgaagaaactcatatgtcctttatctcttggtgtagaaaagattcatgcttgtaagaatcactgcatattataccgtaaagaatatgcggaattggaatgttgcccaacgtgtggcacaagtcggtataaaatggggaatgggcccgtagattcagagtgtaccgatccagattctgataagggtaagcgcgggaagattccttcaatggtgatgtggtacctaccaattaaggaccgcctgaagcgtctgtactcaaacccgactgatgctgagttgatgagatggcatcaagagagccagaaaatagatggtatgattcgacatcccgccgacgctcgccagtggaagacatttgatgcaaaacacccagaatttgctaaggatcctaggaatgtaaggtttgcattgagcactgatggaatgaacccgtttggtgacataagcagctcgcacagcacatggccagtccttctcacaatgtataatcttccaacatgaatatgtcagaaacgaaagtacattctactcactatcctcatacaaggtccaaaccaacctggaatcgacatagatgttttccttgagcctttgatggaggacatggaggagctttggaaagaggggttacgactatgggatgagtttaagcgggagcacttcaatctacgtgcgatcatattcgttaccatcaatgacctacctgcaaacttttcattatctgggcagattaaagggaagactggatgtctgatatgtctggagaaaacttcatacagatacctgacgtcgtctttgaagacagtgtacatgcgacatcgacggttcctaccacaaagacataggtaccgtaagatggctagattgttcgataatacagtggagaatgacactgccccagtagcaagaggtggtacatacgtgtatgagataacaaagaagattaatgttgtatatggaaagggaaagaagaagacagtaaagaggaagaaagctgatggtgacaacggtactgcgtcgcctttcaagaagcactcaattttcttcaaatatttagattacaggaaggacctagagattcgacatgcaattgatgttatgcacctcgagaagaacgtgtttgatagcaccgttggcacattgctggacatcccgagtaaaacgaaggatggattgaagtcacgtaacaaccttgtatatttgtccatacggcatgaccttcacccagtagtgctgccaaatgggaagaccgagattcctcctgcttgttactcgttgacacttgaagagaaaaaagccttcagtaaatgtttacaaggggttagagtgcctactggtttcacatcgaacatcaggaagctagtatcaatgaaggatttgaccatttcgggatacaatgcgcatgactgtcataggttgctaacggtgttcctaccaattgctataagggcagtcaaaccagtccacacaaaggtggttataacaaagttgtgctactttttcaatcgaatttcgcagaaggtatttgatcctttggaattaggtccgcttcagacatttgccatcgagactgtatgacagcttgagatgtatttcccaccatcatttttagatatgatggagcatttgatcgttcacatcgtccctcagattattgaacttggtccattatacttacatcagatgtgggcctatgagcgttacatgtcgatcctcaaaggctatgtacgcaatcgcgctcatccggaaggatcattgatagaggaatacacaactgaagaggcagtcgagtgttgtatggactacataaaggatgctaatgccattggcattcctgttcatcgacatgaaggtagattgtctggaaggggtactgttggtaggaagcagttcttcaataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctccgtggttgaaagatctaaacctgccagttggtgattctgtggaggaacttactttacaaagactggcatgtgggccttcaagtattgtcaattcatggcaaggttacgacatcaatggatttaccttgagtacgactacgaaggacatgaaaagcactgcacaaaacagtaggatccgtgtcgaagcgattgacacgagtggagaaaagaggtcgtattatgggaccattcaagaaataagggaactggactatggcctaaacatccagatccctgtgctccgttgtgaatgggttaaagacacaataggggtttccgttgatgactacgggctaacgatagtcgatcacagtaaaacaggccacaaggatgatccatgggttttagcagagcgtgtggctcaagtgttttatgtgaaggacccttcagatgaaagaaaaactattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatgtcgtacgttcgagcagatggtgttgccaaggttattaagtcatagttatttcgtaacctttagttctcattgtgttccaaatgtacgtgcatgaatttaggtcccccttatgttgtaatcattagcatgtaacatttgattacgagttttgagcaattttcatgagttttcttagtgccaaaaacatttggaatggataattgtggcgaaatattgggaaaaaaatatatatggacagtttacttagagaaaaaaaatatgagtttttttggtaaaaagatctttccatgcggacgacttaagccagccggatggaaatatctttttcccatgcggccggctttatggcccgcacggaaatatctttttcgcatgcggctggcttaacagcccgcatggaaagatctttttcgcatgcggccggcttatgtcgaccgcatggaaagatattttttccatgcggtcccttaagccgcctgcatgcgatgatctgcgcctatatatagggagcgcggggagccaaaattttctaagtcccggctccagcgaaaccctagccgccaggctgccaaaatttcccaagtcgccgttgccgtcgtccccgccaccgccggctcctccccaaagtcgccccgccccacgccgtcgccgccgccgccgccaggacctctcccccctcgccgtcgccgtcgccgccgccaggtcgccgtcgccgccgcacggacctctcccccctcgccgttgttgccgtcgccgcagcacggacctctcccccctcgccgtcgccgtcaccaccgcacggacctctcccccctcgccgttgccgtcgccgccgccaggacctctcccccctcgccgtcgccgtcgccgccgcacggacctctcccccctcgccgttgccgtcgccgccgccaggtcgtccccgccgccaagtcgtccccgctaccgccggctcctccccgaagtcgccccgcccctcaccgtcgccgacgccgctgccaggacttctaccccctcgccgttgccgtcgctcggtaacatttacttttaaaaaaagaaatgtgaaatgtgcaattgtggattgtggattgtttaattgtgcatcgtggattgtgatatgtgcaattgtggattgtttaattttgagaaggtttaattgtggattgttaaatggagatttatgtttaaattgggacttatgttaaattgggatttatgtataattgggacttttgttaaattggcacctatgttaaattgggacttatgtttaaattgaaacttatgttaaattgagatttatgtatatttgggacttttgttaaattggcacctatgttaaattgtgacttatgtttaaattgagacttatgttatattgggatttatgtataattgggacttttgttaaattggcacctatgtcaaatggagatttctgtttaattgtgactgatgctaaattgggacctatgttaaattgtgacttatgtttaaattgggacttatgttaaattgagaattatgttaaattgggacttatgtgaaattaagttattgggacttatgtgaaaataagttaaattgtgacctatgttaaattgagatttatgtataattaggacttatgtttaattgagatttatgtataattgggacttatgttaaattgggacttatgtcaaattgagacttatgtgaaattgcgttaaattggtacttacgtaaaattgggacttatgtcaaattcttttacgtcaagttggaacatgtcgaacgaaaaggttccatcgaatgcaccaatagcgcctcaagaaggtaacgctcctcaaaattccggtagcaataagcagccagacgcttctagtgaagaaacgtggcgcacaccaagtgacccgtttccaatggaaataacacaagtcgccccccgcgatgatgatccggactacatacctatcgaacaggccgtaagtgttgaaaatcgttagccatgtattattccctaactatgatgtgacatgaacctaatggtgtatagagttacctattctttgcagatggtagtccgacgccgctcgaaacgtaaagccgagaggaacaggacagagcaagaagttgagatggacaccgctacgtctgcacctgaacgtacggagacatctacaagtgcaggcgggagtgggaaaaaaagatgtggtgagagaagcaagaataaattacccaaggaaacttacaacgtgattgctctcgatcaggatgggaagcccgtcgagccaccgatagtgcggtccaagttcagcaacgcatgtggcactctagtcaggacacgttgtcccattaatgtcaagttgtgggaaacagtggacgacaacatcaagacacttctctggaatgagttgcagaagtattttgtgttccctcctggatcagaggtcagggggagagattacgcacttaaaaagatgggagatcgatggcgacagtggaagtccgatctaaatcgggattatgttcagaagaatctcccaccgtttacggattatggacatatatcgcaggctgactgggacacgtttgttgcggatcatacaacagctgaagcattggctttgaggaaaaaaatgtcatacgctggtcacgtcgatcaatggcgggagatcgagcaaagatttgccgcggccggtaagcccctgctggtagaccccatggttgaacgtagcaagaactgggtttgggcgcgtagcacaggtcaagtctcggatgagggagacatactattcgagactccagacatagaagaagtgactactaatttgcagcagatagtcgagaaagaaagatcaggacagttcgtcccacggagggagcgagatcagcttactgcggcgttggggacggctgaacactctggacgtgtaaggggtttgtcctcaaagacaagttggaaggtcgggtttccacaagacgcaccaagttataagaagagagacaaatacaaagaacaactatcggacaagatctatgcgcaagtgaaggaacacttctactcgttggcagctgaaaacccgacagcctttccaaggttattccctgatagccaacaacccacacaatccgcacagcaaacaactaatgtacccagcagtgtaggctcagtgcagacaactaccttccctgtggatagtataactggaccacctccgtgcagtctcatcgtaccaatcggtcgcgctggaaagactaaggaggttgcaatgggttttgcaatacccggacgtcaattccacaacacggcaatccctgaggattacgcaaggatacaggtcgccaaggtccatagcaaccacgtttccttggaactagacatacctacacttgaggggattgaacttctcggtgatgcagtgaatcagtttatcttgtggcaccgcagagacataatcctgagcgcggcctttcctgcagcaggatcttcaaccccatcctcatcacaggcaatgactgctgccgctcctgcaccaccgtcgccttgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcagcgaaggcccagcacacacaaagacaaatgagaaacagcggaagactagggcgacgaccacaggcgcttgacggcaggcacgagctagacaccaaagccttcatcttccaggggctcctcttctgggtttgggaaaaattgagcaagactgagtacaaccaccgtattcaacaagacacacccacaagtacagaataaatgcaagggagtacaaaggagttatactataaagggttagggttgcagtaaacagcatttaaagatatttagttgctcaaaactatttagtaaacacgattctagaactatacaatattat

SEQ ID NO: 55146 - DNA, 8695 bp, Oryza sativa
aagacagtttcagagattcgcagtttcctaggcctcgcaggatattatcggaggtttatagagaatttttccaagattgctaagcccatgacacgactgcttcagaaagatgtgaagtacaagtggtcggaagaatgtgaacagagttttcaagaattgaaaagtcgcttaatatcagctcctattttgattttgcctgatccaaagaagggttttcaagtgtattgcgatgcatccaaacttgggttaggttgtgttttgatgcaagatgggaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcggtagaggtttcgttgcagctttagaagcgaagcccactctaattgatcaagttagagaagcccaaaataatgatcctgatattcaagagatcaagaagaatatgagaagaggaaaagctattggtttcttggaggatgagcacggaacggtatggttgggtgagagaatctgtgtccccgacaacaaagatttaaaggatgcaattctgaaagaagctcacgatactttatactccattcaccctggtagtactaagatgtaccaggatctcaaggaaagattttggtgggcaagtatgaagcgtgaaatcgcagaatacgtagcagtatgtgatgtttgtcagcgagtcaaggcagaacatcagaaacccgccggtttgttgcaacctttgaagattcctgaatggaaatgggaagaaattggtatggattttattactggtttacccagaacgtcatcaggccatgactctatttgggtaatagttgacagacttaccaaagtggctcatttcattccggtaaagacaacttattccggaagtcgcttagcggaattgtatatggcaaggattgtgtgtttgcatggcgtccctaagaagatagtgtctgatcgaggcagtcagtttacttcaaatttttggaagaaactttaggaagagatgggttctaagctgaactttagtactgcttatcatccgcagacagacggacaaaccgaaagggtgaatcaaattttggaagacatgttgagagcttgtgctctagatttcggtggaagttgggataagaatctaccttatgcagaattttcatacaacaacagttatcaagctagtttacagatggctccttacgaagcactgtatggtcggaagtgccgcactccgcttttgtgggatcaaacgggagaacgtcaggttttcggaacggatatcctaagggaagcagaagaaaaggtaaagatcattcaagaaagattgcgtgtggctcagtctcgtcataagagttatgccgacaatcgccgcagagatttgagttttgaagagggagattatgtgtatcttcgtgtcacgcctcttcgaggagttcatcgttttcataccaaaggaaaattggcaccgcgttttgtgggaccttataagattgtcagtagaagaggagaggttgcttatcagttggagttacctcaatctttggcaggagtacataatgtgttccatgtgtcgcaattgaaaaagtgtttaagggtacctaccgaagaagctaatattgagcagatagaagtccaagaggatttgacttatgttgagaaaccaatccgtatcctggaaacaagtgagagaagaaccaggaatcgagttatccgtttttgcaaagtcccgtggagtaatcactcggaagaagaatcaacttgggaacgagaagatgaattgaagtcagctcatccgcacctgttcgccagttcttccgaatctcgaggacgagattctgtttaaggggggtaggtttgtcacaccctgaaaattcaaaatatataaattgttgtttaaatggaatttttagaaataattttaaaagtcttgaaaagaaaatctaattttaattaataaattccaatataaaattgggccagataaaatttcattaaatactttgcttaattctataattcctagatttttctgggatttatttgagctaagaaagtatttttaataaatggaattgcatttaagaaataatttaaattgaaaaaggttttaaaaagtctcttttggctttgggccgaaagtcggcccaaaatcccttctctctcctcagcccagtccggcccagtccgcagccgcccgcgcgagcgcgctgtcgctgacaggtggggcccacccgtcagtcgtcgtcttcctcgggccgaaaccctagtttcgcgccgccgagctgccgtcgccgccgctttccaaatccggccgttcctttccttctccggccgatttgttagaggggaaacaatctccgggatctcctctaccttttctcctttggaatctttggttaaatcgctttggaaagcgtcggagacgagttcgtttcggatcggttttccctctctccaagccgaaggtttccttcgccgttgccgtcgccgtgggccttcgccgccgcctccgagcccctttaaaaggacccccggtgtctcctctacccgtcgcagccctcgccttcgcctctcgtcgccggaagagctgtagcgccgtgtgccctagctttgccgtcgccgccgccgctccagccgtgcgccgccgtcgtttcagccgtcgccgtcgctcgggaagaccgccgtcgtgcttgccaagtcgccgccgtcctcgtccgccccttcgctgccgtcggagaccgccggagcatcgtcgccgtcgtcaacccgaaggtagccgccgcttccttctcgtcgccgtcgtcgtccgttccttttccgccgccgttttggtcaccggtgtgttcgccgcgttgtcctctacgtgctggtgccctccgttggtgccgtggtgccgccgttcgccggcgagtgtccgccgcccgagccgttttcttcgccgagccgccgccgtcgtcggtgatgtcatcgttgacgtcatcgggatcctctcccgtgagccggtcatggaccgatcgatcttggccgtccgatttggatcggatcaatctcggccgtccgttcgcgtgaaccgccgcccatgcgcccggtccaccaaaccctagcccgctgacgcaataaatccccttttccttttcaaaaataattcattattgcgtcataattcaatttaaaccgatttaagtgttttaatccgatttaatctttaaaaattcataactaattcatcttagctccgatttagttggttcaattctctaattttttctaaaattgagatctacacattaaaaatatccacatgtactgttcatgcttgtttatgtgctgttttggtgattttgcttctttttgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttattacaatttgactagttgagctttatttatattggttcaactagatattagatacaattgcttagccctgcttagaaacattagtacacttatgggataactaatgactcactattatttcatgatggcttattgatagttcacgatggtcaatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccggggtggttgttcagaatggttgggcctatacaacagggtatgttgtatagcgttggattaatattgtttaattacttaactgttttatcaaattctcaaatgtttgctaaatgctgcttttgcaaatacaaccatattatgccatcctttgttatcctgtgcacttgcatatttgctgcgtggcttgttgagtatgtcatatactcaccttgcaatcattcatcagaagaagagttctacaatgaggctgatggtgtggaggattaggtgtagccttggtcaagctgcctgtggagtggagccgtctgcgccgtttatttaatttccgctgcttagaactttattgattgagaagaactatctacctctgtaatgacattttattcgcttattaattagagtattatttgtactctattatcaatttgttattgtgtgcctcggctgattcctggacgagggttcacacacatgtaagcgtttggaattttggatagaaattccgggcgtgacaagttggtatcagagcccctttgaccctaggttataccaaatggttacccaaagaagccctctgaaaaatattggaaaagtagaactgttctcctccctttctcttttaattaaccaaactaatggcacatgcacttcataatttttttttaatggttttcattaaaaatttattccagtgttattagtactgtacatctattactgtactaatggctcatttatcagcaaaagttttacaatactgttttatttaatcttgctgcaataaaataaatttagtatgttgattttataatttcctttcatctcttttgaaaccagttattcaaaattacaaaatttgtgacctcgtttccaaatgttttaatttatttcgcaaagcttggtttactttatttacttccctttttactttgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgtacgatgtcctttgtcattggatttgggactgcccctttttatacccagattcctcatgatcgtcatgaagagaagtgccgagtcaaagtcaccttgaacagcaatagtgaagatattccctcagtgatgttcgaagctggaggaagaaactacatccatgcatgtcaggaggtggcaaggatcgccataggagagctccgtgatcgctacagtgatcaattggccgacactgagtatcgttaccatcctcgccaaccccagggaagtgaccgtggcagttatcttgagactgaaggaattgagaattatgttaccacaagacatttggttgagatgttgtgggctatggatgaaagtcgtgcggagactgtgttagcagctcaagatcgtgaagaccggaatcatggtaagatttgcaagttagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtggtggagaaagaagttgccccagctcaagcggatcctccggtcatcatcttaagtagtgatgaagaagaagaatctaagcgcaacaattccaagattgagtgggtagcaacccaagatgatgaagacgagccttcaatcgacctccgatgcttggaagaactagagtgacttgttaagtcgttgtcatagatcgttgtgttagtttgcttgcttaaagtttgcttgtgtgtggctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattctctgtcctaagtagttttccccgttttctcttcttgtgccctgtccatgccagatggtgaacactcgtagcaatgggaatggtcccaacaaccccaataacaacaatggagagaatcccactcttgctcaagttcttgctcaacaaacacagcttatgaacatgatgatgcagcaatttcagaatcagcaaaaccaagggaataatcatgcacctccccagaacaagttagcagaatttcttcgtgtgaggccgcctgttttctctagtaccactaatcctgttgaagctagtgattggctgcatgccatagagaagaagttggatttacttcagtgcactgatcaggagaaggtatcttttgcatcacatcagttgcatggccctgcctctgaatggtgggatcacttccgccttaacaggactactgctgaacctatcacttggcttgaattcaccgctgctttccgaaagacgcatataccatcgggagtagtgtctctcaagaagaaggagttcaggtcgcttactcagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtataatcgcatggagcagaagaaacgtcggattgctcaattcaagacacaacagggaaataatcagaagccgcgtcttactttaggaccccagtctatgccacagggaggttcttcgtctgttgttcgtccgcaacgtcagttcttcaacaacaatgctggcaacaacatccgtaataaagctccacgtcctgttgcagctccagtacagcaacaacctgccaagagggagcaaggcagcaagcccgtggtgtgtttcaactgtggagacccaggacattatgctgacaagtgtccgaagccccgtcgcgtgaaggttgtccctgcccagagtaactctgctgtaccagtatccaaggctcgtgtaaatcatgtcgctgctgcagaagctcaagatgctccagatgtaattttgggtacgttccttgttaactcagttcctgcaacagtacttttcgattctggtgctacacattcattcttatctatgagttttgcgggaaatcatgggatggaagtagaagatcttagacgtcctttgatggttagtaccccaagtaatcaagcactctctttgcaacgtagcccctcggtcagaatagaaattaaaggagtaccatttctggccaatcttatcttgttagaatccaaagaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaagagattcctatagtccgggagtattctgatgtgttcccagatgatttacctggtatgccgcctaaaagggatatagagttcagaatagatttggtacctggaacaactccgatccataagagaccttatcgaatggcagctaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactatcaagaataagtatccactacccaggattgatgatttgtttgatcagcttaaaggtgccactgttttctccaagatagatcttcgatcagggtatcatcagttagaatcaaagaggaagatatacctaagacagcttttaccactaggtatgggttgttcgaatgtactgttatgtcttttggactta

SEQ ID NO: 55147 - DNA, 9964 bp, Oryza sativa
  unsure (1)..(9964): unsure at all n locations
cggaccggagctcggcgggcgacggcggagagagagagcgacggcgcgagctcgattccggcggggagagagagcgacgagtggcggaaacggcggagggaggcacggggagcgtttatatagggttgggagtgagagagggcggtcggatgagggggaaacggccgcggaagatccggccgccattgatgcgccggcgaggtttaggggaaaagatcccgaacgaatccgatggagagagagagggaaaagtggggggaaagagggagggaatcacggggaatatttcccccctcttgattgcacgtggggcggacgggagcggcgggatttgcggcggcggcggcgctagggcacgggcgaggcggcgggagcggcgggaggtaggggatgacgggtgggccccacccgtcagcgagggtggcgggcgggcccgcccgtcagcggcacgcgcgcggggaggaggccggatgggccgcgggggagaggagagagagggagggaggtgggccgagccggcccaagagggggggaaaagactttttagggtttttctttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagggtcgttttgggacgcgacaaacctaccccccttaaacggaatctcgaccccgagattcggaagaactggcgaagagatcgggatgggctgccttcagctcgtcttcacgctcccaagtagcttcttcctcggcgtggttgctccattggaccttgcaaaaacggattacccggttcctggtcctgcgctccatggtgtccaggattttcactggcctctccacgtaggtcaagtcttcgcgaacttcaatttgctctgagtcggcctgctcggatggactcgaagacatttcttgagttgtgacacatggaacacatcgtgcccgttgcccaaggaggcgggcagctccaactggtaagcgacttcttcgcgccgagcaatgatacggaaaggacccacgaaccgaggtgcgagcttcccttttgtctgaaacctgtgcacactcgcaatggcgtgacccgaaggtacacaaaatcgtccactgcgaattccaggttacggcgacggttatctgcataacttttctgccgggactgtgccacctttagattatcccgaatggttctgaccttcgcttcagcttctctcaggatatcagtcccgaacacttgactttccccaacttggtcccacaatagcggtgtccggcatttgcgcccatacaacgcttcataaggtgccatttgtatactggcttggtagctgttattgtaggagaactcggcataggggagactcttatcccaggtcttcccgaaatctaggacacatgcgcgaagcatatcttctaggatctgatttagacgctcggtctgtccatctgtctgcgggtgatacgcggtgctgaaatttaatctggtacccagctcttcttggagcttcttccaaaagtgagaggtgaattggcttcccctatcagatacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcatgagcttcctgaagtatcagctgtttatgttctctgacatccggaacgcatacccgatttccgttccatagggttccatgttcatcctctgtgaaacccgcagctttaccctgtttcatatttttgaggagtccacgcatgtccgggtcgttcttctgagcctcgcggatttgatcgagcaaggtgggcttggcttccaacgcagccaagaatccacgactcactacgctcagattcagggcttccatctgttggttaagttcgggtggaaagccacggacgttaagagtgttgcaatggctctttcgacttagagcgtcagcgaccacgttggccttaccaggatgatagtgaattcccacatcgtaatccttgatgagttctaaccatctcctttgccgaagattcaggtccgactgagtgaagatgtatttcaaactcttatgatcagtatatatttcacagcgattcccaatgagataatgccgccagatttttagagcatgaaccaccgcggctaactccaaatcatgggtagggtagttgccttcatgaggccgtagctggcgggaggcataggccaccacatgaccgtcctgcatgagcacgcaccccaatccttggcgcgaagcgtcacaatacaccatgaagtccttgcgagtatccggcaagattaacactggcgaggaaaccagcttttctttgagagtttggaacgccttctcgcattgcgggctccacacaaatttctcttctttcttcaacaactgtgtcatgggtcgagcgattttggagaagttctcgataaacctccggtagtatcctgccaaacctaagaaactgcgaatttgagtgactgtcttgggttgcttccaatcagtgacggcggtcactgttttggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctctgattgtgagtataccagaatgtcatcaatgaaaaccacaacaaacttatccaagtattccatgaacactttgttcattaagttcatgaagaaggcaggagcattggttaaaccgaatgacatcaccgtgaattcatacagtccgtatcgcgtggtgaatgcggtcttaggaatatcttcttcacgaatacgtaattggtgatatccggaacgaagatcaatcttggagaatacagtggcacctttaagctgatcgaacagatcatcgatccggggaagagggtacttgttttttatggtgacttcattgagagctctgtagtcaacgcacatcctcttcgtcttgtctttcttctccacaaaaatcacaggagcaccccagggggaagtactcggacgtatataccccttttctttcaactcttccaactgtttcttaacttcagccagttcatttgctgccatacggtagggtcgcttgtatagaggagtggttcctggagcaagatctatccggaactcaatctctcgcttgggcggcataccgggtagttcttccggaaacacgtctccgaactctctgacgatggggatttctgacagtcctatctgatgaagttctgaactactgacagaggttgggggtgcaaagaaaacaaccggttgttctggccctgggtacagagtgacagtgcgtctcgcgcaatccactactccttggaattgagccaaccaattcatcccaaggatcacatccaagctcttggtgtctagcagaatcagatccgagggaaaaggaatcccctgaatttctatagggacggcaggactataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggctgtcacgtggttcacacgaccccgaatgacatccttaccaccgttgttggagcggggaggcgcttggccttgctgacgcctcagctttgggcatttatccgcaaagtgccccggctcgaagcagttgaagcacagacgctgcggaccttgagcgtccctgcggctttgaccaggctgcacagttggcataggaggacggggcgcacgagtcccttgttgactctgctgctgctgcggctgtgggacgcgcaccacgaattgaggtcgaggcgcggagcgtggttgctgctgctgttgttcctgctgcgaggaggatccccctggatagggattggtgtagcggaccctttggttagcaccctgttggttgcggaaattcgccaagcggcgcttgtgtgactccagttccttgtgcttgtcttccaagcggatgctcttgtccaccagacgttggaaatccggatagtccccggagactagacggacggacagctcaggatccattcccgccaagaacttctcctgcttttcctcatcttcccgtacatcctccggggcgtaccgggccaggttgttgaactcatgcaaatactccatcacagagcggttgccttgcttcaactctcggaattcccttttcttaagggccacggactccgggcgggncacatgggttctccggaaagcagcggtgaagcgggcccaagtaataggctgcccctctggctgcgtagcctggaaatggtcccaccatagagatgcgggcccctgcagctggtgggcggcgaagatgactttctcctcatcgctgcactgcacagtgtctagctttttccccacggcatgcaaccaatccaacgcatccacggggttgttggagctagagaaggtaggtggacggatgcggaggaactcggcgagtttagagtgttgtgggggtggtggtggagcattctgttgtggcggattttggaggtggtggaggaaagcagtcatcatgttggcctgctgggcgaggatttgagtgagaatggcgttggtgtctggtggtggtggtggaggcggaggaggaggtggaggtgggctgccctggtggttgtggttgctgccttcagattggttgccctcaccggtggcagcacttctcctggtcgtcaccatctgaaaaccccacccaaaaccagcaaacagagagagctgacaattaaagctaaccatccacgactaccataattcttgaatttattactgctattaaattggttcattaaagttcaagttgcttaagcaaataaaataaagacaggctccgacacagttacaccacacaccggcataaccatgccccacacaactccaacaagaagacaaacgagaaagaacacacgcgcaagcctactaactgctcgtctaccgctgcgacgggccaggacggaaggtgagcaacagcgcatcctccatgctaccaacgccggaggcttccccctcctggggaaccacgggcgcaggctcggcacgaggggtctccacgaagcaagtccacgccagggactgacgaacaagctcgggcctggaggtgctcttgcgggcggtgatcttctggctgcggcagacgcggcgacacttggggcgacagacctctccctgggtgatcttgagctgatgcagctgcgcctccactgcgtctaggtccttcttcagctgcagattctcctgacgcagctccaggatcttcatgttgttctcgaccatcccacgacgcaccatctgatggaagtcgatacgagccgcatcgtacgcctccaccatgcgcgccaggtgcatgatggtagcgtcatcctccgagctagcatcccggaaggtggcgaagtcgcgggctcctccgcgacgagggtggtagcggtagggcgagtgctgcaactcgtccgggtagccctggtgaagagtgccgatggcgaggagagcggcgctctggcaagcggcggggaaagaatctccacccgcggtgactgccaacgaagtccgctcgggagagccagtgaggatcactgcagtaacctcccaagcagcatggggctctgcatcgtcaccctcctgctccgggagcggcctgccctggtagtccactccatgcggataccccaggacaacgcacatgccccgcagctccaagacgaaaccagtcatgtccagaccacgacggctgacgctgccggccatctacaaacaaaaacaaaaagaaaagcaacattttaaaggtcatattttggcgataaatgaagcagcaggacagagagagactagaggattttcacaaataagaagggatttttattttgaaaatattgctaaggcttgggatctaaggctcgtcctagggtcaagggggctctgataccaacttgtcacgaccggaaataacccaacgggtgttccttacgtgcgtgcattaatccttgtcccaggaggcaaggtacaccaaaagttgatacaattcagagtttaacaagcggaagcgtaaatagttaatttattacatgggcagcaaaggcccagcacacacaaagacaaacgagaaacagcggaagactagggcgatgaccacaggcgcttgacggcaggcacgagctagacaccaaagccttcatcttccaggggctcctcttctgggtttgggaaaaattgagcaagactaagtacaaccaccgtactcaacaagatacacccacaagtgcagaataaatgcaagggagtacaaaggagttatactataaagggttagggttgcagtaaatagcatttaaagatatttagttgctcaaaactatttagtaaacacgattctagaactatacaatattatttatcaaggccgtgaacccacacgaacctgccttaacccaaggcctacgatgattcagaccgaactggcaacccgaccctgggtcccagctcgtcccaagccaacccaggccaaccattccaccttttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccacagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccaaaccattccatagtgtccaggtgatatgaacatcccaaagtctagagttgtaaaatcacctaatgttacctaattaaacagcgaagcatctacctaaaatcatactagtggtaccatgagtagagtgtccactagttggggttttgtttaatctaaggtgaacaaggtaataataacaataacaataataataaggtcataacaaaggtaaataggcatggctagataaaacagtgataacgcgggaatttaaataaagcgataatgcaataatttaaagcaacataattttataaactgggattcaatatgttcaaggatgatgtgacttgccttgctcgcttttccaaacgtcggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaaggttatatgctctttaaatgaatatttgcgaatttcttcatttaaattttaatttaaaatggatttattgcgtcagccgaggggagagggcgcgcggaccgggtccacgggagtggggccacggtggaccgggcgcacccggctcacaccggccggcgccgtgggtcccatgcgtcagccacacccgagggcgcgggcggctgacggccgggccccacatggcagccgcgggacgcgcccgaaggcggcgcacccgcgccccgatggtcgccgccggcgaccaccggcgcggcggagcggcgcccgagagaggggagggaagggggaagcgaatcggcggtccacggctcaccccgggtcgacggcgacgacgggaacggcgaccggagcggaggaaggcggcggcgcggcacgggtcgacggggacggcggcgttccggcggtcggcgaccgaaacggagaggtggacgaggtcggcgaggttgcggcgaacccgaagaaggcgacgccgaaacgggagaaggtccggggcgacgacggcggcggaccggagctcggcggcgacggcggagagagagagcgacggcgcgagctcgattccggcggggagagagagcgacgagtggcggaaacggcggagggaggcacggggagcgtttatatagggttgggagtgagagagggcggtcggatgagggggaaacggccgctcatttcttctttattcattgtacagtatgcaattccacgaagctgatagaactggagcaaaggttggatacgtcgatccaacaagaatatgcaaaacacaacacaccgtagagctgagagaagactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctccaataagcctatcttatatgtagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaattgtttccttcaaacagagcacacaagtactaccgcaaaagaggtggaccagtacatattccatcccagaagaagttatccgtcaggactggctggccggtactatcaaatttataccaatacaactaattatcgaacagtacatatatactaaatatatctactgagatcggtccccataattatatcgcagtgctacaaacaaccaccaggaaccaacttgtgtggttattacgtgtgcgagatgctcagagtaaatggaaggtacaaaacaaccagtaaccgagcaggtcatcgaactcttctctacaaagaaacccatctcgcacacacttctcactgagtaccattttattttcctttctgtgtgcagatccccgaaatccca

SEQ ID NO: 55148 - DNA, 3710 bp, Oryza sativa
atattattttagctattcggaaattgaatttcgcatgcggtctacttaagacgcccgcatgcgaaaatagatcttcgcatgcgatcttcttaggtcaaccgcatgggaaaatatatcttcgcatacggctgcgacatgcgggccggccaaccgcatgtgaagatcgattccgcccgtatgcaaaaacgctttctgtagtagtgaacgttgaaggcgggaggagcggcgcgggcgggggaggcggcagcccccccgatggacgcggtgggcgtgccgagccggccgacaacgacgtgaccacacgggagttgggaggcatctgcgtcaagcattctcctgctggttgccgaggcaatcggcaagagacgacagatgaggactgactggactgcgactagcaagcggtagcaacaggcagtgcatgtgtgtactaacatcaagcggcaagccaacaagcaaagggctgactgacagagcaatgctgcagataggcacgcatcgtctcctcgccggacggtggggcggccgcggatggtccaggtacgacgaccctccccacccattcgcacggacggagcgcggccgcggaggagggggacgcgaggggcgggagcctcgctggccctcgagcgccccccgccgccggcgctccagctcccgtccctgcagacatgcgaaggggagagaagagatgtcggatataatcttgacttaattagttgctgcacattatgtgtatgtgcagatgtacgtggtcactgagtcagtcacgtagttagccattacttgatgattgcacgcagatgagctagtgattagttactgcatgtgcgtgtattagtgggagttagttgggttgttagtcgtgtgagctgcttacatatccatgcagtgcatgctgaagttagtgcctagagaataggtcgtgcatgagtggagttggtagctcttttgtgtacataagtactagataaatgaatgaaaatatgtggcatggttgccgagaaagcaagatgtagtttatgtgtccacctctgttcttcctccctacttgtaatattcttgtgtgcgtgtgtctaccaaagagaatttacgtgtttgtgattaacacctagagagtgagaggagatattcctaacaagagagaggagggagagagagagggaggaggatgaagaggagagaggataatatgtgggccccacatgtcagtgggttcacaaatttgctttgaatgataaataggtcccacacatattttttaattctaatgatacctaagcgccacatcaacgccacgtggacagaagatcgagtcaatactgccacataggtgccacgttagtaaaaccgccctccaaaaccgccgagggagtcaaattgcaccggttttaagagttgggggtcgagatatccggttttgtggtttagggtcacagattagatttcgatcacttttgagagtcacgaagtgaacttattccacatcggaatcagttgggcctaccagacaaaaatgggcctccatatcacacctaaagagaggggttgctcaatatataatccaacgcttggtattagctggtctgagctgatccaacgacgccaattaactgatgacgtggatgaataagagggcagcaaattagtattaactgcagtaagtgtggattaatcgtatagatatataggatttttgctatgctgactgcagttctcacgacgaccacggttgttgtcatcattgtgaggatgaggccacgattgttacgatgatgtcagcaaccgttgtcctcattactcctttggttctcgcgcttttccctccatccattgaggtgttgacataagtctatcagcttcatcgtttggcctaaacagtcaaagaataaaccaaaatttaaatttttaaacttaattttgaaattgattttgaaatgcttttaacgtaatttttgttaatgttggcttttaagtcgctacgaataaatctacagaagttttacttataaattaattttaattttctaataagccattttggataaaatgggcaattgatgggagcctacatcattattggggggaggagaattgcgtgttctccatcatcgaggcatagattgatcttgattgtggttctgacttcattattttggccttctgcaccgtcttggttccttgcgggagattggtgatttgctgaatgtcatccctctctttgttgattgttcacagttttaaatgtagtatcgaggttggctgtcatagacttcatatgttccaaccaagctgttgcatctggattggtcgttgcattgttggggatttggtccagcaatccatgtacataggtcaaatgctcggccggtgttagagcagggtttgttggaggagtatgttgtgagaagctaacgtattcaccttcctcatgggatgctcttgctccagcactggttgccgcttccccttgattaggatcattaaccttgtgttccgagttggccccctcatcttttcgcttatgcttatacttatcagccaaaatttaaattttcaaccttaaatttggagttgattttaggattttattcattgtagtttagttttcagcatttgagcctttgcttttatatcgtcaagaacacgtatataaaagttttatgcacaaatatttttcatttgtaattatgttgttttgctttttcctccaatatgcctaatgatggggttgtaaaatagccccatattgcatattcaggcatataaactatcacaaatgaaaattttatcaattagaaagttgtttatctcattgagctatataactttgatatacgtcatgtctctatctgagatcatttaaaaaattcaaaaaaaaattccaaaatagatctcatcatttgtaacgcttatttgaacatgtaaacaatctcaaataaaaatattgaggtctacaactttgatatagggcctatctccattcaagtctgtctgaaaaatttaaaatttatttttcaaaatagatcccatcacttagtgcatattcagacatctaaacgatctcaaataaaaatattatcaattataaaattaactctacaacttttacataaagtctgtctattcgactacatacacatttttttaatacacatttttttatcaaattttataaaaaaaggttgtgatttaaatatattccctcatgtgtgagggttcgtaactgccactcatcatagatcatagatatgtgtgatgtgtcgtagttacgagctattacgatgacgggtcataaatatctttgatgggtcataagcagggcttcccttactgccgtaaccactcttaccgtgggggtacggtaatggttaccggcggtagggtttgatgaattttaaccaaattcaaaatttccaaaacaaatcgaaaaaaacatggatgtagttcttgatttgtagtggcggatggtaaagaaatttgatgaaaaagagtaatataaaataacatttgatggtaaaaccgagagtacattagaaaatggtaaaaaaataatgcaatggacctttaagttgcactgtttatccagcaaattaaggcccaatagtggagaaaatatatatagggtggctgggtgctacatatggacatcattatgatttgaaatgtgaggttgttgaattgacgttgttgacttattatgctatgaa

SEQ ID NO: 55149 - DNA, 1144 bp, Oryza sativa
  unsure (1)..(1144): unsure at all n locations
attatcctcaatttttacacatatttatgtttttttccattttttttagcattggtctgttcagctacacaactcacggttaccgtgtcaaaccgtgcggtaaccacgatcaaaccgtgaaaccgctattttttgaattcaaatgtttgctgacgaaattcccatggtttaggcggntaccacntggctatcgtggtaaccgccttaccgtggggatgtaataacccccctccaaacggtaagagaaaccatcacagatagaagtggaaacgagccaagccgagcctggcttggctcgtgaaagcttggtacaagggaagcttggcttggcttggctcgctacaagcaacgagctaaaactgcagcttggcttggcttgataatgggctcgaaccagctcgagctggctcgcgagcctggcatcaagtaaatctccagcacgtctaagagaaatcgagcaacataataccatatagaatgcgtaataaagttatatttttctttaatatatcatcacaacacgataaatagataatatgacaatcaaagttatcattttcaaccaataaatagttcaaaaatgtgcaatttttttgtatatgacctattctattgagtcaaaagagctcacgagcggctcgtgagccagctcgggcttggcttgtttcggaaacgagctaggaagcagtcttgggcttggcttgtttggctttcgagccgagccgacctatgcgagcctgaaccaagcttgagccgagctcacaaggccaaactttttgtccacccctaattacagatggcctgtcaaggatgaccgaatttgtagcagtgatggtgcacaccatctatatttatatttatggggtagtctgcgttgcagagattgggacatcaatcttttgcatataattacagctttaaaaccatctataacctattggaacttatatattcaaattcaatagctattcgaccaataacaacttctctcttcgtcccaaaatataacacttttacgatttagaatttgtcacaaaatataattacgtatccaccaatattttcttcttgatcaatcacaaccctccaccatttaattttcccatttaccttcacttctcatccaatcacaacattcccctat

SEQ ID NO: 55150 - DNA, 2281 bp, Oryza sativa
ctgatgcactggtcgttctttgttgtctgtgcaaagttgaaaaaactcaccggtaggccctccaagtttgattttaccataataccatttttttcttgcgcgaggaaatatcagtttgcctttgaccaaatgaattagtggatccgaagatgttgacatgaactctctctctctctctctcaagtggttaaccatgcatgcaaccatttttttaaatcttttataatttaactgaaaaatcgttcagtaaccaattgttaaaacaaacaatctagccattcactgaaggtaacatggtaagctattgactgtaaatatttatgtaatgtcgaaaataacttgccatgtgacatagcaaaaatataattttcaaaatacaaaaaaaaaatcacatgcgacccaatcaaatactcctatcagtgataattgaccccgcaagccatctagggtcaattctagtacaattccacgtagatttcctcccaccctaagaaaagttgtcactttgttctttaaaaagaccaactcgcgtgactttcttctttctgcgctgtaaagataatagaatgaaacattccggcttttgctcaagagagctacagttaattattacaaggtagtacacttaaaagaaaaaaataacgcaaacacaccaaccaaaaataaaggaaaccaaacatgacaaggataatattattctaacctgttggtgaatctccatccatggttggcaaaaagttgcataaccgtcgtctcaaacttacgacatgcaacaatcaggaattcttcatcttcattacacttttgtagttgtgcccacaaccggagccaatatgttgccctaaaaattacctgcatataggaaatagatgatgatttatcaaaaaccctatcattcctacacaaccacagtgcacaacataaggcagaagcaccaacaaatatcagtttactctttttcatgtcaaccccccgaagccatctatcaaaaatatgagatatggtactaggaaggtataatccaaaagaaaactgaactgctctccaaataaattttgcataatgacaatccataaacaaatgttgaatagtctcatttttcatataaaaacaacatctcaagctgccattccaatttcgtcttgctaggttatccttggttaaaacaactcccttaagcaagtaccacataaagaacttaatctttagcaacatcttaaagcttccaaataaacttatttctatcaatgtaaccattattaattaaagctaagtacattgatttaaccgaaaactgaccattttgatgataatttcatctaaaataatcagaagaattatttaactggaaatgaacaatagaagcacacaactcatgccaaagtgttagattctgaccaactaaagctctcctaaagaaaacattaagcggaatagaggccataacactagcaatagaagcattcctccttctgacaatagcatataaagatgaatacttatctctaaaggccatattacctagccatttatcttcccaaaatcttgtttcttccccattattcacaatccaggaacccatacttaagaaagtgtttttcactttcatgagtcctgacaaaaaatgggagtcaccttgtttcctatcaacttgggttatagacttattataaagatactttctcttcaataaatcttgccaaacaccattcttattaattaacttatataaccacttactcaactgacatttattttgaatctctaaattatgaacccccaaaccaccttgatctttgggttgacaaataatatcccatctagctagcctatacattttcttatgatcatccccttgccaaaagaaacgtgatctataataatcaatcttttgaagaacccctttcggtatctcaaagaaagatatcataaacatagctaaacttgaaaggacagaattgatcaaaaccagtctacctccaacagacatgtgtttacctttccaactactaagttttttctcaattctttgttcaataactttccaatccttattacccagtttcctaaaatgcattggaatgtcaaggtatttaacaggaaaagaccctaacttacaaccaaagatactagaatattgatcatagcactccttagcctgaccaaaacaaaacaactcacttttgtgaaaattaattttcactccagataatttttcaaacacagataagatcaattttagattctttgcttgttgtaaatcatgctccaggggtgcagg

SEQ ID NO: 55151 - DNA, 8074 bp, Oryza sativa
aggcctttataagtttaaaaattgtcaccaatttgatcattaactttaataccaacatgtcccccttgaataaaagaggctatccactcacaccatttaagagagaagcccttcattctcaaagtctgttgtacaaaaaaaccatttaaccttatcataagctttctcaaaatcaatcttaaaaattatgcactcatgtttttacgatgtaattcatgtaaggtctcatgcaaaataaccacaccttccataatgtttctcccaggaataaaagcagtttgggtaggactaattaccttttgggccacactcattactctatttgtggcaactttggtaaaaatcttaaaactaacattaagtagacaaatgggcctatattgttaaatttttatggcctctacacacttaggtaaaagaataatagtaccaaagttaagcgagaataaatgtaaagtaccattatgaaactccttaaaaaggtttattaaatcaaattttataacatcttagaaaacttgataaaattcagcaggaaacccatcaagacctggtgctttgttatgttccatctggaaaatagcctccttaatctcctcttcagtaaattccttgtgttagagcctcattctccaaaagagaaacttgaggaatgtcagtaaatttactctcatcaaactgaataggagaatcatctggaggaccaaaaagacccttataataagtgataatatgcgatgtcaaattttcatcaccatttattaattggtcaccatcttggaattcaaaaattctagtattactatgtttcccatttgcaaccaagtgaaaatactttgtattagaatcaccctctagaatatccttagatttggccctcagataccatttgatttcctcctctctcataattgaagataatctattcctataaaaccatctaatatccaattcctcctgactcaaaagaatatcctctttgtctcccatgtttcttttgatttctggaagtgcgtcattgcatgtacaagggcaaagtttcatgggtactggctccatcagtccgccgctgcttccactcaaaagctctgttgggcgacacgggcagcgaccgccgcttgcacctctaccccccacctctctccctcccgcctcaccgccgccggagccagacaccgaaaacgtacggcagcatgaatggcggcggcgagggcattaacgctctcctgcgcgggatctaggagctagcggttgctaagaggacaacggtgacgattgccactgctggcagcgtcgggcagtcgcggagaagttcaaagccaccggcgagagctcagaagcgcagtgggaggatccggcgaggaggaaaggcaacggcaggcggatccggtgaagagggcgatggggcggtggctcgcacgtcgtcagcagcctggcgctgccggcggcatagggttgtccaaggggagacatcttcgaccctcgtgactgcctacgcgcaacccctctttgccgccggtgaagctggacctgttcattcgcctccttggccgatttgtctagatccacttactccttggccagatctactcggttggggctgggaggtcggtggcagcggcgccctgacctgcccatgggggcggtgtgtgatggtgtcttcaagccgctagcgtccgtgccgccgccgcgtgagctatctgactagtgtcctggctggctttaccccctgctctgggttgaaaaccccttttggtttccacagcgtacgatggcgtcttctttcttgttgtcgtccttcttcttgaaggcatcatatttggaaatcccctgccataaccctcgggtggcttcttctcctcgtcattgttgtgccctctacctgtttgtcccctggcatccatcgtgtcctgcctacacctatcctcgacgcctttggtccaccttgccttgtcttttcatctaaccagtgttagtgttcctcctagtttccttggtttgagtcattttggttgttgtttcttgccttgcttcgaccaccttcaccttgatccaccataaaccacgagtatgcagtttcccctttcctcctcagatttcttccattttggcatgctagaatgattgatagtttggggctgcaagttggttagaaccattggctttctcagtgaacctatgactcctcaaccatcgtggatgatgtttcctccaccattgcaattgctgcctcccaacttacctcttttgctttgctccttgttctattttcatcttctttgcttgggtgtccttgtccacaatgttcagcgaccatcccaccattggggcttccttctcccttggggcgtcgggggcgttgtattaattggcaatttgctaatgccggattgaagccgatttgatgtgtgcggcctttacagcaacccttagttgctctccctcttctggggcatcctttacccaaagggcgttggcgagcattgatcaatatttcaacacaatgaaatcgggttttgatggcttgatgcaggtggtctttgacatacacaacctctaatctccggaaactgagtcggcttgtgcgtggcagatggccttctgacaattcaactcccggtgcttgaaggttgcgtgtagagtagatgttgtcaggctagggagctagctttagctcagattaggattgtggttttgtgatcttgttggtgaaaaacatcaaacacctcctctctctctttctctctctctctctctctctctctctctctcgtagtcctgctagtgtggctcaggtgcccttcggggtggttgtgtttctgttgtgtttctcttccttgtttttccctgtatactttctcttatcctccaggactactgcgcttgtgtagcagaagctttgccctgtgtaagaccgtttgaagtaatatatttaggtgggcatttcgccccccggtgacccgtctaaaaaaaagttgcatgggttctgacaggaatattcagccttaattcgaaaatgacaaggtcacttgacaagcaattaaagagtagagagagaaatattaaagagaagagagacaaataatcttgccacataggatttttcatgtcagcaattaaagagagaaaatggtgtcttgaatctgacattatcatgcaagtaaaagagcattggaggggagggcagtatcgacaacataaaatcaaaggagagagatggacaaagaaaattattatctgatccaacaagtagaaacaatgcattggataaattcactaatacaaaaatggttttttttttgcggccaccggcattgctagagaccaatggccagtgaagatgcagcatcttcaattcactggcgatcgccaactgccagggaatatagcttttcgctggcggctagtttaaggtagccgccaacaaaaatggtagaggtaatgccttagtctagttgtatgagattagatctgtatttgagtatgcgcggtacaacgtgtgaatagcacgtagcacgtatcgtcctctccccagaattagggtttttggttcaccctatatagaggtaacatatctcctataatctggcaacctaccatcgatttacatgagataagatcggttgccttatctagccacgcatgctcctcataggctcaggcctactcggcccaccacatgctatgcggcccaaaggcccaacagttggtacctaggtaccgtgtcccccacattagcccccgactctatacttagttaagcatcaagcaagtggagagtcaagaacatgaactcccaacagcgtgtggttgagtaagacaaaccctagaggatttgcctcatccaatggaaccagccaaaccatggaggtgaggaagccagttagtgatcacaaagttggccaacatggggacgtagttgctcggcggtggtgaaggagccaaccagcacaaggacaaagtcacccgacagcagcataggcaaccaacctggagacgcagcccccagccggcggcagaggagccagccaacatggggatgaggtcacccgacggtggcataggcagccagctagaagacacccgggacttgggagtgacgcccgagtaagacaactcagggggcgtgtcttgcccagtggagtggtagccgagtaaagcaaccaacgtggaggcatagccaccagccggtagcgacgaagccgagtaaggcagcactaaggagtgtgcctcacacaacaaagtgccagctgagtaagatagccaacgtggaggcgcaacccccaagaggtggcgacggagccaagtaaggtagcactcatgagtgtgcctcacacagcaaagtaacaaccatgtaaaatagcccacgggggcatatctcactcagcgacatggtccagtcctcaagtataggagatgggcgcatggtcccgagctccaattacacatatccatacctgggccctgcattaaaaaacacataaaatgagtagtatattgtatagaaaatatccactcaagaggaatacaagtttgtttaaatacatgtaaatatttgttcctcctttattagaattaatttccccgagtagtttactatttacgttcaagcactctgcctcgggcgtacggtatggggcgtagccataccgtgtaagtgtgcagtgagtggcgtagcccccgggcatacggtgttaagcatggccttgaccgtgtgagccgtgcgaggaaatagagcttcacgaatcagagtttgtgctactcaagtacttttgcaaccattaagaggaggaaatgaacatgcagtttgaagcacctaataggtgcagcccttgactttatgtttggttgggtgaccaactaaacagtaagtcagaagtaaaataaattactcaaatgaaaataccatataaaaagtgaattagattacttagtattccatgagttgaaaacaaccggggaggcggtgaagcccttcagctgccccggagccggccagtcggtgggtacgtgattgactaatgtggaggcgtagttgggtctgcgtgagccatacaagagtgaagccccagggcatacggaacagtgacgtagtcgggtagagagtagccgggtctgtgtgagccgtacaagggcgaagcccctaggcatacgggcacacgctcctggcgaagtcgggtcgagttagccgcgtgaaggccaaagctcccaggcgtgcagcgtcgtgcccaggtcttacggagatgtgcccgggcgaagtcgggctgcgtcagccacgcaaaggccgaagcccccaggcgtgcggagtcgtgccttgagagtacgtgccccgggcgtagtcgggccacgtcaaccatgtaaaggctgaagcccccaggtatgcggtgtcttgcctcgggcgtacggagacgtgcccagacaaaattgggccgcttcagccacgctcgaaagacgaagcccccgggcgtgcggcatcatacctcgggagtagtctgtctggggcgtagtcgggccgcgtcagccaggagaagactgaagcccccgggcgtgcggtgtcttgccccgggcatacggagacatgccccaggcgaaatcgggttgcttcagccgtgcgaaggccgaataccccgagcgtgcggcatcgtgccctgggagtagtccgtctagggtgtagtgtcgggccgcgtcaacgaggagaaggccgaagcccccaagcatgtgcggcgtcatagacggtgaagcctcatggtggcgttggtgccggctagcccggggacatgttcaccacgcggtggcgtggaggcagccgaccgcgaaattgttcaggcaatcggcagtgtaagcagatgtggccgacatgggaacacggttgccactcggcaactcgaagatggctgactacggaggcgatggagctaggctgctacgacacaaaggcggccagagtggagaccactcggcgacgtcgaacatctccggcgcatgtgcaaaatgattgttaacgaccgaatttggaaatatcgatgcgatggcgacagtgtgcccatgtgcgcggctaccgacgggcatgtcttctgtctacctggtcgtgtccgagtgcgtggccctcgcacctgtgtgcgcatggccacgactacacacgccatcactactaggaaaagcattttcgccggcaggggaaacacatcttcccagccggaaggccggtccgcctatagcacaacgcctaggaattcatgtgtattcatcctcttatgggatatcaatgggatgaagagttttgagaattaatccatttgattagggaattggtaacttatatcaattactcctaattgatggatggttgatggttgtgtagtggaggatggttcatggctagttgatgacaattagttgctctattcctcttcctattccatttgtaacctacatcaattactcataattgatggttggttgatggttgtttagtggaggatggttgatggctaattgatgagaattagttactctattcctcttcctattccatgactcttactcttcatcttccatttctcatataaaatgagaatggatttgatctcccaaaagagaaagtgagacacactttcatccattttccaacgctgttgctgctacggtaatcccatcccgacgagtgtgtgcacacgcgttgggagagtaggcctccgaaaccacgcgctgctgcgacgtttgcacggacgggcgggcgatcaggtttttggagagcgtaaggcgcgactactcactgttcgtcaacatctacttcaccttcaccaatatgtcgaacactggagacaacggcaacactggatacaaggagaaggaggctcccgtcaacatcaacggaggcaatactgcctcaaactccaacggaggaccattcttggggtataaccttcttacattatttcaattagaagttttactgttaatattcattgcaatgtcaacattgtgttattatgtgattgttgatgcttattctacattaagcatgctcatgttgattacattcaccactatcactggatcaaatcccattataaatatcatgtttattatcttgttattttggattaaaatatgccgaattatgaccaaatttccaacaatccaaaaacctgataggtcattttcggtagttggctttgctgcaacactgaaaccacatgcttttgatagttctaattataagatatggaaagcacgtgcactactgtggttgacagcgatgcaatgcttctatgtttcacggggcaaacgaagtgaaccgcctctctctcctgaggaggaggctaagttcgaggcttcggattgcctgttccgtggagcattgatcagtgtactcgctgacaatatagtggacgtgtacatgcacatgccttcagggaagaacatgtgggatgcacttgaggccaagttcggagtttccgacgccggcagcgagctgtatgtcatggagcagttctatgactacaagatggttgatgaccgttctgtagtggaacaagctcatgagattcagatgctagcaaaggaacttgagaacaacaactgtgagttgccggacaagtttgtggcgggtggcattattgccaaattcccaccttcttggtcagactttgctacttctctaaaacacaagaggcaagagttcagtgttactgatctcattggctctttgggtgttgaggagaaggcgagagcaaaggacaaccggggcaaaaatatcgagggaggttctagcgccaatttggtgcaaaataagaaccctcacgcatcccataacaacaacaagaagaaagtcaagcctgatgtcaaaccaaaggctacaaccaattttaagaagaaaggcaagggaaaggccaagggcgactgctttgtgtgcggtaagcctgggcattgggcgaagaattgtcctgatcgcaaggacaagaagtctgccaacatggttattagcgagggcggaggaacatcggggtacggttattttttacctacagttctctctgtttttcattcacctgattggtgggttgatact

SEQ ID NO: 55152 - DNA, 1984 bp, Oryza sativa
  unsure (1)..(1984): unsure at all n locations
gtgtagcatgtccctttaataaagaagaatctagttagcggctctctactgtgtagagatggttttagacttgtgtttgaatccaataaatgtgtcgtatctaaatatggaacttttattggaaaaggttatgatagcagaggtctgttccgtttttctttggatgacatgtgtaataataataataatgttgtgaaccatattagcgataatgatgagtccaatgtgtggcattcgcgactttgtcatgtgaatttcggttgtatgacgcggttggctaacatgagtttaattccaaaattcactttggtcaaaggttccaagtgccatacttgtgttcaatcgaaataacctcgcaagtctcacaaggcatttgaggcgagaaatttggcaccactagaactagttcattccgatctgtgcgaaatgaatggcgtgttgactaaagggggaaagaaatatttcatgacactgatagatgattgcactagatattgctgtgtacctattgaaaacaaaagatgaggcattgcattactttaagatctataaagctgaggtagaaaaccaacttgaaaggaaaatcaaacggttgaggtctgataagggtggagagtatttttccaatgagtttacgtccttttgcgaagagtttggaattattcatgagagaacgcctccctattcaccccaatcaaatggggtagccgaaagaatgaaccgcactctaactaagatggtgaatgccatgttagacactgcgggactttccaatgaatggtggggtgaggcaatttttactgcttgtcatgtcctgaataaaattccagtgaagcataaggaagtaacaccattcgaagaatgggaaaggaagaaattaaatctctcatacntacgcacatggggctgcttggccaaggtaaatgtacctatagccaaaaagcgtaaacttggaccaaagaccatagactgtgtgttccttggttatgctatccacagtgtgggctataggttcttaatagtaaactctggagtacccgacatgcgtgttggtacaattactgagtccagagatgccatattttttgagaatgaatttcccatgaaaaatacacctagcacgtctagtctagaacctgttttaccccatgagcactttgcaccgataaaacacaatgagcaaacgcttgagggaaatcctgaggaggatagcattgtagatactcgtaagagtaagagacaaagggttgcaaaatcctttggagatgactacattgtatacctcgtggatgacactccaagaaccatagaagaggcatattcatctcctgacgctgactactggaaggaggcagtacgcagtgagatgactcgattatgtctaatgatacttgggaagtcgttgagcgtccatatgggtgcaagcctgtaggatgcaaatgggttttcaagaaaaagcttaggcctgatggtacaattgaaaagtacaaggcaaggcttgtggccaagggttatacccaaaaagaaggcgaggattttttcgacacctactcaccagttgcccgcttgaccacgattcgagtactacttgctctggcagcctctcatggtcttctcgtccatcagatggacgttaagacagttttcctaaacggagagctggaggaggagatctatatggatcaaccagacaggtatgtactaaaaggtcaggagggaatggtgtgtaaactgttgaaatccttgtatggccttaagcaagcacctaagcaatggcatgagaagtttgacaccacacttacatctgctggctttgttgtgaacgaagctgataaatgtgtgtactatcgctatggtaggggagaaggagtgatcttgtgcttatatgtcgatgacatattgatctttgggaccagcttcaatgtgattgaggaggtcaaggactttctgtccaagagttttgaaatgaaggatttttgagagg

SEQ ID NO: 55153 - DNA, 1393 bp, Oryza sativa
taaaaatctggcagatcagtttaccaaggggctaccacgtaatgtgatagacagtgcatcgagggaaatgggcttgaaacccacttagagttgcacaatagtggaaacctgtccattgtgatcggagatcccgtgaatttggatggcgaaacaaactattgtgtaaccgagagaagagacccttaaatgggctcattttcatgatgtacttctcttctactctgtgtggtaggatggcttatgcctcggcttttattaagcagagatgttgacctgcaaaacatattagaaggagtacacctatatgagttcgactactagtcacagtctatgagatttgggtgatctctagatactcatgaaaggcctggagtatgacttataagctccaacctgagggaatactaacggttgcctagtatcagttatggaattgagtgaaacctaactgcacaagactgacaattcaaggcatagtccattgttcagttgtggtccggtgtagctccttttctaggtgaaagttcaacttaacagtcttcaccaaaacactggtatataaaagctgctatggaatagagagcattctcatgagccttgaaatttggtggggattgttagatttaattgggtaattgatccaattaaatcaattaaatcatataaattccaaggctcattatgctaggaattcatgtgtattcatcctcttatgggatatcaatgggatgaagagttttgagaattaatccatttgattagggaattggtaacttatatcaattactcctaattgatggatggttgatggttgtgtagtggaggatggttcatggctagttgatgacaattagttgctctattcctcttcctattccatttgtaacctacatcaattactcataattgacggttggttgatggttgtatagtggaggatggttgatggctaattgatgagaattagttactctattactcttcctattccatgactcttactcttcatcttccatttctcatataaaatgagaatggatttgatctcccaaaagagaaagtgagacacactttcatccattttccaacgctgttgctgctacggtaatcccatcccgacgagtgtgtgcacacgcattgggagagtaggcctccaaaaccacgcgctgctgcgacgtttgcacggacgggcgggcgatcaggtttttgggagcgtaaggcgcgactactcactgttcgtcaacatctacttcaccttcaccaatatgtcgaacactggagacaacggcaacactggatacaaggagaaggaggctcccgtcaacatcaacggaggtaatactgcctcaaactccagcggaggaccattcttggggtataaccttcttacatt

SEQ ID NO: 55154 - DNA, 5540 bp, Oryza sativa
tgtgttattatgtgattgttgatgcttattctacattaagcatgctcatgttgattacattcaccattatcactggatcaaatcccattgtaaatatcatgtttattatcttgttattttggattaaaatatgccgaattatgaccaaatttccaacagctatatggtccgcctgcgaaaatatagcatgaccgcctgcaaaaataaaaaaatgccgcctgcgaagataggtacaaatatttgaaatttgttacaataataattttctcataaattatttttcaattaattaattaattgttgcataaataatattagtaaataacaagcttttgatactgagaaatctacatatattgcaaaagggaaaagtatcgtcaaaatattataatattttttacattgtcacttcaaatacgctatctaattacattatggcatagcattgctgcactcccgaagatttttgtatttgtcacttgtagctagggcaccctctttgtcgaagaactttccttccacatgacagcactcacggtggatgaagtggtagagatcgcgctggatatttttaatggctgtattgtcaaagcttgtttgttgctcctcccttggcaactgcatgcatggaaataagcacaatatattagtatcatctatatgtgaagttgtctaatccatatagtctagagacttacatcctctgggttaaccctgacctcccattaacccttaggaattcgcatgcgtaatacccgctgaggacagtgcctctaggttgcttgtgacacttcatgacatatcatagaagaaaatagttaaattttgcaattagtgaaacaattggaatacattaagtgagtggagtattcccggccaatatgtatgtactagcagcttctcccttgatcgaatctgttctccacccttgaacttgtagtacttgtacgcactgtatggattttgtaccgtttcacattaaggaggagatttaattataatatattcatagcagacatgcaagtgtcagaatcacttactattgtaagattgttagaaattgtttgtatgagtcatgagagtaatcgagagggtccaagactgtcacggtgcagtgcttcgggtagatgattaaaccgatgtaatgatcgctacatattaacaacagtgcagttagtcatggatacaataagacacatatgtataagagaaatgtataccggacttacttaaaattataagcggccaggacgaccctcttattttgaaagtgcaagaaggctcgtccaatgtactgtgcgacattaatcagtttctgcttgtgcaatcccttcttgtattcagctatctcttcgggagtcttgtccttcagctgctctaactgtggtgatagctgcacggtatgctgtgtttgacatatcctagttggatctagaaatccgataggttcttttagcttcttagcatccatgtattgcatcctacaaaagaagtttgttagtaataatcacatggttatgtattatatagattccgtcgtgtaattaatgtacactcatactcacaggcactaagcaccgatatagttgacgtccatcttttcccgatgatatatggtgtgcagatcttcgaaatatggttgtgtcttcggctgttgcgtcttatctttcttcttcgagccggtggacttagctgggaccgcgtcttcttgtgccttgtctttctttttcggctgccgttttgatctccgtggccccgttttctacgagtaggtatgaaactttcgaattactactcactactagttatcactcacacaattacgatcttaattgtacctacccctttctcacggggaatgtagtccttatcaccttgttcaccctcatccttttaccaccgtttcgggcttggacaacgatcacttggtgacgagtactcatcgtcctcgttgggtacgtcgctgtcggacccatcggacggcagcaccgttggttgcggagcaaccacaatagcaagggacggctcaactggcggttgtcaagactccacctcccctacagcctgatcttcatttcctttagtactctcggccatcgtttcgtacttcaaacataaaaatgaactcgatagttaatatagaggccataaaaaggagcaaatttaaattatcgaggccacttatcataaaaaaatagattataccacctacttgtcatatgtgcaaaaaaaattgaacatagaccactacgttgccatagtaaaaaaaaaattcacatagaccactatgttgccatagtaaaaaaaatttgaacatatctccccccatatgataggaaaaaaaatttgaacatctcccccacatgttatacacaagaaatttgaacatttctcccccagatgttgtacaaaaaaattttgaacatatctcccccacatgttgtaaaaaaaaattgaacatatctcccccacatgttgtacaaaaaaaatttgaacatatacccacattcacccatatatcattcacatccacccataccacccgtatcacccacaatcaacagataagacccctcattcccattccatccatatatacaaacccctcacagtcaactgttgaatgtttgttgttgcttttataaactctagacgcagttgtgttttctgctttcttttcttctgctgtaaactgtgacatttcttttaatgaaaatggagggttaaggccctttgataaaaaaaaaatacaaacccctcacacatatataaacacccacatgcacatgttcgctcgcggacgacgagcggccgaggacgtcgttcggtcgtggacgaggaagttgttcagccgaggacgacgttcggccgagggggcatgtgcgcggccgaccgggagagaggcagcggcgcggcctggaggaggcgggcagtgaccgacgtgcccaagagagagagagagagagagaggcgccgtggcggccggccaggaggaagcttgccggaggaggagctggccggaggaggagccgaccgaggaggcgtgcgcggccgggggaggcgaggcccggaggtggaggcggcgcgcgcggcggccgaccggggagagagaggccagggaggaggagataggcaccagcggcccacaggtagaggaccaccgcgaccggcggcggccggcgatggacggggtggtggcggccggcgatgcgcctggtcgtggcggaggcggcagccggagtcgacgcggcgggcggacggcgcttgcaggcggacggcgacggaggatggtggtcggcgcggtttcgtcaaaaatttcagcagcctgatggcgacaaaatttctacggttcccgcctggacttagaaatttggcgcccgacgggtgcccttatataggcgatgtatctttctaggcaggcgccccgcctgcgaagatacatcctaactaacttcgcaggcgggccacccgcctgagaagatgtcacccccacttcagtactcatttttcgcatgcggacaccccacttgcaaaaataattagaaaaggtcaaatattaatacttaataaagaaacattttattaatgtaactgactttataaattataaataaagatggtaagcccatataaaaattgtaataaagatggtacgtttcccaaaaattgttacaaaatattaaaagcttaataaaaacattttaaaaaaataattgattttataaaatataataaaaatggtaagtccatataaatattataataaagatgataagtgcacataacaattgcattgtgagtaaaaacataataatgtgcaatatgagtacatatagccccctacataccatcattacagaacaaacaattactctttaacatttttccccacaccgtccttgtgcatgtaaggcttcatggtcttctgagttgatgcctctacaagcttaatcttttgtacaaattacgtataaagtggcatactatcgtactggttgtaatcttcgacatcttcgaccccgtctactcccaagatcttttgttttcctgatagaactatttctttcttcaaatttgcaaggtctgtcacatagaacacatgtgccacgcgattggcgagtacccaagggtcatccttatgacccacattcgcaaggtcaacaatagtaataccaaacttatcaatactgaccctgttcgggtattttacccactggcacttaaatatgaggaattgcattgtgagtccatagtcgatttcccagatttcttcaataaacccaaagtatgattgtttttccccctgaatcaattgcctccatacaaacaccgttgttttgagttacggtcttactatctcaggctcttgtactaaatgtgtatctattaatgtcatatccctcccaagaattgactgtagttgatggaccacaagccaaccgcttcatagttatttgctcggttgtttctccatcaggtaagtctaggtctcgcaaccaatctatgaagacacgcttgtgttctttcattatccattcggttgtgcgtcccttattgttagctcttagtaattcgatatgttgatcgatgtaaggctcaatgatagcaaactgatgaagaatgctgaagtgagcttctcaaaatgatttgtaatcatgggtgacaaatctcttctttcctattgtccccctgccagtcaatctacccacgtgttgaggtacaggtgtcagggttatggataccacatacctaatagtagttgactaaatctcggcagggctcaccacataccatgtcctatacggaagcaaccttcggatataggaggagttccgataaggaaatgaaaccagagttctacacggaaacgacaaggactattcggattgtatccatattagtttccctagttctacttggacaaggggacacctatgggtataaatacaaggccccctatgaggagggggacgactgaccaggagacgatcaacacgatcaacatggtcaccacgatcgagatccacctcaatcaacaaccaccacaatattcggaacaactgaagccacagcatacaagccaacatacgccaagacacgccgccagatatcgacttcagggataggcatggctattcccctacggtgtctccggataccgtcaggagagactaaagcgctatctttgaggagcaaggctaccctgtagtcgactacgagtcagaccttcagaccgccatgtcgacaacagttagataggctattccacatattgtactggtgcgattatggtgaataaaagcaactccggctccggccaacaagatgtagggttattacctgaccgctcaggggcccgaacctacataaaaatccctgtctccgtctcttttacctcagtctcgcgtatatcctagcaccgacgatccccatactgtccaaataccgtagtcgagacatcaaacgtcgacagtggcgcgctaggtagggggattttggtgctctaggatttcgacgagatgggttcaagagatggaggg

SEQ ID NO: 55155 - DNA, 2975 bp, Oryza sativa
tcgaccaaagtacgtctcccgacgagatcggaaccatcgtcgtcaacaactcgttctctcgagatcgaccaaacttcaagacgtcaacaccgcggagaatcaactgcccagacctccgcctacgacatcggctggaccgacaaaatacacccggcatgtatctacaaaggaacaattgagcactcgagtaggatgtggtcgagtacgccgcattatcgagaacgatctcgacaaatgcagagccatcgcgcccaacctgccaacgaagaccgacgacctatctcatagcaccggccatcctgggctactcgagagaaggttgttaacgaataattcctcgtgaacgccgtcggcttgatcacctgacatgattgcgaacggacatccgtatatgctataagttgggtacgtgagtcatgctggccacatgagatacacttgcaacaaaccaactctagcgcttccatcggtgttcgagagataattctgctcgctcactggtcctcgaaccagtacgtagcaatctctcgcaccgcaaacttcattggtgttcaagagataactctacacgtttgctggtcctcgaaccagtacgtagcaatctctcgcaccgcaacctcagatggtcgaggtacgactacgattgatcttcgaacggcagcagagtagcagtcctcgcaccatgactcggacgacttcaaattgatcgagaaacacctgctcactggttctcaaccagtcaatcgtagcgatctctcgtatctttacttctagtggtcgagtttagactacctctggttctcgaccagcggtgtagcgattctcccactacctttacttctagtggtcgagtttagactacccctggttctcaatcagcggtgtagcgattctcccactacccatacttctagtggtcaagtttagactacctctggttctcgaccagcggtgtagcgattcacccactgtttccacttcaagtggtcgagtcacgactactgcctggtcctccaccagtggtgcagcgactctcctactacctctactccaacaaagttggtatcaggtacacaagatcgccaagtgttttacccagagatccctcacccagatgacacctagcgttgacacctatcctactgtccctttacgccatgctgacaaggcctccgaggaacctaagggatcttcggctggggatgcccggagccgataaggccttgtcggattctttagagacgaaagaccatgtcagccgtggtcgtgtaagagttctccccgtgcgtattaaccaagccgcgtaatcggaaattaactttccaacttcacggctgggggctaggatcagtacttgttcaaccgaggcagttcaaaggtccaagagccttgtccctcgagaacgattctccgacgacaaggctagaggctagggagagtgcataactcaacaaactgactagtcgaagtcggtaaaagagaagacgctcatacacaaaacattggtcggtaaatttaattcatttttaatttaccatacatattataacatgtcaccctttgagcattcgctcgggggctctttctatttgatattcttttatgagtattgatttcaggaaaattctattcgacatttgttgaaaactcatgtctctatagttctacaccaagatcgactaaggcgagtacgacaaatgttgacaaggctccgtcgcagactctacgccttctcgatcgctcgagaacggttgctggatctcgacaaggaatacggaatgaagagatggtgtacccgccgagataaaatttcttgacttcaatccaaattttcgattacagcaagatgggagacttagtcgtctgctctatacttccttggttgacatcagagattgactcagacaaaccctttcggtgcccgcacgaggctgataaaggaagtctaacgttatctctaaactcaccgagaacggtcacgtgagctcgataatagttactccatggtcagtggtcgagaataggaatccgttcatgtgcattgaagtcgggggctactgtcagggttatggataccacatacctaatagtagttgactaaatctcgacagggctcaccacataccatgtcctatacggaagcaaccttcggatataggaggagttccaataaggaaaggcaaccagagttctacacggaaacgacaaggactattcggattgtatccatattggtttcccaagttctacttgaacaaggggacacctatgggtataaatacaagaccccctaggaggagggggatgactgaccaggagacgatcaacacgatcaacatggtcaccacgatcgagatccacctcaatcaacaaccaccacaatattcggaacaactgaagccacagcatacaagccaacatacgccaagacacgccgccggatatcgacttcagggataggcatggctattcccctacggtgtctccggataccgtcaggagagatgaaagcgctatctttgatctcgccggacacggattcgaggagcaaggctaccctgttgtcgattacgagtcagaccttcagaccgccatgtcgacaacagttagataggctattccacatattgtactggtgcgattatggtgaataaaagcaactccggctccggccaacaggatgtagggttattacctgaccgctcaggggcccgaacctgtataaaaatcctcgtctccgtctcttttacctcagtctcgcgtatatcctagcaccgacgatccccatactgtccaaataccgtagtcgagacatcaaacgtcgacagcaagtattccaattgtctttccatctttgaggtaatcgatacagcactcgacaacctcttctgtactgtaaccctcaaccattgatccctccggatgggcatgatttcagacgtagcccttcaaaaccgccatgtaacgctcgtatg

SEQ ID NO: 55156 - DNA, 4090 bp, Oryza sativa
taatgaccttctgtgagattgcattaaaaaagcagcacaaccttgtgatagcaaccttcaaatgttctggttttatggcacttattgcaatggcaagaaacacggtgagcaagacatgacagtctgttaacagtgaaatttggtaaacctcgaggatgtcatcggcctaaaatcagtatcggcttcagagtcctggaatcagtcgatgggagttatcaagtcgccatagtcggattcttactatattcggttaaggaaattaatctattaaagaaagcttatccaagagtaaccgagttcaatgaggatgcagcatggcagttatctattaattaggaatagtctgttagtttcctttttatctttaggaaagtgtgtttagtgtccgattaggactttatgttttccttttatctttaggagagtttctttcttgtcctacaaggactagtatctacccatgggtataaatatgtaaacccggggtcattgtaatttatctctcgatcaataatactctcggcgcatcgccaccctctttcctgaggtttttacttgaaatttggcacctgacacggggctgcatcggttcagttcgatctccggcgaaggggtaagtcctacgttccgccggccctggtgaatctatcggctgcttcgatctcttggatcgctctggtttggttgatatatttgcctacctgatatctcaattccatctctaattgcattgtgtttagagacgcatcggtttagttgggactgtctcggttaggtctgatcttctatcttagctgatatatctctacaatcataatgttgttctaaatagatttgttatatctatcacattagacagatctatcggctcatctagtattagattatcatatacaatctcgtgctgcatcggttaggttcgacctactagattgttgttgataacataagtcttgtttagccgataggttcatgctagtgttttatcggggtgctagccgataagttatctggatgttgcatcagcttataaggatagcatatgatatatatatatatatatatgtatatatatatatatatatatataaaagttggatttagccgatgacaacaaaagtttcattgatttatctaatcttgtagattttatgacatcggacctccagcgtattatttacccttcgaatcagattggtttctactggattatattgctatattattattgtttatcatcatcagccgatcgcctttatatcattatctacattggacatatagccgattgctaaaaaccctatcgacatcgactgaaatcggcatcggctaatttcggctatcggctggaattactccatcggcttgtcagccaatcggctttttttatctgttttttacatatcttgtcagttgcaggatcaaactgactggcacgctcgcatgtcatcaacctttggacatgcactggagctaagcagatctcccaggccagtatatgtttttcgcatcagcacagtcgtgtgaattataactagataacgtcaaatctttcatggagactagtcgactgatgtttgatgagaaacctatgggcactttcacatcacgaagtgataagcaaaatgatttcttctcctcaggtgtcggtgtgaaacaggctggtgaaatatatattttgccgttcttctctctttcttgagggtgtaactcttcactaattcccatctcgactaggtcaagtcgtgattgcagaccatccttagtcttctatggtatgtccaacaatgtttcaattacgttgtcaaacacattcttttctagatgcatgacatctatggcatgccgaacctctagatctttccagtacgggaggtacttaaagaaaattgaatgtttcttgaatgggggagggagttgatcacctggcttctttctatcttctggtttcttggtcttgtcaggtttcttgcgctttgtaccctttgaaggtttcttagtcccttttccaaattcgcaaactattttctctgtcatttcacatactttctccccggatgtatatttttgtggaggatcactctcttcaatgccatcgaattctgacttcatcttgcggtacttgtgatctgtgcgtaggaaccgccggtgctgcatgtacacaaactcgttggaacccggaaggtacctatagtacgttccattcaagcagatcacacatcctgttttacctttaatttgccctgaaactgaaaacatggcggggtaatcgttaatgatcacgaagatgatggccttcactgtgaagtattctctcaagtactcgtcccacactttcaacccctctttccataaatccgctgtatcttccaacaatggttcaagaaatacgttaatatcaataccagactgtcagggtccctgtatcaagatacagagtaatacgtattttcacttttgacaaagccaggtagtaagattatacatggtgaaaagcactggccaagtactatgtgagctactcatgtctccaaaaggattaagtccatcagtactaaggacaaacctaatattccgtgggtctttagcaaactcttcgtacttagcatcaaagtttatccactgatgagcatctgtcgggtgttggagcatcccatctttcttgcgcccttcttgatgccagcgcattagatctgcatctcgtagatttgagcatatccgtttaatgcggtctttgactggaaagtaccacatcacacgctgcgggatttttctcttagttcccttgaatatgttagacgcttctaggaaagtatttctatttgatttgtaccggctagcaccgcaagttggacattcatccaaagaagcgtactcttttctgtacagtatgcagtgattaacgcacgcatgaatcttttctacaccaagtgaaaggggacatatgagtttcttcgcttgatatgtgttgtatggtaatgagttaggcctcggaagcatgttcttcgaaagttcaagtagactgtcgaaactactatcagacaatccatatctcacctttaacctcataagttcaagaactggccgtagtgttgagaactcactgtcacagccctttgactcttcgtacaaaacttccttcgctgctttctgtaaagtttcaaagttatttaaacctctagccgacccaatcagcacctcaggttctgcatgacgtaacatttcctctagatcaattttgtcttcaccacaaccaacgccgtacaccatgtcttcaacttctgtcggaacttctttttcaggcccggccacttcttgttcgccatgacgtgtccatatttcgtatttttccatatatccacgagttactaagtgttcctttactttaccaacatcttcccaggccctttcattcttacaatcagcacatagacaaattatcttcgtcatattgttctgttcagcgtgtgccttcacaatactaataaatttacatttcttccctatataaagccaaatacctcggcgaatgatacatccattgccgcctgtccatatctctacaaaaaatgaccaacaaatatttacgctattcataccaaatttctagggttcactaaaaatgacatagcactattcataagaacaaagattatttaatttcatactaaattaatatcatagaaaaatctaacaaaatcatatcatcataacacaaataatttttttaatcgaccaaattaacatacataaaaaattttcttctctatgtgtctagatctagacctaggagatggagcttttccttcacaattttgcatgcatagatccatcacaaattaaggtctaaaagcataaaaaaaattacatatctagagtggaaatgagtagatctaaccatcgtagaaaaatccccctgagatttgaagttaacagcctacacaaacatatcaaaataaagtaaataaaaaaacatggagcttttccttcacaattatgcatgcatagatccatcacaaattgaggtttaaaagcttaaaaaatgtatacatagagtggaaatgagtagatctaaccaccgtagaagaat

SEQ ID NO: 55157 - DNA, 8942 bp, Oryza sativa
  unsure (1)..(8942): unsure at all n locations
tcctcggctctagttttcaccggcgaggtatttgctcaaaagcgtatgtccggttgcaaaaattttttgccgacgtctgcgaaaatgctttttccagtagtgcgtaggtcgcatgggacatgcaaacaagcaaaacaatctcagattagccttaaaaaaactaattttgtagatgcaatgggcatgcatgtatcgatcaactatgcactctgtttgccagatgtgcatgcatgccgatcaatctcgtgcatcgacgccagatccatcgacgcatatgcgtgattgaagcagctccgacgacggtcaagcggatgcgtggcaaggtgcggcatcaaccggggccgcgcggggaagcaagcatgaatcatgatgcgggaggttgcacgggacgagaagggcggtcggcgagctgcgtcgcccaccgcgccttcctgcatgccccgacatgaacagcctggggtcgcgccagctcgtgacgcgtccacgacttgcgcgatcgccaccccggccaggatagcacgtcgcaggcgtgcactgcatcgtcctgcgctgcttatgccatcaacgcgatctcgtcgacggtatcaatcggtgattgaagccatctcctcctgatgattgatctagcgcccctctacctggcgtatcaacagtcgattctctggatccgcaatataatttatagggtgcacgaaattaaggagatatggttacacagagtttatactgattcaggctctcaggggtaatgccctagtccagtcgaaattgctaattggcgccccccgcgcgcgactgggcacgtggcgcgatgggggagggggagggctgagcggcgcgatggggaagggccacatggcaccggttcgttttttcggttctctgttggttttttttcggttttcctgttggttttttttggttttcctgttcattttttcggtgtttttatatgtttgtacgacgtatacaaagtttgtatatgtcgtatacaaactttgtatacatgtttttttctttctcggtttttttgtttttaatatgcacgtatacaaagcttgtatacgtatgtatacaaagtttgtatacatgtatatattttttataaaatatatacatatagaaaattatatttatatacatatatataaactttgtatgtacgtatacaaagttacatgtatgtatatacatatgtatataggaatagtagtatatatcatagtagtagagtatatagtagtagtatagagactagggggagtggggctggtcgcgcgccaacgcccctaagtccagttgtatgagattagatttgtatctaagtatccgcagcataacgtgtgaatagcacgtagaacgtatcgtcctcttccttgaattagggttttcggtcctccttatatatacttggaggcggccaattatggtaggtaacaaatcacttataatataggaacctaccatctatttacatgagataagatcggttgccttatctagccacacatgcactgcataaactcagacctacgcggccctctctatgttatgcggcccaatggcccaaccgtgggtacccgggtaccgtgaccccacaatagcatccctcctcatcgctgtgaaaagggcggacgtggttggggaatgaggaggcatgtcgtcgtcccttctcgctgccttggggaggccggacctggcaccccggaggtcgaaataactagatcagggtgggcgatgctaaggaggtggggggtagatcacagtgctcacatgggggaggaggtggcggtgcactactacaggattgattttcctggacgccaccccattttgtttccatgtagtccataagttggactgcacggaaaaatggggggagcgaagccgggtcgttgcccgcacacgaaaatcaattttcatgtgcgggttacttaacaggcccgcacgcaaaaataaccctattttcgcgtgcgggcctcctaatctacccgcacagaaaaatagccttccctcccatcctattaaaaaaaattttgactttcttctctccccctgggcccccttctctcctctctctctcccccttatcttctcactttcctctcctcctctcattttcctctctctctctctctctctctctcaccttcttcttctcaccacatggccgacgcctccttcttctcctcccggcggctctcaacggcgggcccgacggcggctggcgggagcggcgggctcgcggcggcggtgggtgggagcggcatgcgcgtggcagcgggctcacgatgggcagacgtggggaggcggcggtaggcggacaggggccactgccgacgacgacgcggcggccgggagcgtcgtgcacacggcggcggcgggcggacgtgggccactgccgacgacgaagatgaagcagcgagctcggcggcggcggacagacgtggggaggtggcggtgggcggacgggggccgctgccgacaacgacgacgaggtggcggccgggagcagcgccgccgccgccgttcgacctagggttagggttaggattttgtaattttattttttttttggattttgattttcgtgattttcccagacgaatcattccagacgggcgaaacaaccgcacgcaaaaatttgctattgtagtagtggtggtggctatcgagaatggggggcgcgtaggcggcacttgggtagggtagcagagccgactgcggtgctcactattgacatggagaagagggacggtcgatcttaatctgaagggagggcgcttagcaagagtgtttcagtaaacaaattgaggagctgggtattcttgctttgctaggctccgaacttataacggttagagatactaacctctgttagagattagaatcaggcattgttacaggacactgcttgtgtgtgttttatctctaggataagtccaaactcacttttggggggaaaacactccataaacgtggtaatttgccagtggacaccgcgctgattaaaataataatttccggttgaagaggagagagaaatcgcgtaaaatatcaaaaatacccttgggcccacatgtcagctctcctatctcacttctctctctatcccctccttccagctcgtccgcaatggcctcgaagcacctcccgcttccacgacgccatgcggaccatccacgccgtcgtggcgatggctggcgatgaaggggcggcgcggcgaggcgaggttggtgctcgaccggacgtcggacaccgccggccgagggcgagcagtggctgcaggacattgaggacgtcgtcaccgccagctccgtcggtggcaacagcggcggcgcgcgccggcatatggaaacaaacgatccaacacatcaccggccgtcacgtctctctttaaagcatgcacacacacatatggatggatcagcagctagctgcacaagcaatagcaatacatcgccagcgagaacacgagctatctgcatcaatgcggcggcgcacttcgtgttcgtcccgctcatggcgcagggccacctcataccggcgttggacaccacactgctgcgggccacccacggcgcgctctgcaccatcgtcaccacgccagccacggcggcgagggcgggccccaccgtcgactcggcccggcggtccgcctcgccgagttcccgctcgactacgccacctcctcctccacgctcgcccgacgtgcctcgtggcggacttctgccacccgtgggcgtcggagctcgccgccggcctcaccgtcccgcggctcaccttctttagcatgtccgccttttgcctcctctgccagcacaacgtcgagaggttcggcgcctacgacagcgtcgccgacgacaacgcgccggtggtcgtgcctggcctggcgaggacgatcgaggtcacgcgggcgcaggccccgggcttcttccgcgtcgccaggtgggacaagttcgccgacgacgtggagcgcaggtgatgggcggtgatggcgcggcgcggccgtgcttgagcgctggccggctcggcgcggtgtggagcatggcggcaaggtggaacggagggaggcggcatgggaggaaggaggtcctccagcggccaccggtgccgagtagaccgcgcgcgctccgggcatcgccgctgtcaccgagcaagccgcgaccgagaggaagaagaagaagggagaaagaaacaaagagaggagagctgacatgtgggcccaagggtatttttgacatttcacgtaatttctctcacctctttaaccgaaaattattattttaatcagcgcagtgtccactggcaaattaccacgtttatggagtgttttcccccaaaagtgagtttaggcagtatcctaagattaaaaccacacattagcagtgtcttgtagcaaaatttgccttagaataaaatctataataggtttagaatattgaaccattacacagataggttgtcgtcagtaaccagtgtttgatcctacctctatctataacagtctatataattaagtgttacaggttatgtccttgcaaactgtcttagctaagcggttacagatggccgcggttactgctggttacacgttccgtagtagtgtgtggagcccaccagcaaagatccggccttcctccctaaggatggaaactaattcttctgaacgcgtaaaagactcattagtatataattaattaagtattagtatattttttaaaaaaaatagattaatatgatttttgaaagtaacttacaaaacttttaaaaaaaatgtaccatgcgatgcaccatgcaccatgcaccaccatggacggaaacgcaaatttgtccgtccatgcaatgcaccggaccggggagagtcatcgtcgatcgtcgtaccctcaccccctctctttttctcctttttcgagaggaaagggtaccatattgttccttcgttgggaaggcaggcatggcatgtgtgtgccgtggtagaaaaaggcggatgcgtcgcctccataaataaagccaagaaacaacgcatatatagtataattcaattatccgtccacgaatcttggattccagcgctgcctcctgcactgcactgcaagtagactagagcagatgccgtacgtcagtgcttgatagcctaagaaaaacggtggtaattggcgtgcttaatttttaattttggtttcccgtacgtgtgagtgtgtgtacatgcacctgcgaatcgacgaggaagcagcagcaggggcagagcaggaggaaatggaggaggaggacgtgaagggcggcatcgcgaggagcgccatggcggcgtcgtacaacgaccagatccggccgctgctggacgccgtggaccggctgcggcagctgaacgtgagccaggagggcatacagctcccgaccatcgtggtggtcggggaccagtcgagcggcaagtccagcgtgctggagtcgctggccggcatcagcctcccgcgcgggcagggcatctgcacccgcgtgcccctggtgatgcggctgcaggacgccggcgacgacgacgagcctgcgctgcggctcgagtacagcggcggccgcgtggtggctacctccgaggccgaggtcgccgacgccatcaacgccgccaccgccgagatcgccgggtgcggcaagggcatctccaacgcgcccatcaccctggtggtgcgcaagaagggcgtgcccgacctcaccctcgtcgacctgccgggcatcacccgcgtgcccgtgaaggggcagccggaagacatctacgaccagatcgctggcatcatcaaggcgtacatcgcgcccagggagagcatcatcctcaacgtgctctccgccaccgtcgacttcccgacgtgcgagtccatccgcatgtcgcagcaggtggaccgcaccggcaaccgcacgctggccgtcgtcaccaagtccgacaaggcccccgagggcctgctcgagaaggtcaccgtggacgacgtgcgcatcggcctgggctacgtctgcgtccggaaccgcatcggcgacgagacttacaaggaggcccgggaggcggaggcgcggctgttcgcggagcaccctctgctctccaggatcgacaagtccatggtgggcgtcccgacgctggcgcggaggctgacgcagatccaggcgagaatcatcgcccggtccctccccgacatcgtcaagcagatcaacgacaagctcagccgcagcagcgacgagctcggccagatgccgccggagctctgcaccgtggcagacgcggtgagggaattcttccacatcgtcaatcagatgcgcgcgtcgctggagaaggtgctcgtcaggggagagttcgacgagtaccccaacgaccgccaccaccacggcacggcgcgcctcgccaagatgctcgagggcttcgcgcgcaggctgccggcggcggccgcgaccgacggcgagccgttcctggtggaggagatgcgggtgctcaaggagaccaagggcatcaacctccccaacttcatgccgaggtcggcgctccacgttctgctcaaccggaaggtgaagagcatcgcgcaagtcccgcacgatctcgtcaggcaggtgtgggactacgtggaggacctggtgctcaaggagctgcagcgccactcgcgcagctacccgcaggtgcagccgtcgtgccgccccgccgtgcagagcctcatggacaaggcgcgagagcggtcggcgcggtacgtgaacgagctcatcgacatggagatggtggccaactacacggcgaaccccgagtacatcaagacctggaccagcatgatggatggccagagcaggctccgcgaggccctggaggaccgctccaagccagtggcgaaggtatatagtgtttggggggtgcacatgaaccccctaaattcctaatttctcacttaaaaacactagaatgtatagcgttgtactgaaattttctagattctcaatggtagtgcaccccccttgttttgatgctagcttcgctccttctccaagcccacggcggtcgccctcccggggttcggagagaccgacgtgtcgcacctccaccagctgccgccggagcaggtggagctcgccatgcaggccttcgacctcaaggcgcgactcgccgcgtactggaacagcgtcgtgctccgcgtcatcgacggcttggccctgcacgtcctctacagcatcaagcgcctcgctgagaaggatctcgaggatgagctcgctgctcaggtcatgggcaataacatggacggagtggagcggatgctggtgcccacacccgccgccgccgccaagcgtgactgtctcaagaaaagcatcaaactgctccgggaatccagggaagtcgtcgccaatatcatggacagattaacgcggcaagcaccgaccatgtctgataactactactccacctagtactccacttcgcgtgtagctgccacgcataataatactctccatgagacattccctccctcgttggttacatgttattcaaatagctataaaaaaaatttaaaaggatatcagcgtagccactagctacctagctttccttccatccatcaccactcgcgcgtcttgcgtgtaattttcagattgttatcagtgtcctagatatgggatatcctatacatgtgtacttagctcggcggggaccaccatataccaaatcctgtacggaatcaaacctcatacgtatggcaaaactcttaagtagataagagaggagtctcaaataaagagaaacatagtcctatttgggcctaaccagaactactcgaatcgtacacatatttgtcttcctagttctacttagataaggggacacttgagggtataaatacaggaccccaaggaagggagggataagccaacacatcccaacaagccaagagagatacaaaccaatacaagccaccatcaatctcgtagagtcactactcgaggaagccaactacagctagccgccgaccaccatgctcgagctttacgccaatatactggcagcctagattaggctttcctctatatactttgtactcgagagattgatatataaaggcaacaccggcttcgtccaatagtagtagggctattacccatcatccaggggcccaaacctgtaaaaatctcgggtctcccattttcctattcctatcttgtgtataccctggtaccaacattccctatactctacaagcatagttgttgaatctactccattgacagtatgcagtattcctagacatggtaagtacatgtatatgaggtataccttatctatgacactaacagtaaccctcgacctctacgcaaatgctcattcaatgctgacaactctagcacacccgagaagctatgatgtcgaaaaaataaacttactcattcattgccctctttgtcttccatcatcttcaaactcccagagcccaagaacgaaccctaacctccacaacaatcttgctttctcataatccacccatggatcttgagaaatccaccatgaataaagcattactcaaggcactccaggtggaggaattaatccttggccaggaaacaattgtcacacccagatattcataaccagaattcagaactaaattgtgcattaaacccctatccaagactagctatgttacacaaatgatagtgtattatagatctaatgtcttacaaaacatcatcagatgtttatacaaatgcagcacaaacttgaaaagataaactaaacgataacatcaagcagatcaacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 55158 - DNA, 866 bp, Oryza sativa
taaagtaatcttatattaaaaatcaaataatattacatgctaagactaaaatagtcatgtatgctaagtgtttcgtgcgtatatgctaagtctaattaagactacaatagtcaattgctacttgtcgcaccacttccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataattttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctacaagatacaaaaagatgtattaggataaatgcgaagtaacatatatatatatatatatatatattgcatttcacgttaacgttcgtcctcgttcgttcgctcgttctcgttcatgttcgttcgcttgttctcgttcacgttcgttccctcgttctcgcttgtcttcgttcgatcgttctcgttctcgctctcgttcgttcgatcgttctcgttcttgttcacgttctcgcggcaacgtacgttgacgtgttcgttctcgctctcgttcgttcgatcgttctcgttctcgttcacgttctcgcggcaacgtac

SEQ ID NO: 55159 - DNA, 1325 bp, Oryza sativa
gccaaatgccttgtcactaaccccattttttgccttccattgcaacaactctagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggttagcgtacatccattgccgatccatctacatgagtcaaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttcttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagtcccggttggtgctaccaaccgggactaaagtcccacccctatatatatgtcttcttcctcctccagctgcccgagcaggcttcaaaatttcttcaaaaaagaggggaggtcgtgccaaaatttctattgaatttattttggggattacgtacaatcggaggggcct

SEQ ID NO: 55160 - DNA, 705 bp, Oryza sativa
tcctgcacccctccgtttcacaatgtaagtcattctagtatttcccacatgcatattgatactaatgaatctagatagatacatatgtctagattcattggcatcaatatgaatgtgagaaatgctagaatgacttacattatgaaacggagggagtactaaaaactataagaagtaataactagtaatctctgaaagttaaacttaaagatatctacttcatgccaagaatgacaagcaaaatgtttaccactgctttacactgcaggaagagccagtcatgggggcagttatcaagtagatatacaaaatcttttggctctgccactgccacaatgttttggagttgtcaggatggaggtaaattacacgtgcacagaaaaaaaaatggcaatgagaaacaaggtcacatcttaagaggtgaacttacatgttccaagcccaccccaacctttgttgatgatacctctctgtccagttatttcaagtgctttgacaatgacttcagtcatctttgctggatcttgaactggctagtatatatacgaacaaatgaaaggagtgaattttcaaaacacaacaatcatagtatcctaaaattcattaagaaaaaaactgaaccatggaatcactatttgcaagcagctactatatgcatgccacacagatcaacaccaccaaggcaccaacaactcattatcataa

SEQ ID NO: 55161 - DNA, 3889 bp, Oryza sativa
tcatgtaaaattgatgttactagatttattattaaacaaactatcataatatgtaactctttttatttaaaacatcttacttttatagatattgctggtcagagtagcatctcggaaaccgtgtcaaagttcaaaaattcttatattttgggacggagggagtagcaaactttcatgctcattaccaattagaaaaatgtggtatcaaactgaaaggctaccaatttcagttggcattactaatattgacttggttcacagtgttatcacagcaaatactcaagcaagctcttttcaatacaacaactgaatgctataagaaagtcaaatgaaaagaaaccatacgaccaaatgaaggcccacaagttttaaaaactatacaatcgacggatgacaaggttaagcatgacgtgaaaagggataacatataaatctcagataaagctaatactcatcaggaacctttcggttttggaacaaggtgaggactccagatgtaaccatgaggaatgtcattcccagaaccctgtgcaccacttaggtatgttaccggacgcaacttcagcttcttcttcctaaattcatttatcatatctcggataccaagccaaatcatagagtcaacaatttgataagaaagctgcaagtgtaaaccatttgaagattagataacaaatcagatcagaagaaaatgagtgatttgagtatgaatctttcaacaagtgcttgatgtgagttagggagatgatctctaactttgacatgtggtgcatggttgtttttagggaatgcagcaaaattgcaacctatttaattacaagaattactataaattggatcaaggtcccttgcaacctaaagagcactcccaagaacaccagccacactgaatgaagccagaaactaactctctgcatacagtaactcacttgagtttaccacccaaatcagtctaacaacaaacgagcacaagcaggcaggccaaaattgtcagagttgggaccctatcccagagatgcacaacaatgcaaacaaagtaagcacaacaaaacctattgtctgattgccatttacaaaataacagttcaagccatttcaaatatctctactattataaaaattgaagatgtttccgccggaattttggtacgtcgcccgtatccaattcgatgtgagcctaaaataactattgtaactattattcaaaaaatttgtacaaatataaaaaataaaatgttgtgcttaaagtactttgggtaataaagtaagtcaaaaaaaataattctaaaatttttttgaataagacgagtggtcaaacagggcaaacaaaaactcaaaatcccttgtattatgggatggagggagtagtttgtaacttttggtcccattggtgtttttgattgctcagttgatggttttcttcatattgaggcccagagcacattctatcgtgttgctactgatattgcgttcactgggacctgttagttcttaaattcatcacttccagatttttcctccaatgaaatcttgtttccatttttccctttggcatgctatctttgaaaaatcatgttgatacagaactgaagtaccggttaactgaagaaatttttgttagacaactgattttgatattttttgagtctctacaagtcttgatccatgttgtaggagcctatttctaatcccatgtcattcttattcttgcagatgagtcttggttttcattcctgcaacgcagtgactgggaaatactattaatggatgctatccttgatgttcctactgacgatgggaaacaccaaacaattagggtaacaattccagacaacacgacaccatcaccacaaattgattgcaaggcatgcaagtcccaaccaacgccgacgccacctccgcctccatctccgtcacctccacagaagtgaatccatctggagaatacttttggtccggaaacagctaccatggattagttttttctttaccctattgctcatcaaccctgaaaagaaataagtgctgcagttggaacgggagaacagcagattttttgctttggtgttcgcaacgatacaacatagaataggttacctgattgtttcccacgcagcaatactttgaaaggtaggtccatcagtcactaaactagatttgctttaggacttgctagcggggcatcatatattttaactgaagttttgatactccatgagatctcgtagattcttgctggttgcacaagcctgctgattggcatttggcaatacatacatatagtacgtagcagtttgattagggatgtgggattttaagttcaacaaatgatggcttctgtgtagtcaatcattaaattgtctcggccgagctatccgccatgtcattatctttctattgttagtgatcaagaggcctgcttatgagatttatccccttctattatacctcactttatagttatcaaaatatggctatttctagctgtagctatattttatgaaggatggaggtaatagattcttaactgattgccctttgttagatttggtcctgttttctaccatgcatataaccaacttttggttatgaatatggacaaatatgtgttcagatttatagcttaacacttgctatattttgagagcatgcagtatttctttttcatttgacaagtaaattgacaaactactcgcccaactacccaagctacgccatttgccgatctgcaccgtatgccgttggcgacctgctcgtcttgtcccttgctcgtcgcgttgcctctacttattctcgaataaaaccgtacataagtaatagggatttgatatagggaaaattggcatatctcattaatatgaaagtagtattggtgggttggttggtaggtaaggggtattgaagggataaaactcttccatttgtgaaccaatagtaggtaagagtatagaaatcagctttttttttggcatttgacggggaacttgtagttacattttggaaaagttcctgacttgtaattagcgcgcagttcgtctttggcaacctttagaactcccgctacctctaacatgttagagcatgtcctagctcatccaaacctgatctaccatattaccatttgaatggtcataaaaaaatccatctctatatctcttttcactccaacaaatcattcatattacatcttcaataaaccacacctttttatattttattaatatctttcaactcctaactggtaaaagtatatttctcttcatcttttctctatgacaggttcatcccgggtgctcgatccagagaagaggaagaggggaagggtggactaggacaaccgagtagaggggcgacagtgggagctagcgacgcagatgggcacgggtggtgcagggccatcggagttgggtcagcggctcagcacgagaggtgcactggtcacagactgtgggccgctagagcctcctaggggagggcgtgagcggcgcaggtgatagcgcgggtcgcacagggccgccgaagttgtcgcaattggaggtgctgcaggcgtaggggcaggggtagttgatccgaatgggggcgggagcttgatctggaggagtcggttgcaatatggcgtgaggagagagaaacgccaaatataaatttggtgtttctctctgtgggatagcgtatgcaccatttttggaggcctggatagcatatatgctagagtcgcttttttccctccatatgccattttttcaatggagaacatgatagatgagctgctaggcatgctcttagcaagcgtccgtgtggtggattatgtttcacttgtagtgaaaagaaaatcttgaccgtggaaaatacataacatgattatctgatgtcaacttagtggaacgct

SEQ ID NO: 55162 - DNA, 1750 bp, Oryza sativa
  unsure (1)..(1750): unsure at all n locations
caggtggtgaggtcggctggccggccatccgcgcggcgcggtggtcgttttattcttagccaataaagaaactaaaattctgcttcacaatttttaattttggtagcggctgagaggcaaacttcgatgtgactttgtataaatttagtttattttgcttattttttatatactctctcatcctagaatatagcagtctataactaaatgtaacttacactactatgtaaatctagacaggaaaaaaaagtacaagagtactctccatcttatattaagtgcagttgtagaatttaattaaaaaccaaattagtaggacaaacgaattacctaaatgcccggatgggattgagagtgggatggcatgtaatttaaatgatgaatgataaaatgggaaggaattaatttaaatcaaaagtggttgaaacagaaaaaatgtgaataggttgccacttattatgtgatgaagtttgcatactaggaggtgtttagatacaggggtgtaaagttttggcgtgtcacatcaggtattatatagggtgtcgcatggggtgttcaggcactaataaaagaactaattacagtatccgttagtaaaccacgagacgaatttattataagcataattaatctgtcattagcacatgtttattgtaacaccatattgtcaaatcatggagcaattaggcttaaaagatccgtctcgcaaattagtcgcaatatgtgctattagctatttctttagcctatatttaatactccacgcatgtgtttaaacgttcgatatgacagagtttaaaattttggggtgagatctaggcaacttatcctatgcacacacctatcttggtgtactcatgcactcgaccactatcagctcttgtattctaatccaaaggctaaaaacctaagtgtggcgtttttgtaagagaaaccacgaggtaagacttcatgttagttttcctcaaaaaaaaaattccatcaaatggcccattccgtaggaattctgaagatgcttttcagagtcattcttttattcaaaacaatcacataagaattatttcccctaagaattcaatctttgataattcctccatttcccctttgttccgaaggagcccatagaagacagtgtcgatgtccaagactttacataattgcgaccacatagaataatctcacagtacacgtggaggctgacgtgccatggtcctatcatggtacactttcacagcccacttggcacgatcttatgaccttccaagacaataacgcccaaaagttgtggagattttagctgcaaatgttgccatccaacacaaccagggagggtacagtcagtagaaaatgtacaatcgagtggagcaagcggccttgccaagttgccacggcctacatcccagcatttgttgtcaaaacatgagtgacccatcttgttgtgttcgtcctccaaacgacaaaccgcaaaacatcatcgaacatatgcctagaccacccaagtttctgctgttcgctagtactgttggatccacaagaattaatactctgctagagacagacagagatgcccctaggtggtattggcacatgtacaatgctactatagtttgcaatgccatgacatgaaagatatcataaaacgagaactaaagaaaatggtataaaaggtacaatatgaccaatacaataaacctgnnnnnnnnnnnnnnnnnnnnnnnnnnnnnnnnnnnnnnnnnnnnnnnnnnnnnnn

SEQ ID NO: 55163 - DNA, 1038 bp, Oryza sativa
cagccggggtggttgttcagaatggttgggcctatacaacagggtatgttgtatagcgttggattaatattgtttaattacttaactgttttatcaaattctcaaatgtttgctaaatgctgcttttgcaaatacaaccatattatgccatcctttgttatcctgtgcacttgcatatttgctgcgtggcttgctgagtatgtcatatactcaccttgcaatcattcatcagaagaagagttctacaatgaggctgatggtgtggaggattaggtgtagccttggtcaagctacctgtggagtggagccgtctgcgccgtttatttaatttccgctgcttagaactttattgattgagaggaactatctacctctgtaatgacattttattcgcttattaattagagtattatttgtactctattatcaatttgttattgtgtgcctcggctgattcctggacgagggttcacacacatgtaagcgtttggaattttggatagaaattccgggcgtgacaccattccatagtgtccaggtgatatgaacatcccaaagtctagagttgtaaaatcacctaatgttacctaattaaacagcgaagcatctacctaaaatcatactagtggtaccatgagtagagtgtccactagttggggttttgtttaatctagggtgaacaaggtaataataacaataacaataataataaggtcataacaaaggtaaataggcatggctagataaaacagtgataacgcgggaatttaaataaagcgataatgcaataatttaaagcaacataattttataaactgggattcaatatgttcaaggatgatgtgacttgccttgctcgctttcccaaacgtcagcttcaacttccacgaagagcggatcttccgaagctgcagcgtctacacgaccaacggaaaagaaaaggcttttactctaataaactccatataacaagtagaaacaaagcacaaaaatgggttcttgacttcttaaggaaaaattagagactcgaacggtcca

SEQ ID NO: 55164 - DNA, 854 bp, Oryza sativa
ttcctgcagccctaaaaaatatgtgggacccatttatcattcaccaaaagtatgggtgggtcccactgacacgtggggctcatataaatcatatcctcccctctctttctctccgcgagtgtgggacgggggccaatggcgacggagacccaggagcggcactggagcggtgacggaggcgtgcgggtgagggccggagcggcggcggcggcggcggagatcgagaccgccgtggaaggttggccgtcggaaggaagaaaacgagccacgagaacggccgtgtcctcgccatcctcggccccgccaccgcactatccatcgctgcgctccacgccctctctgccggccacgacgcaccggcctccgccgttctcccgccgcgcccacgaacgcgtaagggtcgcctgcgtctcgccaccgcgactcgcgtcggcatcccctcgaagatggcggcatccggcggtggcttcttctgcacctgcggcggcaaccactactacaaaaatcgtttttctgtacgagggggtcggtaggttctatgcgggccgcttgtggcggcgcctgcaaaaaccgccccccgggggcgggttgattagccgcatgcgaacatgcggccgtcttaagtggccgcatatattagggcatgcggctccttaagacggccgcatgcgaaaataggcccattatcgcatgcggctgatcttcgcatgcggctgtcctaagcagccgcatgcgataatggatcttcgcatgcggctggcttaagggaccgcatgcgatgatcggccatatatgctcctccaggcccgagcttgaccatttgaaaacgaagctttctctctcctaaagcaagc

SEQ ID NO: 55165 - DNA, 857 bp, Oryza sativa
ccacataccaccacggtatacagacggaagacgtgacatagtttccaacccatcctagccatagacaagagtaccgacccaatcccacctacggccggaacccccggacaggcaggcaggactgagcccctagcagcaggacaccggccctgtgccatgacatctcgactaccgggccacagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccaaaccatttgtcacaccctgaaaattcaaaatatatatactttgcttaattctataattcctagatttttctgggatttatttgagctaagaaagtatttttaataaatggaattgcatttaagaaataatttaaattgaaaaaggttttaaaaagtctcttttggctttgggccgaaagtcggcccaaaatcccttctctctcctcagcccagtccggcccagtccgcagccgcccgcgcgagcgcgctgtcgctgacaggtggggcccacccgtcagtcgtcgtcttcctcgggccgaaaccctagtttcgcgccgccgagctgccgtcgccgccgctttccaaatccggccgttcctttccttctccggccgatttgttagaggggggtgcaggaat

SEQ ID NO: 55166 - DNA, 3639 bp, Oryza sativa
  unsure (1)..(3639): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaattaatgtaccctttaatataaaaaagaaatatactataggtatctaattaagactgcgttcgttcttgagctgaacatctgagatggaaattggagcaagcaattaacatatgattaattaattaattattactataaatttgaaaaataaatttatttgatttttagtaacttttatatgattcttttatgaaatatattgtttagcagttcgggaattatgctaattaagaatgagatattaccttaagcctagatgccggaacaaaaacaacctaagtgtgtgttaaaggcgtgcacttatatggatgcgcatgctaataatagtgcacacacatattttccatgtaataaaattaggattcacccaaaaaaacacattatattcgcagcctgcgctaacctgcagggagccatatataaaatttcgttttttttttatcaaaagtgggcaatctgtaagaaatcgttagctcagcctatcgtgggctgaagtactaacagagagtaacaggctactgggctcatccccttgtccttaaccaagtttctaccggttctctcgcccaaaagacaatatcaacgcgcctcagctttgtccaatcatactcactagtcgccatatacagatgaaaaaaaaatgttccaaatattggtcgatgagaaatcgcgacatatcattatcgtttccgtcaagaacaagaactccgcatatacaaatggagtaatggaaacaggttgaatcgaatgatcgccgactcgctacagaacattactagcaatgattccccagattaagcggacggtctgagcaagtaaggtcgatgaatccgtcttcctcctccgattgtgaagatttgcgaggagtacacttgcatgaatacattctcggattaaaggatgaaccgcagtcgtagcaaaacacagtgccacatctgcaaacaaaatttatcacatgaatgtaagaaatttcatgccgacttaggaagcaccagtgatgtggtggtaaagtcgtgggtgtatgactctacccaccagagttcaaattaatgctggtgctcacaaatattacgcatatatatgtgaactttctaaaaaactttagtgagatcatgtatgtgctcctggtttctatttcttagagcatgtgttaggagacgtattcgcggagatgtgagtgttgtgttgcgtgtgtagtgttgtgtgtgcgtgtaagtttgccgtgtaatcgtaaaaaaatcaaagcataattccataactacgggtctacggctctatttgaatagctgaaagtggtttgatggatcatttattttttttctacagttatttcaaagcataaacaaatgaattataactactgcaaaattgaaagtagctttataaaagcattcaagatgtcacaccccaatccggcaccgccgtacaacagcacctgacaggagcgtgtcgtaggaaaaacggcgtgaaccgcttcctacgaaaccgcgatctcagtaccagtcccaggacatagcgctggtacccacggtgacaaatatgaatcattgcaatccttataataaatagaggacttatttaccttaacttaggttgcattttagaacagcccgagaatgcaaccgacgacacgaacgaggaaacaccaacagcagcagcagcagcggaaccaacggactaacacccaacaccacaggcgacggctgggaactaggacgaaaccctattcttcatttcacttcatcttcatttcaaggtgtaggaactatatatatatttatatagagcaagggtgagtactttcgtactcagcaagtcacgagaatttaggtgtttgatgcaagcttggaagagaggcaaggttgttttgcaaatcctttgttttgaaatcattttgaaattactaagtggtttacttctttctaagtttgggccgaaaagagacttgtgtcttgattcgactttaagagatgtttttcaataactcaattggtaatgtaccgacccccgggtcagatcattacttctcggctcccagagccatttcacttgattaagcggctcccagagccttttcattttctcggactcccagagtccaactgcccagcagcacaacaatccgcttcaactcgggaagcctagtctatgatgcccgtagacatcccgaatcacacagattcgtttcttgaccactcaggtcatccatctgccacataggctgattctggtaacgattcccaaaccacaacaacttttcacaaagcacaggcaaacaaatctacgctacaggaaacacctcacatccgcccatgaccgtgggtacggctgttcgaacagttagttaacctctgcagagggggtacactttacccacacgacattactaacccggatcacccagtccgtgagatcagccatgtcgggagaccctaaggttttcatgacaaggcatttcgaaagccgacacagggttgccatatgccaacgagaggggtcccagaccgacaacaggttaggtcccagaccatattgtgccaggaagcccgagggttctacctgacaccagcccgttgaatccacatgtctcatggcatcatggctcctccgattagctaattactcagccaggggcgtcccattgcacccgtgtggtcgcacttattatatgctcggatgaatttcccacaggaatcggtccttatatgcgaatacaggacagtaccacataggcacaacccccgcatcgcgagttttcacaatctattttgttttcaaacacaccgatgccatatgtcgggttttcaaggctctcaaacacaccgatacaaacaatggtgtatgtggaatagttggtatatgtgctcagagagcacggataccgaagtaccacaaaggtggaacgacaaggaatcagggtagtacaacctacaaaaattagtgcgactactgggtaggtctgtcggtttggcacgcaaaccgaggccaagcaagttaagtgtgtgattctactaatgcaagttgcaaacaaaataataatgattttccaattataggagcaattggtcaaagggtgatttgtcttgctcaaggtcttcacgaagcttcacgtatcttcgagaaaacccacgatcgatgaaaatccggtgaccgcaactatacgcaaacaatcaaaaacctaaacaaaagaccaagaaaaaatatcctatttagactaaataatagtaccattagatagatcacaattttacagaattactggaagtggaacggggtcaatcggatgagcggttgagaagatatggattttcgaagtttattggattttctaatcaaaggaaaaacgatttaataatttattaaaccctttttggaaagaaattaaag

SEQ ID NO: 55167 - DNA, 41387 bp, Oryza sativa
ggtaggagtggcgcacggattggtgcaccgggtggaccgaaggatggcaggcccacgcgcagccgttaggctctccgtggaccgcgcgcactgagagagagaggagggagcggacccgccttgactcggtcttcaccgaggtggcgctgacgtggcgcctccgtggcatgccacgcaggccggcgagaggaggaagaaagaggccggccgagatggacggcgggcggcgggggtctcaccggagcatggcgcgacggtcttcggccaagggggagcacaccggagtgaagaggggcacgagaggaggcgagccagtggctcggattcgccggaggaagatcgacgacggcggattgcggcgacgcacgccggcggtgagaaaaaagggggaaacggcggaggggcgacaaggattcaactcaaggtggtgggagtatctctgggagtcggggattctgtttccggcgccggatagggtggaggagcaccgaggagggctagcgtcgacggcggcctctaggagctgacggtaatggcggcgaggccatgccaggcgacggcattgctatggaatggtttggggaggccctagggagttcaaggacggtgttggctagggtggtcgacgagctggggcccgacgacggcgcgcgactgtgtgccgcggctgaaaaagcgcaacggcgaggcgcgcggcgcattgtgcggcaggaggaggaatacggtggggagctcaccggtgagggaggagcggtgttggcgacgcggagggagtcgcggcgaggtggtcgcgacggcggggcggcgcggaaccgagagggcgcggccgagaaaaggagggaggcagcgaggccgaaaggatgatgagtgtgtgcacacgctcttggccacggcagtgcggcaccgagcttgacgaggccgacgccgaggctcacgcggccattggcacaacgcggcagcgaggaggcagtcgcggaggggcgggggcgagcagctggcggccggcaacaatggcgcgggtggttcgagcgaggtgaagacgaaacgagaggggagggcgcgggctttataggcgaggaggagaggtcggtttggaggagggaaaccgacattggcggtcaagggagctcggttggtgttcacgggcggcagcggcggtttcgttggcagtgcgaaagcggcgacggtgtggatgtgttgggcggcgaaggcggtggatcgagcggcggaaattgaaccgcgagcgcgggctggcgcggcttggcgtggtcaaagtgggggcggcgaactggcgcgcggcgtcagcggcgttctgcctccgcgcgcaatggcatgggcgtgagagagaggtcgagtctgagagggaaaaaggggaaaagagggagaaaaaggggaggcttgtccatgccgttctgggaggaagagtgagaggggagcgcgagcgctggctcccgtctttggagggtagcggcaatgggcatcgggagagaggagagagaacgagagagagaaaagagagctctctctctctcggccatggcgcacgcgcgagcggcgctcgagggaaggggagagcggctgggagagggaagtgggctgaggggaaaatggcccacaacacccgagggaggcaaaataaacttctgcatagagatttgagttgggaggatattgggattggaatttggattggagagaatttgagaaggattttggaatttaaccttgatacttggcctctaggaacataaggtggagtcaagggaaggattcgaggtgggatttgaataattttggattcgaagaagtatttggcgaggattcaaggaaggatttgaatttcgaagacttgaattggaatagaaatcttgaggtggacgattttgatggcgatgagagggaacaaggacggatttgaattgagatccatggcacgacttagactcgcacataaagaaaagaaatttttgcaatcaggattttgccgaattagtttttaacgtcttgctaaaagcgcggcgttacaatattttagtaagaaaacttttacacaaaatgcattggttagcagtttgagaaacaagcaaatatttctttaaaaaagattttattttctccataaataatggtcagttaccgctaagatatttctctcccttttcagcgtccacttcgcgagggaagttcagtacgtgttcggtcaagtcaacaacggttagtcaaaactaacgaatggaatacgtgtttcagatgagtggcgaaaatttcgccccgatttcgaagtttggaagcaaagtttagagatttgagtctagcgatcgaaattaaagattgaatcgaagaggaggatcggagtagtggtgaatcgatgagtttacctgcatgtcatgcgcttgcacccatcgatcttgtcgatcatggcgcggcagctggggcagcgccgccactcgcgccccttggcgagctgggtcagcgcgcaccgtgcgccgccgtcgccgccgccgccgccgccatggcggtcgtcccacggctcctcgcactgcaggcagaacgcgcgggaacaggtcgggcaggacgccttggacgccgcggcgcgcaggggcagggccgcggccgccgcctcgccctcgagcgccgccatctcgccgcagtcgcggtaggggcaccgcgcgcgcgcggggccgacggcgcgctcgcagagcgcgacgcaccaccggtcgaacacgtcgatgtcgagcagcttcttgcagcgctccgggtgcatgacgccgccgccggagcagccgcccccgcccgccaggaggcacggcacgggcacgctccccgccgcgacgcgggcctcgatgtggccgacgacgcaggcgacgcagaacgcgtgggggcagccgtcggagacgcggaaccggtcgaacaccagcttccactccatgcagacctcgcagtagaaccgcccgatctcgtcgtcggtgagcggccgcacgcggcccgcgcgggacgacgacgacgacggcgggtccagcatggagccccggatcagctcctgcaggtactgctcccggtcgagctcctgcgccgccgacgccgacgccgacgccgcggcgctcgccatgggagggggacgacgcgtacttggcgctaattcttcggcgagaaggaactaggaagtggatggagtggacttgggctagtgcgggtcgtcgtcgtcgttggtcgcgatccctttagcctttaggtgggtgtgtgcgctttttaaagttgggcaggtacagggtacgattggaacggttagagatgagctagatacacaacaatattatgcttaaaggcacaatatttgctaacattacgtatcatgctgtgagtatatttaggatatttaggttgtctataacttccatatacttaaatcaatcaagtgagatcattatttgtaagagttttgtaaaaaaaagtacgtgtagcaggactcttttttttaattattattattattatgcatgtgcacacactactatactcgtaatcccatacttacgcacccaccaattctcgatatcttggcaaattcattacaatccgcatcaaccataatgctaaatttcaacaaatcgtgaagaaaacaacaaattttggttgtgatcgtgatgaaagtcttgaattttctttgtaatagtttcctcagttaaagttatgatagtagtcataacccatgctttactcaattactgaggaatgactcgggcagtgacccatgccacggtgccactccactttcctccctcccacctcctcgccaccatcagagccatccgtcggaaatcttgcggtgacaaggatgttagtggtgtggggccttttctcccatgagctcccagaggttgcgagcacaaggtgatagatttggaggatggatctggccatgatagtgactgtgatggcggcaacgcggttgaagcgacgacaactatgaccaatggtgttgaagacagttccagtagtggatctagcgctggtgatgctagatccagtagcttcgaggctagatctacgtgaccaacgcgtggtagaggaatgctcgcaaggcatagcaatggcgacactgggcaatggtgagaccgcctgcgtggaggtacggggatgggtgtgagcagttgctgtggcaaccccctcgtgccgacaggatgcggtattggtagcagacacggcgataggaggaaggtgggggttgaccacctttgtgtagaggtgttggcgacaactctcctcttctcgtgcttggtagtcggcgacgggatggcgtctgtgtcgttggctactgcgcagatgagagaccacctgtaaacatagttatacttagctagaatcaacttcaaatacacatgccatatatccggtgtgcactagttaagttatatataggaaagccactatgcatgtgacatgggtttttttttggtaagtgaacaaaatttaaaattttcactactatttgcatatttgcattgcatttgaggtgtaactgtgcagaggaataatattaccaccccttttatttgaatggcttttattggaggataagatgcagttctccttttagaaaatctgcacagtgctttaatctgtatattgcatttattcatggttagatgctaaaaacatgatacttttatgtacagagaagacaagtgtcctcatgtatagtgatccatgtgttcggtgctcatgggtcaccatccactaattaatctttcggtccgcacaaattactacttcctccgtttcatattataagactttctaacgttactcacattcatatatatgttaatgaatctagacatatatgtgtgcctagatttataaacatatatatgaatatgggcaatgttagaaagtcttataacctgaaacggagagagtactactagtctctccatttcaaaataaatgatatgcccatattattagtagagattaagatgtaagaagaaaataatatagcgtttcttattaaatatgatgtactaattgttggtgaaagggtggttaaagataatataatgataaatttaataacaagtaattgatgggaccaatactacttaaaatagcactatttttttaaaaaaattaaatcctaaataaacaccaattttggggctgaaagagtagacacagcatagaaaagaaaacgaacttttcaattgctaatcaatggttgaaccgaaggggaatttttttttaaaaaagttgtccgatctgtttcgttgcaacatccagaatttatcagctactaaagactaaagagtaaccaacattgttggtttcttatcgtaactcatcctaacttattgattaaatatggagaacacacattttttaaataaaaactactaacactatcagcctacacacaaacccctataacacattttttttccaagggactcctaaaatgttgagaacatatatactcccaccattctcttttatgtgacctccaactccaaactaaaaaaacataggtataaatcagcagctaagatagataaagcacacacacataacagaatccaacacatctaataaatgtctcaattcaaagatgatacaatccgaaaccatccaaccatctatgtctttctttccaacttttcccagcaacccgctggaagcgaaaagaagcaaattgcacagatccacacatcattcaaccacgatcgatgaattaaaccgctaagaaatccaggtaaattcgattaagtaatctagtcgaccgacggatcaaactttaaattaaggaaatagtttggtttagcgaccagtaaacgcatgcagaatctgctgggggcagcagctaatgttcgacattgtccatgcatgcatcagcctccagcttagctccttcttcctcggcgccggcgacggcgagatcgattctgcaggtgatcagggcaccagaacgacgccgagattgtcgaggcactggcatttctccttcccctccagcaccgctcctatctggagcccacaaaggtagcagaagaccatgcggcaccttcaaaataaaccgcttgttaattaaataaaaaatgtatgatatgtgtgttagccacactaatacacacacaaacatatacacaaatctgaattatgataacgcatatacataaaagtctattgctccatgtaatctggcaaaatcgtattcccattaaatatataaacatacacctctgtaaaaatcttcacagcaagtttttgaattcaatgtgcttccatatcttggttcatattcaaatctacgccattgaacccccactaaagccattgaacgccagtttacttactacaattaccactcaaaagttcatttaacctggagaaacatcctaatgtgtacgctaaaaccatatcaaaccaaaactatcaagtataatgaaacggattgagagttggagggagtaaatatatatacaccactgtacaaagatgtaattatcattaaacacgagttataccaaacttctaccatggtaaaaatgtttcccaagcatttaatggtgcaaacggaaaaacaaaggaaccaaatatggattagacacaaactaaagcatgtcctaccttgcaatgtaacccaatatatgttgttaacactttctccctacgaaaatgttggataacgaatctacagacaagttcaaacatgaaaaaacaaatgtcccccctataaaaagttagaggacgaatctacaaacacattcaaagatgatacaatcagatgctttgttttttaaaaaccagatgagtgatgtgcaccaaaccgtatacgctatatattactccctccgttttaaaatgtttgacaccgttgactttttagcacatgtttgaccgttcgtcttatattaaaaaaaattgtgaaatatgtaaaactatatgtgtacatgaaagtatatttaacaatgaatcaaattatatgaaaaaaataaataattacttaaattttttgaataagacaaatggtcaaatacgtactgaaaagtcaacggtgtcaaacattttgaaacggagggagtaacaaaacttctgccaacaacatactactttaaaaaaagcgccttgacaaccaaagaaaaacttgacgtcgaataattaagaagaataattaaaaccatatatttgtgctctctatgctatctagcacatagtactaaccacgtattttaactccctatgctatcgaacgcatctcaaactatatgtgggagatacattttctccaaattatgtactacattttcctcaaaaaaaattgtgtaactacatttgaaatgctcgtgatggattaaatagagtaatgaagcaaatgcaagaacctatgaaatgctcatgatggatcataataaatagtagaataatgaagcaaatgcaacaacacaagaagtgaaatgaagtagacagggaggtgagcacagtagtgaagtgagttgagtacctgcaactcatgaccctgcagccggctgtcctctcaaccagcatcctgcatttggggcacgccttccaccgccgctcgtcggcgagcttcttcaccatggcggcctcgggccccttggagcagtcccggtggtcggcgtcgtccgccgtgctccactccccgccgcacgtcgcgcacagcaggtgctggcacgccgggcacgccgccatggccggctccgcctcgccgctggtctccagcaggatcccgcaccggcggttggggcagtacgcccgccggtcgtgcggcacggcgccctcggcgagccggagcccccagtcggtgaacgcggcgaagtcgatggccttcttgcacccctccgggtggagcacgccggcgccgccgtcgccgccgtcggcgcactccgggtccgggcacgccaccggcacggccccctccctcaccttgccgtcgatgtaggtggtcatgcactcgaggcagtacttgtggtcgcaggggaggccgcggaagaggtcgagcatcggcaaggtgtcgaagcagatgccgcagtcgaacgtcgggaggtcgccgtcggcgagggggagcaccctcggccgcctcgtcgacgggccggcctcgtcggggtcgaggtcggatgggcggaggccccacttcttgtagaagtttggcatggagaattcaccttcttcttcttcttcttctccggcgatggcggcggcggtggcgcggggtggtggttgcgccacgacgggcgattttgtgaggtattgcaccgggagaggcccatggagctctgggtcctcttgcagctcggcgatcacggcgtcgcggatgacggagtcgtaccagtcgttgtcgtggccgtcttccatgccggcgaagacggccggcgtgtccctgtcggcgagtagggcctgcctcttcgaggaaaccgagtcgttctcgttcgcgacgttgcggtgaacctcttcttcttcttccatgccgccggcggcgcctcctttgccggcggagatggccggggttctgtgttgcccacacttgccggcagagacggcaggggcggcgtggctcccttctcccgtggtggcggtgacggccgccggggtgtcggcggcggcggcggcggcggtgagctggcggtcggcggcggcaatgcgagtccatatccggccgaactgcgcgacgtttgggcgagggtttgcttgcaatgctgccatgaggttttctgccctagcccaacggccattgccggcgccacgggcatggccggtgccgggagcggcacgagccgccatacgggcggcaggacgtctcccgccgtggcggggagcggcggcgccgccagcgatgaggccgccggggcggagtgagagttcagtagacggcgccatggcagcaggtaggccctgtggtaaggtggcggtagagctcgtgccgatgtcggcggtggcggcgccgcccggcggccgcgggaggaaggccgtcgctgatcttgccggtgccggctgctgtctcgtcgccacggtgcggcgcccaccggatcgtaacggaggcggcacgtacagttggacggtccgcgccgccgccgccgccgccggcgcgtcatcatcatcatcgatgacgatgggttgggccctgctcccggcggcgccggcggcgagggaagacgtcgatcctacgcgatccatcggcggcgcgaagctgctccagtcgtcgtcgcccagctccatcagctgcgacacgtacaggtcacgcgcgaacgcctcgtcgacggcgacatcggcggcggcggcggcggcggcgtggtggctgctcgatgctcctcctccagtcgcagcagggtggggttttcctccttccatggcgaattggcgcgatcgatcgacttcgattctctcagagattttctagggtattagggagtcgatcgatcgatcgatcttgaatttcttgacctgcatgagaagaaagaagatgcgaattagggggggatttcttgtttctactcagaaaattaatgtacagatccgaggctgactgtactatctgaatttctatgtgttcagctcataaattgtactattggcgcctatatatatatgctgaataacaggaggtagatcaaagtttattcgggagtagaattgcatatatttccaaaaacacgtgtgcatgcgacttcatcggttaatattgatgaatatatactactcttgctttttgttcaaatattgttgtattttgttctcacttatattaagcaaaatcggcccttgtacaaatggtgtgcacataaataatctgataaaaatgataaacccacaaatacaatgaaatagatcgggatgtggatttagagtggttcctacatattatacacatagttttgcaaatatgtaaatatgcaaatagttgtcttgcgcaagcataaatacggtgaatgcaagtacataatacacatatattgaattgaaagtgtgattaatcagccatggtaagaaatgtcggttaggccaagaattcagtagagaatgatggagcagtggcaatggatctagtctgatctacgatgatgagaaaaaccgagaaaacatgaaggtaacttactagtgactatgaagaactaagggaggaggaagacacagttgccaccggtagacgagccacgccaaaagttgttgagagactagcggtcctcaccggtgtttgtggatggaccgatgggcctcgtcggcaatcacggagaagccgataggcttcaccggtgtttggcggcgataaaggggtagggcggcggatcgggattgggaggcgttagggtttgagggagaaatctataagcttcaatgggagtatatccgattgattgagatccgacagccacgatttatttggtttatgccaaaatctcttggatatatctattagtaccccataaattgtctcttccaacctcctattttaatatctcacccacctacttatttgacttttctcctactcattcactcctattcaacttttgatttctttgaagttaaaaagaaattaaaatctactaaaaaagctatcaacaattttctactcatctacccgtctattttcactcaaacatagaaacctatgcatcttgattcaatagaaagaataattgtttgaacaacgacgatcatttactaagaggttgtgaggaaaagatttagagacaatgaataatgctaggaggtggaagacaagtttccaaagggagaaactagcatgaggtttgtagtagcggtgaaggtcatgtacgccaagattttggtagagaatgatggggggagtggaagttagaagcaacatggaagtaagggcataggaattcacgatggatctaacttgatctacgattatgagaaaaaccgagtcgacgtgaggggaacttaccagtgattatgttgaacgcaagaggaggaagacggttgtcggaggctgtcgagagattggcggccttgccggtggttgcgaagggaccgacgggtcttgccggtggttgtggagagactggcacgcctcgccgatgttggcggagataccgaggcggcgggatgtgggaagacggcggcgggtcgggattggggaggtgttagggtttagggagggaggaatttatatgatcttcgatgggaggagatgcggttgattgagatccgacggccacgatttatttggtataaggaaacttctctagtgtatatccattaatgccccataaatgttctcttccaacctcctattttaattcctcatccacctacttttttaacttatcctactccttcagtcatattcaacttctattttttttatttttttgaaaataaaatcagctaaaaatttatcaacaattgtctactttttcacgaacacagagagcatttgcatgttgattcaataggcagaataattgattaacaactacgatcattggtcaggaggtggtgaggaaaatatttagagataacaattaacgttgggaggacaaagacaagttgccaaagggagaaactagcatgaggtttgtagtggttagcatcacttgctaatgttttggaggaggttagggggcctcagcaagagttggaggtgatgccaattcctaagtgagttggaaagggaaaacggcgggtggatcgctatggttttggcaactgcctctaaactagtagacatcgattaacaccaacataattccctttccaccttgtatgttaatttcttcccaacatacttgtttaacttctcatagtccttcattcttctacaacttctaaaatattcattattctaagaaatcaaaatcaactaagatgcaagctttgcatgtttaccatgtttggctactcttacatctttttattttttacaaacatgcaagctttgcatgtttacctaattcctctatttcacattataagatgttttggatttttaataagttcatatatggatccatgtatgtgcttcatatatgcgtcaaaatttatatgtatattagtgaatctagactaatgatggagaagccaaaatgtcttataatgtggaacggagggagtactatattagtagagcttgaaaaagaggctgcacattagatcttgtaaaaactccgactttaatcgaagacaaaaagaaagatattgaccatccgatcatggtagacctaaattatgatggtgtagatcgattgatatggtcatatagaaaataagattttacctatgaagctaagtgttgtatatgaaaggcttgttcactttgttgccactttcaaccctaccaaatttgacatgactaaattttggtaagacaacaaaccaaacggatccttaccaatgctaccttatcaaactttgttaattctagaagttttcactgttcaaaattctaccaaactttagtatggctttaaactaaacacaaccaatgctaccaaaattttggtagcgtcaaaatgtgtcaaaatatggtattaccaaattttggtaggattgaaagtaacaacaaagtaaacaagcccaaaatccaattattcttttgaaaaccacactccatagaaaattaaaatttatttatggaaacataggctaatgagtgtatatgaaacccaactcttttaaaatcttgctggtgaaatatccactagtacaataaataaaataagtgtcgtggtgccaaccaaaatgtggttagtgagatttctagtgctcccacacgccttttatttcaaatctcctgacaaattctcggaccttgaacctttctagataattttgaaatttggtgaggaaacaacatggaaccccccccctccccacgtgaagttttttgaattgtagagttctttctctgctttagggcagttgttatcccctctctgtattatgagcccaagctacatagtcctacatgccatgcaatctccatccattctatatcctagtttgattgttcgcatcagacaataccttgtggtggttgcaccaatcaaaccaaagacaacaatatttgattattaaaaatgtgtcgcacgatttaggtgctgtgtaactaaattagcaaaaatcgtatggtatggaaccaaaatttccttttgaagtttggctagatgcaaactccttggacctgatggtgttcatgcacgaactaatttctgtttccctagtcgcattgcctatatataacttattataccgtttatcccccatttgtagcacagtctagccagcctactacttatctttttgcctctctcagtagatttatcagcttagcttattaacgtagccaaaattggaatcttagagttagtttaggttttttttttcatagttttctattctttattagccttagcttttggaccactaagaatagaagtataaactttttactgtaaaagtatctttggtagcttcttttctttttctagactttatcacccgtagctcaacaccagatcgacctctacttcttactcctttgcttccatgccgcttctaacttccattgctccatcgctctctaccaaattcttgtcatggtgaccttcgttgacatggctgaccaacccttttattcaatatatgtttgttatgtccttgcattcaccatatttatatttatgattgcacacaacaactatttacatatttgtaaacactacaagtatatgtagaaaccgcatccaaattgtcgatcgaaagaagtcacctcgtagacgatgtgcccgttcatgtaacactgatgagtggagcccatttactatatgatgctcagtgcatattcggaaacatagattttgtaaagttgaacattgtaaaaactacaaattcatgagctttatgataacaatgctagaattatgcttgtttgatatttttcggcatactcaccgccatgggtgtgtgtgggttgagtatttgattatgtgcgcgcgtgtgtctttcacataattataacaaaaaaaaggtgaatttgttgtgcaactttatgtgtattgcacatatattctgttttagaaatttttttacccatcagtacatgcaacatggtgatcatcagtttttcatttgacaatggggacagtacataggaagaattgaatcactacaagaattcgtaattttcttgatggtcaaaaacctccaattataacatgaaaactgccaaggtggttatttattcatcggccgaccgccaaagaaatcagttggccgccaagaaaattatggattcttgtagcgaataaacttcattatttgtgaaatctagttctaaaactaagcatccatgccggattaagttagtcacctgcctgctcttccaagtgatcctccatcttctccatgaaggagaagctcaaaattcatacaaacttttcaaggaaagaataaaggcgactcgatggtatttgcacgagtcttgcgactatggagaaggagaagcccaccaccgcttttcccgcggttttcctttctctttggtgcaatgcaaagttgcaaatggcaacatatatattcgtctcactctgctgattccatggcttcttctatgatctctctctctcactagctatagctagctagccatggattctaccagcagcggcaggagaggtcgtcagagttgcgaggagagctgcaacaatggcgctcactggccgccgcctcagtcggcgagatgtctctgcctctacctcgccctctcggtcgtcttcttcgcgctcgtcgccgccgtgctgctcgtcgtgttcgtcgcgaggctcaagaagccgacgttcttgctgcagtccgtgcagatggacaggtcgttcagcctgatccagtcgtcgctgtcgtcgtcggcgtcggcgaacggcaccggcggcggcggcgcgaacgcgaacgggacggcgtgctcggtggcaacgctggtgttcgcggcgcagaacgccaacggcatcgggatcaggtacggcgcggcggcgctcggcgtcgcgtacgcgaacgagtcggtcggcgccgtgggcgtgccggagttctaccagccgccgcggagcgccaacgtgacggtgcccgtgcacgccgtgttctcgcagcccgacgtgacccggctcgtcgtcggcgagctctcggcgcagcgcaagtacttggagatacggatcgccgggagcatcgatgcgcgcacgcacatcatgaacttcgctctgcccaagattcaggttcaacctctcattatctgcttattagcttatatcagtcatagctaaaacttaaattttaaattttaatgttagatttaatctttttggttttattttcatcgtaatatattttctagcattagcttttgaaacactaatatcacacgtaaaaaagtttattctactgatagttgaaaaaagatcttcagatttcagacttgctctaaatcatttacttgcttgctgtaatttcaggagattggatcactaaatttgcaaactttcaacatgtttttgggtgcagttttcgattgattgcaggataggaactaactacaccgacatagtgcaccgggaagggatcgagtctgtaattacacgcaaggtattcactgaaacttgtattatgatattcttcagaccttcagtctctcaggctattgaccactgattctttctgcaggctctcctcgtatctgaactgcctcacgtttcacagaagtgctccatcaagattgacctgagatcaaggggaaagaggacaagtcttgacgagttaggatgctgatttaatttaagccggagattctttacctgtgtagcacgtacatacggctattttaccttggggaattttttattcgaaacccgacttgtgaaatgtaaatatactaggtttcttcagtagcaactgttgatctgtatattgtgggaaatgatttattgcactagagatagatagatggatagataaaagatcgattgattgtaatttgacacaatatgtcttatactcttaacatttttgcatttgttgctgaaaatgtgagaaatgtacttgagatataaatttacagtcatcacgcatgcatctgcgaatgcatggatcctttcaatacatgcttaagagatacaaagccccctttgctattgatcgatgagacttcataatcctgttcttttcagctagtctattggattatttgctcgatatttctaaaaaaatatatatttttctaagaaaaactttctcctactgttgatgcgaaaaacacacactggcctggaagatttgcttaactccagtgtaggtccaaagaattgcttttggtttctgagcatgccagttggtttgatccttaaaccaacaagaaagaaaagaaacatagttaaatctacaaacgatagccgatcggctgtattgccgatgacatatcgttcaatattgggccgatgtgaagtgaaccagatcagcaataaagaaagaagcaagataaaattaaatctacccgatcggctgtagatatcaatgatatataatctatttctaaaaatatgtttaaactaagtgattgtgatagatcggacagtctgccgagacaatataaatcacttatgtttaaaagtacttcaagattgagattatatatattcatagcatagccgatgaagtaaatcttagatgtatcggctaatactccgacactgctctatcctaagatgttaaaacagacaaaatatactaaacaacgagcttaatatattttaatgcaataagatcttaatataaatggcagatttagcatatcgagtaaacatgtaaggaacaagataactaaaccagataagatcggctgaaaccccgatactatctctatcgataatcataaaacaagctagatattatggttctagatgttacttaatagatcgaacatgactgatgcagcattaagtacaaagagaaacataagatctaaacaagtcgatgaaaacctctttgagatggtagatatactatataatctagatcaacattgatgtttaaccctatcggctaccctctgatgatagatgctagcctatttaaggttagataacgatattgaaaaagattatataacatatatgataactcgacgatttacataaacaagattagagtatcataaagatgtaagcactaatcccgagaacacaagccaccatgacaagttttacctcttgctggagatcgaactcgttgcaacccaacttgaaagcaagaactcgtcgaaaacaatgaaagtagaaaaggtggcgattgaactgtcgttaatttgtttacaaggtcttgggtcatatttatacccaaaatatataatatgtccttgccggacacgactcccaatctgttacaactctaagatataaaagtcttttaggtagaatcttaccgaaaatatctctaaaaaaactaccagaaaatcctaattaatagatacaattgccttcttaggactcaatccatatgtggcaatacttgtgcagcacatcaatcgatcccgaagatgattctagaaccaccttactagatcggctacattggttgttctttgtccggtccaatatcagccgatgcagacattaaccgatgctctcgtagccgatacgcactctgtttctgggaacgatctcccgccaaatccgcttcgactttagcttcgaatttgatgcatgatttaccaaatttggtcgtcaacacctactatattgcttaaatcctttgttctaaactattatttcacaatatttgatttaaatttataatcgtgtagaaaatcaaatacaataatccggtagataatctattttaaactagagtggtacaaacgcaagcgctcataatgttatcttgagattgacgaagtcaccacgaagtcacgaacgtcttgttgtatgtcacctaccactgaatacaattaaccataaatgtgagtatccgcgtcgagtctaggacttaaattcagatggattagttctatcataaggaatctaaccagtagagttacactcacacagttgagttacactcttttcactagcgtgaaacttttgcttactagtaatatgcccccacgttgttgcagtatttttagttaaaatctactaaaaattaaacgtttggactgcttgcttgaaaaatataatatataatatgtagtgaaagttgtatcggacaacctgaaatgaaacatcacatgaaccgttggatttttactcgttgcaacgcaagggtattttttctagtattgtataaaattcctttgtatttgctcaaaacataatcttaaagaaattctaacataagctctatgttcaaagaaaaaaaatccgttgtgtctatatctctcatctaattagtgagttttcgctctgtgcttcatccaaacggtatttcctacagttatagtgcattttttcggtccatgggattcaagttgctatggcattttaatcctgcgtagtttttatttccgtgttttgagaatcatgggttccaaagtaaccataagaagaataggggtatgacaaaaattaaaggttgttgcttatgggttgtgggattactaggttgtgggctgaagagattggctgaagatttagtttggccgatttaaaacttcagtgtgcataagtgtcggaagacatgtgtgagtgatgtcattctacgtggtgcattctttttgactggtttgcaccgaactcccatacatcgaatacgtatacttcctccgtttcataatataaatctttttactattatctatatttatatatagatattaacaaatctaaatatatatatgtgtgtgtagattcattaatatctacattaatatagaagaacaataatataaagtcttatattataaaatgaaaggagtagttttttcccatccgcaaaagtttgataacagaatgttgcttcatcacgcgtaattgcgtgtattcaataattcaattcccgccaggttatctccttttcacacggaagttcggagttagcaaaaaaacgattttatattgcacgtgttagttcatgataaggctgttccttccagctaataattcccttaagcgtacagcaatcttattttattttatccatttatttgcaacggtccattccatcggaacattcccgaacaatgtgaaaggtatcaaatggaatatatcagcgctatgtacgtttggcaaaatttgttctgggaaattcaaattttgcataatttattgataaatatcataaaaacgtatcattgctaaaagacatttaaatttgataatttactgcaaaacatttttggctcgagtagagagaaaaattcttcaggaaaaacaagaacacattaaattcttcagaaaaatttttggtcaaaagcttttggttctaaggatattatcgtcttccttaagaatttatctatctaattgagccagaattgtcctctaccaaattatcagtttttacggtatctttcaaccgtgacatatttttacgatgtccatcagcgaattacattaaatttgggtatcctacagcaaaatttacccttttaaataggagatgtccaacaaatttcaaaatttgtagccattaatatataaatatataaatatattaatggctacatattttgaactatataaaaaatatattaaaactcttttaatatagcttttaacagtaaggatgtcgaatatatatcgcaccactaatttttttttcatatggccaaaacctatttttgtgtgtatctgcgaaaatcactatttttttcatgcggacagcgcacctgcacaggaaaatcgtgcgcgtgcttatgtcgtccgcacgcaaaaacaaaaatacgaaaaaaataaaaaatcccaaaaaatcaatctcaaaaccttagcaaggtctcatgccggcgacagcgtcccgcagtctgccattgctcgtcgtcatcgccattgccatcactgagtcccgtagctcgtcgtcgtcgtcaccgtcaccgaggccgtcgtcgctcctccccgcactgcattgcccctctaccgccggatccgcacgggggagcgtggggtagggccgccgcctgtagatccgtgtggggaagcaccggggagggccccactgctgctgccatcaacacgtgcctcctccgctgggctcctcacaccacattctatcggagtcacagtaggaagagaggaaaggagaggagaggagaggagaggggtgagaggagaggagaggatcgcctaaacacaagagatatgctgcacggaacgaatctcagtgtcaactcgggagccaactgtgtactcctactttgcaacacttctatgccagaagactccaaccacacgtttttcacctgctcattcacaaatcaatgcaggatttttcttggttttcgttgggaaacgaattaagatgtcatgaacatgatgattaaaaaaaaggaattttggtcacccattctttattgaagtaattgctatagctctttggaacatttggaaacgaaaaaatgacttaatattcaacaacattcaaccttctttcaaccttaatttggaagcttcatttcagggaagattttactctacttttgaatagggtaaaaatacatgatcgaccaatctggcaaacatggcttgataatttctaataatccctcgtgcttcgccttctagagtacataaactctctgccctttaatataccgtagtagtaggagcctctcctactgttttctcgtcaaaaagaaaaggaagagagaagaggctaagcgaggagtggggagagagtgaggagtggacgtaggaagttagatatttgaaggtgggcctcttaaatggggttgcttgtgaaaatatacttatttttatatttgggtatatatgttaagaggtcagtctctgaaaattgatttttttttcatacggatcttttaaaggagcttatgcgaaaatgtaagttgatttttacgggcgcaatcagttacaatccatgtgtaaactataggggttctcgtaccgtttcggtagtagtgtcagttgttgatttattcggtgatacttattaactgttacatcgaaggaggactgtctatatgggattcatatgattttttaggcttccatcatgcagtgtttcaccaaataaatcgaaaatgttttaattttttaaaaaagttggaacacaatcaaatcactccatgaaacattttgctacgatgtatgaaacaacggttcagaatatatatatattctgaaatatgaaacaaatccaaatacatcaagaaaaagtctatatgggattcacattattttttaggcttccatcatgcatattttgaaactaatcgggcgttgtttcaccaagtggatcgaaaatatttcaccaagtagattgaaaatgttttaatattttaaaaagctaaaacacaatcaaatcacctcatgaaacatttttctacaacgtataaaacaacggttctgaatatattgaaacatgaatgatttagctatcaaaaatcattcgacagccatttagccttccgataaaaatatacttttgtgcgtgtagggttgatcagttgggtatgcacacgtctaccagcattacatctcttgcgatgtttgaatacgtgaagcatcttttgttccgagtactagcagatgtttcgtctctttgttgcaacaatatgtctgtactatactgtattacttaatatcatctactttgtttaataacaaaaacaaaaaacatgtgcctctcggagactatatgggtgttcaaaatgtgaaaacaaaacggaaacaacatgatatattatttaaaaagagaatgaatggattatatgatgcatgaaacgtgtcattcgttgttcttaatttatagcgtttcgtgatttcgtcaagactcaacaacttaagcactcctctaatatataagaacccccatcaaccacacatgcaaaaagcatcctcaggcaaaatcaataatttagcttgcaagcaaattcatctcagtgcagcatgagcagtacaaacaagagctcgccagctcgaaatgagagcggcggcgacggcgacggcgacatcgccgtcgacctcttcccgttcctacgcgtgtacaaggacggccgcatcaagaagttcgtgcgccacgccaccgtgccagcgtcgcccgtcgagaggagcccgagtggcgtcgtgacgaaggacgtcgtcgccgtcgacgacgagaccggcgtgtccgtccgcctcttcctccccgtcgacgcggccgcggccgcggtcgccgccggcaggaggctgcctctggtggtctacgtccatggtggcgccttctgctccgggagcgcctccgccccgccgttccaccgctacgccgagtccctcgccgcgcgcgccgccgcggtcgtcgtctccgtggactaccgcctcgcccccgagcaccccatgccggcgggttacgacgacgcgtgggcggcgctccggtgggcggcgtcttcccgccactccgacccttgggtgtccaactacgccgacaccgcgtgcgtgttcctcgccggcgagagcgccggcgccaacatcgtgcacaacgtggcgttacgtgccgccgccgccgccgccgccggcgaggacgacgacgacggcggcggcggcatcgacatcgaggggataatactcctgcagccatgcttctggggcaccgagcgactaccctgcgagagaccggccgcctggaggcgcgccgcgccgccgatgttcctgccggagaggctcgacgcgctctggccgttcgccacggcgggcgccgccggcaacggcgacccccggatcgatccccccgccgaggcggtggcgtcgctgccgtgccgccgggcgctggtgtccgtggccacggaggacgtcctgcgcggccgcgggcggcggtacgcggcggcgctgatgcgcggcggcgcgtggggcggcgaggcgacgctggtggagtccggcggcgaggaccactgcttccacctctcgccaaggcctaaccccaacgccgcggcgctcatggaccacgtcgccgagttcatcgccaagggcaacacctccacgtcgtcgccgatggcgaagcggcggcgtcgccgtcgccggtgcacgttgcatggcgcgggcgcggagaaaacgacgtcaatgcatgcgttgcgaggccaaactgcgccgaaagttcaacatgccggatcaggaataatggccaataaggccgacaagtatgtggtcaggagttgtctctgaagaacaaaatggaaaatgttgggccttgtgtttcctgaacttccttttgcccaatcactatgataaagtacaatatacctatgttgcaaaatgaagtatgtcgatgtgggggacagatgtatgcttaataaatagtttaatgtttttgtgctgctaatttttaaaaaatccatatcatcccttacactgatttctttgttactccctcttgtcattaatatacgacgtttatcaccaaaattagtgttaatacatcatatcatatattaatatttggagggagtaaatagttattatttctaaaatttaataaaaagtggaaaatgatatctgtgatttattgaaataggaagaatgctagaaacattcatgcatagtgtttcttagggtttaccttttccttgtggaattgaaaaccactccttattggttaatcgaaaactggccagaaacctgaaagaacgacgacttcaaggcaatgccacaagtaaaccagctcaaaccgatcggtttccgcaaactgaccaccagcgatttgccgattattacatgaaaaccgaacgattttggtgaaaagcgatgttctgttaactcgatctagtgtccttatttggccgacaacaacacctcaccttgtgctaatatccgccaatatcaaggatgcaaatgggttgatctacgagcccgtttatatatcacttttctatggctgtcttgtttatcgacatgtaaaaggtaacttaaaatttttaagcgagtttgttggggaaactcttttaatcaactatatggatgtccactcgtctattacatgtcaaccaaatagttgtgaaattttttaattttttttaacaaacatacacgattaaattcaacttctataagttataacaaaaataaaaaaatagtatacggatatgcacaactaaatttattttttttacaacatgtagaaatcaaatttgattttgtatgtttaccaagtgatatcatatattacaccttaatctatcttgtttaatcttgtaaaataattataagtatttaaataatataataaacgggtgatcgttcaactgattacaatccatctccggactcgtcggccgacccagacatttttttcctctcaactataggatgcaacagcgttgacgttgacctctatgcatgtaccctcgtctctcgttgcagctaagctagctaggcattgccgtatggctaaccacactgacaccctcatctagtcttcttctcctcttccacgtcgaggcctagtgttgctagttgataaacacacgccgaggctgggcattattgccgcatcagatcatcagtgtcattttaattgctttctgcaagtatatcaacttattatattgtattggggttaatcctaatgtatgtttacatatatcaatccacgcaagtaaccacctagtctatccgtttcagaatatagtaacctaaaatcggatgaaatgtacctgtccaaattcgtagtactacgctacgttctatccgattctagattgatatattcaaggacgaagggagtagctatgataatcattgccattatgttgatctggtaatgttaatcactacctaaaaaaataattttctcatgtgaccaaaatgaatttttgtatgcgggcgcaacaaccgctgcctccaactgtatgtaaaaatcggattttttttttcaaacggacaacacaactgtgtgggaaaatgaggtttctgcaagcggacacgttatgccacctgactgcaaaaagaaattttgccaacttttttcccaaaatccctagttcataagaaaccgctgccgtccactgtcgacaccacatctattccctgaaaaatggctgtcgctgaccttgcctttgacatccccgaccttcccaccgccgaattcacccctcccgaggctggcaccatcattgttatttctcccgaggcctctgtggtatacgtcatcgccactcctatgctcgtcattggcagatccacccctcccaaggcacacagcgacagatttggtgcccccgaaagggtgggtgtgggggggaggacggggtgtcatcgccgctctagaggttgacgtggtcatcgtcgcagctcccatgcttgtcagcaacagatccactgctgctgaggccacaaccatcgccgttgctactcccgaggctgccggactgataaaaagaatgaagagattgagctgagagcaaaggagaaaaaggaacaaatgagcagaggcaggggcgtgtcctttgattttaatatagctcttcggtccatggtggaattgtgtgactgaatcgactcaaaaccaccaactgggaaaataggtctattttgacgagcagacctactaagacaaccttaaccggaggagtcttatgtatttttaaaagcgggtcttcctttagcctattcgtaaaaatgttgggttatctaaaaaatggttttatagtagtgaattggatttccctgtccacctattctcctccttttttgcagatgcaaaacttcataaacaatatcgatcggcgccattgcttcagcaaacacgccttcctcccagtcccaggttctctctccttctcccagagggtccatggataatgattttattttatgtggcatgtcttaattaattcatgagataaggttgctccagcaaactgcccttctacgaaaatgtaccggccagaacaatattggtgcatgcatgaggatgtgaaaggtatcagcctacatgttttttaagaatggaaacatggatcagtattggttttttaatacgtatggcatctctcctctttgtttttcctatgcaagaacttcataacatttaatgcttatatataaatcatatatcttcctttcccagataagttcatcaacaacaattttgtattaattcacgagaaatttgttcctggcttcctgcgaatctatatattcccttctacggaatgtttatatgtcttttcaaatggaacgcgtatgcttgcaagatcgagagaaatgggaacgcgcatcgatcgatcagttagttgtgttctgagaattaatcaatcaattaaggtctcctaaaaaaactaattaaggggttaatttagagaacttcaccagcacggcacctctctactccctatatataagaacccgcttaattcccattccatgcaagccatcgtgcaagagcgagctacagttgcagcatgagaacaagcagcaagagctcgccgtcgccggcgccggcgccggcgcgcggcaacatcgccgtcgacctccggccgtttcttgtcgagttcaacgacggccgcaggtggatcttggtgcgccacgagagacaagacgaggagcgggaacggcgtcgcgacgaaggacgtcgtcatcgacgacgagaccggcgtgtcggtccgcgtgttcctccccgtcgacgcggccgcggcggccgcggcggccgggaggaggctcccccttgtcgtctacgtccacggcggcgccttctgcacggggagcgcctccgccaggatgttccacgactacgccgagtcgctctccgctcgcgccgcggcggtcgtcgtgtccgtggattaccgcctcgcgccggcgcaccccgtgcccgcggcttacaacgacgcgtgggcggcgctccggtgggcggcttcccgccgcctctccgacgacacctgggtcggcgactacgccgacctctcgtgcgtgttcctcgccggcgagagcgtcggcgccaacatcgtgcacaacgtggcagtacgtgccggcgccgccacccgcaacgctggcgaggtgttcgacgacgacgacgacatcgacatcgagggcatgatactgctgcagccatacttctggggcaccgagcggctgccgtgcgagacgcgcacgcgcgagccgccgccgatgctgctgccggagaggatcgacgccctctggccgtacgtgacggcgggcaacaacaacaacggcggcgacgatccccggatcgaccctcccgccgaggcgatagcgtcgctgccgtgccgccgcgcgctggtgagcgtggccacggaggacgtccttcgcgaccgcgggcggcggtacgcggcggcgctgcgcggcggcgcgtggggcggcgaggcgacgctggtggagtccaggtgcgtggaacactgcttccacctcttgccggagttcggctcccacgcggagaccggcgtgctcatggatcgcgtcgccatgttcatcgccaagggcaagacaccaccaccgatcagcatgctgatggaggaggagcgcgccactaagaaaacgaggtcaagtgcggtggtgccagcttgttggagagttccccgcgggccgaggtgtacggcccaagctgtggttgggcttcgacgtgccgggtttggggtgggcaacatgatcaggcttcccagtaaggcccagaagtatcatcgtgttcctgcaattgctctacggagtgtgctccagagttattatctctgagactctgatgactaatggaaacagttgtgttactgccttggatgtttcacggactagttgttattattatgtgtgtattattgtggtacgaagataatctttttaataatggaatttatttgggctattgcttcgaaataactagccccaagtattatagagttggcagttcaaaacaactatattttttaaaaaaacaaaacatacagtttgagaaacgtccaagaatattccggctagctccacaaggtaatgggctagacgatttgggttcgaaacccactccttctcattatttgatatcagatctttccctaatattcgcgtattttaaaaacataaagtttaaatacagacgatctgtaacacaagtctaaatacagaaagtgagatgacaacctactccattcgttgttggcaaaaatatgcataatctgcatataagtcctcctccttagattaggggtgaaaacggtatggaaacggacagaagccatctttattattttcgatttcattttttttcggaatcggaatcggaatcggaattgaaaaccctggatacgaaaacgaatcgaatattatataaaccaaaaacggagcgaaaacgaactggcgcaaatacggtacgaaaatttatcggaataaaaaacccctcaaactgataaatccaatggaataaattatctatgtttaagaaagtaatgttgttgataaatcctaatgcaggaaaaataatattcttatgtaattttagatttgcataacaattttttaaaaaaaatagcaggtaaacaccatgttattcactattcagtgcttaaaaaaaatctagggtatttcagtcacaaaatttctggtaattccgagaaaatttccggaaagtttccgactgattccgagttccgacgaaaactgcccttatcattttcgattccgtttccgacaaaatatttccgaattcgtttccgtttttgaaaaattctaaccgatagattctgttttaaaaaataggtctggaatctgaaaagttttcgtaccgttttcaccactaccttaaacctttgtcgtggattcccaaagaatttgaactcgaatttgcaaatactcgtcgtaatcatcggctgatcagatcacctcacacacatcaccgctgattattacagtcgaaccaagcaaaagataggggaaagtaactgaactgtaaatccatatgtctctatcttcaccagtgatggagagttgagaccgtcaccaacacgacacggaggacgaatatgcaacacacaaaaccgacaacaacaaaggagctaggttacgacggtaagataactgcatcgaagaagctataagccttcaaccaactaacaactcgaggtgaagccgtcttggactggtgatgttgcagaggagctcgagcacggacgcgggaaggaccagcatcacatgaacacaaacaagatcacatcgccgtcgacctcttcccgttcctacgcgcgaacgtacaaggacggcctcgtcaggaagtatacgtgcgccacacctccgtgccagcatcgtcgtccgacgagatcagaagcccaaatggcgttgtgacgatccccggcgtgtccgttcgcctcttcctccctgccgccgccgcatgcaggaggctccctttggtttgtctacgtccatggcggcgcgttctgtaccgcgagcgcctccgcgcgccccgttgttccaccgctacgcggagtcactcgccgcgcgcgccgcggcagtcgccgtctccttcgactaccgcgtcgcgccggagcacccctgtgcccgcggcttacgacgacgcgtgggcggcgctccggtgggtggcttcccgtcacaccgtccagtacccttaggtggccaaccacgccacatgttcctcgccggcgagagcgccggcgccaacatcgtgcacaacttgaaggtacggctcggcgcctcccgcagtggcgccggcggcggcgaggacgaaggcatcgacatcgaaggtgggctggggcaccgaccggttaccgtccgagacaccggccgcctggcgcgccacggcgctgaagctgcggcgcccggagatgcgcgacggcgcgtggggcggcggggcgacgctggtggagtccgacggcgaggaccactgcttccacctctcgtcgaagtttaacaacccgaacgccgtggcgctcctggatcacgtcgtcgccgagttcatcgccatgaaggggtggatccagcctgagggcggcgaggtctcgtgcccccactactggcgtgaagactataagagcctccacgaaaatcctattaaaattttctatatgtaaataggagggggaactttaactctatatagtttgttcagaccccactactatatcttcctgatccgccacttatcgccatggagacaacgcgctccagtgagcatcttgcatgcatagcgatgaagcagctacgttgcatggcacggagtacactgcagaagtggcgtcaagtgcggtgccaacttggagagcttctgacgggccaaattggatcacacagccaattgcatttatcgttgagattttcctaaatcttggttgattcttttcttaaaaccagggtttgaatttctggtacttgatatctcggctgaaattttcggtttttcgcaatttttggtgaatttggttaaattttattcaaattcagttaaattgtgtcaaaatttcagaaaaattcggtccaaaaaatgctgaaatttctgaaattttgaaatggccaaaattttagccaaaatcaaaatttaaaaccctacttaaaactttgagttctaatgtatagaaaaaagttctcaaaatatctatcctataataattaaggttgcaaatgagtcgatttttttaatccaatcagtatttttagttaaaaatgagaaaactttggaaaaattccttataaatactattactatgcaacacaaaaatttgttaaacagaagttgtatttatgtgaacttagcactaaaagccaaatcaaataactaaaactagtaaaaagaaatatttttttatgttttgttgccacaggataccttactttacaaccatatatgccattgatatggaacgtcataataatattatgttgctgatcgatattataactttataagattgtatagtttttatatgtactggctatggacttcaaacttttcgattgttgctataatgttttcagttgtgtactacatattatgttacatcactgtcaatccttgtaaaaagagtcctatatttttccctttatttcctgattttctcgatcacttttattattttaatacagaagcaatcagttttcgacgaaaattcatggctttcaattatatcggtgttcctactctcagtattcaacaagatttctgggcagtttaaaagggaattcacgttctcgttcacttgagatatatacctataggcgatcaggggcggatccaggaaagattaccaggagggtctgaacaaaccatataaaattataggcccctcttctaatagatgtatgacagaaaattttagtggggtctttatggggtcattacaatacgggtagcggggtctcgagaccccagagaccccatggtggatccgccactgtaggcgatctagaggcgcctgcacggaattccaattttggtttgtgagttttgtagcaaaccagtgggttttctcgtggaaaccatcaattcaacggggtttgaattccggtgttgtattaaatctgtaaacactgatgctaagtggcattcacttggtgactggtgtacacattaaggtagaaaaaacacaaaaatattcttcttcgtaggaaagatttaataaaagaaaactggatgaagctagtgtggtgttggaggtaaagatataagggagtaacccataacccatgaatatatttatagattaaaacaaattgtaatacagcttatattttaacttataattgaaagggtccttcgattgagccggcctgagtgcgaatctatattttaacagggtccttcgattaaaacaaattgtaatatagcttagggtctattttagttggtgaaataaaaatttttaggtgtcacatcggacgtttgaccggatatcgaaaagagtttctggacacgaatgaaaaaactaatctcataactcgcctgaaaactgcgatgtgaatcttttgagtctaattaatccgtcattagaatatgtgggttagtgtagcacttatggctaatcatggattagactcaaaagattcatctcgcgatttacatgcaaactgtgtaattaatttttctttttatttatatttaatactacatacatatattccaagatttgatctgatgttttttgaaaagttttaggcgaactaaataggcccttatatatattttaacagattcaaagagtgagggattaattaatttggggttcctttctagcgctgcggctcatgcactcatggtgcagtgttgcctttcctttttactctcgcttcaacaattaatttgcgtcagctcatcattgcagatcggcgcgtagctgcggcgaatcagtgatccgtgtgcactgaactcaaccatgagttaatgttttttagtcgtcagaacttttggcattcaatggcgtgagatcttttgcggcaattttggtccaagtgcgacccgtcaaatctttagtttcgtgatttgatctgaacagtagtacgtcacttcatccgtagtagcactacctccgtattcaataggctactacctccgtattcaacgaggtaatattcaatatttgattgtccatcttattcgaaaaacttataaacaagtttttaaaaagtagtcacacataatgtactttcaccgtcctaaaatatacgtatttttttatcctgacatggcctccgagatactactctgaccaacaatacctataaaaataaaatatcttaaataaaaagaattacatattataatagtttttttaatgataaatcttgtaatatcaaatttatatgattgatcttttttatatttctgctattagtggtcaaacttaaaaatgtttaacttatcactatgataaaaatgcttatattggatggagggagtactattcatgtttatcattttataacaataaaaatactatttataaaactttttaaaataagacgaacgatcaaatgttggatataaatagtgtaaaattgcaatctttctaggatggaggtagtaaaatggtactccctccgtcccaaaattgtcctaggatgtacagatacattgttctaagatgagtctcatcccatattaggttgctatattttgggatggatggactatttgacacatccttaaataacaaaactaaaagagagtaaagcaacatgcaaagaattagtaataaacctcaaatcttatagttctctgcatacagaaaaaaacaagagataagtagtgtcatattttggctgaaagcattagctctataaattcttctgaatatctgatcccctccatccaagaatttaattttagattcttgtatcaactgaacttgcctcctttctttccctcaatgtgaagagaatttacatgttagttagcaagaaaaacacacagaaaaatatataagaatgaacacagcggctcgggaaggcagcccctgaacctgtagggttttttccaccgtcaccttcgaccttcgtccttcggtccccctcctcctccgctatccggtccaataaatttatagggtttcttccaaataaagtctttagagaggtttaaatctatatatgtagagtctaggttttatcttccatggtgttaccgagttagctagatttgtctagagctagttagctttttcttgttcgcggttactactttcacggacttttcaataaaaatttaggagtatataatatagtaccttatattttttattaactagaaaaagtacccgtgcgttgcaacggatgaaatttattttaatcttattattgttatatggtttagttaagatgaaattcactgtgggagttcgcttggatatatatttttttagaaaatcatgagctgcagttagaactccgatcgtctcaagttagcatgcgagtttttttaaacagaattcttatatgattccctctgtattaccaaaagtgaacgatcttgaaaaccgactcaaatacggatatgcatttctagaagcaaatgaacttaaaaaccgactcatacacggatgacgcaccaaaatacctacaaaaacatcttcaatttttataatagtagggatagagatatgctcagtcttttttaaataaaaatctacagtgtaattatccttttggctgaatttaattgatttgcgtcttttttttttttttgcccttgtagtctgattcctttgaagggaccttctggttttacaagtatttactccgtatcctgtaggaagatatgcatccaagtacgaaggggccatggaaagactcaaaagaaagaagataatgctatagcatatgcattgatcaagcatgacgtgcacaccccatcaggcaatcactggccgagcctcctttcgctacccccacaggccacagtaatacagagttacacaagaacggaaagctacatctgatcgatctatatctcagtacgtacaggagtacacataagctaagctagctagggcaacttacgtacgttatggcgtatatatgtatccctgaagaaggggcttttcgcgtcgcttcgctcgtcaaagcaagctagcagtgaagaattgaattcaagtacaggctatcttgcatgtgtgttactcgaaacaaaaaaaaatttctcctcttttgacagggacatagagagagaagtgagcatagttaggttccttgtgatagaactagtatcatccaggtttaaattctagatttaacactgatgctcatatttacggcttattatttttttcaatggtaagcgacgtaccccttgagagtgaggcacccgtggttacttcgtcaaccttaagatataccagccgagtctttcggaggtactaatagagatagagtgtacatgcgtacattcatagaaataagtgtacgcgtgttgtgagcgtctatgtttgcaccgtgtttctcaaaagagagtacacagctggactgtatagtgttgtgtgtgttgtgcaggttgtgcatatatgagagaatttattattggcgcatgcattaataagctagctagccgatcgatggatcgatcgagttcactactgtagtttctactactccatctatttatatagccgatcgtcgagcaaaagaaagctccagctagatagccctcctcttgctcaccgtacctcgctcgcaatcgatcgatctctcctgcatatatgcttgatctgatctctccttaattataagctacacaaggtatgtacgtacgccgatcgacttattaacgcgcgattttaatttcattattattattattattattattattattattattattattattattattattattattattattattattgtacagcagcatttcaagctttaacttgttgcatgcatatgcatgattttctctgtgctataattaagtgagatatatgctataggctatagcttgcttttggtgaagactatagaacgttagaagacttagatgtgtgttttcgcacaatgatcatgcgctgcattggatatgcttgcatgcacatcaccaaatactgagaaatgccttgtactttattcaaatgtgtgtgtacacttggatttcaaagtccagattaaactccttagcaaaggcatctctttcataatttgactcctcgagaaaaggatagacttattttgtttcccttccgaatatatataaacctgattgtacactggtctcattattaattgtcttagtttgaccgagctagaaagcttggtgcacttgtaaaagacgaatattagggaataacctaatataaaataattagaatgagtgaggtttcgaatctatattgtctagcccaccaccttgtgaagctagccgaaagaccctgacacagctatagcttagctagggaaggcatcatcgaacatacgctttactgtttatgtgcatgcatcgttctcttctccttcttaatttgttgattaattacttaattaattaatacttgcaggcaatattgtactaattaagtagccgatcgaccaaggcagtacgtgttggcgtttgctgataatccttggaaatggcggcagcggaagcagcagcgcccatccacgatgagtacgtacgcgtccttgtgattttaggccctgcgctaatcaatcaactaattataattaataatgcatatatggatttgacaccgtcggcgttggatgatatattatggcatttggattgatttagatgggtgctcataattttttattaaaaaatgtttagagaaacgtctctccctttaattttttttcattttttgaaaatttggctgattttgcacgggttgggattttctgccaaaaaaaacaagagtgatggtttgggccaactgggcctcccaagcggaggggccatcaatcaatttgtaggctgtcctcgtttttatggcgtggactaaacaaatatgggacaaccattcattagtagacgtaccggccggccgtaatgactgtcgatcgatcggtaaatttcaagatacgtacttttagtttgaacgcattagtatgatatgcgtgtgcagatttttcttaaaagttactacgtggagtactttgttaaattttgtaaaagtatatatggtacaaaatgtagaaaaagttaaaacatactttaatgtatgaccccgttaactttttatccaacgtttgaccattcgtcttattcaaaaaatttatacaattgttatttattttattgtgactagattcaccatcaaatattctttaagcatgatatagatattttcatatttgcacgaaaattttaaataaaacgaatggtcaaacattagtcgaaaagtcaacggtgttatacattaaaatacggagagagtattataatagtacaatatatttttttaagactggcaagaccatcacactctaggtggagtcctgaacacaatcgataacgtaaaggacacatataacatattctctctgtcttataaaaaatgtttttgcaaacacccattttataaaaaaaattaaactagtactcgttagaatgtgtctctatattcgtttttttaagcaggagggagtaatatggatgcgtgtagtggtattgtatttaatttaatttaatccgtttcgtgcatgcagggctgaggacgacttaccgtacgagacaattgtgacgaggaagataaaggccaaccacaggaagtccgttgtgaagctgctgatcccagttatgaacaagctgggaaagcccgggacggtgggtggcacggggtacatcgtgtacaacgccgggcgcaagttcctgatactgacctgctcgcacgggctggacacgtggatctgcccggagcctatcagggtcttgttcgacaacctggtcagttaagaccattcacaatgcgccaccaaaatatggtgttcctcatttaccaccgagaaagaaaaaacatctacgaactataagatagctacatattactccctcaattctaaaatataaggcataatcacctctaacctaaagaccaagaaataattattatcatcttgtagtttggatcatcctaataaatacaatgcatgcatctaatagaattagagaacatgagaatgtaggattttaaaaagtaataatttaatggagaatggatcatggttaattgcctacatgcatacatgccttatattatggaacatctaaaaaaatggttgtgccttatattatggaatagagggagtactccacaatgcatactggtggtactactccagtgggtcacaccattgtttctcatctctacatactagtactactctctacttctttccccctcaatgacgacgtgtcccaccattctttcccatctatgcatactagtactactcatctcttcttctttcctcctcattgacgacgcgtcactccattgtggaccccacctgcaaaattgatgaggaacggggagctcaagttggctccgagcgcttgagcaggccacacggtttgtctacgtggctaggaatacttgttcttttgctacgaggctgaacgccacgtccttgcactgggaataccctaatactacctccatccgacgagataccgtagttttacatcgtttatattcagcatttaaccgtttattttattttttaaattttcataattagtatttttttattgatattatatgatagaacatgaaaagtattttatgtgtgactatttttttaaaaaaaattcttaaaattttcaaataagacggacggttaaacgttatacacagaaacctataattaattagatataataattagtatggtactctatgtaattaataacttgggggtaattttttgtacgttgtgggttaaattttgccactaattaaatgaaaataatcaggtggtggcgcaggcgctggtgaaggtgtgtgagcggaagaaggaggtggccatcctgtccgtggatgtgtccctgaagcaccgggagctcaccgacgcgggcgagtaccctcccgtggcgttcgaccaccagccagtcaggaaaggggacccacttgtgctcctaggctacccttggccttccagcaagactggctccactaacctgggaagtttcttcggctctgtcacgtaagtgtgtttatagctagcttcttcgtttgtgtttttgtgtttttttttgttaaatttagttatgcatgcaagcagggtacgttggcaaacaattaatcgctttcgctaatataacatttatatatgtggcacaaattgagggtataaatcatactactaattaattaattaaactgctttccatcgagcatgaggagtatataaataatgttgcttaattaattacatgctgcttcacttcacatatattgtaatagtactaattgctggttaaagtcttttgtcccaacgaaataaaatagtacatcctatatttttaaaatgtagcctatatataataatatatagcttaattattggtcaaaatagttatctctagcgttagctgttcattctagtagtactaattaacataaaatgcatgtagtatttgtgcttaatcaattatctctagctagcttttcattcattctagtactaattattttgattttgatgttgtggtcacttactactccatactatatatttatgtacatgtatgtatgtatgtatgtatgtagcaacgaggcagctcttgtcggaaaactgaaagacacccctcccgaagaacacatgatgactgtcaacgctgattactccggtgcaggcgggtcatcaggcgcacctgtttttagaggcgaaaatggcaaggttgtgggcactaatgttcacggtggcaaagaggtcttgtgctttgtcacggtgagctggattcaggatacactgaggaatttacaggaggtcaaaaagtccggagtaagtacccggccctctaatacagtcgccgtgtattagttaattacataattaaacaagctagttttatttatatacgtatgtcccataataattatcacaatagagtattaatgatcctcattaattacttctcatccaaatttcttctctattttagtctcaactacccttttatctttatctataaaccatttaataaatagtatcacagtcttttttttcaaaccttagtatatactccctccatcccataatataaaatgtacacgtatttcaatattcaacctttaaaacatttaacaaacatttaatataatatgaaatgaattttatttgttaaaaattatatcattagattgacatttaaatttactttcatataattataattttgttgctgtaaaccttataacatatgagaaattataagttaaagattagttttagaaaccgtgtaacttttaccatgccttatattatgtgatggtgagaggactaaataacttagaattataatcaatttgggacggagttactatttttttactctccatatgcatatgcaagcaatgtatctcgcttaacaattaattactctcctaattatataattaactacactgtactgtactctgatccatctctgcttggatgctatagcttggaccgaatgcaaccattgaggagattctggaatcatgcttcgctttgcttaaaagcgacgaagctggcccatcatcaaggatcaccaggtactcgatcgatctctccccggccggttgtaaacacattatcgttgtttttttcccctgtaagttataaaatggttgattaattgtcattaaattttaaaatattagttagtcaaaaaaacataaaaaaattagtatggtacgtacaatatttatgcatgcatatagaaaaaaaaaacacgtacttacatatcctcaaggatatatatttttttattaatgaaatagtgcaccttttagatcatagccacatacacgcattaaatcatgctgaaatctctacacagttatatatgtgttatatggttattaattaaggggcaaggctagagggctatgtataattaagctactatacatacgtacatttaattccatagttctttttcgttgtacacaaggactggactaattcgattttttcctttttttttcttttagtccgtcgtcctagtgtatctaatgcatgcgacttcaggcaaagtgcaacctttaatatttatgcatgacgagacgtgcggttctctatacctctccggtgataagcagtgaagggaattgggttaaatggattatgcacttatgccatatgtggcctgatgatatttatatttatatatatgtaccaggagattttatttagaatgtatcagagattcagagtacgtagttcccgaacatatatatgagggagctcaattaatcagcgcagctcaagcctgcctctatctatttaattagacgattgagaactgagaatatatatgtttgttatgccctcaatttatttaagaatgcaggagactgtagcaagtaccaaagatacaatttttcaatatcgtgcaaatctaaagtccctcataaccaaaaagaaaaaaaaagatggattggtgtttcatgaaaagaaaatggtcttaatattcattttgcattttggaaaaaacatgctcgactagttgaatatattggacccttcactgtatatactctttcaccaatcttgaatcattgatttattattactccctccgtttcgaaatgtttgacacccgttgactttttaccacatgtttaaccg

SEQ ID NO: 55168 - DNA, 33297 bp, Oryza sativa
  unsure (1)..(33297): unsure at all n locations
catttcgaaacggagggagtattaagcaatactagctacaaaggtatcaaatgcatgacatgccttggttcactttgattggctcggccggtatacgcgtatgtatcctaccatagaagtgcatgcaacacggtacgtatatgattggttcacttaatttgttggtttgctttgcatgcataaatgaatgagaatcatatgcacctaattaacatgcatctcttgatcaacctgtatatgtactgctagccaccaaatatgttcgtacaacgctgtatatgtatacaggtttttcacacagagatagcctacgtacaacactgggtgtgtttagttccaattttttttccaaacttccaactttccatcacatcaaacctttcatacacacacaactttttagtcacatcgtctccaatttcaaccaaattctaaactttgggccaatccaaacacagccactgtctatcacaaaacaactccagctttcagctagatcatctttccctcaaagtcttcctttatccctccagacgcgttccatccttgctgtccatccatggtcggcattgaagatctcacttgccacttagccgagcagcttgagactattgagatgcaggcattaaagcagagatatgttgttgcttctcattagacaaaaatagtagataaaggggggaaaaaacgctatgcaaagatagacaggagaaagggcacatgatgaactgcctgtagtcttccatgtgtgatgacatctgagttaaaaggtgtggcagactcctctaaaggctaacaatatagccacagatatgacaaatattctccaatttggatccgaatatttgtaacccaaaaacaaactagttcaaaccttttccgaatcagcccaaaccgcctaagcccatctccatcaaaacaaagcctgtccaaacatataaccaatccattaagcccatttcagtctaacccattagcatacctatggtgaacaatagaaaactgtggcacacacctcttttatatcgctcttgacgaagaactgccacccgcctttctcttcgctggtaaacttgacatttgcgaactggcaacacccctctcccttcttgacgaagaactgccacccgcctttctcttcactggtgaccttgacatttgcgaactgctaacaccccttccctttctcttcttcgatgcactcgttttttcagaatcgtacttctcaataagagctgacatctataaaatattatcatgaagttaaaaatctgtaaatttctgagccttttacgacctaaaacagcaaaagctattactcgggctttaggttttgtacaaaaggtagtacctcataatcttcattctgtaatagttttgccaattcaacctttaattgactattgttcagggcaaaattaattgataaacacagtgctgtccgagcaacattcattccaaaaacttttccgaatcgactacatataggtgctcccatcaacccatccccaatcggacaggtatgcacaaatgtgctaacctgttgttctcctctcagttccttttcaaattcgcatacactggcatgcattaaataactgttattaagaaggacatacttaaagaataaataattaagaataaaataccaacattccataaagtgttgtccagatctctaaactttcaaactgcaaatttaagccagcaaacttatttaatttatcatcaaatgtctaagagcttatgatgcatgtcaacaagcaagcagctggtgtggcatgtgggagaatgtgagaattgagattgacgtggatggaaatatatgcaaaatcaacttggtgttcactatcaatcccaattgctcataacataatcaccaaacaacctgctgatcattcatctcatcgatgaccaggaatcaatggcatgccaggagaagccaactcattgcaattgaaaatggctagcttgtcctaccatttcgtcgattatagaccgatggtgttgtgaacgggagacgacataatttggggattacagcatgagtaaagtggaacaagagtaaagagcatatcgattttaggaggttccatgcatatattctaatccatggcaagttcacgtgctcccacataccaagttcactccatgttagcatgccacatctattccctaaggagtatgttcacctttgaacctatgatggtacattaaccaagtttgaaggcctaaatttgcaatttgaaagttcagtggcctgcattttcctctcaattatcttccgtcaaatcttataagcactttaaacataaactaaaacaaaatataatacaaggggaatgaaatgcaacaaaagtaacagtacaaaacaaaaatatccatgaattgtcatcaagaatagatggatacctgattattcccgcagtcattatctgctctttcacaatgctaaaacatccaatacaaaaaacaacatctgcctctggtaagtcgccttcatgaaacgatgtaggaatgcaaggtatggcctgaacattacatcctcgcacaaccaacgcagaaagtaatgaacttgttctgacaacttctgtctccaaatcttcttgatcaccaaatctcgcaacgactctgaaaccatctttcggatcacaactgatagatgtgattaccccaatataattgggtgtcacacataataccaatccagtaccaagatggcatggtatttgggtactttttgcattgaaaactgccagttgcacaattgaaggagctacactttgatgcagttgccttaaaaaagcatcatcataacttctcacctacagattttcaagttaacttgtattttgattttttttgtttattcaattttttataaagcaatctatattataaagtgctatgtaatgccacacactaaaaaaagcacaaactataccatacaacataaacatttcataaaatactactaagtctagaacagcaacacaatttatagaacattttccaaagcaataagccccacaaaacatttttggagtctacataaatgataacttaccgctgacattatttgcaaagcaccaattacaaattagccaatgtaatgaagaagtgcacgttcataacttgcatgctgcattcatagctaatgagagtagccctgggagtataatgaagggaatatcatgtcatcttctaatagtaaaaagggaaaatcaatgtagaataaatgcatcagattgatgcatatccataaaaaaaatgctttatgaaactcaactatcaatatgtaaaagaaacttttattgtgtaaaaggaactatcttttgtacatattgggtccagctaagtgaatcaagcaagcacctttactgttaaaagcccaaaaggtaagaacaatagaaatggtgtggatgcaacaaagaagaaagaaatcacagttgtgtaaggaccattgttctcaatatgttgattatgtttctagtaccaaataaatgccagatcataagccataccaaaattttgacagtttgacccttttaaaaaacttattccacaaataaaccatggcaaaaagccaaaaactataacaaaaaatggatattgtggtccatttttggttgtggcgaaatagattaaaatggtaatagggccatatagtattgaacgtgtagtgtgatggtaaatatacgcaaacccaagatagagccccgggttcgaaccccactgctgcatcctttttattccttttttctctcagaaagttgtgtgggtgcgcacggagggggaaaaaagaagggggttgtgggagtgggaatcgaacacaagatctttggatctagaggggagtacatttaccattaggctacttgatgtttatgagaaagagtagattttaatgtttttaacaaagtacaaaactcaagggtgagaggtcagcaccatgggcctaagcgccagggcccatggcaccgggattccggtccaattttgcaataagtttttgacgtagtctattcttcaaataagtttttctaaaaaggtcaaattgtcaaaatttcggtaagccatagccattttaaaatgcaaggagtggaggtatgtttgtcattctccctatatgtttatagatggccataagacccgaggtccggcccaagcacgacacggcatgactggtgtcgggcccgtgccggtctggcccgacaattgggccgtgcctgagctgatgccttggcacggtaggccggcccagcactgcacggtcaaagaaaactagttgagggatccaaaatagacttaattcagccttataaagtactgtccaaagagaagagggatacaaaatagacttattccagccatataacacacagcccaaagagatgaggtaggaaaaatcaacttattctatggagaagcatgatgggttgtcgtgcctttgggctagcccggcacggcctgagtcttattgggtcgtgtctgggccgtgggtgcagcccgtgggcaagcacggcccggcatgtaggtcgggccatgccggctcgactgactttggcctaggcccgatcatgcctgggacgtgccaggccgagcggcccattcgggcatctatatatatatatatatatatatatatatttgttcactgccaagagaagaaagccttactaaaatattgcctttgattttttttttaaaaaaatcagcatgccatgtacatatgtcttagaagaatcaacgcatgtgagagcatgtttatctgagtagaccattgttgattcccaatttcccatgattgcatcataatatgcagcaaggattgctaaagtgattattgctctaaaactgaattttatcctcaccattacccccaaaaggtggaaattgaagccatacattgtttttttagagcagagacactaattggctaatactccctcagttccacattataagacgttttgatccctccacctcgtgtctagattcactaacattcatatgaatctagacatatatatgaagcatatacatgaatctatttaaacccaagacgtcttataatgtgaaaagaggaagtatacacgaagcaaggcagaacgatttcactaaataggggggaaaaaagaagtacaggcaaacaattgatttgagcactaatgctaagtacatgcgcacctgaggagcaggagcagaacaaaggccgtaccttgcagcagtactgatcggagcacctcaggacaaagactgtgtcatggagcggtagagagaaagagaactgttacccggctatgtaacatcagttgggagtaaacctgagccacattagatgaaccaaagagtatcaaacaacaaacatacaccgacggaaaagcaaagattagccatcggcgaggtggagaatatgatcttgtggaaaacggacactgcctgtggagtctgtggactgtgaaagccggacacagcctatggaccgttcaccaaccctgcaagtgaagcatggatattggatagcataagacaaaaacgcacaaccccgatgagaaaatttgataaggcaaaattaggcacgtcgggaccaggaacaattagagcaataaagctaaaattaagcaatcaataaggcaacggcaacgcacggaggcaaaaaaaaaaaaaacactttttttgaatgaagccgagccagcaattggtggtgtttgtattaagctggaataaaaatcatgtatacatgtttccaccaccaaatggtgtgcacaggaaaagaaaaacagctaaggagatattatcgctatatatcctttgccccacacatgctccaaagcttaacttcgtcttttattttgggctaaagaactaactagaatttctaatcatcaagaaagtgcaaaggagcagttgaaggataagttcaccggtggcgcggcggcgtcttctccggcgatggccgatggcggcggcgcgggcgccccgccgaatgttaggtcttccggttgagggtaggggtgggaccgcgtggaggagacgtcgccttcagagggaagtcgcggggatcggagcggaagcccggcggtggcgccgcctcggccgcgggagaggaggagggcgttgggccggagtcggttgcgggggaggctagttggagtggctacgaggtgggttggggccggcgccggcggctccggctgagttcctgagctggcggcgaggtggtcgcgtgaggagttcgggagaagggagtgtagtgattataaatttataatcatttaaaataactgtgaatttcaaggtcacaggatgattatccgatggctagggacagaggtggtgtacttttgcacttaaccgcccgccaatccccagcgcccttgcctggttttttgcaaatccaccccccttaaggccctaatccgccagcgcacgccgcccacgtcatttcgttgggcctcatcgtttggcttttctcgtaataagccaaaatgtattattagaaaataaaaataaatttgtaggtaaaacttttatatatgtgttctcggtgacttaaaagccaatgctgaaaaagaaattacgttgaaaatatctcaaaattaatgtcaaaattaagtttgaaaattcaaattttggttttttctttggctgaataggccatccgatgggagccgttttctcgctgccgcccgcgcccgccgcccctttgccgccccgccccatggagtgctcctccaccctccgcaggaacgcctcgtccttcccggccaagaacagctctgggcacacaggccccgacgccaccacgttcgcggttgtgctgctgtccagggtttacgatttcgacgaaattaggtcggatttcgcgaaatttcgacattccgacgaggctcgaaagtagaaaccgtttgagatttcgaggagtttcatctaaattcaaatttaaattgataaaaaaagaaataatgaaataaaatcttataaatattatgatattcatagaacttattgggatataaatttccgaaaaaaatgatatattgtgtgtatttactaaaacttacatcatgaaaaaaaagaatttcagcaaattacctccattacaaattactgatcgaaatttcattaatttcgatcggaatttcgccaaaactgaccggttttcgagaacttatcggcaacttaaggaatttgtattcaaattttagtttatgaaatttgttcggaatttaccggttttccaccggatttcgcgaaatttcgaattccgccagtgcccgaaacggaagggcctatcggaatcgtaaaccctgctgctgtctgctgtttgttctctgcagttatcttcagtgcatgtgcataaaaaaatagcaggttatgtctagtggcaatatagatgttgcaggacccagcatcatcttcagacacttctcaaagctgagaagaggtccaatgatatggagtcattagttattcaactcactttgctgctgtaaggaggaaaaaagaggagattttgtactgcagaaaatctcaatcgttgagtgtattgccttgctcaactctttttcttgggcaatgtatgacgattcagtaatgagggcaatgtatgcagtgcaatatacttgttcctcacaacaaatacaagctatgattttaaatttacaacccagaatataaatgtgcctaacaacagatacatacatatgcacagggaaaggacgtcgcgcgcgggtggcggcgaatcgcggcgaagagcgggcgccggaggcgaattgtgggcggcagcgagaaaacgaaacgatgtgggcggcgtgcgctgccggattagggcattaagggggtggatttgcaaaaaaccaggcaagggcgctgggattggcaggcggttaagtgcaaaagtaccccatctctggccctagccatcggatgagcacatcatgtgatcttgattgagagtttccaaggttgcacagcttgcctggttttcacatgatacgctgccgaatctactaccccacttacttctattataaaatatttatatttcattaacactcatgattatttttataaattgatgtttgttgactcaaagtatacatctctcatctattttaacttttttcttcaattctgcgcggcacaaaaacttaacataatactaatcggtaataacatgataatcgattcaatatacatataaatggtcaaaccataatgattagcacttgttgaaaagcatctacatggataaataaataaattattatagataaataaattattatagataaaagtatattagttaaatggatgatataaacttgtattcgggttatatgaaacattttacccataaatataagaatttataaaacaaattgaaaagacaaattttgctccagaacatcgtgacttcgcagttgtgactgtaggataccgcacgaagtgacttctggaggaagacattcaataagcataagaatttaccaacggacaccgcacccattaaaataataattttcagttgaagagaagagaaaaatcgtgtgaaatatctaaaatacccttggacccatatgttagctctcccacctcacttctctctatcccctccgtcggcgtcgtgggggccattgctgccgacgtgaagcagcgcagattggcaagagagggaggcatcacgtgccaaccagccatggcggcacttaaaaacaataaaaacaaatcataatgattgaggaggtcactggcgtgaggagagtagcaccaccatggagagggtgttgccgctgaggggcaagcgtcacgtgttgtagtcttcggagaaaaatagcgaggggggagtgagccaagagtgggtgccgccgcagagaggtgagggagcgtcatcacacgtcaccgccaaggtgctgaatcatgagagtgagagcgaggggaaggtggggagaatgtgagagatgataaggatggggactggggaggaggataaggatgaagggatgaccgtgtgaggctcaactcagcttggtgatttagggtgtcggtttcacctattagagcatctctagcagcctctttaaatctgactcttcaaatatttatttggccagcttgccaaaacaaatgcatagttaaatttatcttcactccaacaccatctccattacactatccaatctaattgtagatcctacatatcagcatctctactatttcactccttcaacccccccccccccctctcctctctctcttctcccctcttctctgccgcaccatcagtggaatccacgcgtggacggcggtggtggaggccgcgcaggagcagggaggtggcgctagtcagcatcgccaccgccgtcctcgtcgtcacgggcataggaggtggagtccgtgcgcactttgtcgctgaaaacaactttatcaaattttggcaacaccaacttttgacaagttttagagttaccaaatttgacagcgtttaatgtgtttaatttgatgccattttaaaattttgtattgttttagtgagagagaagtttcagaactaccaaattttagtaggatagcattgatgccatcattgtttgttggtatattaccaaaatttgatggcaataaaatgaacaagccctacgtcacaactaatgctacttttcacttttcagaacgatgagaacagactctgagtatgccagctggatgcttagacctttggtgaaataaaccagacaacagcattcaataaataacgcagctgtacaacaatggtcagtggctcggtgcatacaatacgaacttccgacacacctctgcatctacccctccacccctccgtcaaaaaaaaaaaaaccaatcttagctacgaacatagacatatgcgtgttcaagttcgtagctagggtttgtctttttttgaggcggagtagtacatcacagcattgacaaagttaatgagattacagaggagcccttgcaggctaagaggacatagaggaaaggagtgaagaggccttttcatgtcaacacatgcctgaaatggatcaagaatccccttgaaagttctcatcttcacagctgaaaattaaaaccataagcaatctgtctgaggaggttttatcctacccattaatgccacagtgcatgtgtgttgtgttggattgggatacttctggtttaagaaattcggaggaaagccgaggcttcaaagacaaatggcagataggttngcatgttacccccccccccccccccctctctctccccaaaaaaaaaaaagggtcagccttcatcagttcaaatatttatcaccaaaatattgcttctttcactgcagtggccatctacaaatagcaaatctccatgaatcatcaataagataagaacatgatttagagtgtttcgaatgaaaacctgttattgaagcaattgttgtgttcaccagaagcaattcctatattcagctttgcaacaaacttagtgttatctctgggccttcgtatttcagcctatattccaaagagaaaagaaaggtttttaatacagtgacaaaaggatgattactaatatggttgccaactaacctggacagtcactttatcctgcgtgggcattgcagccgccattttatcaagaaatatcgaagtaagctgagagtaggaaatcaaacatgagtatgaactccaaatagttgggtcaagtaacagttatattaaagaccacaatgtttctcagactgaaggactttttctgcctgcagtgtcttccgttaaaaagaaaagagaaaaaaagatagtacaaaatatagcaattcaccaaccagaatggaggatagaaatgaggtgtggttgagagaagataggatcatagaacttgcagaaaaaaacaggtggggatacatggatggggattcctttttactatggaagagtaattctcagatgaaccagcaatagttggtgctaacatatttttttcacatgtttagcaatgcaattgaaaaccaaatagctcagcatcaggaaataaagttcttttttttgcctttcaactggaacttctcggactcaaagcactttgatattctcaataaaataactcatcaaagcttttcaaattcatataggatctgcatccaattcatttttcatgatcctatgataatccacccacagctctaactgcgcaaatggcaaacagaagtgctacagacaaacatcaataataatacctgagacagagagtagagaacaatgtcatcaacactacagatgatatcaccagcctcaatgctgctacaattttctggtaacacttctgatatctaaaaaaaatgtagttaagtcaatggaatgcaagaacagagaacatgctataagggcttgtttggtttgatgccaattttcgccttaccaaaattttggtaactttaatagtggtaaatgtacatttggtttggtaccaaattttgcctataatagttcagagtcaatactacaaaatttggtagtgccaaaaggcccaaaacttgccaaggttttggcactaccaatattttggtaggacaaaaattggcttcaaaccaaacaagccctaagttaatttcttgaagagggtactctggctggagcaccgaccataatgctgctcttgtgagggggagtccaggtccaatagaggaataggtgaagtgctaatcagatggcattggtctggcttcaccaagttagcctgagggtcgataattaaatgaggtatagtttccctcgcctgaatccaaaagaggatagcagatgcctacagagtggtattttcccatatggcacaggcacacagcttttcactggtatttagatgaaccatgaccttttttagttttgttttcttctaaactgatgatcttgatgtcatagaaaagttttattaaatctacagaagaatggaaaattgagataaagtttccagttgtacttattttgtttctcctaacatgatgtatcaatatgaaacttgatattttaaagaatgccgcaaataacttttttttttcacaaatggaaaaatggtccgtcgctccaagtttgcaaaacgacctttgcatatccatatcaaaagtttcctccatttgagaactccccctatatgttgatttctgtcaattctaacataataaaaccccaataaaaatcagtggagcaatagtgtttgactttggcatatgtctaccccgtataatttgtttgttcagcttagcatgctcgagtttgcagataaaaacaattacgtttctattaaaatagagagaacgagcggaatcgcacgagttgtaactgacatatcataagttgtgggggtgcttcctagttcctaatagagtggtatgtagaagggcctatgcaatttccccaaaaagatttcagaattactcataatcatgcctacactatagcttggaacaaatatatgctgatcattctagtatttttcatcattatttgagcgaacttattatgatatttatgcctattctaatccagttatgacaaaaaaagtaaactgatactgatgcatattttaacacataaaaatgtagggccacaagaagcaaacgatactttcacatcatcacatggcaaattaacactcaaataagtagatactcttccatgtatatgcaaaaacaaacctcgctctaacttgtagtaatcaaacacagccctttctgattattattggcagtggttcatcatgctctagatgatagtaagtaaccttcaaaagtagagagagaagaaaaggaggggattggctaccttctctaccacaattccagaaccagaagacagctcaggatacatgtagcatattttttccaaattgcatatttccaacttgtgaatagcttgtccccttatgcaaagagatggttgtttgagtgtcctacattcatagcgcatcacatctcttgcaaaagcattaaaacaagactccacaaatgcgtacagacatccataaatagcacaaaactttatcctacttctgttcctactactactagttattagcttcagcaatttatataataaaagcaggtaaaatttacttttaaaagatccaagagtgggtaaaatattatgcaaatatgtacttttttctaataacactggacagaatactagggaaatatttctgtggaaagacagaataaattacatagttaccaaggtcaaagagaataatagccagagaaaaccatgtcaaacaatgaaagaagagatggtactcaaggaagaaagtggtaaacacaaattcaacacgggcactgtggttatactatagcttgaaggatgctaaaacattagctaagttatcagaaaagaaaggcacccattgaacaaggatgtagttgcacccccttccgtaaatattttgtttgtttttttaaaaaaatctctagagatgtaataatatataatgttatgtgcacacaaaattttgaagaagcaacctttcaaaaccagaaaaataacaccctgaaccatatttcatgttagttttgatcgaacggagtggcttctcaccaacatgttcagtcaggtaagtttcattgttgtggacctattaagtatcatctacagtagcaaaatatgcataacaagagtacaaaccaggaaaaccaagtccacttaaaacaaaccactaagaaagtatgtctagggtgttatttgtccgattttgaaagttggggccttgggggtaaaaataactggttttgtagttgtgtgaaataatggacttcgagcaaagttcaagggccaaaaatgtacttcaccgaaaaaagaaaggaaagttgtctttctttgacttacttatcttccctttcacaatgcacatgtaatcatttttttgttcatttgcgtgtgtgaacatatttttaacatgccctacatgtatatggtttttccgaagtacgtgaatcgtataagtgcaaatttcaaatgggcatagccgcagagcggtttaacagattgagacaacaaaaattactcgcaggactaatgatagtggatcatagaacttaacaactagaaaaaacattgtctcaaactagatttaaaactaattcagaagaatccagattgctcaggtatgcaaaaaatgtacatgtgtgtggggatgacagtattacagactggcaaagtgcatatcatatcattaaaacccaaagagaaagcatacctgaaattcttgaagtgttccaagcatctcaccgcaatctcaataggcaagaatggaacagtatccttgtcgtaaaaagtgatgccgagaatcctcctttccaaatccatgacaaggcccccaatgaaaacctagaacaagataacaatatagtgaaatgaatgtcccttttaacgatgacaatgtccacacagcagcatatcgtaatgatctaactcagttgattaacctgcaatacagccacttacagagagctgttgaaaaaatatatacgtgcatgccaaaatgagtaatcattatctggaaattaatcggaactggacaaacaatcaatggatcataataataggcgcacaaacattcacaattaagtgcgagtaaataatttaaaggtatcaccatgacaaaaaaaaaacagtgcttattactaattcactgaattatcataataataggcacaaacattcacaattaagtgtgagaaaacaatttaaaggtatcaccatgacaaaaaaaaagctaacaatgcttattactaattctctgaattaataattagtagattagttggaccaacaatctaaaatacccccattaatgcatcagaagcaaatagatagtttcttaatattcagcgaaatatacatgacagtttcttaatattcagtgaaatacacatgacagcttaccatctataacaactaaccgaattaacagtatatttaaacagtccggtcttcactattgattttctagatattgataatctgtttaccttactaacaggacaagtgcagaccaaaagctcatcgcagtccaattcgctacgttcacgggtcatctccccacatctcactagtaaagtctttgacttaaagttacgagctacagctatcacaggccgacacagcatggaataacagacaggaacgtcatgaagtttcaccaaaggaagatcaaattgtggctcaatggtgacaacagctatattgtactgcagactgcacattgctaagaacccctcagtgattgttttgttgtgcagaagtacttcaatctgcagtcaataaactaaaacctagttacacatcaaattgaaagagaatgtatcaaaacaaacatgaaactgttgttatattgaccttaacatcaccctcttgataagcatcatagtcattgtcacatttcctaaccagagtagcagaggtgagtatccaagttgcagaacccacatgatcaaccattgtccctgagcaagtaaatagaacctttccatctgcggaaagcaactagtaggatcaatagctgctggtatgcgaattttgtaaaaaaaaaaaaaaagcatcaaggctacagacgatcagtaagattaccaacagaagagataagggacacgatggatttggatatgcttaaggccacctcttttgcactcaggccttcctctgtgaaatcctcttcatcactagagccatccttgtttattgcccccttcaaatcgctagcatcatatttgtcgacatccgcttcagaatcactaggatcatcaccgaacaataaactctccacatacaaagcagcatctgaggaattaaacaaacaagtaaaggattcatgctaaacataaacaaaaagatagtatattgttgaataataaagccttcacagctagaatcatctaaaaagggaagagattaggaatatgcatatagaagcaaaaaaaaaaaaaaaaaaggtttgcgataccttctgcacttctcttcttcttgttcggcataatatctgcaatctgcaatgaaataaaaccaggttgacagtgagtttcaagcaaaacagaattgactaggtaacttagccctaataaacacagatactacaatgactcccgactcaggactatctggaattcagagcagatgcggttgcgtgccaaatcaggccccaaggaaggatgtgtgtgagagagaaataccttcaccgccgaggagggaggtgaccgcgctgaggaagccccttgaggtagccaaccgcgggggaaggagacgccgaggggaggcggcggcagccggcagcagcgcccgggaccgcgtccagtctgcctcgcgacgaagggggagttacttgcttgggctaaacttgttgggggcttaatgggcctatgtgggccgactcggcctctggagcctgaggacggagaaagttcactttaggtccctcatttgtcaccgagttcgaaattcatcccttcaccgcaaaaaccagatacaacacatcccctaacttgcaaaaccatgcaaacaaaatcccttggcagtatttaacccagtttttggctgatgtggcgcctacgtggctcctttgactaggtcttcgtcccacgtggcgcttacgtagtaattcgatccgaaaaaataataaaacctgtgaggttcacatgtcagttttacacacgaaataataaaaaatggtggacccatgtgacctcacgtgtcattagggctgtcgacgagttgagctcgagcgagctcgtctgcctaggctcgagctcaatacaagctcgagccgagcctataaaatgttcaagcttttcaacaggcttggctcgagctcgactaccgagcttgatttttaagtaaaacaatatatatttcaaagataatctttaaaataataattaatttctaattcatcatactaatataagaggaaaaaataataaaataaatatatgatgtcaatataaggcatacaaataacatatttgatctcctaatttattaaataacaacaaaaattatatactgctaggctcgttggaagctcgagctcggctcgacaaggctcgcgagcttaggaagaggctcgggcttgacagccctacatgtcatactcactactctctcctctccatccccctctctctatatcctctctctcccctcttctctctatccccccctctctctctggccaagggagcggggtagacggcggctggatcaggcgacgggaagggcagagcggccctcgaccaccgctcccgggtcgacaacatcaccgccaccaccgcaatgacctggctaggggaatgggggtaggcggtggccgaatcgggcgaggggaggggcggagcggcccgctgccaccatgacctcactgtcgcttgcctcaccgtccttgtcgctgcaactgaagcatctaggctcccggtgttaattttggtaattaatgacaagcgctaattgtggactaactgttgtctttgagctatatattttaagttaggaccacgtcatatgtgcgcatcgatgattatcgatggattaaaattgacggcgcaaagcaaagggaaagaagacggtaaaactagcgatttaatttagaattgatcgaggtgtagggcgatcaaatttgctagtttatttttagtttcgccgtactattaagaggggtaatgacctagcaaagagatgattttaattgccacattaggtcattatgcatttagacttgagctctcatttctcacacacacacctttgcctttcactgggttcggcctgaccaggggcggtcagaccggccacatagtagcggtctgaccggcgtgccctggccagtctgaccggccccaagagggcggtctgaccggcgcataaggccgatctgaccggcggcgcatgcgcggtcagaccggccccctggaggccgggatggtgctgctcggggtggccgatacagagccgacgaagccgtattcggtcagactgagccgatggcggtctgaccgagccaaggccggtctgaccgcccgctcaacgccagtctgatcggccatgccgatggggccctctgacagcactacaacggctagttttctagccgttgcagagtagcacggtccgaccggccacatacctccggtcagaccgacagagcacagagttgggggatttcgcccccaacggctagttttcatgggtgggagtataaatactcccccaccagcagcacgggggttctcttggcacccaattcaattgcatacaccccttgcacctctctcacacccacttaagctttgtgttcatccatctagtgtgttagagggttgattagccaagagtcaagtgcattgcttccattatagagctagtgtggcacttgattgatcatctccacgccgggtcattgcttgttactcttggaggttgccgcctcctagacggcttgtggaggagttgcccggtgacctctccgagaagattgtggaggaggcccggcgccggtttgtgagtggtttggagttcaccaccttcggagtgaaggaagaactaccctagtgatcgaggcttgggtagtcctctccgtgggccggctcccgccttgcccaccccttgacgaaggggacgtgtggtggcttcgtggttgagctgtggagttgggctcgcctcaacgggaagtaggaaaccggcgagtttccgaacctcggtgaaaaaatctcttgtctccttgtctcatttgattgttgcatttacatttgtgcaatttacatttctagagacatacttgagattatatcaccctaggattgctaaacattgacataggagtgtgatttactttcctagagatataattgaaccactatcaccctaggtttgcaaaacataacttagttgcttagttagagttgaccctcaccaagcctagcaacttaggttagttttgattaggtgtcatttagttttaaatcgcctattcacccccctctagtcgacatctcgatcctacagcaactcccctgtgcaggaggcactggggttgctgtcgcgtggagtcggcggggctgcaagtggcgctcgctcctctccactcaccggccaatggctatggctcgagaaacgcacttcctcctcttcctccccttactcctcatctcctccttgctcacgcccgccactatggtggccgcattcgtcagcttcaaatcatttcacgatgggggaactagagatagtggcggcgggcgagctcctgttacgctaggggtgaaaacgggtcgggttcggtttgatctcacccttcccatattctaacccatattttataatcggaatcgggtcggacacatatagtgccgaatatggatacaaactcggataatgtcgggcaaaaatacgaaacaaatatgtaccaaaatgcatacgtacactatcggttacgaatatttatttggatatcaagttgaagcaacaatcttatatatcatatagacaataaccatttaacaatttcatatatccataatacgatatattaggctattaggaccttatgaaaaaaatatggtacaatacaaaatagtagaatcaatacatagtaccagatagtggctcacagaaaataatacgagtaatatccgtataattatccgggtaatatccggattttttaccggataatccgtatctatcgcatactaagttcctgaacccgatctcgtatgctcaaataagacccgtattcggacccgatatgcgtgaaaagtcccgggtacctaaatttgtcccgaaataatgtggccgagctggcgggcggtaaatacccaccccgttttcacccctatgctatggtttccaagccatccaaattgccatgggacctatattgcaccggttttaatagttgagagacccgttgaatgtggtgtttcggttgaaagacgaaaatcagatttgttgacaagttaaaggacctcggatgaactttcccctgtggaccaaccgactgggcctcgcgctcgcgggatcgatcgatatcgataccaccatcctctcctaccgggaaacgccgcgagcagcgccgccgtcgcgtcgcgccgatctccacatcaccggcggcgacttgcgagcaccgtgccgggcgcctactgcttccggcgcgtactcgactccttgcgccaaagtcaatctcccctcgcaccgtcttctcggcctcagactcccttctccgactcgctagttcgccccgccccgccgcgcctcgccctcgcctcgccgcctgcgccggtttccatccatcccgcgacggacgggagcatccgtcgggtgccgtcgtcctgctgcctccgcctccggtgagcacccgtgccgaaacgcacacgcacctcctccctttcgaatttgcctgttaacttctgttctagatctggaaactaggttaggacaggttttcctctttgtcttgaaccttaattattagtatagcagttttcccccgccaaaataatctggggggtttcaactgtaacccccatgaccaacgttaggtccgcacctgttgcagaaccttgttttcttgctgacttcaatttgtgggttaggtttaatgcatgatgctgcagcatctatgcacacgatttcctatgccccactttgtagtgcaatcagttgagaaaaaaaaccatggcgtagaaaatgcgtgttgataatcacagttattttaatatatatttttacttcaaattgcagttggaatgcctgcctgcgtgcatatgatagtcatcggctcttatatatttttatgtcatctcaagtaagcggtacaattacagcattctcatgggaattctgtagacagttggtacttataatgtagtaatatgagcataatatatgcaatcagtagcaagtattttgttattttcaagttcattcagtcggcacataagaactgtgctttattaaaagaaaggaaagctatgccatcatgtactatgggtataggagaatatgagagatgggattgagaggagttgctgcattactcctcaatttacagaaaagagattggctgtggattttaaactccaaacatacaacgatataccatagcttctattgcatctgatcattggatagtataagatgttatgatatcttcataagctatagtatatgatctaataaactcaaaaatgcaccaaattattaaacaggtcattactcattaccatgttaagtactatcaggtactactccctccgttccacattaaaagaggttttggcctctccatcccttgtctagattcaccaatatccacatgaatttggacacatatatgaagcacatacattgaatcatgcatgaatctattcaaaacccaaaatgttttttaaggtgaaacagaggaagtacactgtttagatggccttttataaattataacaacatctcgaattgttttggctcttatccatgaaaggttcggaagatgatgagaaacaaccaaaacacacaagtagaaggagcaagcgcaactaagaagcggaagacctcatactctaactccaacagagaaggtgaacaaagtgcaatcacttcgggctcttattcttttctacactaattccaattagtgttaatactctttgttgttcattatttgcagattcgtcaccagttgtggatggttagttttattttggcacatttcatctatcttcttgtatatggctttttattattaattgtgtcaccttttcaccctgttgcaccaggcctcacacgcatattgcgcagaaatcttctcccccgtggttatcctatgccatctgagttcactggcaagtacttgtgttttgatccttcacttcctttctttattttgatatatgtttcttggaattagttacataacacatgttatcccgtgtttctttgactagatggtatgcacatggtgaataactttgaagaatcttttggagacttggatgactgcaatgaagaatacagcaaagttaatttagttgctctaagaatatctcagtccgttgtctcacttgcttcgtttaagggtaataattcactgtctcagcatagacaccaatcaagacaaacagggtaacctacacagagggtaggggataaggagttcccatctgtgtagttccatcacaaattggtaatttaaatgttagtcctgtacagggcgaacgagactgtttgcatgcacgggtacaattatggagtatggaccatctaaaatgagcattctgacttccgctagtttggttagatgcactaaagatgaaaacaagacagatgaaaaattaaaggtcagcattcagccatattttctcttctgttacttctttatggtcttagcttcatgagatgatattgttgtcacttggttgtagattaaggtgcgcctacccaatggcaagcttaccgaaggaaaactgtggaactatgatttatattataatattgctgttgtcaaaatcaagtatttcccagaacttagtacagcacagatacataatcaagggcaatctaatgttaaattatctcaaagtaaactggtcgctgttggacgtggctatgaatctggagaactaatggctacaggtgggacactgctgtacaaacctagcaaacttgactgcaaggaactcatgacctccacttgtaagatcacaaaggtattacctctcatttatttagtactatggatagattatgattgcggttggtttatattgttaatatgcatattattcacgttgaaccgccttttaaaaaaagatcatatggaaagacattaatagtgcagtttaaaatggaatctgttatgcagcagttgttcaccatcattttattttgttacaggctgggattggtggtccccttgttgggtttgatggaaactttgttggcatgaacttttgtgataagaaggaaactcctttcttaccaatcaatataattcggaaatgtttaaagcactttgatatgtttgggtatgttttctagttcttattaatgtacttccaataatcttcacttgcaatcatgtgtgctaatggacaaatttgttctccttgaccgtccactctttgaacactagcttgattgtggagagattatgtcaggactcgtgatggaaatacttgttggcttgtttagttgatacttagactggtagtttattgcttaaataatttggataggtcaaaactcaaaaccaacattctaagatgagtcatcatatcctgatcaatcaaatttgcattgccattttcttttaagcgagttgtagtgaatgcaaaaaaattgtattggataaatgctgtgagctcctcagtttcctttcaactgtcagaaccatttttactaagcaagaattatgaattactatgcagtatgactcaaaagctgaccaaccttagtttcatggcttcatctttcccctgagatccatccacccttgagtcattgccatctggcactactcagtgcaatgtttatgcctattatgaattagaccattttggttggtacttggtctgaaagatgaaatatttacaaataccatcgcatgtgtcattgacatgtgggccctggtccaaagtgtcattctcacatgcaatggtatttacatctttgtgatggtacaaacctatttttctcaatgaatgattttcataacatttggtatctgagcagttgattcatggcatttggtatctgagcagttgatcctgcacgccttgtactgctaattatccctttgataaagcattggctgtatgcagaatacccaaatggccgtgccattgctgccaatatgttgggatttgaggattcctgagtttgacttattgcatgtctcgatttcctttaacgtgccaataagttatatacaacattaagatgaatttacacaatagcatgaataaacaaagacaagcttctataagttttggccacatatggtcgaattcggcaaccaaagtttacatgttttcctatatgtcatggaatatggttcagtatatttttcctgtgaaattcctactaaatgaaaccaatcagggcttcaggactaatagaaaccccaagtgtgttacagaagagcatgaataaataaatacaaatttctgtaaaatttggccagatatggtcgaatttggcaacaaagttcatatgttatcctagatgtcatggtacacagttcactatttttctttttgtaaagtttctactagttgaaaccaatcagggtttcaggactcagagagtactccagtgtgttaaatccttcagtaagctttaagcaagtgagatgtctcatattatttcctttttaactttggctagaaattcgatttatcatgacaggagctgatttttttatcttgtttcattgattatcaaatgtataaaatgtgatattgcttgtgcattacatgctttctctggtggatgtaccaagattttttttatggtacaacttttgcattgttgcggtgcaattgtacagccctgtgagatgccaccccatggtttgacttggacaatgctgttcagtggttcatttgttgggtgtaaaatagaatggctcagttagtgataggtgatccatcgcatcacaattcacaacaagcaggacatatagatataattttcctgctacctcagttttccctttgtgatggctgctacctcagttttccctttgtgatgggatctacatccataaacatcagcagcacactgctctgccaccttctcggatgttcagcagtgccacaatcgctgcatagcaggctcgttggactgccaactactgagaagaggaccgacaatactcataatctccataattacattctattaatctgagccgccagactcagctgtttctccaagccattagcagtcatcaagtgtagttgcagtccccatactgagcaaatcactgttcctccagcagtccgctagtcccaaaactgcttagcctggttctttacttatgcgggtcatttgcacaaaatctatttgatgtgttgaacctatatgcaattttgtatagttatgttttctgtattgctagtttattttaaaattattcaatgtagtccgagtgcctcagtctaaatatttcaatcatctgctaaattttgagatatatgcaggagagttgttcagccatggcttggcctgaggattggatcactgaaacatgaaaaactggatatccgtgaacaaatacatggaagcttctccaacacaggtggcatttatgtaaaagaggtgaatatccattcaatatattcgacatacaccagtttgctgcatttttgttataatatttctttttttgtcctattttcttcattacactgcttattgggaccaaaattcaatttctcagaaaggaacctttagtgtaggtgatccagcccaggactcggttgataagaattggctgtattccaattactcgcttttacttaaattatatctcaagtctaatccatagcaatagcaaaatacatttttataaggcatgattaacgcaagcaagaaccatcagtaagcatcgataaaaaatcattaattaaataactagggcaccatggtgcctctgtacacagaaagtaggtatttttttttcctaggtatcatgctatagaaatttgtttcttttttggttctgggtataaagtttaacctgtttagaagttagttcaagcaagtttgatatgaactttagaactatatataacgctttcttttagtgagtgttggtttgtaagtatatgctgatttctttataaaaacaatgaattcttgaaaactctttcaattgaactgttgtacccaaggttgtcatgtcctaaagtctagttgagtcagccctctacagacttgcctaactatcaaagactagttgttgaatgacttgtcttgggctaaatactacatatgtaccagttgcctctattaatatgatgtcctctcctcacctttccaccaggcctctcccaagtgaggcccagtttgctccttagtggctcattgtttctgcctttgctccatagcgtcttctgctgtcaacagtggcggagccatcgggggtgccggagggggccagcacccccctatccgaccccccctcctctacgtataagaccaggtataaagtgtcagttagcccattagcaaatctagaaaaaacgtcagccaagcaagaaacatgatctataaaattaattaatgagagagattagagaagcagcgaatgcctcatgttcatcacttcagttttgcacccgtatgcgacagcgatgcacgcacgtctccgtcctcccatcctgtcttgccgttgagcacgcaccgatggctgtggcctgaggtctgatctctcttacaatatagcaatacctaaatacatgacctttagtttatttcctatccctaatccatagattgtagtcagactgagtactcagtttgtgatttctcatcttttcaaaataaaatagaagatgcttatttgtgagattcttggtagtttacgttgaaacgatttagcaataactaaggactagtttcaaactgccagtgatattattaaagagctaaaatttaagttttttttaaaaggactagtttacgcgttgattgttatcgacagtgaatatttggcctcatttgctatcgacacttgttaggtcctatggcttattcctcaacacatcccccccccccttcacatcctggcttcgccactggctgccaacaagtcaagttgcggccctcaagttgtgcctccctggctgtgtgtataccctaacaaagagaaatctaaaagttatagtcaaatcttagttgaatgtgcacatttgatgtcatgttgccaccttcagctttcttgtattccataatccagacaacgacaattcatgggccattaaaagacttcttcctttcttgcttacaaggtaccatggcggcccatgtctcttagtcctatgcgtctctgaaatcactatctactattcattggttcctatttttggcttagagaatggacaagtatcccagtagtttcgttccagcaacatttcagtctaaggtacctacaagtgggaacatgcttactagtggatttagggagttgtgatattggcatggttagctgtaaactttaatccttaaaagagggttaacttgagatgagatgaaccttcaaggggagatctgttaatggtgaataatttcatgcttgcattccaggcctgaggaagggatgtaacacatatgattgacatagtttctgatatatttaggagtatgggagttgttaccctgtttgtctcgattggtgtctatgctgagacagtgagacataaaagatgaattttgctatggtgtgcaactatctgaactaggagtgatactcctggggtcgctgtagttattttcttgtactaatatcactcacatccaatacatgaatgtggcattccatagaacacttgcataagatgaggcgatgagaagcagcatggtttatgaatgagtttgatattgattgataaaaaaatcaatgatagaaagttgggtcattgtactgatctggtgaggggatcgtgtggaaactggcagattacttgttttgaattcaatggattattttagtagtgaccagtcaatagccagcgaaccactacctggccttttgtgtgggcggtctggtttcatatataacactctggttggtactgttcaatgggttcccttatgtgtatctctttttttaggttcgcttttatctgagatcatagctgcaatgtggcagaaaacttttctgttttctgatgatggacggccattttttaactgctcctattggttctcatacaaatttcgatcatttatccaaatcatttttgttgttttcctcaagatggtatatttaatttaacttgcagaatctatttcgttggctatttaaacattcataactttcttggttaaatattagcttttcataactttgtttgaacaatgataaaatgaggtatccatgttagctttgatgccttgtcaagtgctatgctaaatcctacttgagttagaacaaaaaaaaggcttagcatctatcttgtccaaataagcgggttgactgtgaacataattagggcttctatattaattttttgtgtagtacttacttcaaaatttactcgataggtttttgatggatccccagcagcagattctggaatcaacgttggtgatgttattaccaagcttgatggagtcgatctattccatgcacaagaggttctgtttcaaaagttctttgcctggaaattctagtagttaatcttaaaattgttttggaaaatcaaactgatttttcattgtggttcttctgactaaaccatttgcattttgtcccaagcaaaatctactagccaaactgttatagtgctattacctgttccttccattttattattcacatccaataattttcactatgtgaaaactatactgttaagagttcactgtgataatatattgttttggtgaacatgtgaaagatataagttcttttcatgatgtgaagtttcactgttagtagatcgctgcaggattccaggatgtaacaaaatgaaaaaaatccagtgcatgtgtataatctgttgtagcataatgtttacttactgcagactagagttttcttttcagtgcatgcggtctttttgttggatattttcttcataattcaatttaatatgtttactttcacaagtgagttacaacttacaagttcagagtaaaacctagcatgatgacttagtgttttccatctttttgaaatagctcaattagtatctggtaccattgcaataatcttaatttgcatgtctgcattttttttgggtaccatttattttgtaatgtaggcaatagaagtcaaaatgtgttggtaagataaggtagtaacgatgtctttacttgctgtatgtatgcaaaacagaataatacatgtttgcatagtttccctttttgatggatttcagctctaatttttcttatcagttctatgagcttattttggggaaatcagaagatattttgcgacgtgatgaagagatgcttttcaaggttagctgcagtgcatgttctaaggatttgttaattgttataacatgcgtacattaattattttttatgacattctattgcatatatggaataggtgtctattctaaggccaagtaacggtttaaccttccgtgcaattgtcaatgctgaagtggttgacatgagtaggaagaacaggtttatcctaacgctctacagctagtcttgcaaatttatgttctaatgtttgtattatgtctcttaattgacagatggcctgtacctaaggcggagtggctatatccatgtacggacgatagatgtgatgaaattgtcgcgcctgatccgatagttattcgaacctgtgaagatagctattatttacgtaaggatcttatttcttacttttcactatattataatagattaatgaactaaaatgcgtcaaatatataacattgatatggcctctgtcaatttgaatgaatttagtctgtactgcagcttataaagctgtcccatactatcagtctaaactgcatgaaaaccacactctgtttctaacattttttcttgttacatgacgttaatgttttacaatgtgtttaaacactatttttttgccatatctttcagccgcccttgatgagtctgaactaagactatattacggtgaagaatgaggtggagaaatcttgcattaatcgagaagaaatcttgcattaatcgagaagatatgctgagatacttaatggaacatgcaccgcaagtttttgttgacattcatatttggcaactgaatagggctacaggagtgaaaaaaaattgcatgtctactaatattagcaaattgcatcctttgccagctgagtaatatgaattgtgttaatgcggagttgttccagcaagatgttttgtttggcttttctgtttttaacaagtttatgaaagcttgggtagtatagcatgatttataaattataagccttgtgacttgtgagacgcaagtcctatcgcatacgcaaaaccctagccgcctccgcccgcatggccgcatcccctcctccctcgtctcgccctctccctctctcgccgccgccgccgcctccgcttcgcgccgtcgctatcgtcgtccgcatcgcctcgcgcctcagcctccgcctccgtcttcccctagcgccgccgcctccacctccgccgccgtcgacgtcgccgttgccgtctctgagcgcctccacctccttctccctcgcgtcgccgtcgtcgccgagcgcggacttcgaggcagacgcggagaaagcgacgaggcgaacgctcctctcctcttccactctcgtctctcctttgcctacgaggagctgtgcctcgccgccatcgtcatcgtcgtcaacctgccgccgtcgtcgtcaactggccggcctagccgctcgccgccatcgcagtggccagatctgatggcacgaactcaaggccgcctgatctgatggcggtgagctcgtggctgccgatggttaggcggttggtggagcaaccattgtcctcccaccaaccggcttcaccctttccgccgccatcgacaccttgtcgctgtgttggacgaggggctccgcctcttcacgcgcagccagccgctgcgtccgatagaatcctcctcacgcgccgcgaaccatcgatggaccagctgaaggagctcgggtgggccaagcggtggagctcgcagccatacgtgtcgtgccgcacggtaagtgctatatcttctcaagcaccaagcgcttcgaatttgtagttgcagagagcattctgacctgcttctattgtcaggcgtcaggtagagttttgggtcaatgcgattgcattggagcttgaattgattggtgttttatttatgaactgtgacagacatctctgcaagagctcaccaggcttgggataaagcacgtggagaacctggtgattccgagtgtcagaaatgatgtaaggcctgctaagcttaaaaatgtatttgtagctttgtttagttatttggaaattgcaatggtgcaacagagcgtgatgatttgatggggattctggaatcaagcattgcaaaattgcaaatgcagaagaatagtagtgccataatttgttcagaagcatagtcccccattttccttcttgtgatcacgcaggcagcattttttttcactgttgtcggttcaaccggattcctacccattcgtgcaggccagcttagtagggtttttccttgctacctcctctttgtgctactctggattgataaaaataatcttttttcccttacaagataagtgcattaggcttcggtcacaggttcctgcaaaataatttttctgttgatattaataaacatcctgtgatatataattttagcttttcaaaattctctatctcaggattggggctttttggttccttacttgattggaagcatctcattgatagtattagctatcggaagcatttcaccagggtatgtgtttgttgtctctgctaataagcctgtgaaagttgggaagagccggcatcaaacaatccagatgtctgacatattctaagattctttaaatggatattcaagcagcaaaacttatcagcttaattaatttaatgttatgtcactcaacatagactacttatggcatgacaaataacactatctgttttatgaatgctcaatgaaaatatgttgcaactttatcaaggatatattgtaattttccattccatcatcacagtcttctgcaagcagcaattggcgcatttttaactgtttttcctgactatcaagacagagttgctaggcatgaagctgctcattttttgggtatgtctccagttctgcaataggagtatgtctgaaaataggttttttactgactatagtttattgaatattgaagtgccttaacaaccaatcgtgacaacagttctggagcagttttagtataatggttaatgatgatattgtcattgtaaagaattatgctgaactagccatctaggtaaaggtaaataacattgatcggaagaatcacttgaaatatctgaagctaacttgagtagaactaaagagcaatacaaaaatattttttgaagctaagctaatggttagatgagctggatatgaactaaggctgtcaattggatcactccattagatgcaagacaatcatactgacctttcagattaattaagttgtatattctcagatttttcaggcccatagacagttgacagccagtcagccactgaaaaagtacactattactagcttagtttttcttttcctacttctacttgacagattaagtcttgttttttactatatgcttttaacatctatttttggaataatagttagctgccttaggatgtaagccactagtagttttccttaggatgtaagccactcctagtttcttaggatgtaagccactagcctataccttatggtgtaagccactagcctatatatatgtttccaaccagccatggttgatagagtggagaatagaaattaaaactagccccaaacctgtgttccttttgctaacactacttggtcagtgtactacttaacatttttatataaataatatcgtggttgtgattgggcatctactggaaaagaactggtaggtcaatgaatccattacggtgcttgtgttgcagggatagttctctcgtgttgcactccaggtgtttgtagttttgccttacggaagagtagtttcagttctgctccatggcttgcagtggttgattactaggggttgatcactagaggtgtgattcatgcttgtcagtactggtaagaaaattcacatattcctgtcatcctgtgtttagtgaggacttcttcttcatctattacttccactgatcagtcttcaattttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 55169 - DNA, 6421 bp, Oryza sativa
  unsure (1)..(6421): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaatatatcacatattgatcgatattgttaattttgttaagaaaaaactttttggttgacattcaaaaattaaaacaataagacatcttagacaaaagagatatttaactatttgccactcttctaaaccaccactctctgtttgccactttttcccaattttggttacttcgctgctttttttttttttgttatttaggttagattcgggaaagtttaagaaggagagaaaattcatggttattctgttatgtttcttgataaatgtttgttgtaatcgacatgaaacatcttcgctttgacactcttcatctccctgttttaactcccttttccttgatttcataaacctgtatctatttcatggcccaaattagtaccgaggaggatggattcacctcaactcgttgcatgcaatgcaagaaatgaatatggttgttgatctttttaattgattccaggccaacattaaataggaaagtctgaaatggatcaacggggaacacaaagaggacggctaagtgtagaatggacatttcacgtcacttgtccatgctgatatgcctatgtgtcatgccatgtaagtaagtgttatctgatcatacgattaatcatcctgatcagtcccctgactccgattagggacattcattcgatcagcttgatcagaaatctgatcatttgattaatcgtcagtcaggtgcgatcagatcgagcacctatcgatcactttcagaacaagtcttagggttgagcacatctgaatgtgtgctacaactgttggttgctttatacgtactagggcaagtaagtgatcattctgccatcaattataagcactgattgctttataccatccattatactatttaggttctggtatacatagtaccgatcaggtcaattaatcgaggctgatcgacgattactcatcctggtcgatcccttggcgatcaggatcgattagcgatcagataacattgtacgtaggcaaaaaaaaaaggcaaaatattaacgatatttctctcacgattgatcgagtgggaaaatttttaggacaatcttgaaagtcgcatttgaatagtggctgtttcttatagtggcaaaattaatagttaaaatttccgagacaaaaagactttcccatagtaaatgttgtatttttacctgggcaaaccgtctccttgtctaccacatcatccagttccacgcagctatacatgtcatcgacaaacctggttaaaccggcgtcgtcgtctgaacctgcatatgcatacatgcacaagttgtggtgcaaaagaattcagagaaagaaacatatacttcatccgtcctaaaaatataagaacctaaaattgaataagtgtccagataaatcgcactaggaaatatttcattcaatcctaagtttttatattttagaatggaaagagtatactagtacgtatatggagatgccaaagtgtacgtacgtacgtaccatattctatgggcgctgggtgagcggaggcaacatagcttgtcgtctcctcctcctcctcgtcgtggagaagcagccggtctagtaattccggcggggatttaggccgcaacggcggcatgatcagatccgtgcagccgctgggctcggagggttcccgagatccaccgctaggttcatcctcccaagatgccatcagccacgcccccacgcgacgccgccactgcttccctcgatcgaccggcgcgccgccgccgccgcaatcgccagcgagggcagccgtcgaaagacggcgcggcggcgccggcggcgggtgaccaaaatataggggacaaaaaagacaaaattagttctagagcatcggaagttgtcgattttggttttatagcatcaaaagttcaaggctcattttgatagcacctgaagttacctccgttacttctgtttagcattccatccaaactccagttagttttcttttcttattattatttttcaacaaaaaattagatcaaacaccaatggtggccctcttccacttccttctcatctcgaaacagcagtcatacaggagctcaggccggtcagccatggtgcgaacgcagtatgctggctccacgagctcgtcatgtaatacttgagccctcacgagctcatccgcaagccgctgtgttcatccgcgcttgctaggtgtgatctatccacattctagctttgcccggacagcgccatcgtcgatcgatctcgtctgccgcgccgccatggccatgctagagcttgttcaaatcttgcgtgctcaaccaggtccatttcctccgcggccgtgccgcttccgagttcgtccgtgtgcactgccctcggtctcccctagatgcgtcatcctcaagctcatccaatccatgaacgcccgaagtgtcattgtccagctcgtcgccggcattgtcgggaccgcacggaagcaaagccctccagattattgtcggcgcccttgagctctctccgacatgctgccctcgatcgagctcatccatcggccctcaaattcgccccgaagcaccaccctcgcgctcgttgcgggctctcctgagtgccgacccactcctccttgccctggatccgttgtctaccgacccaagagccgccgcctctagcatgccagaaccagctgccaccatccaaggctccaactcgctcagcgctatactgtcatggtcgagctcgcctgatgccttgaagagtggtcaaccataggagggagagcgcaggaggaagaagatagaggtaggatggggtgagccgacggaactgctgacggaatgctaaaaatagtaatggatgtagttttcagtgctattaaagtgaatcataaacttttaatgctatagaatcaaaatcgagaactttcgatgccatagaaccaattttgccatctccggtcgatgcgagaaatggcgcggagttgaaagcccactaaagcccaaggcccacttagctgctgacacatgggccccggcccgcttggcccgcggggaccccatcgtctcactcacctcccccccgcttcctttctgcctagggtttctctctctctctctctctcctctctctctctctcctctctctccaatcgaatcggaatccatggagtcgtcgcggtcgcggaagcgggcccgccaggactgggacggcgccggcgcgccgccgccgccggcggagcgggcggtggtacgtccgtccgttcatccctctgtctgctttgctcgatgggggtggtcgggttcctagggttcatgggggctcctgtgctgacgttgtggtgcttgcaggtggcgaggggcggcgcgtcgccgccgtggagggacgacgaccgcgacgggcactacgtgttcgacctcggcgagaacttgaaccgacgatgtgagcgccaccccgttcctgtctcttggttggctgaaaggagatttgtgtgttcttagatcctgcctgcttggaaactgcagtagttttgttcagttttatgtggtgctgtagaattctactgcgaaagttcattgcaataatcgcatgagtgatttggacattgattacctagtgtaatacagtataatattgtatctgtgttctaaaaccaagggaggtgaatgaaacaaggttcccgtttggattagcaactttctgttatgttaataaactatatatgcccttgttccttgcttttgttcccagcatttattgatgctaattttagttgaaattgcaataaccgtagggctttatagctatttaggttctgtgagattgttcgttgatattcttctcttcttggctatgcagacaaaatcttgagcaaaatgggagaaggttggattttctgcaatctgttccctagtacctggtgtctttgctattattgtaatgtaaagcaacaggaatcattttaaatttttaataggtacttttgggcgtgttttggaatgctgggaccgtgaaacacatgaatatgtcgcaataaaagttgttcgtagcatccgcaagtacagggatgctgcaatgattgagatcgatgtgctcaaccgccttgcagaaaatgagagatacagatcactgtgagtacctcaaaatatttgatcccaaaaatcttagtcttttctgtttctctcctgatcagtcttccttactggccagctgtgtccagattcaaggatggtttgactatcgcaatcatatatgcattgtaagtctcaatttcattcatttatgctagttctaaaaatctataccaaatgtcagttgttgatatgcgcatttacagttccaatattccatattccacttttccctgttagttcaaagttttgtttgttggcaatttactttgctggccctccgaatattcacctttttgctcgtaggcagtgaaacatgctgctatgtacgatatggtaatgtgcttgaataggatttccatgcttataaaacagttgtcgttctttgctcataaaggtttgccgatatggaaacaaatcaaagataatttttcttcaatggatatcgatggttttgtcaggtttttgagaagcttgggccaagcttgtatgattttctaaagagaaatagataccaacctttccctgtggaacttgtgcgggagtttggacggcaactgttggaatctgtagcatgtgtgtgattgtttgattctgcatatcaattcttaacaaattcggtagctgctgattcattcttctgttgctgaaaaggagcatgcttgaccatcttttcctttctttcttctaaaatagatatgcatgaattacgccttattcacactgatctgaagccagaaaacatactccttgtgtcttcggagtatataagggttccaggttccaaggtaatgtcaatcagttttgtagtgatcatctgctattctgaaactaggcatgcggtattagcagttatgttgaatgatcccttggggttgtacagaagaattcacaagatgagatgcatttcaagtgcttaccaaagtccagtgccataaagctgatagattttggtagtaccgcctttgataatcaggaacatagctcgattgtttctacaaggcattacagagcacctgaaataatcttaggtaaattggttatcttttaaggtttgcttttattttatcttgcttgagtttggaatatccttgtgatgaaggttaatgtggcctcgagtatgctccaatggagcacaacaaaggtgcaattcaaaatccttggatgcaataattgataatgctgttagaactcttatttttagtgattcgaaatgacagaactcattaaaacaatgaaaacttcttgccatcactataatcatgttagtattggcagaagaaatagcacttggtctacttattcgtcatttttttcagtgtactatctgattatgctttatagtaaagtggtaggcatttgactgagaagaatgtttttattaacttggtatttttagagatggagcatatattcctccctagataattctgatattcttgaatatgttcctatgacaggcttagggtggagtttcccttgtgacctttggagtgtcggatgcatcattgttgagctatgctcggtttgatatcttgtcatgcatatttttcctttcttttaccttagcctatgttcctaaccataaaaaacctttagggggaagcattgtttcaaacacatgagaaccttgagcacttagcaatgatggagagggttttgggtccactcccagaacacatgataaggaaagccaggtacattgtggcagtgtgcacactactttgatgatcattttcttttacctttttctgtgttgtcctcaatatagcaagtagtaaacgaatctatgttttactgtttaatttggcatttgacaaggaaaattttaattgtatcactttttaaaaatattttttgggttttcctttctatagaacttgacttgttagtggtatgctattctgccaagttgaacccctcaatatgtccgttttcttatactagctttaatttaacaacagtttgttcatgtgtagacccaaccttaaatccagggttttttttaacagtttatagttactccaactcactaat

SEQ ID NO: 55170 - DNA, 6424 bp, Oryza sativa
tttttttaatgtaactatgcatctatagttaatgatttgtctgaatgaaggcatattatgtttgtaaatgtttgatataaagcttatttcagttttgtcagggtgcagatagaaaaaataaagttccattttctttggtgaactggtcctcttgtagtgtagtatctgtttcatttagtgatttactatgctgtttgtgtggtaaattcagagtattattctgctggttagtaaaattattccttcaaatttccactaagaggaaatgagaaagtattagaaacatattctgaaatatctgttctgaagaagattcaacttacacacctcaaacattatggactgaaacttcaggacttagtggcgaggaaggctgatcattcaagggcggtgctggcagacttgttatatgggcttttaaaatttgagccatcagagcgtcttactgcccaagaagctctagaccatccatttttcagaaatacaacatgagtacatgatcatgctgactctacccctcccaatatgtacgtgaagaacccaagcctggagaaagcaggcgcaaggacattcccatataaagcagaatgccttcagctcatctgtaccataaatcttctgtaagctgagctataatgcttgtggtggtgacacggcataactgttacgttcacccgatgtaatgtacaatagcattgaatctagggaaggttgatgtagcagatggaacttgtgcattgtgagttgtgtgatacatgaggaattgcattgcgactcatgtcgcagtgacacaacaatgaccaaagcaggccatatatgccccttccaaatgcttgtatgatgtatccttgctggggtgttcatgttacttaaacatctctgtatcctgaagttccgttgaaagcctgacaaagtacatagtagggttggcacttggcgcctgtttgtcctgtttgcaacttgccatgacttcctgaaaaatgttgtgcatacactgttacagatttgaatcttcaaaatgcagagagcgagaggaattttgattcgacaaagaaactgcataccgtgagaatatttgttgcaatggtcgataactcttttttctttttccatcttttggctttggaagccaaatccaaatccaaagcgaaagccgatctggtggcgatttggaaatctgtcctctcgagtctcgactgctgctggtgtctggtgacacatgtgttgctgggccagtgccctttttgtcacatgtggaacaacccctacccccttttttccttcacggtgtcacgtcgcactcctttggcccggtgttcggtcggtgttcccacctcggcccgctgctgcaactgcagcgtctgcagcgacttgtgatggtctggtcagggcacgcacacgacgccgcgccgtgccatgccagcttgcctgcactgcaacgtgggacacggacacggacgccgccgccggcgagccgtggcatcgcccggcgctgctgggggcaagcacctggatgctgggtagcgaaagcgaacaaggacttcgtgccaagtcgatgagaaacacaagtcgatgagaggacacctccacgccatgccatgccatatcgagagtccaggctttgtgggtggctgcgtcgtgtccgtcgccctcaacgtggcccgtcagtgtccgcggcaggactcgtcctttctcctgacgtggccgcccggtacatcagaaaccgacgaggcgcaacactgcccagcttggcaggccactctctgtttacgatcaccttatgattcgtttgccaaaatttaaattttaagacttaggcctggtttagtttccaatattttctttaaatttttaactttttcatcacattaaaacttacttatacacataaacttttaacttttccgtcacatcgttccaatttcaattaaacttctaatttttaagtttttttcatcgcagtttgcttttaaatcgccagtaacttttattcgcaaactatgttttggactgataaaacagtacggcttataatcagcgtaagcgaaataataacctacaagagtcggttctgtctttcgtcttgctttattatcagccgtagctttataagttttttagttggcttaggatgattacccgcacaaacgcaatttacatatgattaattaaatattaattattaaaaaaaatattaaaaatagatttatctgatttttaaaatcaacatctacacgaaatgtatcatttaacgtttaaaaaatgtgctaatgaaaatcaaggaatcaaccaattcaaattgtagtttagaacgggcactaaatgttgagatttaatcttattactgctaattttacccaattaaactacggattataattgcagctcaaccaatccccttctttgaggaattagccaccaccacaaccgatatagattgtctacggtactgcagcctgcagtagatcagccactgccaccactcaccactacagagtacagaggatcggcgcccaccacatcacccatgtcccaggatccaggccatacagagatcacccgagtcccagggacccaggccatacagtgataagagggaaacaataaatgtttattactatgccaattaaaataaatcaatacaataggtatgattaaagcttaactggctaggtttcttacagtgaaactaatcaatccaatatttaaaatgctaaatttaacacgacgataaaatattcttttagtgatagataatatactcgtcgataaggagatactcgtggtggcttcatcaatcaaaaatacgccggtctaatcttttataggtgtttatagtgatagccggataagatgtgtgtatgtttataaggacgagcgtgcgaggagaagccgctatcctcgcgacgtgcgacaaggattaaatcaaatcaagccgtctcgccttggggtttcccatccctccctttaaaaaagggcgcatcatctctaaactcccctccacatctccaaacttccaatttctctctccacatctctctgtgtttcttttatttctcctctgctcgcggcgatggcggcggcgaacggcggcgacagcaaggggttcgaggtgccgaagctggagatcaagttcaccaagctcttcatcaatggccgcttcgtcgacgccgtctccggtacgtcgctgcgtgcttcctaattaatcctccctcttgcatctttcaccttttttttaattattattcttctcctgatgctttttttgactcacgaaagttagcaacaagaagcatctgttagtacttctgtttctttattgtttgcaactttctttttttactatctccgtttcgtattagaaattaacataaacttctttaagtttaacaatttttttaaagaaatagcaacatttagaacacaaaacaaacgcaatattaaaatatattaaatattggtttagatgaaactaatttagcgttgtaaacgttgctaatatttttaataaacctgaacaaactcaaaagtttgattagaaaaaaaatcaaaacgaaaacagagacggatatagagtattgattagtcacaatacgtgcgacaccctgcgcttttaacaccaagttagataaatgtgatagccgagtagtatctatagcgtgttaagaagtgcgggacgtcatagtacgcaagtgagggtgatttatcgtgtaaaaaagatagaagaaaccgaatgtgaggatgagacaatggtagtatggtatctagatttaagcattgcttcggagaatttgtttactgaatgaatgcatgagtttcaccgaattttcgaataaataggtataattcctgtaaagttcattaaaaaaaaacctctattccaaaagaggcttaaaatattactaccaaatatgcatatttaaatgcatgttgcatggtccaccctgttccatgtggaggtaaatcaaatgaggcctaatatattaattactactactggacaacttgctagttatggggcttagctagggatcaagtcaaatattccaggattgtgccaatgctgaagacaactttggacacgggcatctttgggatatatcaaaaaaattaactgatattggttgtttgattgtgtggttgtgagaaacaagagctaaacctgcttacatgttaggtacttccaaacagaagttgtgccatgccatcactctatatttttttcgttttgaaagatccatcactgatcaaaacagcagaaattatggaagcctctttttgaccaagatctagcttttttaaacaaacgcaagaagatgatcaaacacaccacacacatttctacatacatctcatcaccaaagatcttgagcggatgggtacgtatagaacacgtcatcaaccccccccccccccccccaaacatctcactttcaagaagatattgctcgagagaaacacacgtcatggagagctgaaagtggatgtacttccaagagagcgagaacactacagctgcatattgcgtgtgaaagactgaaaatctgaaactgtagagcctgaagaaggggggaaaagaaaaacagagtgtcgactccgtgtgaaactctgaactgaagttattttttttttcgccgggaaggccgaaggaggccaaccgagtatattaagaaggaataaaagttacaagagaaaaaacatcaaaatacaccaaggtgcattgccacacaccacacgctaccacccaagcacaaaccgctgagggtgaaacctagcaccaaacgacccccgctaggcctacggcaacaccacagagacgaggctccgaaaacgatgccaccatggtggtcacgacatctaggatgccgccatcgcccatctaaaaagatctggttttcacccagagaagctcgccaagaaagggggagggtaaccctcgacaacgctccaaggagattacgacgtccgaagacgtagccgctgccggtccggtgaaccaccggactaggctttcgcctgggaccctacaaccttgactgcagatcgccatccaccaactcaaaaccaccacacagacaaatggcagcacgtggcatccaccataccgcaccgatgcccctccgtcggtcgacttcaacgaaccaccacccctgaaagctggcccagaactcctccgttccaccacccgccggccgcttcgccaaatttggccgaaggagaacccgggactaggtggcattgcttcggcagcctgagcttcccccactgacgagctgccgcctcaatccaacctagaaactccccgcaaagaaggggaggagctccatgaaggctgagggtgccgaccggcaacgaggaagacgacccaccaccgccaactccctttgctctgccatctggccgccggtggtgctgctgctccagaccggcaccacccgccggcgcccccgaagtccagccgtcgctcctcccctagccaccgcgacggcatcccggctgcctggcccccacgccgagccgccaccgaggcctggacgacccaccgcgccatgggctggcgccgggcgaccaggccgagcgagtgagcgggggtgcccctgccgctccgggcaggctgcgctgcccgccgcctccgcgacccggccggccacgacgagccgcggccatccgccgcccgcgcctgccgctgacgagccgcctccacgtcgagccgcagtcgtccgccgcctccgcgcccgtgccgggccggcctagccgcagccggccgccgcctcgccgccttgccgccggccgccaccacgaccgcatgtcgtcgcgccgccccaggcctcctcgcgccgccgccgcgcagatccaggcgagggagggccggatccggccatgggggctccggatccgccgcctcctcccctcctcgccgccgtagctgccatggaccacgccggcggggagcttcgtcgtcttcgactcttcgtccttcgcgcagagaagggagacgctacgaagagaagaaggcctcgccgccgccttccctgcctgctaccggcttcgccgccggcgggctccagcggcggcgaggtagggggagggagggagagaaggcgcgggtggctagggtttttgcgcccccgagccgcccgacacgaaagctatgcgcgggggagggggggctgaactgaagttaggaaattaacaacagagggtgtgtttagttcacgctaaaattagaagttttgtttaaattgaaacgatgtgacgaaaaatttgaaagtttgtgtatgtaggaaagttttgatgtgatgaaaaagttaaaagtttgaagaaaaagtttggaactaaactcggccagaatttccaggcgtcactgcctgtagctttgtattaaattttagatgaaatcaattcttttttgggctgcaggaat

SEQ ID NO: 55171 - DNA, 3343 bp, Oryza sativa
  unsure (1)..(3343): unsure at all n locations
gtgtccaagctatagcttaattagctagtggcggtgagcctatggagcgttgcgagacaggcattggcactgtgggaagaaaacgaagggtgggagagagcttgagaaggacaggcagatccacacagatggcgagatgtatccatatgaatatgatagtaatatgatgaactgtgtggcagcattgcaaaatgccacatggtaccatggagtaatatgcatcactagagctatatcatgtggcgcatcagtgtccgggagaaaaggcagggtagtgggacacatggaaaacgcggtaattttgacagtaacatactacggttttagtcaggtcaagagttgacagcacgcagctttagttagaactaagtactctccctccgttctcgaataactgacacggttaactatagaggtctcactttgattacaaattacttttaaataattatattatgaatttatgaagtatattttcaagtgtttattaaatttctgtaaaaggacgagcggtcaaaagtttaaaattatatagtggcagcgtaaattatttgagaatgggtggattattttctggtctctattggtcgtagtagaagcaatatgagccgttgatttacaagggtcttatcctattttacgggacagttataccaggcaatgtctaagttcaatgtatgtgcaacgatcagtgcacatatatatacacacacacgagtgatgaatcctgttgactgttgagactgagctgttcggtatctagcgttttcaggggcttaattaggtttatttttcataaagcatccgtacattttctttcttttcttttcttttcaataaattagacacggccgggccgtccgacccaataagtccaagcatgccactatcactatggcagataacactagcttgcaacgtcgcttatgcagacgccaataaaactggcattgttgtgctagcttttttcttaaaaaaaggaaaattgcattgttgtgctaagctaggggacgacgcctgcaaatatttcaatgcattattgtgctctgattgggctcaacactcaattacgtgttgcttttttctgaatataaattataggagtacaaattaagtacatatatatctgatcacatatttctcatatttgggtacttcgacattgaccatccatcctccataataatattatttttcgtgctagccaagtactgatttggatatataaatgatgaataggatgtttttgagcagaattcattgcctggtaatattttgcaaggaatttaaaacataggcctactttgaaatggagaaattttaaagaaatgttgcgtaaattaaattaacttctacgaaaagcgtacaaaattctttcgttcgaaaagagctgttcatcccagcgcgattagactagttcgtactactaaaggatgaagtactagtatgtagtaggttgaaagtgctttgaaattcaatgtctttattagtatttatttttatctcgcaagacatacgtgtacacaatattatgatatctctagagtaataggctcaaatgtaaaaaagttcacgtgttaattaattagcaataagaaaaatgtatgacatgtcgcccttccactttgacatcttgtcactaagtaagcatcaattatacaccccattaaattgataatgacattcaaaaagtgggattagactatattcatcaccatcataatgagcaaaccagacaagtggatggtgaaaaaaacaatgcaaatttgtcatgctgtggaaaatctacttggacctaacataaaaaagctagaggctaactgatccatccattaacattaagaaaaagacatacatatgtaaaagataaatagataattttatctgatcttccgagaaagctctagttagcctggatggttctgtatatgagagattatatatgtaatcttgagatggtgacaacctaattaattaattaattaacaagcaagcatccaggctaataaaccagtgactgctaataaaccagaagtactgtagacaatgcccattgaggtgtccctgaacaattttcaggtctgggtctgctggctctcaaacactaattaagtcagtaaaaaacaccttgtatgtcatcggagatcagataattaatctgattatggtagccgaatattatatggctctggttcgtctgcaacaataataatttggctcctaattaactctcaagtttcatgatcaaatcctggaattcatactggggatcgtccaaaatatttccttcagagtgtctgtcatgccggtgtcttcttccataatnttttttagttacaagtgtttgtgtcgtggaagcaattgaaagttgttgatcagagattcagagacctgatgggtattttatcttaagaaacatgcaaatatcagtctagctagttgattcagaatcgccatgtgtggtagctatcgtgcaagcgtgcaaatagtttagttttttaagctacgatatgttattgtcatgtgacatttggtaatcttttttttttcaatgattttcttcgaaactagacaaccagtagttagacgtcaacgctttggtttttaattgcaactagaatataaataaattaatttactaataatgagggtcctgtatatagtataaattatttcccttgcttgttacgtgtgcaattaagtataaataaagtagctagatgcattattatcgatccacattatccacttgggtagtaaggctacttctcagttctcacaagtgtactacatgcgactatgtgagaatctctgaatattattgtccctttccctctagtcaaacccttgttttacatttattcttacaatttgtgttcagaatactaatttaatagggctaccataatatgtacttttagcacttttttcctttaaaagtacaatagtatatatcgatatatacgaccatatcagttgacaagttatttttgctcttttaaaatacaataagatgttctattatacaatcatacgggttaacggatcttttccctttatttgcaggcaagacattcgaaacccgtgacccgcgcaccggcgaggtcatcgccaagatcgccgaaggagacaaggccgacatcgacctcgccgtgaaggccgccagggaggccttcgaccgtggcccctggccaagaatgtccggctttgtaagcgcgcctctctccaccatcgcccgaaacccgtaaacgggttggatccaaacccgttagttaataataccaggcggcccatctagttataccgcactaattgggcctaattaagcccagcttaactttga

SEQ ID NO: 55172 - DNA, 1082 bp, Oryza sativa
  unsure (1)..(1082): unsure at all n locations
cttctacgcccacctcgccaagcttgccggcgtccccgacggcgtgctcaacgtcgtccccggcttcggccccaccgccggcgccgctatctcctcccacatggacattgacaaggtcagattacctacttgccattatgaatttctgaattccgattgattatgctttttttttagataatggattatattaacccggcctctacaccttagaaggtgtacacagcccaaaccacaatcaagagtacataagactccatctattacacgaggataccaaataaaagtttaacaaaacggttaaagaagaacaacagtctaagcctgatggttttcacttttcaggtgagcttcaccggctcgacggaggtcggccggctggtgatggaggcggcggcgaagagcaacctgaagcccgtcnnnnnnnnnnnnnnnnnnnnnnnnnnnnnnnnnnnnnnnnnnnnnnnnnnnnnnnnnnnnnnnnnnaacctggtccacatggcctcctacaccaacaaggtcggcctctcaccggccatgtcgtcagaaaaccatctagctggcataagcacaacatattgtgaaaatctcatcagctttccacaacaatcctgttctgttgcagggtgagatctgcgtcgccggctcgcgaatctatgtccaggaggggatctacgatgcgttcgtgaagaaggcgaccgagatggccaagaaatcggtggtcggagatccgttcaacccgcgagttcatcaaggccctcaggtatatatatatgctagatcagtaaccatgctctgatttttcaactatacaaacttcagattcagagaaccaaagatgttcagcaagctgtaataaccacttgtgtgcaattacaacgaagattgacaaggagcaatacgagaagatcctcaagtacatcgacatcggtaagcgcgaaggcgcgacgttggtcaccggagggaagccctgcggcgaaaacgggtactacatcgagcccaccatcttcacggacgtcaaggcatgaacatgaccagtgtgctcttcactcctcagtgctaaaatatgaccagcagcattt

SEQ ID NO: 55173 - DNA, 2242 bp, Oryza sativa
caatagtcaagaactccctctgttccaaaatataagcagttctagtattcaaaatttgtaccacaatataagcatttctggggcactgattcaaatgcacggaaatctatatacattttcagccaatgagatgcttgggaagagaatctaaacaattcaaattttgaccactgtgactaaaagagattttttttccatctaccttagtttttgctaaaaaaacgtacagatgtttatattttggagcggagggagtacatataaaatttgagtgagctgataattaagtaaaaataaaagtaaaatttagacttctttgttcttacaggtttagttccagggcaagtgaatccaagggagataaagtgccagatgttaatataatcgagcgcacacccaacttgagaaactcttccatagcaagccctgggttaaaacaccaccaactaagagtccttgataccttacctgcaatataagaaaatctagagaattaagtatataagtaaacaattactgactcaaatgttaacttttaaatatttcgggttacagggaattgtatcaggagtcgagttaagcgtatggaaatagagaagaacgaatacaaacaatggaagttaaagagcaattaactcttgctcatggattatacatataatattgatgcaagtatgcaactaaatgctgcaggcttggagacaaatcttaaaagcagatcttgtaaattccaccattaagagatagttgtacaatattgatgcaactaaatgaggtcagcttggacacaactcctgaaggcagatcttgcagcttctgccaccattaattggatacaaatctataaaaaaatatgcttacactacggatatgaaaaaaacaattgtcaggtgacagcatgagagcatttggatgaatattattagataagtatgaattattagtaccaaaagaagatatgggcatcagctacagagccatgcaaacattgaaccagatttaaataacgagtgaccataatacgagtgaacttacccaaaactttaagagcatctccagaattttgttggcattcattcacatgaaactggaatgaaaagaatgagtgcaattgtaaaagcataaaattccagcagagtatgcaagcttatacagtaaagtgtgaaaagaggtaggatgaaataggggtgcaagtgggtttacccgcgaacccgcttataggcaaaaatagtgtgtaacccgccggtttgactagcaggttaactatgaatttgacttataaatgggtttataaattgatccacttgtatatttagatgcggcaagccgggccgcgacgcgaaaacccataaattattatttatttaaactcgcgggtcggcccgcttgcacccctaggatgaaaaaactgaagccctacttggaacacaggaattttggaggtaacagttcaagaaattgagaaaatttcctgtcttctaaacagggacaatggaagtcaggaagagggggggggagagagagagagagatgtatatatcatatattattgtgcatggttgctgcaaacattaaatgacagaagaaagcagcagaacttatctaaggtagagaaacttacacgataatactttgcatggctttgaccaccacctctaaaaattatgtcaagaatgtccctgattgtttccaatctacagacagtagccttcgccttcatcccaggtccagtttcagcagaatttcctaagtgtgcaggaaaaatacagacactcaactgctttgcatgaaccggcaaacaattatcaatagttatcagaaattcaatatgttcaactaaggtaacacttagagctagaaaaataatgaaagcttaaagtaactattcagatcgagaaaatggaatagtacatttcagtggaaagaagaaacctggaaaaattgattaccttcctcaagtaatagagaagcaccatcaattgtgtcaattagctttttggatgtttcagaagtaatattcagttcagagaggaactcatatatgtaattgccaagttttgtatggcccaactccttggaatcaatcaccacctcactaattttcttttcaagtgccattaaaagggctggggaaaaagctcgattattattctattacagtacgaaatctcacagtccgaatcattaacataggtaaacactttctacctaaaaatatggatacaggtatgattcgctgctg

SEQ ID NO: 55174 - DNA, 3171 bp, Oryza sativa
tcaaagttgaatgtccactcaccatgaaaatacaatatatttgcaaaaaaaataacatttcaaaaatgtcattatgcaaaactgatttccaaaaatgacaccgtaaaaagcataaatcacttggcatacaggaataaaaaacatgtgattgttatttttacatatatatgctacacccagacataattttttctataatttatggcctatatagttaatttttttataatttatggcctatataatttgttgctggaaacacaacataatgaaaatatcatttgcaaagtgatgtcaagaataaaatgatgttgcaaaatgatagtatataacttgacatgtattgtgaattaaaatatcgcatgagtgaagtttctaaaatggaaattatgctacattctgtgaatatcaagagaaaagaaagagaaagaaagaatattcaaatggaggaataaatgctacgattagcttcctttgacttgctcttactcagggagtacatggcctacgtcagacctacactagcattgactgtgcgccgtgccggtgtactactgtgaaacaacgtgtttaacccccacagtgagcttcatgagggcaagtacaacgggtcggcgatacccgtcgacatgcacttttttttttgcgaaacccccctccccacggtgctcgcttcggcccatctgtcgtctcgttcgtcgacgaggccagcgcgtgctcccaggcaacgcgacggcgatgaagcccgttgtacgacgcgatgcggggaggcgacggaagcgcgggatcagctctctcgcgcgcggaacaggttcgcgccttcctcgcccgccaaaatctctctcgcgcgcgttgaaatagcccccccccccctgcggccccatccaaccatatttcgatctggccaccatgtcgcggcaggcacggaaggaggcggcggcggcggcgcaagatatgctgaagttggatgcggcttggatgcgcaagccagctgcatcgcaatcttgaaagggtgcgatggcactgatgcggaaggcccagggaggagctcgggcggtgtcgatggtgccggagcagagcagttcagggttggcggcgcatgtgccagagcaccggagttcgggatatggcgcggctagtccaccaccaagctccttcaccgactgcagctacttcttctaagatcatttcatatataaatatatataattattatatacatgtttattttacaagtcatgcggaatatttaaatgtactgtgcattgtcttatgtatgcaacaaaatgactacaaagatcaattatacactagatcatcatgatttgtgtgtcaaaggatgaattaaacactctacagacagccaaaccaacaacccattgtataagctgtctgtttaagctgtctatttgtgtaaaaagacagcaagctgtctacacggttgtacttgccctgaatatttagtgcatactaacccatgtactagccgcacgcatcatgagaacgatggatggctaggattcatggagcatatggaccaaggttcacatctgagttgcataatatgaaccaaggtgcatatgcacctatatgcatagtttgacagatgtacctacctgattggttcccttcatagtggcggtaaggaatggtacatgttatgatttttatggtccaaaatggccctcaagtagtactacagtagttcgaatgaattttttttgtggttttcctttttttttcaaagtaatgtcctaagtttatttaatatgttgataaaaacatgacattatatttctaaaaaatatataatgtagattcattacaacatattgtgagataattttgttatttttttacaactttagatatgtaattgatattttattcaagaataatgtatttccattttccccctcaacggtggtattatctttctatgggcggactttgtgttctctttggtttgcacttgcaagaatttttttctcacagttttctagtcaatgcaagttttgggtttagatataaattatttttaaaatgctatttagagatgtgtcatttgcaggttttattttcagagaaatatcattagtatgaacattaggagaccatttgcacattttatttagagatataaaatcattttctaaatgctatttagagaaatgtcattaacaaatcatttgcaaattttatatttcatacaaaagaagatatatgatatatcagtatgaacatattcaataaatcttaatatatattactcagctacaaagtcaagagagataaaaataataatagttttttatatgtacgagtacaaaataaaaatttgctttgaatcaatgaacgtctcgtgtagtgacatactagtgcaaaaggacaatttgggacaaactcaaaatgtgacagtggcattgtgtaccttccccgggtgtacatacacctcctctcatccaccgtccatcccaaccagcagcgatcggatattccatctgcgaataacgggtatggccgtataggatccgctaaatattctaaaattattgttgaattagcgatggataattaactaactattaccgcttatatatatagttgatgtaattcagcatgcgtgcagtgatgaatcgtcagtgtgcttagtttgatcatggctagctagcttattagaaagagatcaaaccactgatgaatcggtcaatctgtttgggtcggccgagattgactagggtgttaacaacatgttaaggtgttcgatctctctctctctgcgttctgaacctacgtacggtcgtacatactttggaactacgttctgaatatgtatatttcacccgagttgaagttatagtggtcgtttaattgagagcagaagttgaacggagcaatgctgaccaagccattgtggccactactgccgtcctgtgcgggttgatcgatcgagcacgttgagtaaatcataggtatgatgccatttgacacgactcaaatgcgttatcactttatcaggatgagcatattgcagccgccaccgtagactcatcaagcacaactatatagaaacgattttttttacgagaaccctataggttggttatagttaaacttctcgcccttgcaaaaatcgttttccaagaaaaggttcacgggccttttcgcata

SEQ ID NO: 55175 - DNA, 10250 bp, Oryza sativa
attcctgcagccctacgacgatggatcccggcacgacggcagcagcgaatttgacacggtggcggcggattagggtttatgtattgtggatctagggttttttgttttgatttttctttttgccaaattatttttgcgtgcggacggctcaagtgtccacctgtgaaaattggattttcgcatgcggctgcgttgacggcatgcaaaattccgattttcttcgcagacctttaggcacaggcgggtcgcccgtccatatgcaaaaaaataacttttggccgcatggagaaaatatttggtagtagtgaacattgtgaatcatttgagaaagtttacggcatttgaggacgtaacatattttctaatgtgcagtttagtttcataatacttttttattctagcatttattttatttagaatacttgtcattctcacatttcaaagaacttctctccctgccctccttcatcaatgcagccatatatcaatgaagtcatagctctcattattagctcatctcaatcaacttattagatcgactggtttggaaaaatagttataatgtacttaatgaggatataaatataattttctatatctcttaattagttagagagtacctcatgaggatatcatttttttcctgaaaaacaaaattaatggattggagattttcctttctatattacgacctaatcacttttcctttttgtctgtttcttttcaccgattgtgttttttttcaggcgcgcagcaaccctttttttttttacttctgttttgtttttctctagccatttttttttggaacatgcacgtgaggggaaggaggatgactccgctttttgagtagtagagatgtactccctccgtattatgacgctgttgatttttttataaacatttgacctttcgtcttattaaaaaatttatgtaattatcatttattttatattgacttgatttatcatcaaatgttctttaagtatgacataagtatttttatatttgcataaaaaatttgaataagacgaatggtcaaacgttggttaaaaagtcaatggcgtcatatattaaaatatggagggagtaaaaaaattagtacaacgtaagaacactgctagcatagatcatttttcagtattccggattgcagctcttgcttcctaaaaaattttcagtacccaaccataggttataagagcatcaccaacagattatctataattttctcctaaaaatttgttttttggtttcctaaaccgaaaataggaagtgaaaaaactcctccatccaacagatagcctaaattcaatccccaaaacttaaaagtaggcccttctgttaaactaccaacagaaaattccgtttttttttctttcacgcgcagaaagatcgctatctcccacacgcgggaacgaaggagagaggcgggattgcgtgattgggagcgccttccgcgcccacatataaacggagcgaggaaccaggagaagggaacttcaaaactcgggtaggagagtaggggatctgttggagctgatttttggactaaaatccctcaaaatcagttttgggaatcatatagggagactgttggtgatgctctaagagatttttgagtttccacccatattatgaaatatactcaagagagttttacttatgaaaagaaagaaagaaaatgttacagacttactagcttaaagtaaatacacacatatataatagtattcattattcaaacaaatttacaaagaaacttaattataagaattatctgctactgctacatgaacagatacagaacaccatgaccctcttctactcacttgagagttagaggcatatgcttctaaagaaaagataaaaagactttttttctagacttgaccttatgcaattatgcattcttacaacacccaaacaaatcgataacaaaattacaaaacgctataaaaacaataaccatacttgaaggaacagagaccagaaccagaaccatggcactctcgttctcttagcgatcgacattctcgtttttttttttcagaccgtccacagtagtgctaccgtagaaaagaacttcagtgagaaaagtaggtgacgaacagcgccgcgaacatgagcaggtaggcgatcgcctgatcgatggccttggcgtcgatcaccctcgtcgccggcgccgccgccgcgccttgcgccatggacagctgcatgaggccggagaggaagaaggcggtgaacagcagcaggtacaccttcagggtggccatcttgatgtgtgttactgcaaagctacctgaaagcctgaaactgtcttgagtttttaagatcttggaagcagctagagatgatcaggctggattgccaacacttttcttctgatgtgtttgtttgtggcaaatgcagacgggttggtaggtatatatatatatagatgcagacatttaaatatatttgtaaatctccattcaaagttgatcaggaccttgagattcaggaattatgcagagatgcatggtgaatcggtcaatctgtttttctgtctgtttgggtcggccgagattgacctgagagtgttgttgaggaggtgttctctctctatgttctgaactttggagctatgtacatgcttgccggctggtgtacatttttttaaggtaatgtttctttctaaaagataactagccaaatacccatacattgtaatggattattgaaaatagctaaaattaagttctcgttgaaaaaactgtcttttacttggttgaaacgagatctttcatcttgaaaacgaaataaaaaaaataccatgcttaggattgcatttctaatgtgagaaatagacgtttggttttcgatcagcacttaaatatagatcgatcacatgctaataagtttgtgagattttttcttaatcgagataaagcgacagaaatatgcagtatatatacaaacaagcatcatggccacttgtcaatattggtggtggtggcaaactcactaccaccaccaagaattacaatctttttaaacctatggctcatttagtataatttacataattatgcttttatcttataatttttaatcttcatagttcaatttcaatagatatttagggttaacataaacttacggtgcaaacactaatattttgacactaaaggagacaatgcatttatttaagtatatttctaaatattcattcgaagttgataaaaatctacatgtccgttaagtctgagtttccggcacgtggtatatattagttggcaaaaatctatatatatatgctcagtttacttacaggcaaagatcgatcgatccgtccgaacatgtgcagttcacacgagatggggtgtgtttagttcacgctaaaattggaacgatgggacggaaaagttggaagtttgtgtgggtaggaaagttttgatgtgatggaaaagttggaagtttgaagaaaaagtttggaactaaactcggccatgaagttagagcatctccaacagcctccttatccccctctctaagttaaattttagcaattttggctcaatttcacactccaacagactggctatcgagctggccaagccatccggctggccaaagtcctccttccactagccaaatttgaccaaccaaaatagcctagccaatcgtgggccccacgccgacagcatccctctcccctttctctctccgccaaccgtcgtcgtcgagatgccatcgctggtgctgtcgaggtcgtcgttgccagacgccgccgtcaccagccgtcgtcggcgctgtcgccgtcgccagccgtcgtcgtgccgttgccagatccgcgaggtcgtcattgagccgtcgccagccgtcatcggcgccgtcgtcaaccgtcgtctccgaggtcgtcgttgacggacgccgtgccgtcgctagctgtcatcgacgtcgtcgccaaccgaggtcgtcgtcccgtcgtctccgaggtcgtcgtcgcctgccatcgtcatcgccatgccccggcggattcggccggtgcggcatgtagtagaggacgccgccatctcgctcctgccgtcgtgttcaccgcccacgccgattggccgccccgcgtccacgcgagctcggcccgagcggcggcggcggcacctactgcaagctgagcagagtgggtttggggaaaagggggagagatgaggaagaagaaagggttgtagagaccaacacgtgcgtcccactgtcataggctcataatagagagtatgaatggagaggctgttggagtaaataagagtttgactgactaaataagatggagagttgaccaaatagacatttggagagttagggggtgtttgggaaagaggggctaaacacccccttagatttagagagacggttggagatgctcttagttgtttgagagtagaagttgagcagagcaatgctgaccaagccgttgtatgtgtgtggccatttgtcgtcctgaacgggttgagcacgttgagtaagcattggttacagtgtcatttggcagttgacacgacttaaatgcgttatcgcgcgctttgttggatgagcattgcaagccaccatcgtagactcatcaacattgtaaaccctttaagaaattttacgaggtagcacatatatattttttatataaaatttagttcctcaaatactaggatacgagaaggatgtcattgtttttttaaaaaaaaatgttacctcctaaaatatttcttcaagagaaaatcactcaaatccttttaacattttacacagcgggatcaggtgggtagattccaccgtgaggaccgagccaattaacataaatttggttttgctagtgattttttgacgatgtttcggaatagacgatgtacagctcatgccgtcgacgtcatgcgtaccatgaacatatatgcggccttagttaaaatgacgaaggagtcttccccgcaaaaaaaaatgatgaaggagtcgaagaatcaatgaatcatgaaaagctgaaaatatgctcggtcgattaattacattttttgcactaatattttgttgactcttgtgattcccccttttcaacttaattatactctttcgtatcctacgtgcagtttcccgagctactaaacagtactcgctccattccaaattgatctatatatttcatgggtacaccaagaccaaaaaaagttaataactctctcatactatatttactctatcaacaaactcaatgcatgcactatccccactatttcctagccaatagcaaatcaagatattgtatgtgggttataaatgcttgtgtgcatggatgcatgcatcaatatccatttactccaatgcacaaataacgaatagacctaatgaatgaacacaaatatgtagatcatttagaaataaactaaaaaaactatatgtagatcaatttggaatggagggaatatgttttttattaaaaaaatttctatggaaaagttgtttgaaaaatcatattaatttatttttaatttttttagctaatatttaatcaatcatgatataacgagtcattctgtttttcgtgtggaaagtataagttcccaacacatgtacaatagaacacagccctaagcctaaccctgaaggtactgtcctccttaagcgtatatgacttaagagcaagtttaatagtggagtagctaattattggctattagcacatattaaagctaacatgtataatatgttaacacatattaaagataggatttattttttttctatcttatctatttctcttactatgaatttaatgtaaatatctaggagcatgtgtatagctagctcttgcataaaagccaacactcctcacttttatttatctctcttttccatataagcttatagttagcttataactcagtattatccttactctaagttttactatagaaaatgactacatgaaatttaaccaaaaaaaacaattacttgcatgaggagtatggagagttaccacgttttatagtgttaatccataggagtagtacatttttggttatatatagtacattttgtatctcgttgaggaccataaaaacactcttaataatttaaacatatgtaacaacattttagtatgtacaaacactgcttgcatagatcgttttcgatcagtattttggattgtagttcttgctttgtacaacatgttcagcatccaaccctagaccataagcagatttttgagtttccacccatagtacgaaatgtactcaagagatgtttttctatgcaaagaaaagatgcttcaggctttccaggaaacagtatatgcacatacattattcaaacaggtttacaaataaactcaaactatatgagatatctgcttaattacattaagatatatcatatatctgttcctgttttgaaagaaaatgtttcagacttaccatcttagagtaagtggactgtctaaaaatcattcgacacattttgcttagaaaatctgtcagattttcaagtcacccaaatagctacgtacggctgagatgagaacgggcgttaatcacgtgaagccataagttgatggaacaaatatagtagtattcaaacaaatttacaaagaaacttaaattataagtatctgctattgttacatcaacagatacagaaccatgaccttctttaactcacttcagagctagaggcatgcatgcttctaaagaaatgatagacttttatctagacttgaccatgcaattatgcattcttacaacacccaatcaaatcacaacaaaattacaaaacgctaaaaaaaaaagtaagaaccatacttgaacagagaccagaaccatggcgctctcgttctcttagcgacaatctcatctttttttttccagaccgtccacagtaatgcttcagtgcgaaaagtaggtgacgaacagcgccgcgaacatgagcaggtaggcgatcgcctgatcaatggccttggcgtcgatcaccctcgccggagccgccgccggcgccggcgccgtctgcgtcgccgtggacagctgcatgaggccggagaggaagaaggcggtgaacagcagcaggtacaccttcagggtggccatcttataacctgtaattactgcaaaatcgatctaactgaaagcctgatgaaactgtcttaattcagttcttgagatcttggaagtagagatgagtctggactctggatgatgagtttgctaacactttgtgaattgtgaatgtgtgttggttgtggcaatgcagacggattggtatgtgtatatatagctgcagaagaagcagctagagtcagctaccactctgatcaacctgccagtgtgctttgtttgatcatgacttgagagattcaggaattctggtgaatcggtcaatctgcttgtctgcctgtctggatcgtcaggattgacttggagtttgagacctctctgtcacacgagatacgttacatgtgtgtgacatttaattttcagttcttgacgtgtcattgctgcgttagctgggccggctacgatcttagcaggacgagtgagtactgagtggatgattaatttttggggattcagtttcaacttcgatgggctggaaaaaacggaaacaccacttttgccgtttctgtcaccactaacgactaatctgcatggttttctctgtctctgcggctcagaattagagttggtgtcgtgtgatttcaagtgaaatgagaagtcaaaaaatattctgggttggacgatgtgcatgggaagtcgtgattggtgaccggcaattgcacggttttggaggaataacgcatgaaaggacggcgttagaaaacggcacaacaacgttgaccttgggcctaaacagtagtagtgcggttgatttgggaaaacgaatcggtttggccggctgcatggcaaagtgcatgtgagtgtggatgaaaaaaattcactgcaaagtgcaaaagccttgagaagtaggtatatatcgttaaaaaaaaagcatctctgatttaacccatttttgtggggttgcacattgcactgtgttattcatttcagattgaataaataagaaaaaaagggcttaagtgaatttctttggtggtggacaacatgcacaattgaattactgcacgtgaagctcgataagaaatatttaaagtttaccacaaaatttaattaaaattttgaaactttgaccgtcaataacttcttaattgtgtatttaaaaatatataaattgtgttgatggtatacaaacttgttaggtggtgtaatttactacataaatttatgaaataatcattatggtgcacggacttatctagtgcttctgaactaaatctaaaacgatttattgtgactaattatgtttcttcacctgagagggataaggatgtagtgagagattggattttgttgctgtaattgtgcttgtaacttatttatttttaataaaatctatttaacagtaggggcctcccctgctatgttcttgtttaaaaaaagttcgagtttgattaggatgtcacacgcataattgaggacatgagacatatcttaagtgtaaataacctttatatatatactttatatttattttgtttttattcattatttgtatccattgcattttccttttatatgtttttttctctgtttatatacctttttctctgtacactcaacacaacttattcaatgcttgatttggtatatgtttctttaaaacaagtaggagctctgctattttaattgatagaagggaaaaaagcacatagcattactaatctcataagaaaaatggaaggcaacaaccaaaaacacgaacctgcgtttattttactgaactacgtacaaagccagagccattttactaactgatcatatacataatatcctactcagcgtgcaatttagtgaaattagttataacatatttttttctttctttagtttgcatacactacacaagtttttcaccgaaacgagcaatttacaagttcacgtattaccttcgatttatattataagtcgctttgaattttttttatagttaaattttgttaggtttgactgaagttatagaaaaatatagtgacattttcaactaaaacaaacatactagaaaagtatatccaatgttacatttaatgaaacttattggtgtcatagatgttactaattttgtataaacttagtcaaacataacaaaatttgattagaaaaaagttaaaagggcttataatataaaacggagaaattactaaattgcacactagtctaataaagtttgtgtaccgacagtacaatttattcttaaaggattcttatgcgttgatttaccttgaaaagcttatttgaaaattgatttacttattttaatataaaattgattatgataagcttattaaggtttattaaggctctgtttgctggccatggttgggaaccttaccctcccgcacggaaaacgaagcagtccattagcatatgattaattaagtattagctaaatttttttttcaaaaatggatcaatatatttttttaaacaactttcgtataaaaactttttacaaaaattgcaccgtttaaccgtttgaatagcgtgcgcacggaaaacgaggtaaagtggttgggaaccctcatgaaagaactcagccttaactttatcatcgtactgttttatgactcgaagcccaagggagtatttgtgaagtcatctgctatgatgggctttctggccatgtgaaaataaaggaataagttcactttgtgaccctcaaaagtgattaaaatctaatccgtgaccctaaaccacaaaaccggatatcttgacccccaaacttctaaaaccggtgcaatttgactccctcggtggttttggagggcggtttcactgacgtggcgccacgtggcgcctacgtggtgatattgaccgagtcttcattccacgtggcgttgacgtggcagcgaaattaaaaaatatgcgtgggacccattagtcattcaaaaaaagaaatgtgggcccactgacatgtggccttccttcttcctcccccctctctcccttctctctctttctctccccttcttccccttctgtcgacacgcgggatggcaacaagagcgagcagcggcgggcggcgaggcggagctgcggcggtgggcgggagggcggcgagatcgagcggcggcgcgctgcgacggcgagggagctgcgctcggcgggagagcaagcggc

SEQ ID NO: 55176 - DNA, 5008 bp, Oryza sativa
tcgcctacatttgtctcttcatcttctacgcggacagcaagaagacgagcgtaattcttcccatcctgcacctaattttgtcttagaaaaatgtacttgtagactgcagtactagattgctactgtagtagcctagtgctgtacattttcagttttgtctgatggcaatatgccatcaagaaaggaaaaggatggtggagctctgcgcgctgccgccgccgctctcaccgccgagcgcagctccaggctgggcggtgtctagggtgggggtccttttccttcgccgctcgctctcgccaccgagcgcagctccctcgccgtcgccgcgcgccgccgctcgatctcgccgccctcccgccgcagctccggcctcgctgcccgtcgctgctcgctcttgccgccatcccgcgcgtcgggcgaaggggaagaaggggggaggaagaaggaaggactgacatgtgggccccacatgtcggtgggcccacatttctttttgtgtgaatgactaatgggtcccacgcatatttattaattccgctgccacatcaatgccacgtggaatgaagactcggtcaatatcaccacgtaggcgccacgtggcgccacgtcagcgaaaccgccctccaaaaccgccgagggagtcaaattgcaccggttttagaagtttgagggtcgagatatccggttttgtggtttagggtcacgtattagattttgatcacttttgagggttatcaagtgaacttattccgaaaataaatggaataagttcgctttttgtcccttatcctgatatcgagtttaaatctagtctctgaatattatcggatataacacatccctcatctttcaaaacagatacaaatatagtcctatgataatattgaatgtggttttaggtgatgtggcactgacgtgacacaagaaacaaaattaaaaaataaaaaaccatgcaggatccacatgtaagtaaaacaacaatcttctttcctatcaccctctcattcaatcaggtgaaggtggtagagcaaggagcaaccttggccccgacaatggctgcgacctcaatgtcatcggcgactcattccggcggtacggttcgcggagggcaatgttcgctagctacgaggcgaaggggaacgtggtcaccgactcactgtcaacctcacctcctaccaaagtttaacgatgtaggacgaaaccacctccaaaaccatctgagaagtcgatttgcaatggttctagaagttagggaacgggttatacccggttttgcacttgagggatgcaatccaacagggacatgacttgtggaggcaaaatagacttattcctaaaatattctcactggcttagtttggagtgttaaacttttctcgcaggccaaattattaaacattttacgtggccaagttttcacgggccacacatggcctattaatgtatactggcagtctaaacttcagcctttaaaattttcgcatggcctatttacgataagaattttcacacctccatcctcatattccaaacctctcttgcaggaaaatttttccaaagacaggaatcctcaaatattcccaatgaggccttgattgcagttgcatatatcatgccttaatttgcaaaccatggtttttagctttttggtcttcaacttcataaaaagcagcccttaatgctcccagatcaactccttttccatttaaacccaccataaatcccctgccggtaactcccattaccgcaatatgataagtaaaacaagaacaccaccattcactcatctccttcagtttccacattcttgacaccctctggctcacaatcccattcagccatgcaagaagataacatcagtaagaaagccaagctgcgaaaatccatacagctcttcctctcaagaaacctcaagaagatcccaccgattcacatccccagctcagccatccctgcgaagatcaccagcaaccgcctcctctccacctgcaggttccccagaaccccatcgctgcacggcggcggcggtggcggcggcgaccaccgcaccaccgacgacgacgacggcagcaacggcagagaccaggcggcgacgctctccgacgtcgaccgcttcctcttcgacaacttccggtccctctacatccacgacggcgacaaccatcagcagcggcgacaaccaccaccatctccggggaaattcacacagccagcagcggcagagacatcatcatcaaggtcagagtcggttgcagaagacgcaagaggaacaagctcgggtgatgaagacgacaacaacagtagtacggccataatgctgttctccgtggatccttacacggacttccggagatccatgcagaacataatagagatgcaccatggtgaggaacctcagccgttggactgggacttcttggaggagctgctcttttattacctgcagctcaatgaacaaagtgtgcacaagtacattctgaaggcgttcgccgaccttactgctggagcccatgtcagctgcccagcccgtgggaaaccgcaatgggctgataagagtgtccggagtaggaaacactattagggcacaagattgtaatgtatttgcttaaattttttcactcgaaagtactgagaataataatgcacaaaatacaaatccatatcgtgcgaagccatgtaaactcatgatgtaaggtacactgcacataaaattagttttacaactcccaacatttttaaatatgtgatgtcataactttttaacatccgtatgaaacaaaaatataaaaaatataagtcatgttcaaagtacctttaatgataaataaatcacaacaaaatattgataattatttttttaataaaatgaatggttaataatatgtgtagaagccaatagcgtcagattttttaaaaagagggtgcggaatgctggttaaacagtcagaaactcagaataacctgaaacacatcatctcaacagaaaccataaggtaggttgggaatgattattgaatcaatttctgccataacgaagtattccaaatgtgtattaagctcaggtttcccataaaaaatatcaaaagataattacattcaagttattgatttagtaatttacacggacctatatatagagacgcgtgggcaattcccgtcaatccactctagtttagctaataatgcagtttcactcgcgatgaagaaaatacatgttttagttaacctagtagggtacacatactccactatctgcaacgcactggctggcatgatacctagtggaatcggataatgtatattagttaacaaaactgccagggcattagtcacttagaaaactatgacatcagttaactctaaaggctttacatttcttcttcaatgccccccctgtcccagatgatgggaacaaattcaacagaactatttgaattgaccattaaagcctcgagggcacaattatgatatgagaagcacgggttgcattttaccacagaagtttccagaaattgatctgcaaatgcaaacggtggtcagaaactcaaataatcctaccatcctaatgaagctgatcaataatgaaaggggccattcagtacatatgggagataaaaggaaatctagtcaatttatcttacaaacatttgtagggcatcaatgcaacggaagctcatcctattccaggcttaataagtgtgtaaagatattctatcctactctttcttgctccacatgttaaaagaaaagatatagtttgcatggcccagataaggaacatatgaaccaaataaatacaaattcttgatatctgctgtattacagagtcaacaaaataccactggataagtagccgatattaaacagtcaataaataataccattgaataaatagtacaaagcttgaaaatcagcccaaataaaacctgaaatttattcaggttggccctgaaccatgaatcaagggtgcagaatcattctgaatgttggcctaatgacatctaagcatacacagtgtaacaaaatactgcctccggttcatattataactcgttttgactttttttttctagtcaaacttctttaagtttaccaagtttatagaaaaatatagtagtattttcaacataaaacaaacatactatcagaatatattaaatattagttttaatgaaacaaatttggtattgtagatgttgctaaatttttctataaacatggtcaagcttaaaaattttttactagtaaaaaagttaaagcgacttataatatgaaacggagggagtatgtataaaagaccagtaattatggacaaccccaaaaacattcgaggtgtttttgcatttggaaggtcaaagaatcttttgctgaagcttaatgttctcacaatatccacttctccttggaagtcaaaaacaatatcacattcaaaaacacaatgatgtgcacatcacagtgttttcaagtcatccgattagtcgcgactaatcacgattagccgtccttatctctaccctgacctcaatcaggaacttcaaagcaattagttcaaccagaaaacttatcgtccgactaatcacgactagtcacgattagtcgatcaaattagtcgtggacgactagtctgttagtgctaaaaatgtgttggactttacacttcagtggcaggccttttgcccagcccaagaaggcatgtacccctcatctaaccctaaccagccatctagatctagtcacgagagacgggagaaaagatgaaggacttattgcaactaggataggtaaatgatttaactttaagaccttaagtcaagtgtgaactgtaaactctgaaaatctgattatccttaatatttataagcatctatacattatcctgggtacccctagcctatagtcaccgactaatctacgactagtcacgactaattgcgattagtcgactagtcggagcccttacgactagtcccgactagacaacttggaatcactggcacctcaataatga

SEQ ID NO: 55177 - DNA, 1030 bp, Oryza sativa
ccactttattgtcatgatggaacttaaccttaatttcctcctgccttgcctcctttagtactacaaattactttatggttctgctgatgtgggattttaattattatattatctgtagttacaggctagtgttataatcacccaaatagtaatttgttttggtaccaaaatcattaaacacccacagcttactatgcagactagtaggcattcaatcataggagtttttattagacatgcccccccccccccccctgggcatgaatcacttcacagacctctgccactataccgccctcaataaatctagctaacatttttttatttggggtacaaaccatctccaatacttaccaaacatcagccgaatgggcttttacccttcattcttttgactgcctgtcaacaattgttcaggaaacaatcatgtttattaatgactctatgagtttaaggtgaactttgaagcacctcttttccaccctttctaacctgcttctgaactattcaggaaagtacttgcctgtgttgtgtgtggccgtctaaaaagtgcattccagatagcctcccgaagtggaagtgttgctgatgttcaatatgttgctcatcaggtcagccaccttcacaggtctacaaatgtttcatgcttgatgacagaataggtttatggttgttcctttgcaagtgttcactataaccagagatcagttaaagccccatgggccaaaatctggtttggtagataatgggcatatgccaattggatcccttctttttaagatcagttctgtactgttttattggataaatggtggaggaaaactgaactagaagtctaatattaaatgattattcaggccttaattttaagatcaggtctatactgtttttatggataaatggtagaggaaaacccaactggaagtctaatattaatgactattcaggtctatgttaggccctgaattttgaggttacttatttggcacgtttgtattaagcgtattaccacagtcacgttaggaaatgg

SEQ ID NO: 55178 - DNA, 1907 bp, Oryza sativa
tctagcattttaaacaacatttgccaatgcacaaagtatggtaagtaaggtaggcttagctgactgatgcttactaaatcgaaactttgacttctatattcaactcagtctttcaattaaaatctctgctgttggagatagggtgggctttcttatcggttcactgaagtcagcttgctaaatccactttgtggatcatgaatattcttgctgcttgctgggtcatgaatcctcgtgctactgtatttcattttcatctgcagaaacagttctactaggatttgcaggcgtaagaacatcattcaatgcacttatgttttaatatagttgaccatatgcagccccgtttctaatagcggcttatatttcatatgtttcagtccaagatgttgatgaaggaagggctgaaggtccatacttcacttacctttatatgtttctagttttctatcagcattgctgagattcttttttcataaataggagggttattctatgagtgcgactacgactgccccgactgctgtgagccaggctgtgagtacatcatgtatcatgtaagtgcatacagttggcatacattgcttcatatactgcaatttctaatgaacttttgttttttttcagccaaggtcacctcaatgaactgcgcctgccttcctgcaactgaagctaatgaactgtgtgtagagtacgggtgtagaggactaatgaactgttatgttttagcagaacaaaggatccttctatgaaactgtcccataaattgtctttggatttggtgatgtttacttttgttacatcgtgttatgaacccaaaactttttgtgttctcacttctgtttatagtttaatgtaaactgaattattgaatgaatattatcatttcaatagtgcatctgtttttactcaattttttgttttcttgcgaaattagctatatgtgcataggttgagcagtgcaaccatctaagcttaacatgagatgagtttgatcccatccttcaagagcagtgtaaatttctagaaagaggtaacacattttaaaattatatgttatgttagtatttctagatttatcaatatatctagatttatcaatatatcttttaatttgtttgctatgtattccagctaaagtagaaatatatatactccatgatttattagagtatgttgagatgttggcccttgtcttttcaaacattttctctgaatatagatttctttgtttggtttattcaggaatgacagaggtgacgactgggtggtctggtttgctcatgatctagtgccccaaatgcagaaaagaacgcgttatagagcagactagcaaaaagtgaaatccaagaaatgatggaaatgcgttcttcaagtgtatggtgaacgaatgttagtcaagattgatttttttgatactatgttgattacatttttgctattccatatgctgcagtcttgtcagaaattcatgtgggaagatgagtatagaaaagagttgcttaaagcttgtaaagagctggagatcctacgatctgagaatgctcaactgaggagcatttttgccaatcaacaagtttagatagaggcattggttgtcaacgaaggtcagctttattagattctcgccctctcttaccctccagtcctctcttcctctctccggtcctcgcgtttcttgttctacaaatggccgggaattgagatctgcagcgttgctggatatgatcttggttagttttttcttgtagtgtagtggacgatctggtcacgattcagttattggtttttttggatttcagttattagtttttttggatttctcatatttcttcggcttttgttgcctaaacctaaccaacacttgggacggatgctgactggctcagtggggctctgccgctctg

SEQ ID NO: 55179 - DNA, 2654 bp, Oryza sativa
tggatcatgaatattcttgctgcttgctaggtcatgaatcctcgtgctactgtatttcattttcatctccaaaaacaattctactcttcattagtcattaccatgcttcgatcacacatcactaatctgctgcagtgctaagccagtttcacgagttttgtttgcattgtttgaatgaactagtagagtgtcatacaaagaggtcaaattctatgttatgttgttttttctgctcaaacactgttatattttattgacatccctatgtgctacaacattgagtgcctgctttatgatttgcaatttgttgtgtaatcatttatagatatggacagcgacactgaggttgaggccttctctaggatttgcaggcgtaagaacatcattcaatgcacttatgttttaatgtagctgaccatatgcagccccatttctaatagcatcttatatttcatatgtttcagtccaagatgttgatgaaggaagggctgaaggtccatacttcacgtaccttcatatgtttcccgtttcctatcagcgttgttgagattcttttttcataaataggaggtcatcctatgagtgcaactgcgactgcccctactgctgtgagccaggctgtgagtgcatcatgtatcatgtaagtgcatacagttggcatacattgctttatatactgcaatttctaatgaacttttgctttttttcagccaaggtcaccttaatgaactgtgccttccttcctgcaactgaagctaatgaactgtgtgtatagtactggtgtagaggactaatgaactgtgtgtagagtactggtgtagaggactaatgaactgttatgttttagcagaaccaagctaggatccttctatgaaactgtcccataaattgtgtttggacttggtgatatttacttttgttatatcttgttatgaacccaaaattttaccttcctggaacttgtgattttaccatcgacgaccacgtgattgtcggcgcgatctgggccgattcagcggcccagcagttggttgctgggctccaggcccaagcgtgagcagtggtcgcgtcgttcttgttagaaataatttagtgtgtactttatatgtaccgatatcaccaccaaagagttcacattatagggcaccaagaattcatatgagatattagcgttcatcttgctaattatatatcgaatttcttacatttgaatttatttagcccccttcatttactcttatacgaggagcaatcccgtcattagggggagatttaaccactaaaatgctaggaatgaatgtatacacattcgctctcttcgaatgagagactactgagtggtatattgcaccagtttgcttcagtccctatgtgctctggaacacgttttgctgttaagaacaaccttgatgtgtgaacgtaaagaactgcagcagcagcagcaaagaactggagcacaaaggaacttttatcattttttacgtaaagaacttggattcaacaagttcatcaaactgcagcagcagctcataatgacacaatacaagtcaaacaatcacacataatagaacatggcagtagcccttcaattcaagtctttaaatagataaaaaaaaagttccagcgggtagcaccatagcacacccggcagtcccaacagcccttcaacatcacagattcaagtcttcatctccatctccatgactccatgaaccagcagtcccagcagaacctgaagatggtttgttgtcaacccctggcccctgcccatatctcagttagggatgactcacctgcacacgctatacatcttaaagattaaagataatataggacttttttttagaaaaatcatgtaggactgttgtattctttctatcttcttaatttctaataatgtacattacctatgcagtgtgctgtttttaagttgttgcataatgaatgtcatagggagcactacacatcagtaggaagagcaggaagtcacctggagacaacaagctcccttgatagcaggaagagcaggaactcaacatcactggaaatctgggggtagcaattctggatttatgccctccactgcaggtaccttcactattccttttttccacaaaccaatgaggtgttttctcttgtcttcatagcttttcatagcaagaaaccctttcagagcagctgggtcctccaatgcaactgtaaatatataatgctcaatgtccttgcaaccatgttctgccaaacacttaagtgaagaacctaggtctttgggtgtcgtgtacttcctcttcttcgatacactcggtgcacctgtaccggtggcttcactagccgtgaataatgaagtgaataagccgtcatggccaatgagacgggcacccgagcatgtaaactgggatgcaagacaaaacttctcatcaacaatctataatcagtcaaaacggcaaagaatgagtaggagtggggcaaataccatctgttgagatccagagcctttttctaaccatgatgtttcatatctacctagttttgacctaaccttggaattagtcaaaggaacatattgattgttgagatctagcggtataaaatgatcattcgtcatctttgcaagacgtttaaagaaatcgcttttgttgtgggctgcaggaatt

SEQ ID NO: 55180 - DNA, 3355 bp, Oryza sativa
aatcgcttttgttgtccttaaacgattgtttcttagcaagtttggcagcaaactccaacagagccacttcttcctgatccgtcgatacatgtgtgcttgctgcctttgcttcacgattctatatatcaaaaacagagtcagtaaagaggcaatgcatacactttgttttcttttagcaggataaaacagtaaagtcgaaaaaaaggaacaaactttcttccccatcctcagctaactgggaacaattgaagaacaggatccgctgaagctctgactcgtttgatgaatctgtcacaattttacatacctggaaggcagaagaaagcactggaacccctagtgctaagtttactaaattggtgcacgtttattattctgtattgtatatttttcttgaatggcgcaggagagctgtgtgtcatttcattaagaagacaataaaaacaatgaacaagtaaccaaaaacaggactcttagcgccgcatactaagaaaatcaagtgtccactgcccaaaaaacacttaagcagctataggtagcatcctagtaagaagctgttgcagagccttagctccagccccaacaccacaacaaatgctcttccgtaactacagcttcaactctttggacacaaggactagcaccctcaaatattcattgttatcaacgattcaattcttagttttgttgaatttctcatattcatttggcttttgttgccccaaacccaaccaactgttgggatggatgctgactggcttatggttcagccgctctgatattacaatcatacatgtttaaacttgctgatcaggtcaactatgaaaaatgtacaatcaaatggcatatcattcctaatcaaattacctacatgaaaattttcttctgatataagagagaactataatttaatctatagtaaacatttaatctgtagaacctagttgcttcacatgtaaagcctgtgcaggaccaacctcctcgttggctagattttgtcttcagataacccactgtatgcatctcttattcctgatcactgtttgctgtgtcatctgctactctatctcattggctagttgagcataacactatgctactctctctttttgtttacttaagatcataccttgtcctcgtaggctcatacgctacatggctgttagttgtctcatttagttactgaacaccatgttactcttcattcagcaagcttttgatttaaagaattttctgatgctaaaataaaaaaaagaatttttaacttcttatatttcttatcggttcactaaagtcagtttgccaaataaagaatttgcaacagagagggtctcaagatttccaaacccacttccatttcagccttactccaagcacattgttgacggtcggtagcgatcagtttcgaccgtcaatattaccaaaatagaggagaactagttatgcttgcaatgcataaatatgttagaataataatattccactagtattaggttcactaaccttttgcggagaataaccataaagtggaggagaatcgacattgaatcagacgataaatcaatcggacgatgttgagaagtagacttatgtatgaatgggccaagaactcagaattgacacgatgaattaggccaaaattcacaagtctacgaaagagagcaatggaggaggccacctgctgtttttgggccaggttgggccgacgcaaggttcggtcgaaccattaggttcagccgaaccccccacaatgccgtttgatccaggtttctcctggacggctgagatgactccccaatgacggttggttggtattaccgacctttccaaccgtcacaaccgtcattctcaagctataaaaggagttctcatcatcacttcactcacacacctcaagcaagagctctctcatattctctcaagttagtttagtgttatcaagctagtggaataggaatagagtagaaatcaggagtccagaagtcttcggaagagttcgggtatggcttagtagctttccttttctcttttataagctttgtaataatattagaatattcttctttatacatttatggtattgaaatacttttggagtatatgaatgcctactttacattatgttcatgttattctgaatataccgctagcttatctgggagatgctttggcgcgggtataatgtttgcttatgcaattactctatgtcatgacgatgatattagagtagtatctggtagtttaggcatggtgtctagattatgagatatcattatttggggttatatgctgcggatgagaggtgggccgctgatggtgatagctcagtacgggtattcctccatgcgtgtatataatcctaagttaattccctggggagggtattcctccgtatttagccccggttgtatgatcatgacgggctgtcgtaaggaactcggcagtcaggggtggcttctcgaagtaccaggagggcatcggatagagggtattagctagtatgtcagatgactagaatgtatgtatactatgtatactagaagtatatgaatagattatgtttctcttttctttccacttagcttatataatttagtatgagaatgagtagcttaatgcttgtgtgtcactctactcttgaattatcttaacccctgtttaagatgtgattatcacaagtaatatataaattattagttaagttctctctacataatcttcctacgggttaaaataaatacggtacccttgtaatactctcggtgaaatgttacaatggtatatccgtgcgcttgcggatgattctgtaaccacaatataccaggagtatttctgcgccattgctggaaattatatttctaataatattgttaagaaataccaacacacatatgctacaatcactcagccactgatacgctaaaccctatcaatggccaaccacgcagcagaatcatcaccctatcaatgaccaatataaaatttgggaacctatacgctaaaccctagcaccccgagccagcgcggcagacacggtccggcgagcctaaactcggaaagattgaaaacatacctcgggttgcttgatgccggatttcgaagtgagcctgccgctccgtcgagccggttgcttcctcttcattttcgagtgacttgcttatgtattggggcgaattaactcaggcattggagagaaacaatggcgatttgacgcgcatagggaaccgcgattgagagtggagagaggagagaagaagagcgccggcggcggatgtaaaatgacagttgagccctgctcaacgcggcggtatgtccaccaaaggactttggcatatttggccatttggcactaaca

SEQ ID NO: 55181 - DNA, 3044 bp, Oryza sativa
gacccagatgtaaaaagtacggccaaaagatttttctatgttatgttaataataaataaagaagtatgtattggtgaaacttgttaatattgttataaaaatgtattgaagttggttgttgcgcaatttcatatgttaagtgaggtattattttgtaccttattcgacgtattagtactcggataatttatataggcctatcgcagtctggatcgtagaaacattatatggacttaaacaagaagaattatgtaacatgaagaaatagtagtataatttgaacatgatacaactatttgcattgcggttacatagatgatattagattcgaactaggagggaggtagtgcaatagttgaacagaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtggttcaagctgcacaacacggctaggtggagttagaacccttctggtgtctatccattctctgtacatctccttggtggttcctgggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggatgggcttcccatggagggagtgccgtagttagcacccgctagtcgctctgttgttcacgacattgtcgttcataagccgcttttctctgtaagtattgctcagtactttcggatgcgaaataccagcgaccttcttgtaaacaagtggttaggtcgagaacgggattttctgtatcaacccactcgatgtatgcgcaagctgtagtgcgggtctgccgaatagagtagtgttacgaagaataaagcgattgcccatacgaaatgaataagcatatgtagataataaaatacctcacgttcatagttagggcacctaaaaaagcgccttcctcgaatatcagtattcctcgaagccattagttggcatcgatcaccgcataggcagagaggacgctggcaccatggtggtagtaggtatacataaggatcgctacgccagtttggatcctcaacaccccggcgtctagccattgatgaatgccggtcagatttgtaatgaagcaagtggggaagagagtactgaatgtgactgagttctgaaagattgtgaggcctcactcgttaaggcgacttatataggcgcaaaaaattgagtgatacccctgacatgtgaacgtggtggggtatggtgggtacgcctgattggcgccgaaagttacatgcctgattagcgccgaaagttacattggtcgtatgcaccaaatggcgggcaaatactcgtatcgcacgcgaataaaggaggctgcatcagtgcggcagaaagtagtcgtgcatgcgccgaaaggtatcgtgcatgcgcgaaagttatcgtgcacatataacaacaacgtagtcattacacaagcatacattactggaaagtgaagcaaataaacaaagagaagactgctctactggccctgccccgcgccgcgaccacgcttggtcctccgggcctgtgctcgcacgtggtcctaggagtaggtgaaacgatccggtggcacagcatgggtagcacgagtgtcccgcggaggagtggcctgcgcctgtcctgcgtctgcactgggggtgcacctcccagctgtgaggggccgatgacgtcctctgtcgagcctgaagcgaagtcgaagtcagtgatgtcgaagagcaaggtggaaggcagcaagcggtccgacgaggtcccagcacggtccagtggtggaccttgactcgacgtgccggctgcctgtgacgaagtctcggtgtactgccagaattgcgctgagtgcgaggtcgacgcagcttcctgagacgctgaccctgcagcctgggagaagtgggcggcctgcgtcatagcgaactgggcgaaacctacacatcgacaatgggacccttgtaagctaagacataaaatgcatgtaaattgattgtcgaagtaatgttgtttttttaagtacctgtggggggcacaacagaaggcctagccgaggaaggcggggtgctgaacggtgcacgaaaccctgaagcaatcggcaagtgaaacggctcacttatatgtgcgaggcatgtacagaaatagtaataaaaatacttacctccgtgcggaaggggagtcggcctaggaacatgcgcagctagatggggaccagtcggtatgggtggccgctgtatagctgcgtctgcccgagcaacgtcgtctgcacgacaggtgagcactcggagaatcgagcgcattgactccaccatccgcgtgtacgtcgtcaggtgctcctctacgggtaccggaatccccgcgcctaaacgttggatcatcgttgaaccgtcaacgacgacccggttgatgtcgttgacctgcatggttaatttgttcgtaaatattcgtaaaatttgacgaagagaaagacatgaaaacataaaggaatggtgcgatgcagggtactcacagcacgagcgaagtcctggtcgcggttcctggcgtagaggtctctagtgctcgcaacgtggggctgctgctccaagggagcgaaggtgaccctagtacgggtgcgtggctggtaccagcgtaggtaggcctggtacgcctcctcagtgtgtggctctccctcatggtccacgacctcctcggttgcgagcaaccagtcctcaataaaagtcgccaacttggcgggccagtcgccagctgactgctgacccttgcgcgagtacctgcgaattaatgtgtaatattagtgtgaatcgacagatgttacaaattattgtgaacaggtagattttaatgcaacaatggaaagagtagtaaagggggcag

SEQ ID NO: 55182 - DNA, 9290 bp, Oryza sativa
tgggacggtggtcggaaacggtactggaaagggctgacggaagccgaactgtcgcatcacgcggaaaggggcgtgaggctcaacgcagatgtcgaagaccatcggaaccgtagtcatccagtacgccttgtccctggtgcagagtgtggatagacccaatggcgcacgagcttgggtagccgcggcactgtagggctcccacacgacgtcagtcggcagaaggcggtcgaactccataacaaactcaggatacgaccgcctaacctgaacgtgagcccatcggcgctgcaattcgagacgatcgatgtgatgtacaatgaacttagcaattaacttaacaatacgataagatcgatgcaatgtacctgacgacggcaccacagagtacccatcgtagggtagtcgacctctggtcgctcctcgtacagtgactcgtacgcgtgctggtccacctcagggcggccgatcacaatcctctcagctgcccagatagaaagaaagagagggcacccaccaaaggtcgcgctgggatccgtcttcgtgcaagcctcacaaagtgcacggtacagagccgccaacaacgcggaaccccagctccactgaggcacctcgcctaccgtagcgtcggcgatgctcctggcgtagtgcacgagtcccttgtcgaccgcgtgcccgtgaccgccacagaacatcacccagccaaaaagctagagcaagtacgcctccaaacagtggctgtaggagtactcgtcggcctccgcctgtagctgctcgacctgcaagccgtcgataaaatgttaggcaccttaactgtggactaaatatgtaatacgcttgtcatttcggtacaaaaacactcacggtgaactgaagcagccacctcttcgtaggtccggtgttgcggtggtgtgccaacggctcgagcgggaggtgcggtgcgcgctgtactagtgcgaaacgtgccgtcatatcatcctgccagtccacagccgtggtcactggcccaacagtgtctctcgcgagtggtagccccaacaagtacgatacgtcctgtagggtaggggctacctcaccgcacggcaagtgaaaagtgtgcgtctttggcctccatcggtcgaccaaagctgctaggagggacctgtccacagtccatcgtctggccgggtccgcgtcgccggcggcagcctccaccagccgacacatcggtaggaggccgacctcatgcagcctgcaataacaaattaatatgtcattataaaaaatattacagcgcaactaacttatagtaatacattgttcgtacctctcgacaaaggagtcgtgaaccgtgagtagctcaccgcacgtccgtgcccggaacgtcccaagctgagccccctgcactgcagtaaggtgagaccggtgtcggtgatctatcgccgggtccaacaactgaggtgtatcctgacgtgccatctctgaaaaatatagtgtttcgtgttagaacaattcagcaagtagtaatataaaacaaaagataacttgcaaaattatgaaatagtaataaaatcatgagaataattacgtacaacaagagtacaggatatttaaatatagcaaacgttactaatggtacataacgatgacgtgcaatttaacatatatgtagagctcgataatataacataacattacgtgtcgaaatccgacatacatcagcatacctaaagacgttaggcgccttagtctgacgttacatcacgagaccaaaagacatgacatgccgaagtctgacattacacgacgaaacataaacacatcgataagttctaaacgaattacaagcaaagccacatgccaacatagaacataagaactacaccacgtagccagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttgtaggtgtgcccatgttcatcgcatttgctgcaacgcttcaccctgccagcctcccactagtccatatcgttgcggatgcgacgagtcctcctccttccagccttgcctcggagcttcgatgggtcaggaatattgagtacttcattgttagtctctgtgaactccccagctatgccgaacccataaatctcgccgctccatgtatgatatattgcttgcttactgaagtactgtgacacatatactgcatctggtatgccacactccgctgcggcagcaatgacatggatacatggcctgtggagcagcttcggctttgcacaagagcaatgacatgtgccgtcggctttgagaacacactcctgcttcactgtcttgcggtagatacccctgcctgccttatcttgacatagtatcttaaacctgtgctgttgggtaccttgcactagagctcgatgtttcatggcctttttacgcaagtcctctagctttttctgcatgaaagttccaaacaaaatgctgttgttcgacatagagggaagaactgcctggaaccgatccctaaaatacctgcatgtctgtcacgtcctgataaattcatcccgaaataaaaatcattctctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattattaagaaataaacaaagttaaaatggttttataaaaagaaaagctctaaaaagtcctttttcccccttccccctcttgggccggctcggcccatctccctcccctctccctcctctccccgcggcccactcggcctctccccgcgcgcgcgccgctgacgggcgggcccgcccgccaccctcgctgacgggtggggcccacccgtcatcccctacctcccgccgctcccgccgactccgccgagccctaacgccgtcgccttcgctaataccgccgctcccgtccgtcccgcgtgcaatcaataggggggaaatattccccgtgattccctccctctttccccccatttttccctccctctctccctcggattcgtttggaaactcctcccctaacctcgccggcgcatcaatggcggccggatcttccgcggccgtttccccctcatccggccgctctctccccctcccaaccctatataaacgctccccgtgcctccctccaccgtttccgccactcgtcgctctctctccccgccggaatcgagctcgcgccgtcgctctctctctgcgccgtcgccgccgagctccggtccgccgccgtcgtcgccccagaccttctcccgtttcggcgtcgccttcttcgggttcgccgcgacctcgccgacctcgtccacctctccgtttcggtcgccgaccgccggaacgccgccgtccccgtctacccgagccgcgccgccgccttcctccgctccggtcgccgttcccgtcgccgccgtcgacccggggtgagccgtggaccgccgtttcgcttcccccttccctcccctctctcgggcgccgctccgccgcgccggtggtcaccggcggcgaccatcggggcgcgggtgcgccgcctcccgtcggctgtgccggcgtggccgccttcgggcgcgccccgcggctgccatgtggggcccggtcgtcagccgcccgcgccctcgggtgcggctgacgcatgggacccacggcgccggccggtgtgagccgcgtgcacccggtccaccgtggaccgtggggctgccgcgtgggccccactcccgtggacccggtccgcgcgcccctcccctcggctgacgcaataaatccgattttaaattaaaatttaaatgaagaaattcgcaaatatccatttaaagagcatataaacttcaaatggcaataacttggccatttgaactcggaattggaccgttcaagtctctaatttttccttaagaagtcaagaacccatttttgtgttttgtttctacttgttatatggagtttagtagagtaaaagccgtttctttcccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatctagccatgcctatttacctttgttatgaccttaatatttttattgttattatttccttgttcaccctagaataaacaaaaccccaactagtggacactctactcatgggaccactagtatgaatttaggtagatgcttcgctgattaaataggacaacattaggtggtttttataactttagactttgggaattctcatatcatttggacactatggaatggttggcttatggtggaattggacatacacctctcttcctctttcaaaacccctaaaacctgttttccggtggggtttgagtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctgggggctcattcctgcctacctgtcccggaggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgtttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataacactgtgtaactctaggatcgtcttataaaatggctttgggcaactaagtgacttttaaatgctgttttctgcaaagcttaacccctatattatcaccccttgtacccccttacattaatcatgcatctgccggtatggcttgctgagtactgtggttgtactcattcttgctctatctttctccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgccttttatatcatgtttgtgtggtgtaccccggcttttcctgggacggggattaatacactagcgttcgggaaaaggcaattttctcggtcgcgacaagctggtatcagagccatctcgactgtaggataagcccagtggataaaaacctaaggacatattttataaatgaaactatttgcgaaagttcctgtttcctcctttacctaatgctatttgcaaaatgtttattctcttcttcctccttcggattttcaactagtactagatggtcagctttgcgaagaagaagatgtcgtcaattgtctgccgaagctctggaagactattggatctgctagcgaagtggaggaagcagcgaagccagatgtgaagcaggagtgaagatcttggagaacccgtcgcagaacctaagccaccctctagggtagagtcgttagtcgtgtgtttccttgcttgtgtgtgtagcgcgtggttttcatcagtggggtgtgatgtaaccatgctaggttgtttgcttaatcaacttgcagaataagtgaaacaaataacacatcaacaagaagagttagttcctttaaggtcctgtctctagttctggtctattctttcctagctggtttcctctcttcacctcaatccctgtaacagatgtttaacagagaaaaagaaaagaatgtcagcgggtatgcctccagtaactcaagttttcaactcaatccaccactagcctcaagagagttaacaagggtacacccttggtccattccgagcatgctgcttggttcacagctaccattggttggaagtcaagaccaaaatcagtatgtgtttgatcgagcacttgccacccaggtcaatgagcttccaatgccagaagaggatgtccccttttgtcacgattgtagagagcaaggacactatgccctgaattatccatgggtatatgtcaaagaagccccttcctttggtttagcagggcagacatcgctaaaccagcctcctcacaccaagtcaagcttgcagcctagtgtgcaaagtagagagcccaatggagagaatccattgaatcctgggaaatgctttcctcctagcctttcgtaccacgtggggtcacgtactaagcaagccaaaggcaagaagagtaagaatcagaagaaaaaagcaccgatgcgaactgaagaagaagtacgtaagatgactattaccagcaccgaatggcctccagcagggataactattcctagacgtcaaagaggaaataccttccgaggtgcacgacagttgacccagcacctcctaagccatggcggcagagtatttgatagtgaagggtcagatcaagtctcctcggattatgaagatgagtctctccgacatctcggcgaggaagagatggaatcaaaagcatgccctcgttgtggagaaattggacacgttgctagcatgtgtctcacactttgccctcattgtgaggaagaccatccaccaggtggatgtcccacccgcaaggtcacatgttttctatgcgaaggtacaaaccatgtgcccaaggattgccaactcagtgtgttgttgaccaagaccgcagaaatccaacgaacaaccctacgattgtctcgtcagttagtcagctccaacagcaacatcgacgatatcatccacagcaccaatgctcctcttgctgcacctgactctgcaataaatcatagcaataataccttcagcaccaaccattctctgcaccgacggcctcagcaaagaattgtcgtcgatggaagaagttgtgtctctccccgacctactccaggccgagcgaagggcaatcaacctcaggaggatgataccaagcagaagaccgttattcgcttcaaccagcaatcagaaggaagcttctcctgtgaatgatagcaaaatgcagtcctatcacatcatcacagaaccaatcaaggatgcagtcactagaacaatgccagctatatctctccagaatcaaaatgagcatccatgtttgtggttttcagttcgctacttatcattgtgtaatcgaaagtttgcagcaatcatgtaatacataaatatattcatgtctataaacagtgagcttgctatgcttatggatgattcatgttgaggatacaatgtaccgatgttaagcaccttccctttttgtttaaggcagtgcctcgtattcatgtaatatgggagaaatgtgtaataaaaacaagttctatgaggactctttcagaagatgctgatatgggattatgtgtataattgtttactgtcaaaggagacctagggtctcatttcagaggaactatgttctaacctcgagttaataaccaacctgatgatggaaaagaaaatcaagcgattaaccaaagagacatttgtttggactaagagtttcagatgtgtctttttcggatcaaaggcaatggcagtcagtatagcttttggcgaaatacttcaaggattcactgaaaggcagcagaccaaaggacctcatcgccaccagaagtgtccgcaacccacattaaagagtaccacctgttagagataggccgaaagatgattgataaaagagattggcaaagaggttctctagcaggaaagatgtaggccgaaaggtgattgataaaggataatcaaaaacatgctctgcatcactcaaggaagacccctgatagtaatcgccctgcaacagtcaccttgtcattgagagaaaaaaaaagtcgtgagtaagcaagatgacctaggtaaaagtgtttctatgaaggcaaggagtgaaatcttcaactcagtatcagatgctacagggagtgaaaactgcaagcaccggttaccaggcaatgccatgtcttgggagatgatccaatgggaaggaactcatcaaggtcaaaggagtaaaggaatacgttgaatgctaaataatgacaacctgaagataatagtgggaagtaaactgaatgtaaataaccaagtgatatgttcgaagatagtctacagaggtcagattaaaatcacatctaacaacgaagcttcagatttggcaggataacgatcaaacaataagaagttcagcagtaaagtcatttgggaagacgtcaaagcatgtctagtgggataatttggttcccttgggaaacataattcaaaggcaaagttatcgaccctcacattgaatagaggaaatatctagcaccggagaccaggaaagctaatatgagacaattagtggcaagttgtcaatcatggtattcttagtaagcgggatatcatagtctaaagcatatggtggtaagttagaagtaaatgacaagcatggtattctcatgatgacaagcatggtatcctagtaatgacaagctgatatcggcgcaaaacgtgaagtgggtaacttgtatgaggttgacgccaaagatatgaattatgagaagttctggaactgaagccccatcttccaatgccgcagcccagtcgaagtcagctaaaggttcaaccagggacaagtcaggtgaagagaagattccatctgcaacaagggatcgagacaagcagcctagagtggagaagtttttctaggcaagtttgttataaaagacgcgacggaagaagtcagacaagaagag

SEQ ID NO: 55183 - DNA, 2713 bp, Oryza sativa
cctatattatcaccccttgtacccccttacattaatcatgcatctgccggtatggcttgctgagtactgtggttgtactcattcttgctctatctttctccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgccttttatatcatgtttgtgtggtgtaccccggcttttcctgggacggggattaatacactagcgttcgggaaaaggcaattttctcggtcgcgacaatgtcccatgtaaaatgaactccattatgccaactagtggcagtccacggacaccgcgcatcacccagttgtaaacttctgccaaatttgttgtcattattccatatttagcaccacctgtgtcatacgccttggcccatttctcttttggttcatgcagaatccactgagaaaatttcccaatctccaatccagttcttctaaccaatgttggactatccgttgggagaggtccaagagcttgaggagggtcagcaacggcggtcgatggagccgctgcacgctgatcactgcatttggctatcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacactggggtatcctcgttccatactcccaaactgcaactcttctatcgctcgcagaatgccagcgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgtcatcttgcatgcatgtagagctaagaacgccctttgcagcacactcttgccaggatgttcaattgaggggaatttcttcacttcgtaagagctcccagggtttctttcctcgataacaccaagcaggcgtggcaaattgtcatacgaggcttcataagttccaatacttggcatagctaatagtatacttgtatgtctcttcgatgtgttggattattgaccttggttcatatgtgagattatcgattacatgcgcatacatctcagatgcaacaaatgcacatgtaatgttcctgtggtatttctgaacaccaggtagaaaacatgtatgcttggtaacgactgacactgtccaataatccttccatttccccttatacgcgtgcactctccagggataaccatctttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacttggttgaatgcccactggagctactacgcccccgtcctctcgtgcgttgacctcctctacagaagtctcatttacttcagcacttggtccctcgccatcatccatgttcatctgcacacctggatccttcgggtgaacaaacggaaccaaagctagaggccactcgcgttgcaatgcattttccaaataccatatccacactcgagagttttgaactggcattagttcccaataaaaaccctcagttgcccgacttactataacattgattgttatgtcacttgtctgtggatcaactctcaagcccctcattaaccatccttttatagaaggtacactcctctcagccggtctatcaattcccctttctgatacaattaactctgacagatctaccccagttgggcccataacggacgtttcctggtccatggtaaaacttggagtatttgtttggtcgacaatatctgtcaacgaaataactagatcatattactctttcatgcaataaacatctacaacgtaatatcttcttgtgtaagccaatgcaacggtaatgtattgattccaaactagcagatctacgtagttaccgatatctacaatacgcacttctagattagtacaactaaaaccctacaaatataatgcatttattcaaaccaaattttaaaaaatacacactatttaactcaatagtcacatataggatctatgaatattacctgaaatcggcgtctgaatccggcagggcttcgccccttcttctcttctcctcccctctcttttttttcactggaattgaggggggaggaatgagggctgggggct

SEQ ID NO: 55184 - DNA, 12332 bp, Oryza sativa
cgcccggccagagggcggcaaggggccgcctgcaaaatggccggccccgattggcttttttgcattcgggccccttgctgccccaccagaggacggcaagggttttcctgcaaaaaaaaccctccctccgtcatcgcccgttcctcccccgtttgccacgtcagcttgccgccccagaggtgggcgacagggtctatttttgtaatttttttggccgatagattatttctgtaaatattttaaaaaaaaatctaaaaccgaaaaaaattcgtgccatgtctgggccaccattttgggccgtgcaaggagcaccagaggctggctggattgggggcaacgctacgaccgtcaggcaagggctatattatcttcgttgccttgcacaggctcttggtagtaacctacacccagaggcttattttagacatgactgtcacgtcgattggcgtataggttcccaaatgtgctagggtttagcgcattctcttggtagtttcagccttttttaaccagaatacctgacaaaaatatcaacaagcaattttgcaagcattaggtggtttcttccataatctcagggaactttccatcccagggaactggggaggctcagagaaggcccccatcggttggctttttttctaataagccaaaacggcttattaagaaataaaaataaatttataggtaaaatttatatatatatatatatatatatatatatatatatatatatatgttctttgtaatttaaaagccaatgctgaaaaagaaactacgttgaaaatatctcaaaatcaatctcaaaattaagtttaaaaatttaaaatttagcttattctttggtttattggaccatccgatgggagcctagctgtgctcagctctatggtatgcttcgtccgcaattctcaagttcagtttctcagcattctgtgcaaagttcattttcagtgggtgcaatggaagacccattctctaaaagagctgcactgaagtacactgaagaaattaaagactaggtaagctacctagcttgtgatcatccgttgatcacttgctgaaattaagctgctactctttgatcatcatcagacatcagctgtgggtagcttaattaagatcgacgataatggcgagcttgaagcttagggcgtgcgtgcttctgtccaccgtgttcttcttctccgggctcatgcagctgtccatggcgcaagctggctcgccggcggcggcgacggcgacggcgacgacggcgcgggtgatcgacgtgaaggcggtggatcaggcggtcgcctacctgctcatgctcgcggcgctgttcgtcacctacctagcgcactaactaactaattactccgtattatttattttaagttcgctagaaaggggcatgccaaatcgtgtccttgttgatttgagcactgtaaacatgctgtataattgcataattatttcactgtaagcatgcataattgcacatggcttatataattatatggagataagttttcaagttgttcctatttgaattagaaaaatgtttcatgtatgtttgacagttcgagttgtcaaaacttgtaaagagagagatacgattctatgcacggagacagctcccgggtaggtatgttggacagtcatctaggatccatcgctgctgtctcgtactacggacagccttcgacatgctatagtcatccgggcttgatggtggttggctccgctatattgtgttcctgttattttctaagaaattgttcttctatttgaatttgaatgtttgtacgctcacaagatgtttgaagtgccttttcccttggagaaaatttttttatgtttaaaaatacaagtatatataacttgccaggcatattaaatcttcgtttggaagtgcattcccttaacttttctacggcatgtaaaaagagacaaacgattaacgcatgattaatcgaatatttattattataaacataaaaaatgagtctatttgacttttaaagaaacttctatataaaacgtttttttaaaaaaatgccatttagccgtttgggagatatgctaatggaaaaggaagttgcatgtcggaaacgatgaaatgaatggggcctaaaccatatatatactccctccatttgtttttgtttgataggatggggtagtattatattaatgatcttagggttgaatgttgcaacatgcatatatatagtgtatatgtcttttgggttgcaattcatcacttgcatcaattgcaattcttctcgttcaaattaagatgcctgtggttttgtcggaaacttggaagaattgattctggggtcaaggattgcatgaagaccatacattccgatttccgagtcagccgtcaaggtactaaaaattgacgttaatttaacggaccaactattctgacctcacctggtttatcagctctaataaaaaagaggacagaaatgcaacccaacttacctaaccgtcaaggtacctttcttgcttgtatatcatatatatcagagaaaaatctaccccaccatctgtcttaaacactagcctaaagcccgtgcgtcgcaacagaaaacaaattaaggtttttgcttattaaattaattaataatcacttatttagtctaagtaatattatgatttttcttattgaacaagtgattttgaaatttaggaatctaatggtgaaataggggaggacttgttgaaaggtggtgtaataatatagattatagggcccagttttaatattgtggaaataaacaccatcgctagtcgcaatagtataaatatgaatcttagagggcatatagttaaacctcaaggtgcaaaggccgaaaaatattccatcatcttaaaaataaaaggttaaacctcaaaatctaaaaccactaatacagtttaaccttaaaaacggattcagaatgcagagccaaaatacagagattcacgtatcccttaattaagaaatggttgcttttttggacttataatcatacatgtgacctaatcaaagaattaatcttatggtaagactattgtacctacttctaattttagcgacccaaaagtcaaaacttgaaatattaggaaaaaaaatcccttaaataaatctaaaattaaatactaaaactcaagtttgctatggcatataagcagcaaaatccttaacgccaatgcaaatgctgtcgaatattaccaggcatactcaaattaattcgatgacttttttttactttacttaactaggtaataaaataaatactgttggtcaaatttttaagaaaatgttaactactactccacccgtcccataatataagaaattttaggtttttgcttgtactgtttgatcactcgtcttattcaaaaaaatttggaattatttttttttttgacttactttattatccaaagtattttaagcacaacttttcgttttttatatttgcacaaattttttgaataagatgagtggtcaaacaatgtaaacaaaaactcaaaattctttatattatgggatagagggagtacaacgtatacttacaaacggaggtaatattttacaatgtcggtaatcacattattgggcgtgcctgccctgcgttgcagtacggaaatataggacagaacagcacgacaatggcccggtcagaattgttctgctgctctcttattaacgctgttccttctgaaaattctgcaataaatttctgtctcattgtatgatagagtctgtatccaactatcaaatacaaaaacaaaaaaacatccgagtatctgcctcgtgcgagaattaattaaaccagacgtggctatcattaattaattgtagtcattagagcacagttagtggccggcttgcaagtagtacgtacgtagtggagtagctccaaattagttgatgaaataccttctagctagtcaatctcgccgagccagactctcacagactgaccggttcaatatatcatctcctcattcagtttctctcctcgagtcctgatcaaaccaagcacactactgacaattcatcgatcgatcactgcgtgctactccgaaagtccgaattgcatgtagaaatatatatatatatatatatccatattccttcccctcgcactgtgggagatcgagtcagacacgtactactgcactagagcaaaatccattcgtcttgaaactattattattattattattattattattcacttaatcagaagatggcatgctgttcttcttcggtccaggctcgtcgatggctatgggccaaataggagatcgcatagggcctcctttatgtggcccatataaacatgaaggcccacttccaattgctcaaccatagcatgcaacaaccaatagctcaataggcagatcgattaacaaggccaagccagggggtggggcactactaggctgtgcgatcgtctaattttttttggccctagtgctggctgctgtgcaatcctaattccacgccacactaactgccgagatgtcgatcccaattccacgtgtggcgaccggcgacacagcttgttgcttgcgactctgaggctgcagctacctcgcctcggttagctcttggctcctgctttccccctcctcgtccgctcgtcatcctcgacttgaccctcgacagttcatcctcagactggtaagattagacttcataatatgcatcaaattaccactagtttatgatagattaaatcaaattatcatgttatgggtatagcccatcaacatcgtgtccaaccctaaaactgtttatattttgaggcaatattattttctcttgctaatcgagtgtgtgcataacttagaaatgaatatggtatgttttgatttacagaaatgaatgccaaaccaataagatgatttctgtgcaacaaaagttattgtacaaaattcctactttggtttttcttcttcttctttcggaaaaaaaaaacatggctcggcaaaacaggacatggaattttcatctgactaatggaaaccaaaagttcggtagcatatcacgatgccctgaaatgcgtggcaaatattttaagaagtttcctgttgtttctatgagtgcttatatatctgcctatatcatccgttttcaacttgagaccgtcatgcattcgtcctaatggtattgctcagtattcattcttgcatctggctctggccatttatcagagaacacaattaaaacaactccagtcatactgttaatgctatgttcggttaatccccaagagagagggattggaggggatttattccacacctattgtggtgtggaattattccccctcaaatccctccaaaccccttcaaccccttccataccgaacaaggcggtcaggggctcagggcacagtaccccgttcgaataatccaacctgctttgaactttgaggcacattttgtacgatttcaaacgatggcacatgagttctatacatccatttctcaacaagttcaaccaaacaaggatcagatcatgatcatcagaaccccttttaatctgcaccatatctcaccccacaaccaaactacatacaaccacaccaagcagcagcagaattaaggagaaaaacatccgaaaacactacacaggctgcagcattcatggtacatggtacactctagctatagctgctgcttgatttgatttatcagtaccagggcgagtccgggacggcggtgatgacggtcttgacctgcaggtacttgtccatggcgaccatcccttggtcccggccgaacccgctcatcttgtacccgccgaacggcgcgtcggggtcgaaggcgaagtagcagttcacccacaccgtgccggcccgcactgacctcgacaccatgttggcaatgttgaggttcttggtcacaatgccggcagccagcccgtacttggtgcagttggccttctctatcgcctcctccaccgtcctgaagaaaaaaaaaagttcagatcataagtcaagttttcagaatgtttttttttgtttgttttggagatgagatcagatcatcgaaacttgtgaggtttttgagtactgacttgaacttcatgagggacatcaccgggccgaagatctcctcttgcgcaatcgtcatttcctcctgcatggaggatcaacccagatgagcattgttgatttgatttgattgtgcttctaaatgtaagctggttaccttgacatccacaaatatggtaggctcaatgtagtatcctttgtcaccagtgggtttgccacctgtgagtagggttgctccctcgttcttgccgatctcaatgtacttgagaaccctctcaaattggaccttgtcaacctagcaaatgaaaacataatgttcataagttctgatacaattgtccattttgtcatctcaatgttttttcttccattgctcgcatttcgacagaaaatgtttcagaacaaaaatatgaaaatagtaggataatattacctgaggacccatattggtggcagcatcaaaagggtctccaactttccagttcttggcagcctccacggccttcttcacaaactcatcgtagatcccttcttggacatagacgcgtgacccggccacgcaaatctctccctgaaaatttcagacgccagtagcacggtcagtttttttttgctctgaagttcagagtctgaactgaacactcctaacctgaacatttctgaaccttggtccggtgcatagtgcatttagttaccttgttgaagaaaactgcaagggatgacagactgacagccatgtcgacatcggcgtcgtcgaagactatcatcggagacttgccgccgagctcaagagacacattcttcaggttgctccgcgccgccgactccatgatggcacggccgatttcagcagagccagtgaaagcaacctgacatatgcacaacaacatttcggtcagaaactcattcagacaaaaacctgaaacgctacagtaccagatggtgatcggagtgctcacactgtcgacgtccatgtgggaggagagtgccgcaccggctgtcggcccgaatcccgggacgacgttgatcactccatccggaactccagcctgaatgatgatatcaaaggtacactgaattatcatccaaattctagaaaatcaactcaagaacaagaagaaaagcaggcatgaaaacaaaagggtggatttggtttgaacattggttaccagcttggcgaggtgagcgtagtacagagcggagaggggcgtctgctcggcgggcttgacgacgatggtgcagccggcggcgagggcggggctgaccttgaggaagaacatcatggtggggaagttccaggggatgatgacgccgacgacgccgatgggctccctgagggtgtacccctggtacttgccggccacccgaagggactcgccgtggatcttgtcggccgcgccggcgtagtaccgcatcatctgcgccgcggcgggcatgtcgatgatcttgcccagcgtcagcagcttcccggcgtcggcgccgtccagcgccgccagctcgtcggcgtgctgctccaccaggtcggccagcttgttcatcaccctgctcctctcctgcgtgacggcaacattgtttgtggattttgtcggacaagctacagtaccatacagtaaattggacgaacttgtaaaatttggctctgaagaagatcatatgggagtggaaacacgtacatagcctgacatgcggggccacttgccgtgctcgaaggcctctctcgcggccttgacggcgaggtccacatcagccttgtctgcctctgcgatgtgggccaggacatcgcctgttcgtgggtcccttgtcttgaatgtcttgcctgtaaaaatcaaatccacatagaaacaattacatttgtccgttttcgttcttgaaacaagatttaaggagatagagattaacattttgagtttttccatggtcctttgggtgatgtcttttagtttatctctttgcaccatcatttttttccttagtagtaatatagggccagacctttgagattagctgagtgggtggattaagaataaagcacaggctaggcccatataattaggggttggctcgataggtggatcgagaataaaatgctggaccctaggtggaatgatggacagagaacagaaggaggacgactgcacttttaaagtggtagagataactattttcagttgaaaaagtatgacttgatttatcacgagagtgaagtatccacttcacacaaacataagaggaaaagaaaagaccgtggcaaatatttttagaaaagttgaaaaagtcaaacactttaatagagtgaacattatttccattcttgtaaaccctaattttgatattaccttcgtcccgaagtaattgtaattctaaattatcttatcatatactctctctgcttcatattataaatcgtttgacacttttcttagtcaaagttgtttaggtttgaccaagtttatagaaaatattagcaacatctacaatgccaaattagtttcattaaatctaacattgaatatattttgataatatgtttgttttgcattgaaaatgttactatatttttatataaactcggtcaaactcaaagaaatttaactaaaaaagtgaaatgacttatatatgatacagagaagaaaaactatgatgtctctcattcaatggtgcatatgtaaaagtgggagggtgcttgagagtaaaatatggaggaatttgaatgggaagtgattgatgagataatttgtactttattacgaaaaccatttgagataatttgaattctagaaatataattattatgggacagaagtggtacaagagtacaagacactgatcaaaattttcaactttgatcggttgcaatggccaatccaaatagaggaagaacaatttgagatttttcaaagttttgtaccgacaggaccttcttggtccatcttttttttttttttgaaagcaaggtccattttgttagtggcacaatgagggaatgccgaggattatgaacagaatcccacgagaatggaagatatttatgactagtcaaagctgttccctctcaccatgacgtcatgtctacgtggagccacactcacattgattccctttttccatttttagggtggatatttttctgagggcataataaatgctggataatttgttttctcttgtaaataaataaagctattccccctacaaagaaaccaaaatttttttaactgccttaatttgcaatcgcagtgcacgccacgtttggccacttgacgtacgattcatggtgcttcatgtagtagctagctaataccctctccgatttggcacaattgacatttaaacataaccattcatcttattttaaaaaatcataaggttattatttattttatcattatatatatactttaagaataacttgtattttttttatgtttacacacaattttaaatctgacaaatagtcaaacaaatgtgtgtcctaaaaagttgttatatattaaaatcggagggaatagctagcttgtcatgtgtgctgtgctggccggctgctaatgctagcttagctaaggagataaacaaaaatatattctttattatttgtagatatctgtatagctgggagcgagacatatagaacgtacacaaccgttttgacttggcttcgatctggcctcctgtttctacggatgcaaccacgtctaagagtcaatatcatgtgctcatttcataatgccaaagtacatgactcatgcatgacgcaaaactttgtttcattcatgctttatatacttgtgatgaatgatgtaaaagaaaatatataataattaagagaaaataaataacaccgaattaaaaaaactataggaattacgctttaatttagttaattaactacttctgatgaatgatatatatgatgcaaaaagaataaagagagaaagaaataacatataaaacactataggttatattattgcaataaattaaccaccagcagacatggctacttacgtatatggtaactgatataaatgatataaatgtgtggtgtaccgttagtacaagggttcatggacatggatggtcgtttaatgttttgatggaggcagcaagaattccttttttttgtttaacgaatcatgagccaccaattttattaaatagaacaggagaaatttgtgaaaatatagtacagctagctagatccagagcagttagattctttgcccccgtaaggtttaagttttaacctcctctttaattttcagtattagatcggtcgtcgagagttttccatgttggaacatactctttctttcattttcaggagaccgcgagaattgaagagaaagctagctagctagcggctattttcaaaacaaaaaaaacaaaacaaaaaccgcctcagctctatagcaacacgcagtacatcatattcatacgtacctacatatttgtacattatattcatacacgtacgtacctacatatttctctaatttttatgcaagaaatcgagcatgagttaactccaataaattagttcgtcaacagagtaccatcatatcgtttgcattccatgctcgatgttaagccgttagttttccttgggagagattttgatcagttggctgacgacgacaacgacagtgcgtatacggtaaaatactaatatacgtgacaaaattgttcataactatatatatatatatatatatatatatatatatatatatatatatatattgcaggattgttcataactattaatttgtagaggccggttaaatttatcatattttccaaagaaaatgtaaaaaaaaaatggtacggaattgtcgagagcttaaatagtttcctataaatattagagacagttctgaattaagttgtattggtatcatattttttatataaactttggtacttcctaaatatcctaagtactggtacctcgggtatggtaaattaaatttctcgtatcagatagctggaaagagaatgggtagaaacacacataaggatgaaaaattataatcaaagacgatgaaacgtgtagcagtacgcctatcttgtaaagaaaccatgggaattaattaattaattaattaattaagttaatcaatgacgatgaggcatatatctatgtattacccgaggcggcgtcgacgaactcgccgttgatgaagagcttggtgaacttgatctccggcaccaccaacccgccgccgccggcggccgcctttccattgccgcagtcgccggtgctccccatggacgacgaataggctcttgatctctagttaattatttgtctctaagcttcgagagatgcctatcctctacttggtcgtcgtcttgatcttcttctatctatcttatagctagctggctggatggcttcctctcaacaaggagaacagtagatctcttggacacagcagggacgactggcttgatctttatatagacgatgacgacccatcgtcccaatgcatccatcgatcgtgccaggctatattggctgtacctaggaaaagcacctcattggttggacttggcccaattcttctgttcaatttttttctccatccattatatttttatatatgtgtgtgtgttttttttactttaacaagatctttgagatgctatcaataatatttataaaaataagttgtttaaatgaaaagagttgcatagtatgttaatttgtttaatgctaagtcgagtaatattatccatatacatggttgttttttttttgctattgatagcaaaagttaaaaatatttgatttagctttatttttaaaaatgcttatattttaagatagagtgagcatttgatgtctctcatggctgttactatcaaacattaatcaatcattgtacttaacatctatcagtttcagttttgtgttataagtaaaatttttgtaacttaaatcaaatttacataaaatatgcaaacgtttacaatatcaagtttaactgaaatctactgtgaaacatgtcttgcatagtgtattcatttgggaatgtagatgttacttacttttttttccctatattttgattgaagttaaagaacttttaattcagaaaaaaactaaataaatgttacaatatggggaactttttttagaacttacaatatgtaactgaggggggtattttctaacactagcttccatgtgcagattagttaactatatggtcaacagcttcaccttaattcctgtgccaccggctgctgctattatgtagtagtagtatgtgatggttt

SEQ ID NO: 55185 - DNA, 3644 bp, Oryza sativa
  unsure (1)..(3644): unsure at all n locations
ttagttggaagtaatactgtattaatttgatatatacctttgtttctatttctgtaaatatatacagctgtattttgcgagtaattttatcacctttgaaaagataggggatatcatattttttttatataaaacatgatattcctaggtacttaatatctataggtaccaaaatttttaattttagtgtaaaatttgttacctacatgtactttctataggtactttcttaagtaccttaaaatttattttgtttatatgtagagtggtcaacctaaaatgaacggtattaaatttttgtcctttaatttgttcttgttaacgtattaatttggtggattttaggagtagtgtacttttggtcttttttttaacaaatactataaacttacaaatggttagaatatgtcgaatatactagtcctactagaagttggatttgaagttagaataggtgtaggatacagagttagaatcggattcctgtcatatgttttctttaaatagaggggagcaccacaatgtaaccatgtcgactacaatgtgcgtagacacgtcatggactcataatggcttagttgccatgttgattggggagaagcatccataatcagagctctggagatatgggcttcggttgaacctcgttgacaaatatcgtgagttcttgtgtcttcatgtaatgtgtcttgggtgatcaatgactgaagtgattgagaatgttagtcgttgttccgctatatcaactacttttataacaagtggtatcaaagccaaaggtttaagcattttgatcaagaagacatgtgaaggaggaaacacgaggtgggatcatgcatcggaaggagatcatcaatcatggcaacgagatagatggtgacaacgaggatgttgtggaggcgaagcttgtgatcaaaccagggatggcagaacgtgattggaagatgaggctggacatggccgtaggtgttctgagatatcggaggggtagtgctacgaacgacatgcctgacgcacgcggcgatcgcagatccgcgacggcgaggaggctatagaagaagggcgaagctgacgaacgtgatgcggtgcggtggatgtgcagggcagaggacgatgaggtcgtggatggtggacacgagggctgcgactgcggtacgtgcagaggcacagactaatggcatagggtgttgtcctatgcatattgcttgcacaaagtgatcacccagcaagatgtgtggtagaggtgtgtcatgtgtgcagaccagaccgagctaggtcagagctagaaggttagattgcaagcaagcaatcataccgtgggtaataggacgttcggatcaggttgaaaaaaatacccgggcaacagtgggttgaattcgttgattcgtttggcagtacaagatatatctaagatatacgggtcggcatgataggatatatgaaaatatgtgtcattaaagaggaagagcaaaggttatcgtgataacttgttcaagtgattcaaggcaatattgaattttctcaaattatcatggatttggtctacggatgcagaaaacatagatgttggattttttagctcggttcataagataataagaaagaaatggtcatgacatcaattttatgcatatacaggcgcctgggtatttgatttggatttggaaaagcaagtgttctataaaatttatggtttttggttggcttctcttaatcaatcgtttaaattaatacctatgacatgcttgatagaagacattgtccttctgacaattctgatttagcatgtgtgctctgttcaacccatgcaagagaaaccactttacatattttctttcagcgtccttttagtgctgattgctgggctcggtttggtattgtctgggacatccctctcacctttgaagatatgctagctagctacatcaagcaaagacttcctataggtcttcacattttgttgagaaagttctttatgcagcgtggaacatttggaagcaaagaaactcactaatctttaagaatatacctccattagtttcttatgggaaagctttctttaagattgatctttcgcttttagtttttatattaaatgtttctgagagacaaactctttcacaatggataaacctcttgtaaatatttttttaatttttattaataatttttttactgtggnggtttcccctacagtatttctcctcaaaaaaacaaggaagaaatggttctcttcaatagtccaatgagtttgatttgtttatttagtgatgacaagagctatctagtcatggattagataaaatcaaatttaagacagaagataaaggtgaacatggcctttgaggagtctagtatgagccggttaaggaggagttcaatttgagttggcaagatgactaagatgataggtgggaaaatggaggactactgcaggcagagtccatatgaagaaattacagggataacaaaagtctcctaattgttatattgattggggcctactacaagctatggactcgtagcggcttagttgctatattgatttgggaggagcgcgagccccggagatgtacgctttggctgaatctcgttaacaaatatcgtgtgtttctgtgtctttatctggtatgtcttggatgatcaatgactgaagcgatcgagaaggttagtcgttgttttgctatatcgactattttttacataatagggttaatacaatgaattaataagttcattttacgatcttcaactggtgaagcgtggaaattaaatttggactttaacctcgcatgattcaatcctcggaaatttcaatccagataaaacaataaaaattgactgagatctcaaaattctgaaatgagtttcttgtaataactggtaaagtaaacttccagatgggaaattccatataattgacccacaaaacttaaaaatctttcactgacgtacacaacctttttccaactttgggaactttcagggaacacacacaaacttttcggttggccttatgagacctttttagttcttaagccatgaatgtcaagagattcaccttccagaaagcgcttataaagaagaaatgggaggggcattacaatttgagcccttggatcaaagttcatcagagcaaggtgttcttttcttctgaagatgaaaattaagttttttatgcaaaacgaggtggtattaacgtatggttggttaagttttaattattgcaaacttgaaaaatagattaatatgatattttagagcaacttttatataaaaagttttcgcacgaaacgcaccgtttagcagtttgaaaagcgtaccatgaaaatcttaatattaatctaactcttgttggagaaaagaatgggacaagcagtagacaagtttaatttgatacaagatgcaacctgttgaatgcaccatatatgcacagcaaggttcaagcatgcatgcgttgatctgttctgagaaacctcctcttgttttaattaattacgtggacaataccaactggaccactggtaataccactggtaatatgaactcaacacattcacaaacatattttaaagattatattagggaatttcacattttcaccttctaaatatcaattaaagaaatgataaatcatggccact

SEQ ID NO: 55186 - DNA, 790 bp, Oryza sativa
catattactgccgagtaatagaaaaagtcaacgcaaaaaaaagtcaatgtgtcggtgtcggttagcgtttgatagtatactgtcattaacctttttcttatgggtttacgtcagatcatcagacaaagaaaaacacaccgagaaactgaaatatactgtctttattccgacaaattgatatttgatacaagcaatcaactaaccacaaatataacccaacctttcagctgtatatatagaaatgttatttttttccactgtaattaatctttctgtgctgttcatcatcagatcatagccaaggggtgttgtagagaggggtgaccaccgccttggtgtggaggtacttctcaagggcgtccatgcccatgtccttgccgaagccgctcatcttgtaccccccgaacggcacgtcggggtcgaagccgaggtagcaattgatccagattgcccctgcccggatcgaccgcgaaaccgtgttcgcgacgtcgatgttcttggtgactatgccggcagccaggccgtaccgggtgctgttcgccttctggatcgcctcctcaaccgtcctgtgcaaaaatgttcaggatccagtggtttcaggctttcagttagatgttcatgtgatgttagtcaggctggaaatgttcagaaaaagatgcctacttgaatttcatgagggccatcaccggcccgaagatttcctcttgcgcgatcgacatttcttcctgcgcaaaaggggtctattagtttttcgcacgatttggaaatgtgcattttgggctgcaggaat

SEQ ID NO: 55187 - DNA, 3748 bp, Oryza sativa
attcctgcagcccaaaccggacatatgaggtccctcgacagtatggaggacgtttttggctgacgtgacgtctaagtggcttctttgactaggtctctgtctcacgcactgacatggcgcttacatggcaatttaacccattgggcccacatgtcagttacacgcaataataataaacggcgggcccgtatggccccacatgtcattttcaatatcatctctatcctttatctctcaccccttcgttggagcagttggagcaaaggtaggcggccgccgaagcaacccgcgaagctaaatgaggtgggcagtggcgactgttccctactcctctctcacttcccctttttggcatgtgggcggcggagggtgcgactgcagagcagcggggcggggcaaagcggatgaccggcggagcggggcatgcggcggaaggaacggcggggaccagagcatgctggcggtgcggagcggaatgggtggtgagcgctccctactcctctctcccttccccttttcggcatgtgggcaatggagggcgcggcacaaagcacgcggggcgaaccggccggccggcggagcggggtgtgtggcggaaggagcggcggggactggagcatgctagcagtgcagagcggaacgagcggcgggtactccctactcctctctcccttccccttttcggcacgcggctggcggagagcggagcggccgaccgatagagtggggcgtgcggcgggcggagcggcaatggccatcggatgactgtgacaggcggggaaaagggcggcgcgcggcggccacagccgtatgaggaatcagcttggcggcggcggcgtgaacccgttgcgcgcgcgaaaggcgaccacggccgtgatcgtgccgtggctgttcgctgccctccgctcctctcaacttgacacctgtgatggctgccactgcttttcctcgttgtcgctcgatccaccgccaccagagaagggagggaaagacagggggagggagaggccgccgctggagatgggggaagccgacgaggcgagaggagaagggcagcctcgacagaggaggggtggatctgtcggcccatcccttgctcccatgctgccgccactgcttcatgggaggagaggaagagtggatctggccacccgccgccatcgcctgccgttttatttgcgatggggaaaggaggaaaggagagaaaaagagaaagagagataaaaagtcaaaaagattatactaatatgacccactatagataacttgcacggtaaagtatgtggctaacgaggttcttcatttagttggtacgagaagttcgctaaaatagcaaggcgcgctgccgttagagcatccacaatggtaaagtaaggtgctgtgagtaaaacatgtacatctcagcaatagattagattaatagtaaaccacctcaatagcatgtctacatgggtatgtctagctatctaatctattgcctcgtttttctctagagactatctccaggttagtagatagctttgttctctctcttcatttaatctcttttaagtagaaaaatatattgacattgatatcttataaagagcctatagataaccattgcgggtgcccttagatcatcaggtgtcacggccaaatcacagagctctgtccttatatagatcacacgtgctgttctcagaacgatcacaaattaacggcccggattggcccaactggcgtctagcataagatccaacgacagagatccgtcgatcacgtttccctgaaaaaaaaaaaacgatgacacgaaacgcccccaccacggccgcatctctccactctccagactggccttctcgcgaactcgccttcttcttcctcccccaaggccccaagccgcgcgacccagagcaaaagccaaaagcccgagctccacaccccccaccgcccatccgccgcgaaggcgcgaagccccgtcaccgcgcgcgcgcgcgcgcacagccatgttcgccgccgcctcgtgatcccgaaggctccccgcatccacccacccactcacccctccctcgggggggagggattcttcggccatggcggcatcggagcgggaggccgcgctcctggcccgtgtggccgcgaaccacctctacctcgggcagttcgaggccctgcgagcggcgctcctcagcctacgccgccgcgccgacccgggcctcgccgcgggattcctccgcgccgtcgtcgccgcgggcggccgcgtccccggggtgctctggtccgccccacccgcgtgcccttccccgtcccacctcgcctggctcaccgcgctcgagctcgccgccctcccgtccacccccaaccccgaggcgctccgcctcaaggccgaattcctcgtcctcctccagcacgtcgcggacgaccccgctgccaccggcgccgaggcgcgggggaccctctctaggctgctggatttgggggtggcgaggctcaagcgcgaggtggagggtggaggggaggcgggcgtcggtgctgaggaggtcgcggtctcccaggaagatctgacggggctctggggggtgttcctagacaaggccgagctgtttgacgcgctgtgttctggcgtctcgaggcaggtcgcattggacagtggtttaggcacggatgtgctcctgtggctgcggcggagcgtgcagcttgcacacctggacgcaatgaaatcacttgtagcggcaggagatctcgagggtgccactgggcatcttcgattcctttgcctcgatcatggagtggaggaggatgagtataagtaagctctattgcatatagttggaacctaaatataaatcaagttgatatttattgtggaacatctcatcatctgataggagcgaaaaattagcttcgaggtgcaaattgtgaatttagtggacatcataagttctcagcacatgcgtgaaacggtaggatcggtggtagttttagttacaatcagcatttattgtaagaataccatttgtttaacactaacatatgaatgatgtaacatgtttggttaactccattcaatatcttacagctcgattaggaaatgcatgtttgttggtgcacatctaaacatttgcatgtaaatgacttattggagtgacagtggagatgtaaatatttttagcatggtagttagtatattaaaagatatttgacttgggactatactccctccgtcccataagaaaacaacctagtaccagatgtgacacatcttagaactacaaatctagacatacctgtgttcagattcgtagtattaggatgtgtcacatccggtactaggttggttttttatgggatagagggagtacttcatgttgacagtgagctgttttggagttattgtgtaatctctgtctgattcaatggtcttgctacattattccagttgggtttgtaaactcccaccgtacacctgtcctttaacttcagttgtagcctatgtttgtattgcaaagtacactactgacggctgctttctagtcactgctgccattccattgtaatggacatgggggatttagataatataagtgtgatccataattttgcagtgcggctaactaaaaccgcaatcactaggtgctatctacttatggcaaaaaaatttttctgcaatttgtttttaatatttggtcttaacgccatcatattcatgtttgcagtttaaggttagacataaaacctgtataagtggtttcagattacatttgtt

SEQ ID NO: 55188 - DNA, 778 bp, Oryza sativa
aacttgaaacttgaacggctagctgtgcagacccccattagggtgagttctaatttatcttaaaatccgattactctgatattatttctccaccaagcattcacatggctacatttttactacacctttccatattttacattttctcttttgtcttattcatttcgtgttgagtgcagagcctttggttttgcagttgatggctcaatattcttgtgaaaccttttcttcttgtaacttccatataggtgctatttgatgttgtcccaggaataaagtttcaagatgcaattgagcttgttggtatgcagccactttcttcaacaactgcaatttggaagaggttcataaccatctctgtaatggcatttcaccaactactccatccgtttcatattataagtcgtttggctttttttctagtaaaacttctttaagtttcaccaagtttatagtaaaatatactagtattttcaacacaaaacaagcatattatcaaaatatattccatgttaggtttaatgaaactaatttgatattttagatgttgctaaatttctattaattttatcaaacttaacaaagtttgactaggaacaagtcaaacgacttcagagggagtaatatttatccttttgatttacatattcaatattgcattcttaacttctcacttattgtgttttggtccattaagatctcaccatctctgtgactctgacctgccttttgcttatctcgataatgccttaacttgtttagaagatttcttaacatt

SEQ ID NO: 55189 - DNA, 1268 bp, Oryza sativa
cggcgaaaagagggagtagaggggagagagccggagagaggaggaagaggattggatttggtcatttaataatttaagaatgacatatggtgctcacgtgggccccaccatatttattttttattgtgtagctaacatgacatgtgggacccatcatttttaaattttttttttgtttagctgacatatggatccataatttttattattttcctagacataattgccacatcaatgccacgtgggacggagacctagtcaaaccagctacgtcgacgccacgtcagccaaaaccaccgacggacctcctttgcaccggttttaacaatttagggaccggttgtatctggttttagggttcaagggcgtaaatcggattcggtgtaaaattaagagacctcagatgaacatattctctttggaaacagaaactatcaactggactggcaaaggctccatatttctcgtgcaataaagatgaatcaggagctgactgagttactacctcagttttttgatatacgaaagttaactttaaccaacaatatttattcaatttagattggcagactgtgcacaggcaaacccagatacaccaaaagtacacatgggctgtggttttgtactgccaaaaaaaattattttcattatacaaaaaaaaaacgccacattttccaactttaataagaggcaacggaactactactaattaactacaaaattttaagccacagaggaagccacaagcacctccctttgtactactagttaactacaaaattttaagccacagaggaagccacaagcacctccctttgcaaatgagccacaaaaaaggccacttgcaagaacaaatatatatagaggcatgggtgtgcacgcatgctttacatgaggaaggaaaactgtacaccatggtctttgatcttgctctcagcattctcagggcagtttcaccaaagaactacgtagtatgtcccctgatgttatcattcaccaaagaactacggagtatgtctcctgatgttaccattcttttgtgtagttctgagcactccagcatttatggggtggcacagcacatggaattacatgtactgagctaaccattgcttgcacatatcaagaacgggtaacgcatttgcatgtaatgcctaccaaacatgaaacatcagttagaacaaaatacggtgaatagaggatgaggggatattcagctacatattgcttcatttacttgtatcttttccctaaaacattactagtgg

SEQ ID NO: 55190 - DNA, 1280 bp, Oryza sativa
ccccccccccccccggccccgcgacgcgcacccgtgtcgacgtcgcaacctgcaaccaaattaaggtgatcgatcagtgccgtcgttgcccgcgcgcgcggtcgatccatccatccatccatctatatctgtatcgatcgagtacgttgatggctgtgggatttttaggtggtttggctcctgcgggcggctcgacgtacgactgagactgtatttagttgcaaattttttcaacaaactttcaacttttccattacatcataactttcatacacacgtaaaattttaaccttttcatcacatcgttctgatttcaactaaacttctaattttgatgtgaactaaacacactctgattcagatcctttatctttaaaagcaccatacatttatcattgacgggtggatgtatgagtatttatcgagctcacgtggtagtgataaagacacgtatgttttaaggtagagatgcgtacgtacgacgcggccactagggcactgcatgctcagcttcgctgatctctctgtcgcgcgcgcgcgcgttggaacaaattaggctggtggtgggggctgtgcaccggcggagtcgggccggcgccgccatacaccgcgcgcagctggaattgttatgtacgttatcgtgttactgtggctagccgctctcgtttggggcttttaacctgggaaaaccagagtttggtttccccaggttgtaggcaatgggagtcaattaaagaacgacctactcatctgttggatcgacttgccgtcgtccttggtcacccactcgatcatctgtgtcttcttctcgatcgggccgggggtaatcatcgcggggaaagcgacgcgatcctcgtctgcgcatggacacagatagtgaccggccccagcttagagcaagtttaatattatattataaccaaccactagctctaaaatatttatagctaatttaatactcttaattcatataataattgcttactgtattattaatacctagttccacatgtcatatatacattacgtattaaagtccgtactgcagctggctacagatagactgttgctcttctctcttctcttttatttctataaaatatatttatagctagctagcttataatctgagtacctgctctaaataggactggtaaattaagctactacatcgttaactcttcatgtaacgtttgactatttgttttatttaaaagtagtataatattatttattttgttacgacttgttttattatcaaataaaatataatcttaatt

SEQ ID NO: 55191 - DNA, 14899 bp, Oryza sativa
  unsure (1)..(14899): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtttgcaagtatatataagaggagttggtcagacattgccagtgtcaatagcacaatcatgcatcttatacttctcccgtacacaaatacaacaaattaaacgaagggtttaaattttttccataattaccaggaatcccatggagtactacttccacccaactattcctcatttaggtgttgtttgaatcttctgaagatgaagatgaagattaactgtttcacgcaaaacgaggtggtaatagcgtgtgctcaattgagttttaattattataaacttgaaaaacggattaatctgatattttagaacaatttttatatagaaaattttcgcacgacgaaacgcacagtttaacagtttgaaaagtgtgccatgaaaatccaaaacttcatccagtgtttgcagtggaaacaaacggggccttaattgttcatctatttttatccctaaacaccctttcgctccccatcatgggttctgtcaaggggatttcgcgagatggccgagcaatgatgtgatttgcccgcaacacttccgtaatcatgattatggagtaatacacatgataaatgatgaaactatccttgataaatgacgtttagtccattaagtagcttctaaatggggtctcccatattctttaaagtccgtgtagaaatttttgaagagtatagagcacacatcatataaacttgtactgctggtaaactccatcataaaacttgtcccatattaaacattagaaactgaatttgtcttgattgaacgttaacagagacggaggaccccatacgacagggtgggccagctggccagctagccaccagcccaaatccccaccccccaaatgtgtgtactccctcccataaaaaaatacgaatcctacaagcccgaggtaaatttagaacagatagcgaaaaattaaaatgtcctcaccaaagtacaaagtatacccattaattaacactaaaaaagacaacaaggaaattcaaagtggctctgcttccatcgccgaccctctccctccgccgcagctgcattgcatctgagcaagttctatccatccgcgcatacaaggctgcttcagttgcatacaacagcatgcatgcaaggccgcttcccacagcaatgaagccgcacaggcacactgtctcgtgcatcacatcctcccctgctatgtcgtgtgccagtagaaactccgatggctccgctgcatccggctgcatccgggccgtctccatctgtcgccgtcgctggaagcggatcaaccgtcccaaaacactgccaccgcggcaccgccacggccacatccgagcttatggctgtgtttagattggtccaaagtttaaaatttggttaaaattgaagacgatgtgaccgaaaagttgtgtatgtatgaaaggtttgatgtgatggaaagttggaagtttggaaaaaaattttggctgtgtttagttcaatccaaagtttggattttggttaaaattggagatgatgtgactgaaaagttgtgtgtgtatgacaggttgatgtgatgaaaaagtactgaagtttggatctaaattttgaatctaaacacagcctttacaactaaacacaccctatgcatccaggtcgtcgtgcaaggtcgtgaggagggtgggagggactctggctgggaacttaaccacatagcaaacaaccagctctagatttctcccattgtatctttcacggtgaacacaaaccgaggcttttcgaaacagatggtacgaatagcaaagaaataacacatggaacaaaaaattaagttaatcaaccaaaaaatttagttcccacaatatactctccatgcagccacatttgaatgagctaataggggcaaattatcgcgattactatttgtgcaacgaagatttcttttaaaaacacattattcatcactatttcctagataactgttttccaaactatctgttaactttataatatattagtttgtccctataaacaattaactatccctgacaagctgcattgtctaacaagaacaggtcccctattcagccaacgatttgatcagaaccatcgagtcatagctagtaatattttttgatcaaaagctcaatgcttgcacaagcacaagtggcactgtacgcacggtgcccatctagagacagtgtgactggatcttccaaaggggcacccactcgtgtgggagaccaattgagatcccctactgtagacgacctacatccgtgggagaccgctcggcgtggcagaggtaattcacgagagagtccgtccgcaacaatgagccttttctccttggccagcaggcacagatgtgacttgtgagccaccggaatcgtttccagagcctcccgttccgatgtactttttctgtcctaaaaaaataaaatatattagacgtaacacattctagtaatacgaatctcattctataatagattttgttttttctttgtgagatgcaagtctatcccataaaaaaatctaacttatggtaacgcagattgcgagcagagagcaccggctgccacgatactggtctatatgatctttttgtgggcagcaaactgaagcgttggacagtgttgatttgattattgtgctgaaggctaacaatgtgtttggtttttaagcgcccaccttctaggtttgcgctccctagagccaaaacatacagccttttcccttcattttatagtgaaggatgcgcttatatgcttttgcaatgaaaaaactgcatggatattaaacctcatgagtggcccatattaaaagttacgttttatacttataagttatttttgactttttcttaagtctagcttaaaagtacttcctccgtcccaaaaaaaaagacaaaccctggtttccgtgcccaacgtttgaccgtccgtcttatttgaaaaaaatatgaaaaaaattaaaaagacaagtcacgcacaaagtattaatcatgttttatcatctaacaataataaaaatatgaattataaaaaaatttcatataagacggacaatcaaagttggacacggaaatccaaggtttgtcttttttttgggacggagggagtaagtttataaaaaaacatagaaacatttttatacaaaataaacataatattaaaatatattcaacattatatttaatgaaattaatttgatgctataactattgctacattttttttatatactttatcaaatttagagaagtttgatttataaaataatcaaatcgactgaaatggagataatccttagcaaattaattatcgttaggaaggggcaattttgtccttaagaaagttatccagttactccgtctctcgatggaagcttatcccttcgccggctcggtgcaccaaatcgcgatagcagcgtcatcggcttcctccgccgcgccaaggatgtgaagcaatgatggcattctcagccttggcccttggggaaacaattggcttcaagaaggtgtgtttttacgttaaaattgaaagtttggttgaaattgaaatgatgtgacagaaaattggaagtttatgtgtgtagaaaagttttgacgtgataaaaaagttgaaagtttgaaaaaatgtttggaactaaactcggcctcaattaatgtctgctttctacaaaaggattaaattcggcccagcgttcggcagttggagccgcgcgtgggcgcggggctggcggcgctgcctcgcgtcgcgacctcaacctcccacattgatcaatcgcggccccatcttttccggaataaaacaaaccggcatattcataaataaaaaataatttgtgaaatttttttatatacgtaccaaaagtaaatgctgaaaaataaacaacgatgaagaaaatcctaaaatttaagattgaaaatttgagttttgacagataagtataaacataaagcggaaatatgtctccaaaagaacaacattgagttactatcggccaaattaacttttacttcagaccactcgtgagctttaatatccgtgcattttttttctctaagaagtatagaagcataacttttaaacaatatcataaaaaaatcaaatataaaaatattttacactaatcgtattgattagaaactcggtaaacgtgtgcatttattcattcatcaaccttcagcaatcatttcaccaaataatcttttcagttgtcactcatttagactttaatttatgaaagtattttgaacccactatcatattacaaacaaggttttaattgttatatattattatgtctcgttttcttttctcttccgattgtctcatttaaagtaatccaaatgttatattatatttttttctccaatccatttgttttcctattctccaaatcctgcattaccttggctatctgttttggcattaggaaagcacgagggaccacctggggacgtggtgcaacaggttggtcattagagaagcctaagaaggagcctcttattttggaggacgagacttctctgatcgtaaaataagaagtacatgaccattggcgtgtgagcctatgaatgtgggccccacctatcagggacccatgttcctttaactttacgtcagatgagctcggtccctcttataaaggttgcacaaaacaagttccagactcctcctgttcccatattcacacacctgttcgtcaggggttaactcttaactgaaggcagcatggcagaccagaagctggactcacatctcacaatgtgaatggagaacactattcttctcaaagtcatagggccaccatattgcgctcaatctcacgatattttgtttctaggagtagctagcacgggaaccaccattgcccggttgctcgctccatatgatattttaattttttggatgagagctcactccatatgtttgcaaggccaacctttatttatggcagtcaagtagtttgtttgttgttttcttgagagctcggtcatagtagtttgatgtactcaatgactatagatgaagaggaaatgtctggtgctctattttacagtgataatatttaaagttgtattagaataaatgtcgaatatattagccctaatagatccattacaattggacttagagttataatagatggtaggcttaacaatagaagactttttctgtccttttcccaatgttatgcttagcagtcacagatctctgctagtaacctaaacccacactagcgccacagagcaatcacgcatatgacggtgctaattaattcgttaaattcatcgcgatatttttatctgctgcagttgtgctgtgagtttgatcaaccatcattgctgggactcgtcgtaccagctctccaccatccggtgacccctgcctggctgctgctcgtcggcgccgatcctcagatgatcgccgcagccattttacgacgcatgtatcgctgctcgacgggattcgccgttcctcctcgagcagcaggcgtccaggagagcgacacgacggtatcggatgatttccaaaggcagcgtcccattcccatcgatctgaggcacgagcatcagttgccggccgtgctacctagctaagtagtcggtcgatcggacagtgtgtgttgaggcgatcgatggctagctagctccagaatgaatgcatgcgtcagatgaggagcaaacgatcgagtgtgtgtttcttctgccgttttgttctaaccttccaggcctgcactgcctgtacagtactcctggaaacaacacacagctagctagcttgtgtgttacattcattttatagtgaaggagttatatcatcttgaaacagagtaatgcgtgaaactgctcctacatctgagtacatggggccttgggctcttgcacccaatatatgattgattatatataggccacgtttggtataattctggatcccagatttcttagagctgatcagtattcccagttttataaatctatatatttgaatatacgactaagttgataacatttagatgattcattttgtttttaatttaaatgaaatataaaattttaaaccactgtagtttgcgtacaaacttcaaatcctacgtggatttaggatctggagctatgccataatctgggctttcactgatggagaagtggtttttactcccagttcgtaatcccctatagtcctggttttccaaccgggactaaatatcgctatctttagtcccgggtgaaataactgggagtaaaaatacatttttagtcccgaaagataaagccaggctagatccggttgctcatttattttttttcttcattgtttttaatatattaatttcactccatccccgtccccaaaatcacaaatcaattatccccgaatcgtaaaatctcaaatcgattagggatcgattatcacctccaaattctcaaatcgatcatctccaaatacatcacaaaatctttaaaaaattacatcacaacttctaaaaaattcatcataaatacatcacacacaaatcaaatacatcttagatccgaatcacaaattctcaaaaaaaaagaaaataacctaaatacggtgcctacgccctctgccgcgtcggccgccccctcgccggctgctagcgcgccgcccgccgccacgccgccgcctgcagatcagaagtggggaggagggggagggagaggagaaggagagaaagagatagggtgtgaggagaggagatagaaccgggaagaaggaggagatatgtacctcgatccgatccgcgcgcacgcctctccgcgtatgtcgatcttttttcggtaacaccaatcagaactacaaataaatctttagtcatggttggtaacaccaacaaggagtaaagaaaatatagggggtctgacaccgcctgtcctcttttgaactgggactaaaaatgatcttgactaaagatcaaaaagtacccctgaacttataagccgggactaaaggtgctttttagtcccggtttttaatacaaccaggactattgtgaaatctggtcgaccgaccaaagatggtctactcagcaattttctttctccttttttttttgttgcataatacaaccgtttacctactgatttgttttttaataatgaaagtgtgttgcatccctggcttatatgtcatagggcacctaaccacctagcgactgaacaatgaaaaaggtatattctgacttcaatgatcaggatgcaaattggaaagttaaattgccgggtagcattagaatggggcccagacgcccagtactattgaaaattcatccgatccgcttcagcatattttcatcagtttgcccagtagtactattgaaatttgtgactcatatatacatgttttaatttagcctggtttaataattcacaatcgatggtgtatgagcaatgaacgcgtgcttagaggcttggtcacttaatgctcccgaatcaaacattccatgaatccatgccaaagaaccgagtgctggcctaattaaaagtcatggatacattgctccatggtcagtacatgtgaaaaacttgcagactaaaactttagttcaaaaaacgactgaacgataaaagagtccacatcattgtgctttgattttgttttctcctcatgctatcctagctacaattcatctttccttaaatttgtaaacaatacgaagtttgctccacttagaactcaaccactgaaacgtctgtaaattaaattagcgatcttgacaaattcacgagtatatgtgtccatcaatggcgagctccatggactaattcccatgggagacaaagtcggcgcagcatgtggaactccggcaaccgtcccgtgcgtgggagtggcagagactccggcctccggctcgatccaggtattacaactggagctggtacttgatcgagaatgctgtactcgtccatggcaagaataatcagcgcggggggcactatcagttcgtcacacaggtgagaaaaaatgcttgttgaaatgcacttgatagtgcagtggtaaggggtgtgtgattttaaccccgaggttacatgtttagttctcaacatatttacaatttttttttaaaaaatatttggaaagatgtctctccctccaaatctcgattttttgagaagaaactacttgtcagggagaccagttcgttcccaccatcatcattcccagtgcttctcattctcacatacatagccgcggcgttaatatttggtagaaaagtaagagaataaccaaagcgttaacatttggtgaaattcgaaagaacatttggagcgagcaccaacacatggagctgatgagatgtagacatctgcacacttgtgcttttatgccaatgttgtgtcgtgaatgcctctgtatttaatttccactcctcattcctcgcagcccttttgcttcatttaatttagggtgtgtttagttcacaccaaaattgaaaatttggttgaaattagaacaatgttcaacaaaccaataaagctactatgagtaataggaccggtggccccttacctaaagctttattgaaaatttggttgaaattattgtgggtccgattaatgtgagaatttctaggctatgagagcgaatgtgtaggctcctttttctattcctttaataatataatagatagatggaatataacatcccggcctttgctaaaaaaagctacaacccaatattacagtctagcactcaaaataagtgtagtccaaaaataatatcaaccagcatataaagataaaaatatccaataaaatatatggagaacacattattgaagtctatttatgaatctccatccataattggtaaaaagctacataaccatcgactcaagctttctgcatgcaacttttaaaagatctatcagatccattttgtttaataccaaacttgtcttgccattttttctagttgcttcaacaatacttgctagctactatagccgttggcttttcacataacatttgatcattcattttattttaaaatttattataatatgtaaaaatatatgttaagattatagtttcttttatgataaaaaaattcacaaaaaataaatgatatttctatatttttaataagatgaatgatcaaacgtcacatcaaaagttaacggtgtcatacattaaaaaacagagtgtatatttgtattacaaccaatactaaaccataccaatatggttgatacaaaccggcccttagcactctttttttagttttgtcccaagtcaagtttgaccatttttatagagaaatatcaacgtttacaatattaaattagttttattaaatgcatcattaaatatgtattttatagtatatttgtttttaatttagaaatattgctaactcctataaatttaatcgaacttaaagaatttaacttaaaacaaacccaacatgttagaaaggaggaaagcacacaaaacttgttacgtgatacacatatacaagtttttagccaagctatatatgacctattccaacctttgatccaggctccaatccaaacaaatgtagtggctccaatcgatccctcagtcaatattgggctggtgcaggaagatgcagacggccccaagtagcctcttgatgctactccaatcaatgctatggcaattcacaaaagaacgttgcaaagcctaactctacagtcgatcggactgcgctcagatcattcccaaagtctcccaatctcaaaacagaaaaatattgatcaaaagcccgggtaatgtttaacagaatataatgccaaagagcgagcaacagatcgatgctggtgatgatatatcttacagtgcttcacttctgcttttatgcttaggatgtgttgtttggtgttgcttcatatcttctactcttttggagccaggacatcctctagttgcttaatctctcctctaatcaaaggtcctatacttctatttatggagatatatatggagtaactagctagatagttgtactttgagcatacatttgattgattattgacactagcagatttttagatgagactcatgcatatataggagggtaggattggttgtggtattaattaattcctaaatatacagattaacatatgttgaagttttgaatatttcgcatgaaacattttcatacatatatacatacactactgatccatcttatctaaagaaaatacactactgatgcatatttccttttaattttgaaacatttttgcaatggttgtatttgaaaaaatttgcaacccgaagtgcatgttcaacagtagcgagctctctatagtgttaaattatctatagtctacaccatacatgtccaggctgaacagagtcagcacggaggagaaactaatcctgctcggaccttgcgagccagcactccgtgcaaggttgcaggctacgccaggtgcaagaacgattggaaggtagatgttgcaattcagcaaaaagttttgtttaagacttcggcaaactgcagtttgccatgatgtccttcctgcagatgatcattctcaaagcttttcattctcacatatacttgtcagcattgacttagtgggtgatatatatgtatggagcgaggcagcgagcaacacgtctagcttgatggtaatgttatgtggtgaatgcctttatattttgcacgagtttccccgcctgaatagctttcattcagctttgtagaaaaggtaaattacacatggtagtactgctagggaagtaggaacacaacattcagagagtttgtagaggggtggaaattagatatctttcaattatgatatacaatataacattctccaggctttaggagctcagttacctaggttgagtcttctatacattgttctaagatacgtcgtagtgagggtgccaccgtccaaaagacaacatcatgtttgtgattggaaagcctccaaaaagtagaatcgtatgagtgatatgaaacgttttgctgaatttgtaggagaaatggttaccattgcaatttttctattgaggggattcccttaatgttttgttgtcatctgtgtctttgtcgagtctttgtggagggtttgttttctaagcctatcaggctggcgcaaatttcttgtatatactttgcttatgatttttttctttttaatgatttgacataactcctttcttatgttaaagaaaatgttgagggcttgttatttctctcctcgaatatatgaaatggcagagctcctgtctgttccctcgaaaaaaaagaaagacatgatgaacagatgatttgcattttcttaaccttgtatgcaaattggacaatataaatgatattttgctgccatgatgtgatgatgtccttttactaaaggtcctattacatttatatatggagaaacaaagtcacgcgtatataaaatgtacttttgtaaaatttaagagtaacgagctctaaatattttgttcaaaacattttggtattcttgaacccttgtagccttctagttttgcagtgatcatggcaacacatattttcagcggcactgaatgattttttttttgaataaatcgaagagcatcaatttcattgaatggagcaggaaacggcactgaaatatcaagaacactggaactttttttggtgctggtaccctggttgagattccacatgcttcccatttctacagccacttgagtaatagtatgggtcctctcttcctcttcttattttcattcccaaatatggagtgaaggaaaatagcaaggaactgagcagcttgccggtatatatgatattgatatatataactcaccatgcatcatgtaggtagtgatagccatagactataaatgacataccaacaagaaacataaagagcattcccaaatcaggaacacacatgacatgattttgatggttagcacttaactttgtagtaagcatagttaacagtaaccaagttatgtaatgtcgttgggctagactatgaggctagtgggcctgttcgtctgcctgtgctgcggctgcggtgcagccggcaccaacggtgccacacacacatggcgcagccgcagccgccgcagatagacagccgaataggcccagtatttgttatcttaaaaataaataaaagaagataggtgctacggagttgtgttgctttggatagacgtgtgatagtgcgagcctagctttgccttgctagttttccggcagctggtaggtcttgccttcgttacaacttgactatgaagtcatacaaccagcggtggagcgaggcccagcaaatcctaggttgatgcgacactgctcaagcgggtggtagaatatgcaagcccctttcaacgcaagaagtagaaggtgagggcttcgttcttgatgccagtgcaatcgatactcctggtccatggctgtagcaatttaccacacaatgttgcaaatcctacacctacaactacccgttctgcattggaattattcccgaagccttccattctcatgctcgtcgaagaatttgactttcatactagtgggaagagaaggagaagaacaatcaaaagggctaggtaatatttcacaggatgtctggagtgagaaccgtatatataatacaacacaacccatctgcagtatagtatgtctatatatatcctactacattttctcacttatgtaatgtgctaattaaagatgtgttgttggtgttgccttatatcttccactctgtagagccaagattatccccgtttacttcttttattgtacaaaagtaactgcatcattgtacaaaagtaactgcatcgtttggttcttgccagtcctcgaggtggtaccattcgcttggccagctcttgccactccttctagcgagacaactatatttccgtgtttttgtttttaaaaagggtatattcttgcaaaacacgtgagaaaataatatattttcagaaaaaaaaaagtgctacataccaaacatccatgtatgatgcatgagtaaaattttactccctgtgtgtttgtaaaactgaatatatccacaagtacagtttgactaagacatgatatactacagcataatagcacacgatacatgtggtttagcactatgtaccatgcatttaacgcttgcttctaggaaagtactacaagaccattcactccgagcaagtgtaccaatttactatttagctaacaagctagtttcaaacaaattaatagagctaaatcaagtaagaaaattctataaagtttttatattccaagtaaggacctctaagaattctcaagttttgaatggagcacaatcaaccagtgaccctatgtcacggaagatggcacgccatgttccaacctttgactgtggctccaatcaataatgcagttagtggttccaatcaattcctcagtcaacaaaccagtttcaggaaggagaagagggcgccaagtagcttcttgattccagtcttatcaatgctatggctattcactaaagaatgatgcaaagcctatatatacaactatccaaccagcactgaaaccattcccaaagccttccattctcatgttcgtcagagaactagaatttcaaaattagtgggaagagaaggataagatcataacaaccaaaagggctaggtaatatttgataggatgtatggagtgagcaacatgtacgggagatgacatcctaggtattgtactttcacttattctttttgctaacgttgtgttggtggtgttgccttcatatctttcactccatggagccaagacaatcccctttttcttcatttattgtacaacaatagctgcacccttttgttgctcaccattatttcctcaatattaaaaggcatatactcctaaccatagaaaaataaaggcatgcataaactctgtggttgtgcaggtagctaggcccattggttcttggtagtaactaaaacataatgaagccacacattgcaagtgttacatgccttcgtatgcgtgtctttcactagcagattattaggacaaggataatacatatatagtacggtaggattggctagcacggtgtattaattcctaatagtatacatgctaacacatattaagaatagtttgctcgaaatatttgaataaacattgatcctgattgccttttaattttgaattggacaacggttgtaaagtgtacttggggaagaaagttcaatggcacaggaagtcgtccgacactaaggagcggtagggacaaattggtgcccctcgtgccgttgaatgagagggaaatctccatcgaagctgaacagaagtgagaaatggctgccgctctgacctccatgtttgctagctcttagctgcggtcacactgaacaagatcgaggaagagatcaaggagcttgccattaagattgattagtatccaataggcatcacaattggagaatccaatattacaaaattttcttccatgtttaatgcttgtaattctgttgagattccacatgcctcctatttcccattggccacgttgagaaatagtactctgtgttatcttccactacctaagcaatgagtacaactatacacaagatgatataaatgtaagtcattgtgcatatcttgtagttgtagccagtgatgggtggagtcatgg

SEQ ID NO: 55192 - DNA, 10858 bp, Oryza sativa
agctattgtgttggatttctttataaattgcaaaaccagaagttgccattaccagtttatttgacctcctcaagcggttttgacaatggttttattagacctgatggctacgtagcgttactattgaaaatatattttaaaaaaaacaatgtgacccataatttggctgccatgtagatctaatactcgcaagcaactggtacatgggctttacccgcaaaaaaatcattgaggtttcatctctgggcaattagcacggctgcagcggtatcctgtcctatggcgaagatcaccattcactagtgaactagcaaatgagttgttcccttgtttaatgtgaagatgaaaattctgccccgaaagatgtgtagtgaaactgtaaaaataaatttcttttgcacttcaattgttccactgtaagatgcggtcaaatttgacattgttttcaaaactaacatgtgacttaacatctcatatatgataatatttgtagcgacgaaatcataaagattggaaaaaaattgaagtgtcaaacccaatcatattttgttcgttgaataaaaattaatttatattagactaattaatggtcaaatatatcgagcgttgaacattaaaatacatgtttgtcttaatctatgggatggatggagtataaacttgtagatacaagcataaaattaaaaccattatatcataccaatgaaatgtatatcttatagaacatccctgactccctgtacaatgtgggagtaaaatttttactcactgtgttcgagtaaaacattatatatcacgtgctgcatgtgattcagaacgtccatgtataaaacacactaacattaataaggcatgcttcttgaaaagtacagcaagaacattttactccgggaaagtgtaccaactatttggcttgctaatttcaaatgaattgaactaaaatccggtgaaaatccaatgaatttctgttccaagtggaacacacaatcaaccaacgaccacgaaatcactggagaagaccatgctctgtccctacctttgtctatggcttcaatcagaaccggtaagctagtggctctaaccgatccctcagtgcataacatagtacaatcggcgctgaaggctcgttccaggaaggagcagaggtcacttacgagtgttttgatgctggcctgaacatttcacctggtccgtggctgtagcaatccacccagcaatgttgcaaaacttacacccatattcaactcgacagcactgagatcattcaattcccaaagcctcccattctcacgaaaggagaataataaccaagagaggctgggtaatatttaaaaaatacattgcagtagagcaagtaacaaatgtgggtgtgcttcacttcggctttatgctaacaatgtgttgtttggtgttgacttcctatcttccactccttgagccaatacagttcccattttcttcatttattgtaaaaaggacctgcaccctctggttccttgatctcctatatatcaaaagttcatatactgagaaacaaagatatgcatatgctattgccgatgtttagataaggctatgagctcttacatggtagtagctacaacataattaagccacaaattgcaatagtacagcctagatagttgtacttttgtgcttgtttctgccttcatgtgtgtatcagcctagtaggctgaatattagaccttttttttttcaaaactacgtgcaaacaaagacgctcatataaacatatgcccactcactcctttgaacatacacatatacatcttatccttatgagttcatccgaaaactagactgttatattttgaaattgataaagtcaccgcggatgtcttactatcgaggggtactatgtcatctactaccgtagcaaattattaggataggactagtgcatatatagaaagggtaggattggctccagtaatttctaaatatacaggccaaatagaggttaaagtactaaatattttacacgagacattttgccgcacactcaccttcttgtcgtcttattttgaagtggacatagtgatttgttttcagtagtttgtattcggaagaagaaaatacacaatgccacatgaagttaacactaatagaaagggcagtaatgtttaatggagaggaggaatcgaagtcgggcagctctcctttgtgcaaagcttgccgcactacagtatgggagtggggaagtatctccaccgaagctgaatggaagttaggcccgtttagcaaggctctacgttatatctctcgtggagctagagataaactagatcaaccgattttagctcattcgaaaaaagaagcggagtatgctagagtgatatttaaaaaataaactagaggggtcgagtgagattcgagtcgtttcatagctccacatcaaattctacttttggatttagatttaagagttgaagcctgccaaacgggccccaagaatggcaatagctctgacctgtatgttgcaagctcatgatgggctgaatgcctgaatgagatggtgtgccgcgttcctcgtaactactacctcgctcatctcaactacttcaagggaaaaattttcgcctttaacatggtcgcccttagtgtactggcctccgtctaatataaggaccatcaccatttcggtgcgacttgtgaaccagtgagtcgctccgttgtttaatgtggagatggaaccttttttaaccaaaaaatgtgcagcgaaacaacaattttcctactttcttcacccgtaaaaagtaaaacttgtagcccaggtacaactgtgtaaattactgtacatttaacgcatacttcttgagaaagtacaccaccagcatttcgatcactccgtgcaagtgtacaaattgtacaaactatattagcagcctaagaattttcacgagcaagcatgcatgcatatacgttgatcaatcctgtgtccaaccaatcacacactgcaaggagacgcacggcgatctctcaacgactccctgatgtgtgagatgaatccgtgtgattctcacaagccctctcgtggagaagctcctgcagatgcgcgttcctggccatctcctcctccacctccgtgctcagctcctgcaccctcttctccagctccctcacgtacccaaccagcatctcctccctccccgccgtctcgccgccgcctccgccatcgccttctagcacctgcatcaccatgtccctctgcatctccaagctccccaagatggtcaccaggtggggaaccgccacgtcgcttgagccatcgttgccatcctgcctccgccgctgttcttgctcgtgctcgaccatgtcgtcgtcgttgtcgtggtggaaggggaagcatggctgctgctgctgctgctccggtggcttgtcggtggggtcgagctcgaagctctcctcgttgaagttccagccgctgatgcgtcggttcttggcggcgacgacgttgctgccgctgctggcgtggcggcacggggagacgcagcgcgcgccgcgggcgcagccgcagagctgggtggagtccctgcacctctcctcgacggtggggacggcgtcgagcacgttgcggacgaggtagtcgtagtccctggagcggcaccccttgaagaacgggtggcggaggagcttctccgccgacggccgcttcgccggctcctggcacaggcacgacgacaccatgtccttgaacgccttggagaacttcttcttcttcctcgccgccgacgacgagccctcggaggaggaggaggaggcgtcgacctcgaggcggacgcggctggtgatccgcatcagcatcgacttggacggcggcaggtgggagagcggcggccggccgtgcgcgagctccagcgccgtgatgccgaacgaccagatgtcggccttgatgccgtacccgacgtgggagtggatcacctccggcgccatccagtacggcgtcccggccatgtcgttgaagcacgacgagctcagcgccgcccccgacggcggcggcgcgtggtttatcgggccggagaacgcggacgacgtcgatggcgcggtctcgtagatggacgcggacacgccgaagtcggcgagcttgaccgacccgtcggagtcgacgaggatgttgccggccttgatgtcgcggtggatgcggccctgctcgtgcaggtagcacagcgcgcggagcgtgtccctgagcacgacggcgatgcactgctccggcaggccgtcggggaagccgtgggagaggatggagtggagcgagccggcggccatgaacggcatgaccacccagaggtggctaccgacggtgaaggagcagtgcgcgcggagcacgttgcggtgcgacagcagcgccatggccttcgcctcgcgccacacctcgtccaggttggcgcgcgaccgctccaggtcgatcgccttgatggccaccaccgccgaccccagcggcacgcacgccgccttgtacaccaccgcgctcacgccgctcccgatcttgcacagcagccggtacgacccggcgtcgagcgggtacctcgcctgctgatggtgatggtggtcgtcgcctccaactgatccggccgcggccgccatggctggcggcagcggcggccggagcaaggacagaagttgtagcatcagtcggtctcgcatagcggcggtgtcacgtacgagagagacgatgactaattaatatacggcgcgaacgtgtaacgagcggcggctcgtgatcgtcgttagctgctaatcatctcaggcgagagctgaggtggttgttcggtttaattagcaccgtgcgtgcatgtgaagaggtggtaaaaaggcaaggcgcgtagcgattcgggtggcggtgtcacgaagagctgggggaatctcgtgaagctttggatagttagttggtgttaattatggtgtgtgattgtgaatgcgacgaacgggccaggcaccactgtacactacaccagcgtccagtgaccgatgatgatgtctgtccatttgtggataattgttttactttctccccgtcctaaatacatgatctgttccaaaacttacgaagtggtgccatgaagtggtgtcatttatatccgtgaatctaaaaattatatatttagatccgtgaatttggtttagtgtactatatatccccaattaatccaattgtctttcgaccgcggctgactgtcaccgtggcaccacacgcaagtaacatctttgtgcttagcccgttctgcatatactttctcgcataacttaacctgaccaataacctgaatccttcaaaatatcccaatcaactagggtttcgacagcgatgttagcaacggaaccgggcaggcggcgaggtagcggctgtggcagccaagtgcacgcagtgaggttagcggcgagaggcagcgcagtgcgatggcgcagtgcagcccggttaaaggcagtaggcggcgcagtgtggttttgcatgctcggcatcccatgtattctccaatacagtcgctggaagaagctatcgttgatcaagtgctcgtcgtgtaaagagaagaccatcgtggatcgcacaatgatgacgatggagatagtttcactatgatagaaggtgttagtccttgcggttgctggcataaaaggtactccttgtttttcatgtcttaaatactctagtcataaaaaaaaattagaaaaatcataagattaacttaatgcgcgagatatcttaattcgcaagaaatcaatatttaacttttagaattgtagaaaaaagaacaaattaaagtccatagttatgtttgttatttttgttacaagttatagaagttaaatttggatttacatgcttgtaatgtgacatatcacatactacctccttttcaaaatgtacgatatcgttgacttttcacgtaacatttgaccattcatcttatttaaaaatttaatataaatatgtaaaagtataagttaatattatatttgtatttgatgataaaacaagttacaacaaaataaataatatttatttttttaatgcgatgaatgatcaaaagtcaatgtcgtcgtacatttttaaataaagggagtattaatctatcataataatttgtttttaattttttaataactatttaaatgatatgtaaaaaagaaagggatattaatgcgaggggaaaaggatacttcacaaaaaaaaattatttgttttgtgggatacataaaaggacattattttagatacctgataaataaagaatacgaagagaagctttctccaatgacagatgtggtacataaaaaaagcaaaacgcacgtcagtttttcatagggatacactaccacactttgaagcaagcctaaggatgcgtatattttctgtcagtcccgcaaaggactcacagaaaattatattctgtcggtgcacccacagggatatattttctgacggtaaaaccaatttttccgtggatttcgctcctacatagtaggtcgagtctggtagtggaacttgtgtcgtgtgtatgatttgaaaccaagatgacttatcgtagcaaatattggtgcgttcgacaactttcacagcattttgcagcagcacgcataattaagataaacctttaatcgagtaagtaattattaaaaaattaaaaatgatattatttgatttttttttaaaaaaaacgttcatatattaaaattattgtacaaaatataccatttaacagtttgaaaacatattaagggaaaacgagaaagtagacatttaaagttgatgaaaaaaacttagctccagttttacactgattaaagtgccacgtaggcatgcacaggtaggcgtcacgttggcaacataatactcaccgtgccaagattgtgaggagcggaggaggaggatgcagcggttgggcagcacgacggcgagcgttgccgcggcctcccgccggccaccggcgtcgagggagtggagagaatggacgtcgagcggcggcggcatgaagggagccgtgccgtcgcgcgtccctcctcctcgccgcagctcatccaatgccgccgtcgcagcgtcgtccctgacgtggatcgatcggctccccaggcggaggcgtccggcaatcctggatctgacatttggtgggtggcgcccggcaacagaattattcccggccgttgctggcgtccgggtggccagccagacctcagttccagagcccgacgactgatgggctgattacttgaggtggtgttcggacgaaaacgctaatccgcgaccggtcgcgcatcgcgcgcggagaggagcggcggacggcgcgtgtacggtattcccttttttttgttttttttttcttccggcgcgtgtacggtttcttttttttttcgttttttctgttttcttccgtatttttggtttctttttccttggttttcgtttttttgttttcttccctatttttggtttctttttcttttttttcttttttatcgttttcagttttttcggtttttataaagtttgtatacgtgtatataaagtttgtatacgtgtacataaagtttgtatacgtgtatttttttatttttttaatttacgtatacaaagtttgtatccacatatataaagtttatatacatgtatacaaagtttatatacagtacataaagtttgtatacgtgtatacgaatatacgtgatgttttttttagttttttatattttttaatatgtacgtatacaaagtttgtacacgttgtatataaagtctgtatacatcatatataaagtttagacactactttagactagtcgcgcattagccccccccccggtgtttggatccagagacttaactttagaccctgtatttagacattaatttagagtattaaatatagactacttacaaaactaattatataaatgaaagctaattcgcgagacaaattttttaagcctaattaatccataattagagaatgtttatcgtagcatcacataggctaatcatggattaattatgcttaatagattcgtctcgcgaattaatccaagattatagatgggttttattaatagtctacgtttaatatttataattagtgttcaaacatccgatgtgatagggacttaaaagttttagtcccatcaaaatagggtcttatctccaatttttttttagagagagagagagaggatttagtgaatcttttcattgaaattcagcggagtaaacagtggagtcagcaagggccgtatcttttcagcagtttcacttgcaggcggtcctacagtggagatgcaattggtggaccaactgtgggtgatcagaaggaggtgctggaagtctttagtaattcctgtttagcgtccaaactttgcctctttgtcatttggcgtgatttagagcttaacctcagttatctattgcaatcttctctttttttaaaaaaaagggcttatctaatgtaatcaattcaaactctttaaaggccatgctggtctagaagaagcacactactacataaataatctttccaaacggctaaaatgccgcctacacccagatgtctatagggataaggatttctccgtacgagcattataactgatcacgaaaatggaattttcaaaggcgggcatattatgcggcccgactaaaaaagatttttaaacaaaataaataatcataaactctaggtcccaaaggcgtcttccacgcgtcgcgtctagatccaccattgtcatcgctcgaggccgccactgccaccatcgtcgcgcccgaagccaccggtgtcattgtcgctccaaagatctccagtggcggagctgtcttcccgaggccgagagcggtggataggcctctcctgacactggcattgaccgctcccgagccattgggtccgctgtcatccctaccgaactcccacagccgctgccatccccgtgtgctcctcccaaactccccttcgttgtcgccctccccacgactggatgtacccctttcgaggccatggcggtggatctgtccttctagtggctgccgtcaccgctgctttcaccacctccggagcacctaacactgctgcggccttcaccacctcccagagcgcttgacgccgccaccgccttcgcctcctccaccacccaatgcgctgaccgctgcctccgcccgaagcaccactgcctgaaccatgaagtggaggaaggtggagtcgggggaggagaggagacgacgaggacttataatatttaagagagaggggattggcaggcagcttagtggcagacagggcctgttaagaggcccgcttgaaaaaaaattgatttttgcatacgggtttgctgccaccaaattcaggtgtttttgacttgatcagttggttggtgggcgggattgaggccatgctatcttcatttcctgacaaaaaagattatgtcaactgatgtaaacaggaaagaatggtactgtagatcagaaaaggatcatctcacactttggctgatcatcttttctagaaaaccatgtatagctatatgcagagctatgaaacaaaaataagttgtactttgcaagctaaggtatgaaataaaatgctccctatttaggccaacatgtcattgaactatactgataaaatgatctccgcaatgctatttagtatccaaaacaaagtttagctatatccatttgagtttttatctccacaagattcatccaccaacgtctagatatcatgcacgtgcacttgaatcttgcatcatgcattatttacagaggtaagtcaaattaatagctgcatcgataaatttttagcatttatgtcaattgagagtgaaagtgaaacaatacctcggagaggtactgtccccgtgtgcgagcttcatttccaaatcattctctcaagcagcttttctgcgggcagcataattttagtaagaaattaagctgagataaattgattgagcataattttgctgaaaacaggaaaacaaaaaaggaaactagctattcttgctgatttgttttcctctctcccactatagcacctgttattcaagtattatatgcctgtgaagaaaattgttactttcaagtgcatgagtatatggctatcctctaaacggaagtgatttaaaaggtacactacagcaatatataaggcatggcaactgggcagtaactggattttgactctttctttaagtaaaactagcacggtggcccgcgcagattgcgcggctagcatcattatattttctctcatataatagcatatatgttttcttattatattattaaaatatattacaatgataacataattttaaattttgcaataacttttcaaaactactaatgtgtaataactactctagtctcctcttctaatattccttatttttttaattctgaatttcagctatttctaaattgtatttctatatgtactttgctttttcttgttctctgattaatgtgagaatttctaggccatgagagcgaacgtggaggctcctttttattccgaattttagttggttttaaattccaatatgaactatatactctacttctaatattccttattttttaattccaaatttctattttttttcttaattgtatttctatatggactctatactctacttctaatatttcttatttttaattccgaatttcggttatttcctaattgtatttctatatggattctatactctatttataatatttcttatttttaattccgaactttagttatttcctaattgtatttctatatggactctagtctcctcttttaatattccttatttttaattccgaatttcaattatttctaaattgtatttctatatggactct

SEQ ID NO: 55193 - DNA, 8714 bp, Oryza sativa
  unsure (1)..(8714): unsure at all n locations
ctcctcttttaatatttcttattttttaattccgaatttcaactatttctaaagtgtatttctatatggactctgctttttctttttctccgattaatgtgagaatttctaggtcattagagcgaacgtggaggctctttttttccgaattttagttagtttaaattcctatatggaatctataccctacttctaatatttcttattttttaattctgaatttcttttttttcttaattgtatttctatatggactctgtactctacttctaatatttcttatttttaattcagaatttctattatttcctaattgtatttctatatggactctatactctacttctaatattccttatttttaattcgaatttctattatttcctaattgtatttctatatggactctatactcctcttctaatattccttatttttaaattccgaatttcaactatttctaaattgtatttctatatagactagtctcctcttctaatattccttattttttaattccgaatttcagctatttctaaattgtatttatatatgaactctgttttttactttttctccgattaatgtgagaatttctaggccatgagagcgaacgtggaggctcctttttctattcctttaattatataatagattctacctatgaacagagagacagggataaaccaacatttatgttaaatatataatatattaaagatattttccctgggtttcatctaggactcactctggccaaagaggaactaaaatattcagttagatgactaataagaacaaaaattcaatcatgtaaacaaaaaggcttcgctagcaatatagatatgctggtaccatagcttacttttcaaaatagtggcagcagatttaatctgagataaggacatactgatatacagagctctgaaacaatcaatgaaaaaaaatccatgagtccacgacccaaaagctgactgtgcacttggaaaataataaatagaatattgtaaaccacagtattaacagtatatgatacctaaaggtttaactaaaactatttatgttcattctggatcatatgaagaggtcaaaatggcttaaatgaatttttattcctcaaagtatatgaaaaagtataagcataatccctgtgcgctgacaaatcttaaaatttgacatcagacactgtagggggaaaagaggagaaattggtataaagttctctgtaggggaaggggcccaaaggatggctggcttaatgctacgaattgagtaatttgtggtaactacctttcctgagatataaacagctattgagcagataaaaacacattgacagttaaatatagaacatggatactgatgatcaaaaaaacctctacctgaagtgactttgatgtcataatatgtggttctttgcccaacttgtttttgtgtttctcataacccctaggaaggctgttgggatcatgtgaaaagaaaatatccacattgtaaaaaccagtaaagccaatcatatcatcttcatcttcagtgtatctgaaaatatcaacaaaagcattaaagcagatcgcatgttaaaacctagccaccaagcaaaccaggacaagaagaaattcttgagaatttaaactaacagagtctgaagtgaaacaatacaaagaatatatgtgcttgctgcaattcttccaaattcaatcaaggaagcgaagtaacagagtgagtctgaagtcaaacgatgaaaagaattatctgtgcttgttgcaaatgttgttaattgtgctttatagtaacgtaccttgtggatgtagatggaacagccgaggtggtcgaagaagacgtgatcaggcggcgcaccggtgggcgcaaacaagaagggtagttgtccgatgggggagcagcacgcaggatcgggagacgagcgagccagtcgtccgctgcggcctgcggctgcggcgacgcagagcgcggcgcatgcgaggtccggtcaccggttgggttgttggcgacgctggtgtcgagccgcccgcccgacatgctgctgcttcgttccctcccggggtcgcgccccccgcgccgtcgagcgactcgtgcagtaccatccgtcccatgtcgctggggattgaggtggcgcagtagcagctgggggcggccttgccggcggtgaggtcgggagaaggaagatcgaggagaaggggttggggggcgttgaatgcgtgatttancgaatccaaaggttagtgtttttttgtttaaagggtagtatatcattgtagaatgcagagtctttgaaaatgaatgaaaaatatacatgcacaaacacagaaaatgcaactgatttgagaagattcattcaccaacattattgtatatgaaaaggaaatttctcaacaagctattccatatagatagcagttaatcaggggctacaaattaacctcttccttgccccctcctatccatccgtgccctaatctgctgaatatgttggtcatctaagattggtagggagcatttcttaggtctaggccaaagcaccacatcaaggtattggagggtatcaaatttgcttcgaatctggaacttcccctgcaatattccggcctctgcacttgcccaccaccttccatacttgtcaaaaataaggacagcacaggacatgtctcgccagctaaccacttcctttgccaaatgactagtaagacgagtccctgtaaaccatccatccaataaccggtatcggataggccggaaacgtacggcttctggcagggtaacaattagcgtggttaatgctattttgatggccgtgttatctgaggatggctggtagttggacaaagtctcgatggcatttaatgtggcatgcagtccgagatttattttgggtagattttggctggaaccatcacctagaagagaatggtagtcgtctccaaaagtcaggagtgttttgggttcgggaatttgatctgcaaactttggaatacatgccaatgaccggttctgttggcaaatccggttacatacaagttatctgctcggattgacaacattgcattgtcatcccctctcccaatcagatgtcccatcttccaatctactggcgcacgattgggagtttgttcgctaaggatatacctattatcaatctgtagctgacttgaggtagcaattacatcgtctcgaaacatgtaaaaattgacatagtaactgtttctgaagaagtcgtaatccaaaacatgatatggagcccacccaacactgaaaaggagaaaagaaatcagaaaaaaaaacaaatggagctaagacataagaattatattactcccttcatccacaaaagttacacctattacttttgccaccaagataaggagaaattaaactatcttggatgttacaaaatcaagaagtgaatgcaaggatgtaaccaatgagtatttagatgactccctgggttctaattaaacatttaatttatctcctcatttaagttttgaatgcataaagactataaatagaaacaacttatttagaaaatcttaaatgtaaaataggtgtaacttttatggatggagggagtagaatgcaaacaacataattcttatacattccgacgtacctcttgaagaactctactgattgcacggggaaaacaaggtataacagaaacaccgctgtaatgacagtagaggtagacatggtttgtgcaattaacactaataactagctcatcttatatagtctttacctggtgatttagctaattagttggtaataattagatattgttaattagttggtagtgagtagtttgaataattagttggtattgagtagtttgaatgtaaaaaaacaaattaatatagaggattttggtaattagttggtaatgagtaggttgaatgtaagaaacatatgaatatagaggattttggtaattagttggtaacatattgttataattatcggtggtaaaagttcttcatcaaaccccctactatatcaatacatactacacaaaacttttgccctctatttctttttttaaaaaaaagaactcttcatcaaacctatgagctaatgtatactactaataaatggtttttgcaggttgccaaaagcttaaaaccgatattcgtatgcgattatgtcacccgcctgtacgaaaaggtatttaaagatcaccattttcgtatgttgtcggcccaaccacaatcttcgcatgagagccttttaattagttatgtagctaatggattaatttttttaaaattaatctattgtatctaagcgtacatcatatgcatcggtatgcaccgaaacctatacacgatagtacacgtacacatagttaagttatctataagtacatatgcacacacatatctatgggctatatatgcacgctgatcagatataggaaaaagtacatcgaaggtccctcgatttgtcattgagttacaaaatcatccccaaaccgcaaaacagatatccggcgtcctttaactaatcaaaaccggtcacaataggtccttcggtggttttgaccccggttttatcctacgtggcggctaagtcagcgtgggacccacgtgggccccacatgttaggctgagtatctctccccttctcttcctcgattcctcgtctctctctctctctgcctgtagacctgtcggcggggcggggcgaggcgaggcgggagaggagggcggcgccacgacggcggtcggcggcggcgtcggcgaagaagacgtgtaagccgcggcggcgttggtggcagaggaggacgcgatagcaacactcgacctggttttgctctcgggcctcgcgaaggcgaagaagcctcctcgaccttaacgctcgtcgtgaagacgacgtgcttcaggtgcgccctgttgttggatgcgtccgctggagtgatgatcgtcgtctcgtgccaccgccgtgtcacacgcaggagctcgctgcgcggcgtgacggcgaggtactgtgtgggtttgggatcagaggagaggagtgatgcggctgcggctgcatgcggcggcgagcgcaagatggttcgcgctaccggagacggagacgacgacgacgacgacgccgccgccgccatcggcggtgaggtgagaagatggagccgcaatagcgtatgttagaaataatctagacttagtattttgcttttgcatgtttcttatgtatgcataacttgggctgctagctggtctatttaagcatgtactttgaggttgattatgtgcattgaaaaaaaacactgcggtgtgcagtgccagaaaaggttgcggttgtgcagcacaaataccttgtgttctttgcctactctcctgcatgtgtattcaccaggtgtgagtacgtctcggtctaagagtgttttcttgtgtgctaacagcgtagcaggtagaaaagcctgttcttgtggttgtggacgatgctgcccagtattggcagcgacgagcgtgcagagagcgcgcggccggcggagcggagcaccggcggcggcagacgagcgcgctgccagcggagcggagcggcggcaagcgaacggccggagcaggcccgcgagcgcgcggcggcaggcggagtggagcggaacgccggcggggcgagtcacccgccggaccttctcctctccctcctcgccacgccgacctcctcccgacccgctggtcgccgccgtctccgccgccgaatcgcccgtcgctggccgccgacgcccgttcatctccgcgttcgtcgtcggggccgtcgcgctcatcgccgtgccgttcgccgtccctcccgcgtcgtcgttcgcccgcgacgtcgggcgcgtcgttgccgagcgcgaggagcgtgacggcggccatggacggggagaggcggaggcgggccgcgaggcgggagaccgcgggggagaagtgggaccctgcgacggcggcgaggacgcggagttgaggaggagcgccgagcaccgggagggaggcgcggcggtcctgggcagaagaggggaaagagattaagagagagggtggtgacgtggacaccgggacatgggtccatgtgggtcccacgctgactcagctgccacgtaggacaaaatcggggccaaaaccaccgaaggacctgctgtgactggttttgattagttaagggacgccagatatctggttttgtagtttagggacgattttgtaactcgatgacaagttgagggaccttcggtgtactttttcctcagatatatctggagcacaatccgagcctgctagcacagctgattaagatagttagtatattagtttatttgaattaatctactataatttcgtacacatattcggcgggtatgtagtattttatatatgcttattgtatttttcgaatcaatagtttactatatttacgacgtaaagcatatttatatacaatattgatttacggtaccgggggcagggtgggtcgaccgactccgttacgacccgtgccgtcccaccccttaagatctcttacccattatagtagtcatgggtcaacaaaattagataaattaaggtgtgagaatgaccaacagattaatacgtctctgcaaaacgcacgcataacacaaactatgatcgaggtatggtagttatacgattaaactataaatacaaagtaggttatattttgattgctctagttgagcgaatatcttcgttcttcatctcacctatatattttaaactgcgtccgccaccccgttgcagcgagggcgcgtggcagtcagaatttggcaaggcagcgggggccgggggcatggcgctgtggaacaacagcgccaccctatgcagcggaccagtgacactgatacagaagtcgctgtcgagtgagacgacgcgggtgagcggaaatgcagacaggtcggtgcacgtggcgagtcttatgtgtctacacgacttgctgcttgacttttgtgtttcatgagtactccctccgtaaaaaaaaataataataaatcttgggttttcgtgtctaattttaactgtccgtcttatatgaattttttttataattcgtattttaattgttgttagatgataaaacattatttatattttatacgtgacttgtctttttaatttttttcatatttttttcaaataagacggacggtcaaacgtttggcacggaaatcagtgtttgtcttttcttgggacggagggagtagtagagagagttagagagtaggctggtatgttctagaaataaattaactccaacagaaattgcagcactcaagatgctcttaacaataaatctcacaacaatgcattgttgctttggacaagttgcttctttcctgctgtatcttccatgacatgttgacctccaaccaggagtcatggtttcgtcgacgcgcacggtccgcgacctccacgacgggacgccggacgcagcggaggcttccgctcgagggaggacacggaggcgggtgggggacggggatggggaagaggagggtggcaatgaagggacctcgctgggaggcgcaggctgcggcggtgacgccgacggcgacgacttgcttcctagcggcgccggcggttgtggctcggaggcggcgtcgatggctgattggctgtaggtcgcgtgggccgatttttctgcaacatatgggctgagtctaatcgctatgctcgctcgactccgtccgatgccgaatgaacggacgagagccgttggacgtccctctgacgtagccagcgctacgttagaggatctggttcccatgttgtgcagctcggtttggttaggtgtaaggtgtcgattttgctaaacgtgattttttttctctgatatttgatgtttttttggccgtagaggcatgcaccaagattagtgcaggaaattatagttctatataactaaaattacattattaaattcagttgatatgacatataagtgcactgtaattttagtaaaaatattttgtaagtaaatatgtatttgttattttttaaaaaatataaaattacagccatatataactaaaattacatttgtaaattcaattgatatgacatgtaagtgcactgtaattttgataaaaatatcgtaagtaaatatgtatttgttattttttttagtccgttggatgtaaatcgaacggtagaaaaaatctagatgatttttttttgttagaaatcaccggacaaatgaataggcagttccataaagtgttgcacaaacagacactgccaagcccatggcggcagtccacgaaaggaaaaagtacaccgaaggtccctcaacttgtcatcgggatacaaaacatcctcgaactacaaaaccagatatacagggtcccttaactatataaaaccggtcacaatagatccctcggtggttttgatcccggttttatctttcgtgtctgctgagtcagtgtgggaccgacgtgggcccccacatgtcagcctgtccagttagcctctctttctttcccctcttctctcccttctctttctctctctcactcttctctctggggctctaggcaggtcggcgccgccggccgacgggtggggaggagaccgacggtgcgaggtgggagagaaggtccggcggtcggcaacgtggcggcggtggcggcggagacgacgcgggcgcatgggagcaaggcggcggcgagatgtccatggtgaggtactggaggcagagctccg

SEQ ID NO: 55194 - DNA, 40985 bp, Oryza sativa
  unsure (1)..(40985): unsure at all n locations
aatgacggttggagggtatttccgaccattccaaccgtcactaggaggctacataaacccctcactctctccatttcaacacacacctcaagcaaagctctcttatattctctcaagtttagtttagtgttcttaagctagtggagtaggaatatagtagaaatcggagtccggaaacattcggaagagttcgggtatggctctagtagctctcctttcctcttttgtaagctttgtacttttattagaatactcttctttatacatttatgatattgaaatacttttcgagtatatgaatgccaactttacattatgttcatgttatattgatcatactgctagcttatctggtagatgcattggtatgggtataatgtttgcttatgcaattactatatgtcatgacaatgacattagagtagtatctggtagtttaggcgtggtgtctagattacgggatattgttatttggggttatatgctgcggatgagaggtgtgccgctgatggtgacagctcagtatgggtattcctccacgcgtgtatatagtcctaagtgaatttcctgagtaaggtactcctccgtatttagcctcggttgtatggtcatgacggcctgttgtaaggaactcggcagttaggggtggcttctcgaagtaccagagggcatcgcatagagggtattagctagttaatcagataactataatatatatatatatatatatatatatatatatatatatatatatatatatatatatatatatatatatatatatatatattatgtatactagaaatataggaatagattctctttctattttctttccacttagcttagatattttagtatgagaatgagaagctccctgcttgtgtgtcactctaccctttgatttatcttaatccctgcttagactatgattattacaagtaacatataaattattagtccggttctctctactatgatcttctcacgggattaaataaatacgatacccttggaatactctcgggtgaaatgctacaatgatatatccgtgcgcttgtggatgaactctgtaaccataatatatcaggagtatttttgcacccttgctgggaattttatttatagtaatgtcgttaagaaataccaacactctcccactacatcatgaacagcaatgtgccgagggccgagggccgatgcggcggcggtggcgtcaccgatggctgccgtcgaggcggtccgggagaggcggcagaggaaggggagatcgagccatcgaggatgacgacgccgtatcgacggcatgtcccgtttctccctcccgggagaggtcgtaggtagaagatagcaatggcaatatggcatggaaggcttggccatcttgaggggagccatggcgacagtgatctgcttggccgtgccgttgtaatcgacccatacttgcatagccttgccgtggctcgccagtgtcaggttatggaagccatggtcgccggagttgccgctatcgtcgtagtagccggcgctggtgatgtcgacgccgacatggttgccatcgatgtcgcggaacttgttgttctagtcaatgtcgagctcaacgccgacgaggtggttcgtggcgtcgccgttgctgatgtcgttgaagaggccgatgtactggctggcgacgaagaagacgatgccgtggccgcaggcgtcggcgtcggggcatagaatggaagtcaaagtgagtgcgtgagccgggaggccgccatgacatagaactctacttatcattacttatccggaaccccttctatacacgagatatgattccatataagacacggtatatggtaggccctatcgagcttaatcaactactattaggtatgtggtatccataaccatgacaccgtcggactgccggtccggtccggttctaataactatactcactacatcgtcatttgttttttttttgttttattttttatagtgcattatatgaaatgacaattaggggagaggaaaatctgtctttactgttcagtagcttatttcacatatttcatataaccagctaggcagctactaaactttggatatttatacactgtgcagaaagaaattgtttgcccaacatttagccagtttgaattctggtgtgtcctactatttgttatttcatatactcgattgttcaaccctaaatgatatcactaatttttttcctacattttgttgaggagaagataccttgatccatgtgatgctgctgacaagctacaaggattaatgcggatacatttatttcttcttttgtatgactgaacaagctatatttgtttcttcttttgtggtcggatgatataacagcttctatttatattgtaactgtaatattatattgtagatttaaaaatgtattgtttctatttatggaagaaatcggttcttttgatattcatttttcacttatgtgatttcaagctcctatatacttatatagttcatccccactaaatatagttaatgttatatatttctctcttctcttattaagtcacatcacctcaattatttctagcctttggatgatagatctgtggtccaaattgtctcctctttcttctctcttaaaaacatgcaatctcaattatttttagacttaaaattgtattaaattgttttagttttgttattcaaattgcatcttattcgtacatcctatatacttatatagttcatccccactaaacgtagttaatgttatttctctcttctcttattaagccacatcacctcaattatttctagcctttggatgatagatctatggtccaaattgtctcttctttcttctctcttaaaaacacgcaatctcaattattttttgacttaaaattgtaataaattgttttagttttgttattcaaattgcatcttattcgtacatattatgcaacttaattttccgcagcaacgtgacgggtattcatctagtaatatatactccctccgtttctaaatatttgacgctgttgatttttttaaatacgtttgaccgttcgtcttatttaaaaattttaagttattattattaattcttttcctataatttgattcattattaaatatatacttatatgtatacatataattttacatatttcacaaaagttttttaataaagcgaacggtcaaacatgtgctaaaaagtcaacggtatcaaatatttagaaacgaagggagtacatgagtaaccaattattatcgttcctatgcatgcgttaccttgcacctattaaatccaaacaaacattgtcgtgcgcctccaggatcggcttctatagtaaaatgtgatatagtaccctgtctaacctaccgtacacgcaaggttattgtttgtacagtgaaccacagcaagctactgcagttgagtcaagacactgctgtaacagtgtctctttgttgtaacagaagaagaggatatgcatcctagctgtaacatcaatttattcggttctttggagagctgtaagatgatatcataaattatgtgctttcagaaagctcccctatccagcagggagtgtacacaaaagacgcatacatctcatgaacttccgaatgataacattctgggaacgtttttcccaagtattgaatctttgagctattgaaatgataagccaatcctctctccatttgtcggttcagaaatataacctctttgtagggatgaaatccaaggattgaaaaaaatgtatcgcgatgttcgtcattcatattttcaatgtcaagaatgctatcattgtcagagtcccactcaaatttatttattggtactatcacgtttctgatgctatttccattacgatcttcataggaggcagcttcaaaatgcttgcaatcttgggcggcgatgtactcttcgttataatcttcatttatgtaaccttcataatgggcatcaatgtcattctggtcataattttcacaatagtcaaaatagtgcagtgtccagggtccatcattttgtccatatttgtcatgccttttcagtagaaagctaatgttcttgtcatgcttcaattcccacattttctgaccacatgactcgttgagaaaccaaattcgtagtcgttggtccctatccattaatgcatagtgcaccccattcttcgatctcccgaaaaaatgcgatttatattcagatacttccgtagttataggcagcataatgacctgatatgtcttgtcagataaggatattctgcaaaagtaaaaagcgacgttgtggacaccatcagatcaccaagcaatctttaaatggagaaagaaagcaattataatgctaagagtggatagccacttacctcatgacaaaatctgcttcacaatgtacataaagtgctccctgccaatagactccattgaaatgatcgtatggaaaagacaatgccatgtcggcaactgtaccggcagcctcaccctcccgtacgtacgatctcttttcccattctccggtccttgacgaaaacacattcaacacgcttggtgacggtggccattgcgaggtgtcatccataggatcaagctcgtcgtgatatctatcaagcgcacgtgggatttggaaaatttcgtagtgcgatgatatggtagggtcatacatgagatagttactaagctggcagacgcccttaatctcggtgcatggaggtgggggctcagggaaaggcgcccattgtcgggtggtggggttagctacgccaccccagagtagaacaaggccgttgcagtgatcctccacgcggtccgcattgggcgtgtagtcggtgaacatgccggagatgatggggcgcgtcgaggggtgggagaagaacaccgaatgccgttcatcatggaagttgaagtagatgccgctgagcgagagcgggaggagatccgcgcggagaaggcgacggctgtcgatgatggcttgccatgccttgcagacacagcgggacgcggcgagccaacgcggcgcgaggcggccgaggatttcggcgagcaggtcgtctggtaggagctgcgttgcgtcgtcctgcttttccatctctctttgctccggccgttcctgatctgttctttggtggtgttcggtgtgttccgtgattaattttatagaggatatggcatccgattccgtctgtgttctcaactccgaccccgagtaggagagtgcggctgttctcttgcgttgccgcgaagcggaagaggcaaccaacttcaaaaaaaagaaaaaagaaaaaaaaccacgaatcatataccggagagtcggagtagtaggcgacacggagttaagacttaagcgcctctttctatggttctcagacagaaaggagagcagagagcacattgacgacgacgcaacccttcctccgccgagacgagtactaggcgactagcgatttgcgtctataatcaaccgtcgacgctagcaccgaccactgttccccggccggcaggccgcttcgtcagaacagccgccgcggctccgcaactgcaagacacgttgactactcgccgatctgctcatcggcctgtgaaatatctaggaggtaaccaggagcagcaacagctcgttgccaaatgaccattgacatatgttgtgagtgacatacacatttggcttaatcaagtttatttatattccttgtgggaggttctcagcttggacgaagcagccgtcgtgcgtgttgccttgcacacccgcgatcaacaaatcagtgagatttagatttgtttgaataaatctggtgcttttctagttatgtttgtactttatatttatgctagaaaaaatatccgtgcgttgcaattggtgaagactattttaatcttattattattatactgtttagttaaggtgaaactcattctaagaatttgcttggattttttttcctagaaaaaaattacaagttatacaccaaattcaattattatagttatacaccaaattcaattcacaggttgagcggtttgactggttcagttgctagtcaaacagtcaaataaaagtatcccaacaactaggacggacgaaaattttatacaattatggtgagtatggaatcatcttcaatttttataataggtaaaaatatgagttcagatgttaaatattctttttcaattttttgcatatccttgacatcatttttgttgagagaaaagcagcaaaaaaaaaaaaggacaagtgaataaattgagagaataaaaatggggcaatgaagaagaaattgttggatgatattggtattgataccatggtcaataacttttcatccagaaatataggaagaaaatttaagatattatatctatcaaaaatcatataaatactgattctagatggatttaaggtttgtaactaatttgttttatgttaagacccatgtttttagtttggaataagactattttgcctccctcatatcttgttactgattgaatcacatccctcattcacgagatcgggtatagcgcatcctctgtcttccaaaaccggtaaatatagactccttggtggtttcaaaagtggtttttgcatctagggcccacatgtcaatgagatgtggaaaaccatatacagtggtcccaaatgtcagggagcatggaaaaaaggatgtagggccgaccacctctcagcaatccggcattggcggctgagttcgcgcatctctccgccctacacgcgtgccgttcacgcagcgccagatgcggcgtcgtcccggcgagctgacacgcgcgaagaggcgatgcgtggtggcgactaggcctcggtgcggaaggtgaaggaggaaggaatactgagagttcgcggacacggcggtggcaccgcggagttctcgcgaggttctggaggacaaaccgagttcctccccgcgcacgcgtcgcggccggccagcgaccgctcctcccgcgcgcgccgtggccggcgagccctccccgccctcgcgaccggctagcgagacctccagcgcgcgcgacctgccggcgtcgaggccagcgagctccttcccgcgtgcgcggcgcggccggcgagccctcccgcgcgtgcaaccggccggcatcgagaccagcgagctcctccccgcgtgcgtgactggccagcttgccctcctagtgggtgcaccgcggccggcgacccctcccgcgtgtgcgaccggctggctgttgactgttatttcagctatggccccaaggtgatccaggcgatggcagttgcaacggctggatgaataattcagttttgagtttgttatgcatgcacgagagatgtggcgagctgcaggagtagacgactgcgtcaggcgtgcgttgtgggcgtgagttttgcacggcattggatccaggagttccggatcgtgggatggcgcgattgtaggcttggattcgttttttctgttattagagtataagtagcagtagctaaaatttccatttgtaagtttttcaattcagttgaatgaaagaacccagaaaattgtcccacaaattccttctctctcgtgattctctgaaactctgaaatactctgcttctatgttctgaatttcttcctatgttcttcagtttttttttgtctgttgccgtgccggacatgtgcagtgtgcgcacaaagtgttcgatcgggtgattagcagctaacaagtggtatcagagcttctcaggttgagggcggatctagcactatggcgttggttccggcgacggcggacccggcgagggggagctcaggaagtgctttcctttacccacagctcacgtcaaccaactacactagttgggtaatacgtgtgcaggctatgatggaggatcaaggcgtatgagaagcaatcgagccggcggctagggcggccgttgacccgaggaaggacaagaaggcaaagtctcatcttctccagtcgctgccggaggatctcttgatgcaggttgcaaagaaacgctcggcaaaggaggtttgggattgcctcaagacgagattcatcggggcggatcgggtgcgcgatgcgcgcctgcagacactcaaggaagagttcaccaacatggtgatggaggccggggagacgctggaccagtacgccggccggatcaccacgatgggggtccggtactctgctcttggcgcgacgttgaacgatgccgccatggtgaagaggctgttcgacactgtcccggagaagttcatcagcctcgtcgcagggatcgagcaattttacgacgtcgacaccatgccgttcgaagaagcggtaggtcgcctcaaggcgtatgaagagcggatgcggaagaagaaggcgaccaccggaggagtgaccgctgacgggcaagttctcctcactcaggccgagtgggaggcgcgcttcaagaaaggcgggggagaaacctcgtcgccacagaagaacaagccctctggtgagggggcgaaccgcggccaggccgggcgtggtcgtggcaggggtcgcggacgcggtgggacgcagagcagcggtggcggctctggtggtggcagcggtggccgcgacaagagccacataaaatgtttcaactgtgaggagtttggccactactccacgcagtgtccacaccccaagaagaagaaggctgaagctcatcttgcgcaaacggaggatgctggcccaactttgttgctcgctgtgacagaggcggtgcagaacgcgtcgcgccaggatgcgctctgcgggctggtcgtgcacgaggagcgtgtgtggcctcgcctgatgctggcagagaagggagcagctgctggtgatctgtggtacctggacaatggtgccagcaatcatatgtcaggagatcatcggaaattccgggaactggacgagaccgtgacagggcaggtcaggttcggcgacgcctcgtcagtgcagataatggggaagggatccatccttttctcatgcaagaacggtgaccagtggttgctcgacgatgtctactacatccccagcctctactgcaacatggtgagtttggggcagctaactgaaactggccaccgtgtcgtgatggatggagatgacctcgaggtgttcgacaaaaatccttggcgattggtgatgaaggtgcggcgatcctcaaatcggctgtaccgcatcgagctgcagctggcgtcaccggtgtgcctgttggctagtctcgatgacccggcgtggctgtggcatgcccggctcggacacgtgaatttccatgcgttgaagctattggtggacaaggagatggcggcaggagtgcccgcagtccaccacccaaaccagctgtgtcaagcatgtctggtggcgaaacaagtccggcagccgttcccaggaatggcaaactatctagcagaggcgccgctcgagctgctccacatggatctgtgtgggccgatcactccatcgacgttcaccggtaatcgatactttatgttgatcgttgatgatttttctcattggatgtgggtgtttgtgatcaagtcgaaggaccaagcgctcgcggccttcgagaagttcaagccgttggcggagaacacggcaggacgaacgatcaagacactccggacagaccgcggtggcgagttcttgtccggcgagttcgcgcgcgtctgcgatgcagccggcatcgagcgccacctgacggtaccgtattcaccgcagcagaatggcgtcgtggagcgtcgcaataggacggtgatggcaatggcgcggtctctcctcaaggggatgtccgtgcccggcaggatgtggggcgaggcagttcgtcacgccgtattcctcctaaatcggctgccgaccaaggcgatgggaaatcgcactccgttcgaggcatggacggggaagaaacctcacctgggccacctgcgggtgttcgggtgtacggcgcacgcgaaggtgactgcaccgcacttgaagaagctggacgaccggagcaatccggtcgtgtacctgggggttgaagaagggagcaaggcccatcggctgtttgatccgcgtcgtcggcaaatcattgtaagtcgtgacgttgtttttgatgaaaacacaccttggcagtggagtgctgctgcaggagaggtgacttccactgagttcgaggtagaagaacccgttggcgcagagcagccggcgccagcagagcaggcaggctcggtaccgtggtaccgggcgccgccggcaggaaggcgagccggcaaggagccagaagtggcagaacagcggggaacgcctccggcaagcccggcgaggttctcaccaaccttgcctagcacgcctacactcggctcatcctcaacgcactctgccgaggtgcaggcgtcaccgcgcacggccggcagtgacgacgagccggtgcggtacagaagcttggcggagatcatgattgaagcacctcgggtggacctggtggaggatgatgacgacacagaagcgctgctcgtagagatggaggagccgacatcctatcgtgaagcagccggcgagccggcgtgggtgaacgcaatgaacaaggaactggaggctattgagaagaacaagacgtggtcgctgtgcatgctgccagccagtcacaaggcaatagggctcaagtgggtgttcaagctaaagaaaaacactgccggtgaggtgatcaaacacaaggcgcggctggtggcgaaggggtacgtccagcggcaaggtgtggattttgatgaagtgtttgcgccggttgcaaggttggacacggtgcgagctatacttcctgttgcagttgatcgaaggtggcaggtgcatcaccttgacgtcaagtcggcattccttaatggtgatcttgaggaagaagtatatgtctctcagccagaaggttttgttgagaagggaaaggaacatcttgtgtacaaactgagcaaagctctctacgggctgagacaggcgccacgggcgtggaatacacggcttgatcggagcatgaaggagcttggtttcagccggtgtgcacaagaacaagcagtctacactagaggtacagggagtaccgggataattgttggagtatatgttgatgatctgatcgtgacaggagaaagcccaagcgacatcactgcattcaaacaacagatgatgggggagtttgagatgagcgatcttggactgctcacctattacttgggaattgaagtgttgcaaggcactgacgggatcgccatcaagcaggctgcttatgcaaggaagattctgacctagtttgggatgctagattgcaattctacctcaattcctattgaacatcgttcacagttgcacaaagatgctcaaggaagcacagttgatcccacggagtataggcgagtgataggttgtcttcgttacttgttgcatactcggccggatttgtcctacgcagtaggcgtggcgagcagattcatggaacgaccgacagtgatgcatttcaaggcggtgaagcaaattctcagatatctcaaggggacaatcaactgtggactcatgttttctggaggcaatggtgcagtggagattactggtttcacagatagtgatctggccggcgacagtgatgatcgtcggagtactagcggcatggcgttttacttcaacggcagtttggtctcgtggagttcacaaaagcagaaaacagtggcactttcgtcctgtgaggctgagttcatggcagccactgcagcagcgtgtcacgctttgtggctcaggggattgttgattgagatgattggtgcagaagccaggccggtgaagctgtatgttgataataaatcagcaattgcactcatgaagaaccctgtgtttcatgggagaagtaagcacatcgatacccggtatcattttattcgtgagtgtgttgaaagtgggaagattcagattgaattcgtccggattgaggagcagcgggcggatgcgttaacaaaagggttgccagcagcgagattggcgacagcacggcacctgctaggtgttcgtgattttgggctgtagcagaattaagggggagtttgttgactgttatttcagctatggccccaaggtgatccaggcgatggcagttgcaacggctggatgaataattcagttttgagtttgttatgcatgcacgagagatgtggcgagctgcaggagtagacgaccgcgtcaggcgtgcgttgtgggcgtgagttttgcacggcattggatccaggagttccggatcgtgggatggcgcgattgtaggcttggattcgttttttctgttattagagtataagtagcagtagctaaaatttccatttgtaagtttttcaattcagttgaatgaaagaacctagaacattgtcccacaaattccttctctctcgtgattctctaaaactttgaaaaactctgaaatagcagctaacactggcaagccctacccacgtgtgcgaccggccggctagccctcctcgcgtgtgcgaccagccggtgagccctcccgcgcgcgcgatcgactggcgtcgaggccagcaagctcctccccgcgggctcgccgcggccggcgagctcctaatgagcgtgcgactggcccgcgaccgctccccacgcgcgcgccgcttatggcgagttccttcctgcgtgcgcaccgcgccggcgacccctccacccgtgtgcgccgcttctgacgagctcctcccggccggaaacacctccctcccccgcggcccgcgcacgacacggccggcaagctccttcccacgcgcgcgtcgtggtcggctgacgagctctgccccgcgttctgctgtgagaggtgatggaggaggaagaggaacgagagacgggagaggcgaggaagaagatgaagtggtccttgatgggtggggtccacaagctgagtcagctagtcaatagggtcaaagctgccacgttagataaaaccacctttcaaatcacttaaggaggcgatttataccggtttttacaaataagggaggtgttatactcggtttcgattttgctatatatttgtcgacaaattnttccccaaaaatttgacagatgtaattacagtacaatcgtagtgtaattacactgtaacttgtatgtaacttgtatgtaactttcaaaaatctctccgcaacctgttatttcggtaaaatggaggtcgtggaaacaaattctttgacatatgtgtgtgctatgatttgttttcttcctaaccaaaacaaatcgtgtaatagatctaacgattcaaaattatgttaaacttacatataagttatagtgtagttacatgcaagttacagtgtaattacatataagttacagtgtaattacactacgattgtactataattacatctgtcaaatttttggggaaaaatttgtcgacaaatgtataggtagtcccctcggttttatagatggccaaaaggcctgaggcccgacggcccatcccacggcacggcattttggcccggcccaagcacggcacggcccgatgtgggttgggcccgtaccggcccagcctgaccaccgggccgtgcctgggcccctccaccggcacgttgggccggcccggcatggcacgatggggccgcaagccaggcccgacacacaaacaatagggagtaaaaatagacctattttatgccaaagtcgaaagaatagagacgtaaaatagacttatttagctatatatattttaatgcttgcttggttttgaagcgaacgttcattcattcctcccttttcagttctagtcttagcctagtctgctacctctatttgctcagtctacctctcttcggctcagcacacacgtggaactgtaggcccaactcgaacagacccgtgcccggtctaccggctcagcccacaagtggagctatagacccagctcgaacaaactcgttcctgtaccatgacggagccgatcctcccatcaaatccggtaattcggtcgagctcgcatagtaccatgcccgcatgacaacagagtcaatcctctccgtcaaatggggtcgaatctttcttaatctctaaaattattgagggatcgattagatatatatgcggccaaatctttgaatctttcttgatctctaaaattattgagggatcgtttagacatatatgcggtcaaatctttcttacggcgttttgcttttttttttacctttttttcgccgttttattagggatggcggttttttttccttttcagctttttttactggcgacgtttagaatcgaaaatctttttttttcttttctttgttattttcacccttttcatgtttcttttggccgcgcctttttgttttttttggccctttttacgggctttttattatggacggaactttcctttttaccgttgcacaatcggacttttttttgccgtatcttttcttttcgcttttttttatgtatatacggacgacggaaattttttaaactttttaaatagaaaatagtagaagtagaagtagatatatatatcctcccaaagagaagggagggaaaatagacttatttaaaaaaagcatgatgggccacccatgccttcgagccggccctgcacggcccgactactggtgggccatgcctagggatggcaatggagccccgtaacccgatcccggtggggaaaaactctattagggtctctagttgggagagaaatactatccgtggggctgttatcggcctttttcctcacccgtcgggtgggccgagtatgggggcgggcgctagctccctggccccgtatccctatgggaccccgacgtaggcatatatgcaggccttagcccacatgaaagtaaaagccctgcccaattcggaggtgttggtatataaacccaagaaaaccctaggtcttctcatctcaccgtgtctctctcccactcctctgctcccctatctcacccttagatccaatcggcggggggggggggggggggtcgacgtcgccagggagccgccgcgccgggctcggtgagcggcggcgcatcttgccgccttcttcccgtcttctagccacagcccactccacgccgtagttgccgtcgccaccacgcgcacacagtagcatcgcctccgtcgcccattccacgtggccgcctctaacacatctgtgatgaacaagctagttgctaccttacattatgtaatgagtaatgactaatgatgaattatcagattgttcactgattcaaccattatcaatttattgttgctgctggattatggtgatttggtgaattgcttgtggattagtgcctcatggcttaccgctgcactgttggtctgctggatgaatttctttcgattgtcgggtgtggggacctggcgggtgcgccgtacccgcatggggacggggacggggtaaaaacctcccccgtgtgcggggatgggaatggtgacgggagatttttctcacatcgggggtggggacggggtggctaaacccgacgggggtagccccgttgccatccctagccgtgcctgggccaaaggtggagctgatgggccggcacagcccggcacgaagtgccgatcagaccgtgccggcccgatggctggtgggccgtgccttgccgtgcctgggccgggccgtgccgggtggaccttttggctatctatacctggttttgcgattgagggatgtgattcaactaggtgcaagagttgaaggaagcataatagacttattccttttagtttcaacctatgccaccaaaacctttgcgctgacctggatcataggcataagcatcggcggccccgctacgaatggctggcttttccccaaaaccggtggaatatacaggccgaaaggattaatcttgttgagctcaaaaagggatgtttggaatataaatgaaccaacccttacaaaaaaaaataaattgcatccgaataagttcactttacattcctcatctttaacgtccctcaactcataatactggtgttcccaaggtcctagaaagtatagtcctcagttttggttgacgtggcgcctgagttagcgtgggacttacgtgagccccacacatgtcagcttttctcctcccatctctcccttcccagcgttcctcttcctctttccccttctccctctcttcctagtctcaagggcgatgcctttcttctccactcaccacgccccctcgccaccatagccattgtcgaagcttactagtccactttctagggacgatcgacatatagagatagtggcaatggtggacgcggaccgtcaaatggccggtttgtccttggcagagcttcggcggttgtccatgcatgtcatggcggggcccttgtcgatgtcggcctcaccgcaccatgggctccactcgttccacgcgctggcgagcatagtgctgtcgcatggctgtgctcccggggctatctgacacagagcaactgtgcaccgataccgagatgggattcacgttcccacccgatctatgatctacgggcggtgttctccatggggctcccgtccatgcctgggttccatgactagcagacatgcgtcaggctccgtttgggttcagcctgcccatcaatgtcgtcgctgcaaattaaatcatgtgttgttgcacctcagggcatccggtgtggccatggtcgtggtcctggggccgagtccgactgaccccaacaggtgctccttctcgcgtacttcgccatgctcgtcccactctttgaccggttcttcctgtcgtgccgccttgtctcgctgggaaccctgtcttctttgttagaaacgactgggtgctctgttgtggctcgcgatgagatgatggagctcagctacccctctccctatcgactgccagcccactgccttggaggctaggaagagaggtagagggggaatgaggacgaggaacattgggagggagagaggggagggggagggagcttactcgtggggctcaggtgggtttcacgttgactcaaccatcatgctagctaaaaccggacagtagttcctaggacctcatgtacattggtacatcggtattgtaatttgagaaatgtgtaatatttggtattgcggtttagggacgcgattcaaaatccaacatctagaataccgatttcagggtgcaaacactaccatctcattgggccacatggctaaacctcaaagccactactacgtaaaccatttttcgtgacgcggccattttaggttttcgctggcggaatttagagcagccacaaaacaaagcaaacacatgaagaacactaactcactgagaaccaatctctcggtgattaggaagacgatttttacttgtgaaccatccatccaggtgctgcttcgaggctctgatgcctgggctttgccttcctgtccgtcgcggactccgcaaacgatgccatggcgcattctccaaacggatttcacgagtgccagcatagtcgtgcagccacgacgcaccatagaatagataccacagaatacagagtggatttgctgccggtttgctacggcggtagagagcaaggaaggaacaaaaggggatgggcgcaccagattcgtctccgccgccgccgcttgtgtggctgggagggtgagaggaggattgggtgtcatctagggttaatattttgagacggcttggtggaaaatggactgcaccggctggttgggccactggcctgttactttccatcagctcgtttgagctcatgagctagctcgagctggctcgttatgtgtaacgagctgagatgccagctcggctcattaagaaaatgtaacgagccgagtcgagtcgagccaagctactcacgagccacgagcttttcatccagccctagctgccaaggcctcgtggtggcagatccggccacccccgtcggcgtcggcagcggatccgaccactcccgtcagcggtagagatgcaatgggtacccataacccgagacccgacgggtttttactctattaggagccaatcgtgttctaactcttatacccatgggtctactaacgggcgaaaactcttacccattgggtacgtgggtatgggtccgttctttacccacccgtacccaccaacccgtgggtagaaaaaacccgttgattgagtctaaaactatgagcattataactctcaacgactactaaatcatagcataaaactcctttcacatcttaaatcattgcttagtctagttatatgaaattattatttgatctcttgagtatgtaatgtggttgtataaattttttactcgcctttgaacactaatattaatagcattgctgctagagaaaatattgatggtttacaactctaatatggctaattatagtacaaaactataaatattacaagtcaattatatgggtatgggtacccgttggatacctgttaccctcataggtgtgggtatggggacaattttgtacccgtgatgggtgtggatatttaagtgggagtatttagacatcgtgggtatgggtatggggcaagagaacccgatgggtatgcacccgttgccatctctagtcagcggtggcggcggtggatccggcctcacccgtcgttggcggcggcagatccggcctccccggtcgttggcggcggtggatccggccccgagctcgccgcgtggcgaacgccgccaaggagaggagaaggccgatcgtcgccgtctccgcagtcgccttgtccgccgtcgctgcagttgccttgtccgccgtcttcttcgccatggcagccaagaacaggggaggcgtgggcgtgagtggataagatggaggtggggtgaggagaatagggtaagatggagtgagtggataagaagagtccgtgcgcacttggtgttttagtatagtgaaaaactttcgctggcgatcacttaagaggaccgcttgtaaaaagacctctatttttgcaagcggtcctcttaacccagccgccagtgaaaatggttttttgctggcggttcttagcacctcatctctcgtcaaattttccctagcggtttttgcttatagccgccagagaaaaaaataggtaaacaccatgaaaaatcgatttttttttgtagtgagcaaagtttacatatctttgaaacgcgccacgtggccgcgtgctattccaaggctcggttcgcacccgcatctgttggattatgaatcaacggtagagatggttcaaaggacgtaactgcaaaatttgatcttccaagggtgtttagtgaaaatgttagcattcattctagggaaattctccccttctctcgcccgttctccggcgattcgcgaaccgcctccgacgttggccaccgctgcacctcgccaattcccatccctaaaaccctagcccacagaacctccctcttcacttcatctgcgaacgcgcctgcgccggcgaaggagcatggatattgcgagctcggttgtgcggcgcggcgcgcatctgcagcaggcacgacaaggggcatgggtcgggtggttgaccccctggctctcttcaagcggccgtcgccgtcagcaggggagttctgcaagtgggtggactgggagcttccctgctacctcacctccttcctcaccgtcgtcattctcggcatcaggctcaacgcgaagcccaacttcaccctgcagacccggccgcaccagaaagagcgccaacaggcaacagcaacagagcaacaggagctggtttccatggaggcccagaccgaacgatctgcacgcctgaggtcaccttgaatcgtacactgcgtttgttttgcttccaattagatggttgagacttgagatgtgcaggctaaacactgtgttgttgtttttgtttgatggattttacccgatgatggcgaatgccctgaatattctgaaatgcttttcagttctatcatttccccctctttagatgtgccgcactgcattttttttttgtgtgagcacaattagaatttaacttgtctctaccattcccaaataacatggttacagattgcatattcgggttaggtagagcaaaaatcaattgtcgtgatgaatcctaaagccaagctctgaacaaaaatagctatccctcttgctgaatatcatggcattgttaggatatctaaaaataacatgccacaacggatgattttgtactgtagcaccggtggctattatatataaacttacctcttctttatgttgcttacatttctctccagttcattacttcatttcatgccaagttgccaattagcctatcaatttatttaacccgtccgttcaagatactatcacttaacacgagacatgagtatatcaatgacatgcattgtattgtcattagttttaaaagacatactttttaccatcacctggcaaaccatagagcatattaaggtcagataacatgacatccagggttcttagctgctaccatagatcatgaccataatgctttgtttttgttttccattttcttggtgtcatactaaacatatagctaggatatgtttttttttccaaatgccagttctaagaaacttaacagctctttatattcatccacactccacaacaataaaacacacatgcatagaaatataaaggctcctttgagtaggaatatttatgttgtcaatttcatttgccaaaaactaatgatcaggttagggaagacaagaaaatagtttttttttgtcaattttgaatattttagctgatcagatattgttatcacgatgaataatgtccatgaatataatgtctgtcttccctgctaggcttctgaatataatttttaattggtaaacttccttgatatatgttctgatggtttgtcatgacaacctgtacgatgaacgattcctgttcttccagcagcgccttcttgcattcaagaatgcgaatttggttctgaaaaaagaagtttatgtactttatctcatttgactgcgcttgcatgccactgacacactcatggtggactggccgctcatcgatgaccagaagccggtcttggagcacagcaagttcgctctcagattcttccagccctaaggtaattaaaatcgatcatcctcttctccaatccacgcacatttttggttgttcattaccttaatcaaatcagtgtcccttagggttgtttgattaagtgaaattaattttgcatggtacataacaactgcaacttgagaaacatatcccttataatatgctagcacgaaccatgctggtctagatgaaaacatgtttatttagcaactcagaaaaaaaagagagtctcatcggtacataaaatcagcactacaattctgcacgactgccagcagaaaatattccttaccagtaaggcagtaacaaagatttttcttgctttgatttctctctcttccttattgccagttactcgatcaatgttgcacacattgtacttccaggaatggaaggccaaatcacttttgctgttcgtgaaaattgtaaggttataacttagatacctttttatacttagggtatcatgaaatttagatggtgttgttcttcgtttaggaccacctgtgcctttggagattaaaaaaagcatattttaatttgttatccccttttccactttgcagccatttcgttggtctaattttttatcccttttgatgctgctatatggtgtgcttgataatagttgatagccaaaaggattcttttcgggctgcaaaaggctaaaggcgtatgcttgatgatttgtatcatgaatttattctttcagttctgttatagctattcattgatatcatttttatttgcaatgcattattagcatatggtattatcacttattgatgtgtaatactgactttgacatttcttacttagtgcagaaaattcatcgaaaataatcgtgccattacttggcatcgatccccatcatttgtgtcctcatcttacaaggggtgagctcgaatagtttgtcatggacagataagattgaggccccctttgattcaaaggaatttcagaggatttcatttctataggaatttttcctacaaagccctttgaatcaaaggaatggaccttatggaatcctatgaaattcctatggaatgcctcttcccatacaagttttggaggaattttagcaagaggtagaacctcatggaaaaaatcatttgagtctttatctctcctcaaattcctgtgtttttcctgtggtccaatcaaacggtcattcctacgtttttcctatgttttgcaatcctgttttacacttacattcctgtcagaatcctatgtttttcctattcctctattttttaattcctgtgattcaaagggaccctcaactaaaagctatatattcaatgactatgtacggataataaggatatcacacatctccctagtccctagtcgttgtggacatggcttggtgatataattggttatgagtaatgatcatttatagtagcatgtattttgtttgtaatttgcctcgttgcactggcaacacagtagctagagttgataatgatttttaattttttgccattcactcctcgttcatataaatgtaacagggaatacctctattcggcccaattgagctggcgcatgctagttgagagacctaaagtggatttatttcccaataaaatcagtcgcttctacttcaaccaatggcatttttaagttcaatttttaacttagctgtccaccttttaatgtttattttccaacagcatagtcgattattacgttacttttccataactaatgtttccttgaaatcagtggtagagacttgtagtagtcaacaccttccaactctagctggcttcataggccaccaccttcgacgcatagtaatcaagtaatcgtttgtgtggacagctgagtactgcaaagatgtaaggtggtgccatctgaacagcgaatggcagagaagaaaaggaacaatatcacgctcttcgtattgcttaatacagtcattcaacgaataagtaccagattcaagttcagggatccagggatccaagatacataaacagggatacatatgtagctgctacctacgattaactcagatgcatcaggcaacagctacaattgagagatacatggatcgaccattgaccccttacacttgacgaggaatattattccgtgcaaggatggtcggcaagcgatttactatctctcgaaaaagcgcgtaaatgatctgaactccagtcgccacctccaagattgccataatgtaccgatcccagttgctgaagttgtccccgggatcaagtatcatcttaggctgcttcactgtggctgtgccaacgccatttccagccggaggcggaagatttggctgctcatcctctgtttctgcacacgaaaaacagtaccaatttagtactagctagcatgcaaaagaacgcatcatttgaaattttattgattagagaaccacagaaacattctaaccattgaagccatagcacagggctgcatccttctgtttgacggcacggagacctcaacatgctcggtaagaggtgatcaaagtaaaagcagaaaactgggactccttaatcttggggcgcagagacaccaggcaaagacaattgggtagatcaactaccactacaatcgtctcgcagcacctaacatcaggagaagacccattcccgcaagaatcaattaactgtgatgccagcttgtttgcttcacaagtctgatcctccgggtaatcctcaccctgtgctgggggagggaaagacgaggcaacacaatctaattttagtaaacaagtggtttaaacagcaaaaaaaaaaagaagaagcaaaaagcatgcttttcaactaacaaagacacaatcttgcaaaggatcaacaagacaaacgggcacggagggaggggtctagagacctagaagcggtggccggcgaggcggcggccatcatatctttgtctgtctctatctgcaatgtttgcaatacaacggacttttgtgtttcaggcagtgtcttttgcggaatgtggtgaaaatatatagttaaaccatttaattcggggaagccattaagtggctcaagaaaactgcacgatcaaaacagttgcctctaacgtaccgtgtaacgaagccagaacgactctcaggagaaaccctagctggtcactcggcaggggcatgcgtttagcagctcgatgcctcgatccatatctcgtgcagcagcggcatgtttgtctaattgtctggttggcatccaggaatccggtttctccatcgcccgtttcctcctacacagtcacatagataattgtagagtagggacgagaacgagctagttcattctcttagctgttgcattggtcacgattcacgaacaagtgaaaataattaagcagcagctagttttcaggacgggttgccgagcagctgtgcatgataggaggcaggatcggcacaggaggggcagcctttgtggccgcagagacacacatctctctctcagcgaaaggcgtatagtacgacggcccagcggtgtggcgcagatggcgggtgcccgggtggtgggagtgtgacgagtttttcgtctttttgttcttaacaactactccacagtataccatcagtaatccccccacccaaagggaaaaaaaaaactagaaatgcaatataatgcatccatccagacattcgatccattggcgcagtgcaaaccgccctgtgcgcgctccgactccaaaaccacgtacgctctcgccgcggctcgtcgatcctcccgagcatgcagccggcgcgccatgaagcgcacgtacgagctcctgctcggaattgagctcgcgcgccaacaccgaacctgtcgcggtggccgcctgctcatggctcgtccattggtatcgacggcgcgtccaatcttttgttggcttgttcacgctgggtgttagtattgcagtggtcttgtgcccgagtctgggagcagaacggattcgcgccccaagtccaaccgataagaatccctcgatcgactccgtatgtatcaggcaaaactcccactccagcgcccagcgctcgctttactcggagtgcgtggaaaaccaattaacacggaatcggatgccatctctcgtccatagattaacagaccgcccacaggtaggaggtacgcgtacgtacgtacacgcacccgaaaacctttcgagcaacgaattaattgaacagagagagagattccatggaggagcaccacgacgtgacgcagctcctcccggacgacgtgctcgcgggcgtcctcgcccgccgcgtcccgctgcgtctgcaaggcatggcgcgccgtcatcgacacccgccgcctgctgcgagccgacctcctccctctctcgctcgccggcatctacatcaacttccacgagatgcaccgttcggtgttcctatcccgtcccagctccacacgccccgccatctctggcatgttcaccgactacacgcccaacgacaacctagtcgaggatcattgcaacggactccttctgctaaagtccggcgtggctaaccctgctacccgacagtgggtgccttctcctcctgccccacctcagcccgtctggatgaaggacttctaccggttcgacagctatctcgtgttcgaccctaccatatcgacacactatgagatcttcaaaatcccacgagttcctagtacaggatttcgcgtgctagatcctatgcttaagagcttgcaatggccaccctcactgtgcgtgttgcaagtgttctcatcaaggactaggcaatggggagagattgtttgtacgagacggtgtggctgccggcacagttactgacatggcattggcttttccatttgatcattataatggagtctattggcatggggcactttatgtacgttgccaggcagattttgtcatgaggtacgaggtcatcattcttttaatgtgcttaaattgctctatcttctttctttatttttttcaatggttttataacccatatattgtttttttttctaatgcagaatatccttgtctgataacaagtaccaagtaattaagttaccaatgaatactgaagtatgtcaatataaaaaccattttctcggaagatcaatgaggggtgtgcactatgcattaatcgataatgagcaccgactacgggtttggttcctcaatgagttatatgattcagatgacatgggaactgaagcatgacaatgatcttagtttccttctaaggtgtcaggaaatctgtacacaaaatgatggtccgtggactttgcaataccacaactactttggatatcccagacaaaatgacatggacaactattatgaagcttacaagaaacacattgttaggaaatatcactatgaatatgagagtgtctggtacaaaaatcactgcgaagatatcaagaaatatgtggtagtacgagtaaataattttgagtgggactccgacaacgatgacattcttgacactgcaaatccaaacgaaggagaatgccatggatatctttcaattttgggattccatccttataaagaagttatttttctgaaccaaaagagggaaagaggacttgcctatcattttaatagctcgaaagttcaaaatttaggtagtacgttcccaaaaccttatgatgatttgtatattcaaggcatgtattcatcttttatatatacaccgtgttggatctaggggagaactatgaaagcatgtaattaggagattgtcttacaatttagcatgtgttggtggtgtaagttgtgtggcgacctaaataaatatgctatcttcagatgagatgttaagagacaattatctcgattaattgtacatgacattatgtatacatgtataggttttatttgtgaagcatatatggtaccgaccaaagttgatgtttgactggagcgtgcctgatagaaaatggcgcatgtatttgcaaaggacttatttttattataataccagaacatagtattccatccgtttcaaaatataaatatttttagaatagtgacaagtcatacatttttaactttgactattaatagcaaaaaagtaaaaaagatcaatcatgtataactgatgttattagatttatcattaaacaaactattatactaatatgcaactcttttttatttaaaacatcttattttatagatattattggttggagaccatgtcagagtctaaagatgcttatattttgatacggagggagtatatatcatttacttactttgtcaaataatcaggattgcctcggaaaaaaaattgcttgccgatgcactctagttcataaatttcactctagttcataaatttcaaatgtggataggatcttttgtttagatggtttcttttgtcctttctttctcataccaatactagcaacaaattagactttcccaactaaattaagaaaatcgtatattttcaatctcgtagaattacctccaatcactgaagataaaaggtagtaataattgataatcgatttgaaatgtattttcttttcttttctttttcttttaacaactatgacatcaaaacatgtactccttccgtttcacaatgtaagtcattatagcatttttcaaattcatattgaggttaatgaatctatatagatatatatatgtctagattcattaacatcaatatgaatgtgagaaatgttagaatgacttacattgtgaaatggagggagtaacaaaactctgtgtatcaggcaaaactcccactccacccgtttctttctagaatcggaacagagcgcgcgcttcacttctctcggaatgcaaaaccaacgcggaatcggatgccatctcgtccaggggcggagacaagcctagggcagctaggacttgagccctaggcctgtctccaaaaacttgcttaaattttgttgattcaccatgtaaatttttcagaaaactgaaactccattagtccagccctaccttagccctagtcttgtataatttctggctccgccactgaattctcgtccatagattaacagaccgcctgcaagtattacccgacgagacgacatctaaaaaccgagcagcagtttgagcagagagagattcgatggaggagcaccacgacgacgtgacgcagctcctatccgacgacgtgctcgcggacgtcctcgcgcgcctcgcgccgcgctggctcgatcgccgcgtcccactgcgtctgcaaggcatggcgcgccatcgtcgacacccgccgcctgctccgcgccgacctcctccctctctcgctcgccggcatctacctcaacttcagcacatctggatagatttgtaccggtttgacaactatctcgtgttcgaccccaccgtatcaccacactacgagatcttccaaatcccacggatccgtagtaaatcctacgagctatatcctctggttaagagcatgccatggccaccatcacaaagcctactgcaggtgttctcatcgaggactgggcaatgggaagagagatggttaatttgcacgggaaggtgatgctgccggtacaattgccgacatggtaacagaatatctatatgatcgttacaatggagtctactggcagggagcactttatgtactttgccagacagattttgtcatgaggtacgagttcatcattcttttgtactttgccagacagatatctaggggatgggaacctattccctcctcatggaaaacggagtaatccattagcgcatgattaattaagtgctagctatttttaaaaaaaatagattaatttgattttttaagcaactttcgaatagcagcttgaaaagcgtgcgcacgaaaaacgatagggagggattgggaacatggggttccaaacacaagtgtgcttaattaccattgctttctcttctttctttatattttttttcaatggtttcatgatttatattgttttaatgcataatatccttgccagataataagttccaagtaattaagttacccatgaataatgaagtatctccatataaaaactattttcttgggagatcaatgaggggtgtgcactatgcattaatagataatgagcatcgactacgtgtttcgttcctcaacaagtcatgtggtcagatgacatgggaacttaagcatgacaaggatctatcttagtttccttctagggtgtcaggaaatctgtatacaaaatgatggtccgtggactttgcactacaagaactactttggacattccagtcaaaatggcgctgaggagtactacgaagcttacaaggaatacatcacccggagatattgctatgaatatgacaatgcctcgtacagaaatcattgatatcgagaaagatgtgaaagaagtggtagtacgagtaaataaatttgaatgggactccgataacgatgatatatattcttgacgctgcaaatccaaatgaagtacgatgccgtagaaatctttcaatcttgggattccatccctataaagaagttatctttctgaaccaagagatgcaaagaggacttgcctatcattttaatagctcgaaggttcaaaatttgggtagtacgttcccaaaaccttatgatcatttgtatattcaagacatgtatgcatcttttatgtatagaccgtgttggatacaggggagcattatgaaagctcgtaattaggagatcatcttacaattagcatgttttggtgctgtaagtttgtgtggagaaccgaaaaaatatgttacttcagatgacatgttaagagataattttcttggtttaattttacatgacattgtgtgtacatgcatgtataggttagtatttgtgaagcatgtatagtatggtactgaacaaagttaatttttggctggagagtgcctgctaaaaatgacgcatgtatttgcaaaggccttttttattccctcagttattatactagggcatagtacaccgttagttttacttcgtcaaataataaggattaccccgaaaagaaaagatcacttgccgctgcactctagttaatcaattccaagtgcgcctagaatttactctttggatcagtagtatgatcagggctggattataggccgtccggcctagcatggctcaggcacgacggggtctaggacaaggtcagttaggccggcacagcctgacctacacgcctgaccgggccgtgtctatctatggtcaaggcacggcccaataaaactcgggccgtgtcgtcggggtctcgggttttatggccatctatagggtggagccacagcccggctagggataacgggtaaaaacttcattaaatttaatattgttgaataaagtgacgataaaactttttataataagtgatagtaacagagaagtttgtcccggatcgaaaatctttcaggctgcatgagtacagagaaacgtaaagaaactccttgtataaacctcaaatcactgaagatatggtagtatggtacagtagtaatcactgataaccgatttgaaacattctcgtttttttcttttgttcggaacatctatgccatgggaaactattctaatccctcgaggggatgtaccctcatttgctcaaaaaccatctaaactgttatgaaaagttctggaaaaatttgacaacatttatacaacatatatatgcaacttcacaaaatcttacgtccaaactcaactcacacgtcgagatataaaaaagacaaattcagcgtatgaatagtagcgtactgtttatatctaaatttatcttttttgtttctcgatgtgtagatcgaatttgaatataaattttagtggactagtaggtatcattatactctacattgtcaatttttttcagaaatttttacaactatttgcatcgaatttaaaagaaaaaggtatacgaggagatatcctctcgagggattagaatccactcccctatgccatctgtctagctacttggtgccatgcacgaggagggcgccgtcctcttcgatcctcccgagcggcgccgtcccgcggccgcgccacgccgccggcgcgccagccccagcatccgccttcttgccgccagctcccgcgtccgcggccgcaccgcgcgtcgcccacatggcgccggcgccgcgcacgagctcccgcagctcctgctcggagttgagctcgccgacgccgaacaccctcgacgtcggccggccgacgacgcccgccctggggttcgccgccacgacgaacttgccgaagcccctggcgccccggacgtagaggtcgcgggcgcggcgcagagcgcgcagcacggccgcccccgcgacgcgggacttgcgcgcgccccgccgctcgccggccgtggccatgggcgatggccctgcaagccggaatgctgggatgcagccttgacgaagctttgcttctggtttagacggctagtggtagctagtttaatagtagatggaggagaatggaaatagtgaaattccgagatgaggtgagagaaagttgggttaaacccttgtgttagtcttgcaaatcattgtgtagtttaattttgtttggaagacttcttcttcgaattgacttgaaatgggcaaacggattgttttattttctattttctccttttgataattgattgaacggtaggaggtccacactgtgcgaatgggcaaacggattgatttcttttctattttcttttttgataattgatcttatcgtcgtgtccccggcgaggcaagctgatggatttctattcgttggaaatttccatccatgccaacttggggcctgcacgggaatttggggcagaaggggagaaagagtagatgattgaattctatggcgatccatggacacgtggagttacgtgtgccgttggtttttgatccaacagtgcaagaaaaccaacgttaagagtagcacgatcgcaggaatgtcataagactcacggagcagtgctacatatgtaggatcgtaaagggcgttttccaccccaaaagctagccatttaggtgagggactcccccacttatatcttaggtcctttgcccttccacaacccttcacacattggtgtctctcagctcttcaccgccccttcaccgtatccgggccctaccgcccacggtccatcaggccttcacacgtgtccatcaagccagagatgttaacctagcctggttctgataccaattgtaggatcgtaaatgatctttcccaccccaaaagctagccattgaggtgaggggctcccccacttatatcttaggtcctttgcccttccacaaccaatatgggactattcaacaatatagatacactacgtatactgatctgcgttttgtgcatgagacatgccttcacgatggtgaagtgagaaccatcattctgaccaatttttcttctactccctctttcaagaagaatccctcctaagaatgaaaaaactaatccgtcccattttaagagcagccatgaatttccgtgcccaactttaatcatccgtcttatttaaatattattgaaaaaaatataaaaacgtaagtaacgcataaagtattatttatgttttatcatctcgttacaacaaaaatactaattataaaaataaattaaataagacggacaactaaaataaaacacagaaactcatagttacatttaaaattagacggaagaattatttgaaaaagatatttaaaaacgaataaactactccaactacaacgagtgtggacgacgagagaagaatagcagcccccgtgtagtagagaaacggagacagccgatatcgattatcccgcggacgtaagcatccttgacaaccgataatatagtgctgcggactccctccgtttttaaaatatttgacattattgactttttaagtacatgtttaaccattcgttttatttaaaaattttaagtaattatttattatttttatatcatttgattcattgttaaatatagtttcatgtacacatatagttttacatatttcacaaattttttttaataagacgaacggtcaaacatgtgctaaaaagttaacggtgtcaaatattttgaaacggagggagtaataattaaaaaaaaagatcacatgatgacttctcgacacggtacacgtctgacttggactggcaaagctatccactgtcgcgcgctgattaaagccaacaccgcgtccgagtgaagaaaccgagatgaggccgtgcgcgtggtggcatgccaagccatgccatcgcgtatccgcgatcgcgacggcacgctgcgacggacgacatgtcatgggctatgatggaccggaattgcatgggaggttttggtcggaagcccaaccagaaagcaagcaaggcccagcgcagcgcaccgtacgtaaacttgcccgagagaacctgaacgaaacccaatcctggtagagtatccccttatgaattgggcctttggaataggtcctgaccttgtatgtggagttgtgggccctgtctcctcagcacaactgatcagtgaccgctgacaacaacgttcatcttttgcttaaggccgttgataaacgggaaatatatactccctccatttcaaaatatttgacaccgttgactttttaagtacgtgtttgaccatttgtcttattcaaaaaatttaagtaattatttattcttttcatatcatttgattcattgttaaatatacttttatgtacatgtatagttttacatattttacatttttttaataagacgaacggtcaaacatgtgttaaaaagttaacggtgtcaaatattttgaaacggagggagtatattgcaaaccacatgtgtgatgaaaacctgcaaactatcgttggattaaaaaaatggatacttgagatatggtcacgttatcaagagtaaaattttactcctagattcaaccatgacgtgaatattaaggaatgatttaatattaaataattagaaggggtgagccttcgaacataaatcgtttagcccatcaccttgtgaagctagccagacctttgggggtttctcttcaagattcaaccatgagtaataattttactaggtgtaaatatttcactcttggtgacgtgtccaaatcatatatgttcattttaagatacaatgatactacctccgtttcagattatacgactttctagcattgcccacattcatatagatgtaatgctagaaactcttataatatgaaacagaggaaatagttttgaggttttcactttatatgtaactagatgataccctgcgcgttgcagcgggaatttatagtaataaacttaaaaaattaaattggttgactgatttaagtaggaaaaaacagagaattggtaaaaaacacaaagcacaatcgcgaatttgaataatctgcttatatgacaaagtaatagttgaactgtacattctacttcaattaaaaagtaaggctctgacttcaattgatttttgataacttcatggaaccaaacaccctatgccctaagcagttgtggcattttgaaaatcaagtaaacacatagcggttcttatcaaatttgatccttgtatcttagctagaccatgttagataaagcctagtaattatgtcttaatctgaaaaggctatgttaagccacaaacacaaaaaaaatagcattgttctttatccttagcatccaagtgtcagtgatgagctaaatcactcaaagtttgaagcttgaggcttctagtacgaaaaaagggcagcatatataataggtagggtaaataaaagcaaagatccaatttcatcttggtgaaatgtgttttgccattaccctcgagctgtataactctcataacatttttcccttgtttgaagaggtcctgcacacaaagtagttacatacatgtcctgaaaagacaaaagatgatgaggttgaatatcttgaaatatgcagaaatattatggaaatagatttgcaaatgggcaatgtgaaatacctaaacaatgtccttgactccctgtttatttgtaaatggtcttcttttgtgctctgacaaaaaaaacatgatgtgcttgccgctagcaccaaatctatatgctattaacatacctacccatcttaattttcactacattgtattgataatccaagtccggctgataagaaatttaatcattcatccggggtgcaaagtgtgtattaataaaaacgaaaccactttaagtattttggaatgaaaaatctgtacaaccgaagataagtagctgcactaacctttagatctaaaatttgagtgaatatagaagaatgctgcaatcacaaagagcatccaccatagtccaatccaaaagaacaccgacctgaagaatgaagtaacatcaatcactaaactgtagcttataagactgaatgtacaatggaaaatagagaagaatatataccttatagagaaaatcccctatgtacccatgaaagttcacctaatcccttctatacccctgaattttgctcaatctcttacatacccctgaattttagtttggatcccttccatgtccttttccgctagttgaccgttaaattcttttgaaaaagtccattttgccctttgctatgaagaaacataataaattaatgaagtatattgttggaatgtaaaaatttattggatgagactattatatttatgagtatgtgatgcaccatattatttgtgacaaatttacttttacatatgatataaaaagttgatacttatttattaattagttattaaaagttcttttatgtagcatatgtgttttcatagtaatacaacagatttgtttattacttcagaacacataagctaaaaaaatcttttaataactaataaataagtattaattttttatgtcatatctaaaagtatatttatcgtaaataatatggtgcataactatctcataaacataatagtctcatataacaaatttctatgctccaacaatatactctattaatttatatgcttctttataccaaagggcaaaatggactttctcataagaatttaacggtcaactagcggaaatggcatagaagggatccaaactaaaattcaggggtatgtaagggattgagcaaaattcagggatacagaagggattaggtgaactttcaagggtacacaggggattttctctaccttataagtttgtcactgaactaatcacagtgtgacctttgagcttaattgtcataattcacgtgagaagaaacttgaactacgaaagaaattgccttacctcttatgaagcttgtatcttatgatggacatagatattatatttctgcaaatcctgtgaacatagtccgaagccattagattctacagtgttggtacataatctgccgagggtaatgacttgcaatctgaaggcaaagcaaaacaaatcgtgggttcagtgcagcttagagtaatacacctagtcttagagtaattaggtttacatacatttgatcttcgagtcctcgtaaaaaattcaaggaagtaaacaaattaagtaaatttcaatacctgaccaaatagagggaaccaaaattcctttcgcaataggctggagaataccgaaaccaaatctatcacttgatattgtgtcactgtgagggtaagtagcaaacaaaattgtgtgactaatacttttctaaataagaagaaaaaataagcagatgaagacctatctggttccagaccaggaagaaccatacctgcggctgtgggaggagaattggacgtggacattacctgcggctgcaggaggtgattttagcgtgctatttcccatttggagccgaccaagcaggcgaatgcccttctaatttcttgaagtggaggaggctaggaggccgacggttcgaggggaggaagaaaccgtgggaaacaaattaattttcggcaaagacgaccggagatgtggcaggggccaggagggaatcgatagcggtagaagggggaggcaaagcggaaccggcgcgcagagtggtgctaggaggaggaggaggcgaagcggaacccggtgctaagagagatgtggtggtgggggctcgggtcgatgtggtgcggcgagagatccggtgggaagcggccgagcgagacgcgggagaggagaggagcgatgcgggagagaggggtcgatgcgtgtggggctggcgaagcagcgagatgcgggagaggagatgtgcgatgcgggatgggggaaagccaggtggaaggtcgatcgcttgattgagatcgacggtggggataaaatggggtgacgtggaagcaccaggaagcagagaatttctagtagtggggatgatttgcatatgtatataggatttgcactacattgatttcttttctattttcttcttttgttaattgattgaacggtaggaggtccacactgtacgaatgaaagcgatcttatcgtcgtgcctccgcgaggcaaactgatggatttctatccgttggaaatttccacccatgccaatttgggcccaagacgggaatttggtgcagaaatgatttaattgtacggcgatccatggacacgtggagttatgtcggccgttggtttttgatccaacagtgcaagaagaccggcgcaaagagtagcacgattgcacgaaggccatacactctcagaggccaggccgccaggggagccatatagatacaccaggtacgtatatactactccatccgtttcacaatatagaacttcctagttaatgaatttagacatatgaatttttacattaattcacatctttatgaatgtggacaatgttaaaaagtcttacattataaaacgaaggaagtatgtgttttatgtatcagacatgccttcacgatgagtcatcattgagtccactttttcggttttctactacaactccctctttgaaggagaatccagcttgtgagcacaaaaaacaggcatattaatgggaacataaaaacgaataaactactccaactagggtggctaacagagactaggagcatccccagcatttaaaatctgagaaatagcggatgggagtgaaaaatcggcctccagcggatactccatcggctacaccaaaagtagtggatcgctaaaacaggagagaggaacgccacgccaaatcgcaaccgccactttgggtcgagctcccgcccccatccggagtttcggaacgacctccgcccatcgtcatcgtcgctggccgccggcgaaagtgagtcctcaacagcggtggagaggtttgagagagagggatgtaccagatctggaagctcctgcccaatgttgccaacgggctccacgatacgcgcccgcttcgtcgtcgtcgcccctccacctgcgagctgctattgttgctcctccacgctcacccggtgccgccgctaggcttggggatgcagcagctgctccgcccgtcgccggcggccctccacccacgagctgccaccgtcgcccctccgcgctcgtccggtgccgctgtcgttggcgccgagatgcagcaccagacgagctgccactggcgcccctccgcccacgagctgctctcccttatcctctactctcctctcctctcctctcccattctctccgcctcctctctccctctccctctacccgcgagctactcctcggtgacggcagcaggcggcgatggcggcggcgcctctccgtccttcgcctcctctctctcgccatggggccgcgggacggctcgacggtggcgggcggcggtaggcagcagcgccctcccgtccggccggaggggaggcggcgggcagggacgacgccctctcctccgccggatccagcgggagaggaggcggcggtggtacgacatctcggatccaacgggaggggaggggagaaggtggcggcccgacgtcccagcgatggtggcacccctcccctccgccgaatccagcgggaggggagccggtggcgacctagcgtccctgtggctgttcggcggcgacagcggcaccctcctcttccgacgtcggtgttttcttggtgtccttgtgattgatattcttgtgttattgttgttgttgaaatctgttattgtgtttttttagtagttttctcttggatttaggtccaaattttatgcggactcgaatcaaggcgcacgggggcagggccagaagcaaggttgtcaccgcgacgatttttttcttttatttttcttttgccatcggagacggattgaagcgggatcgatcgcacacgcgaggaagaatttttcgttgacggacgaaaattctacccgggagccttacattttttttaattaagtgtagattaacgggtgcagccagaggccgcgattgaacagagctcctaaatttcctaaaatcaggattagtactactataatttttaatcaattggcaatttcaatataaaacttatgtagataaaatgaatgaacaactgatgctcgataaattgtcctagtgcttcatggcttgctcattggcacttatattaattaggggcctaagtgggtagcctatgcgatctgtcgtttattcctactgcatccaatctgtttttcttcaacaaaagtaatgcaaactagggcccctacacgcagccctctctgctaatctgcgatggtcgacaagaataatgcaaattcttccttcatgctagattgctaggcgaggacttggagtttcctacacgaatattgcattcttccttccgataggattcaacatgcctcctattcctaccagtcacctagaaaacatattccgtgttatcttgatcctctcctttttatgcttggattcctagagccaacacaaaacacatttttccaattcattttgcggtggacttggaaagagatgttgctctcctttccaccgatgctctttttatgtgagaaaaagacatacgtacgagctcctgcagagatagggccatgtgtaatgtgtttctatagtagagtaaatacgtgtgtcggtgcgtaataacataaggtaggagcttggccatatgtagtgtgtttctatagtatgtactccctctgattttattaagccgttggttagtttaattttgaactaactagcaccatatattgaaggatgtaggtagtataaggtgtaggtgtgtctacccttctctatatttagacaacaagcatcccctccttccaatcgattaatttattcaaaaaataataattgtaacaagggcttattctcttgtttaatgacgacatctagttaattaaaaggctagtaatcatggacaagcgttgttgcactgcatacaagtatatagtacaaaggaaagggaaaaaaaattaaaaactgtaacatcatcacaaaaggaacaaattaagacgatttagtgaggggaaggtgcggatgtacaacagaatgaacattgtggcgatacagttgaaaaatgcaatcagaatgaactcttgcttaagaacagactttgcatgatatgcatatgcaagtacaaattatatgaggaacaacaatcttttattaaattatgaagagcaaatctagttattacatatatagagataccactctgaaatggtaaatatagaaaactaaaatatggatcaccccctcctttgcgccatcctgttcatatcctccttgattttaggatttgtttgtcatccaaaactggttctgagcatctatggtagctaggcccagggtgtgaaaaaccgccggtaaccgcgcggttaccacggttaccgcccgtaccgcgggggtacggttacccgtaccgcgcggtacggtttaataaaattcgtccaaattcaaaaatttaaaaaaaaaagaaaaaaatcaaaaaaaatagtgaaggtagtgcttgatttatagtgttttatggtgaagaaatttctcaaaaaagagtaatatttattcaaatttgagagcaaaacggagaataaatttgaaaattggaaaaagaaaaa

SEQ ID NO: 55195 - DNA, 3020 bp, Oryza sativa
gcgcgctctctagcccccgtgagtgtgacccaccgggactaaagatcgagctcaccctttttttttgcacgcgcgcgcgcgtgcgtgttttatatatatatatatatatatatatatatataccatgcatatatatgtgtctatacatatatatgcatacatatatatatatatatatatatatatatatatatatatatatatatatatatatatatatatatatatatatatatatatatatatatatatatatatatacagtacatatgtacatgcatatatatatttatacatatatatgttatgcaaatgcatatgtgtatatatatatatgaccaaaatatatttacattatagaaaatgtgtacacatgcatatagaaacatatgtagtcatgtattaattataatccattatatgtcctagctagctacgatttcgacgtagtagtagtactcgctgctagctcagaaactaaggaccggtgaattgtgtttccgtcatagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgttacgtaatgaaattttgaatttatttgtacgtacatcgagctctcttgtggtgatgatttggtctgcaaggcagtggcaatactcgcacacgtaatagccgcacaagttagttccctgcttttgctttacgcactacaaataaatgacaaacaacgagagatctaattaatatacacttgtatgtatttaaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacagaggaacttatgacggtacctgtgtataagttcgaaaaccttgttaaacgtagactcttttttatccattgagtcatatacgttgacggtgcaggccgacaggtcgaagagtaaaagcacccagtggaatctgcaatgtgcgtgggatgcattacatatgaaacacttagcaagttcgtacgggaatgaaatttagtatgtaggaagacagtaaaattaaactaactctgtgttgtacggcaatagtatgaacgtcttgtaatgctgcgccttcaggagatggacgagattgtcctctgtttcttgtggatattggtcgagcattgcgacatttactctccgagggtcgatgaatccagtatcgaaaaccctccgccgtcgggccctttaaatctccattctacaacgataaaagggagtatattattttctatagtctacttatatacaaggacctaattaattaaaggagacgtatagtaagaaatctaactgaacgatatacttacaaaatccagcaactcataatagagacgtcgagtgcgtccagctagtatagttcgtagattcccttgaaattgatccagagaatgtcatctccttgcaagaagtctgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgatttgtgcgactcctagcaattgatccgtagttagaccggtgtcagtaataaattcttctatcgtcatttctttaccggtcaccaacggctcgatctcctggtttggttgctctccaagctgagggactgttttggactttccagaatatgctttcttcagcgttcgctcatagtacgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctggggggcccttgactttgaaggtgccggaagagaagcttgcggaggagtaggtgtaggagcccgaggaggagtcggtgcaggatcctgaggaggagtcggtgctggagcctgaagtggagacggtgctggaggatcatgaggaggagacggtgcaggatcctggggaggagatggcggagccggaggagatggtgcacgagacgccgcttgtcgcccagggaggatgatgtaccgcctgcgccatagaataatggcatgccttgtgtctcgtagatgcgtctcaccgtctcctccagggtaatccagctcgactcctcgtacgcgccttcgaccaactcaacttcgaccttcgagtatcctgctggaatcggcctgcagtggtaagtacctgaagggttagttgggatggccatgcccgacgccaccttcatgttgtgagagattatttattagtaatcaacatatataagcagcaactagcggaatggctaaatctaaaatatataaactacgagcttacctttattgataagttcttgtaaggaatatgtggctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgctgagttcgtagctcgataccccggaactctag

SEQ ID NO: 55196 - DNA, 2530 bp, Oryza sativa
tattgacagtcacgttatcccgcacaacccaaccgctgtgacgtacatagatcttggcggcttcggccggggcactaagacgtccatcttctttcacttacgttatgatgtgccgaccctcaagcttcttcgctacacctcgttgcccgcgtgccctcttttgtacaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcagtcagccatctgttgatataagaaatatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgttttgtgcgtatatgttaagtctaattaagactacaatagtcaattgctaggagtcgcaccaattccgtagtcaataattacatactaattctaattacaaataaagtaatcttatattaaaactcaaataatattacatgctaagactgaaagagtcatgtatgctaagtgtaactgtcgtatatgctaagtctaattaagactaaaattgtcaattgctaggagtcgcaccaattccgtagttaataattatatactaagtctaattacaaataaaataatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataattacatactaagtctaatttgcaataaaataatcttatattaaaactcaaataatattagaacactacacaatcttatatgctaagtctaattacaagtctaatattcttaattgcattacaaatataacaatcatttatattattatgtcacttgcctgcacgaattccttctacggctagctcttccactccggcttgagggacgactccgacaacatgtcttttctgcaagatacaaaaaatatgtattaggataaatgcgaagtaacatatatatatattgcatttcacgttcacattcgttcgctcgttctcattcacgttcattctcgttcacgttcgttgtcgttctcgttcacgttaattcgttcgatcgttctcgttctcgctctcgttcgttcgatcgttctcgttctcgttcacgttctcgacgtacgttgacgtgttcgttctcgttcacgtgttcgttaacggcggtgtggcggcattgggccggcgcttggcgcggcggcgtggcggcggcgtggcgacggcggcggcggcgtggcgttgcatgcggcggcggcgttgcgcggcggcgaaagcggcggcatggcgtggcggcggcggcgttgcgcgaacggcggcgaaggcggcggcgtggcgtgccggcggcagcgtggcgcggcgtcggcgtggcgcggcgtcgtcgtggcgcggcgtctcgtggcgggcggcgcgacggagagagagatcgagattggagatcgatgaagggagaggcggcggcggctctcaccccagagatgcggcggcggcggaggaggcggaggcggcggcgaggacgacgagctcgagacgacggcgagatacggcggcgtcggcgcggggatttgccgtaggcagtggcggcgaaggagagaggccgagagagatcgatcggccgaaaacgttaagtgttggtggagaagatgagggcgcgcatcgggaatatatatagccctcgatctttagtcccggttgatgagaacaaccgggagtaaagagtaaagatatatttactcccggttgttgagaacaaccgggactaaagaaaatatctttaatcccggttgttctcaacaaccgggactaaagatatctttagtcccggttgttctcatcaaccaggagtaaagatcttttcccgctatttccaaattatttttaaacccggttagggttaagaaccgggactaaagattatagcactgcatatattttcgcttacatatgtgtttctaaaatagaagttaatgcattaacattatttaaagtacaaagattaatgacaattacttcgaaaaattatttttgtctgtaataaattaagtggataaatcgtaataagcaaatatatgacttaaaattaataaaaattccaataatcatatatacttagcatatgaatgatattattaaat

SEQ ID NO: 55197 - DNA, 2498 bp, Oryza sativa
taatacttttaaaaattctctagtcaattataattagcatatgaatgatagtcaattaaatgtagcatatgaatgatagtaaattatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcgtcaggccctctgcccttctttcctttgctagacatgtccttcacgaaaaagacttgcgttacatcattggcaaggacaaaaggttcgtccgagtatccaaccttgttaaggtcaacagttgtcataccactgtcatcaatcattacgcctccaccagtcaacctaacccattggcaccggaacagaggaaccttgagaggaccatagtcaagttcccatatatcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctagaatgtcgcgatcgacccagacggtcccctcgccaggaaggcaagttgttggttgattgactcgttacccatgagatgttgtcgtagccacgtggggaaagtatcaatgtgatgctgtgtaatccatgcatcggacttaccgatgttcctggcgtgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcggtgacctcctctgttccataacccttggcgatgcttgcctctggatgagcacggttacgaacatacttcttcaaaacgcccatgtacctctcgaaaggaaacatgttgtgtaggtacacaggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctacgaaattgcgttcatgaatgcacatagctttgttattgttgcccggacatatgcttcagatcattacgttccatatctttcgacttttcgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctataggctggcttccaggcccctttccgaacactactttaagatctttaaccatagcaaacactgttttcccgctgcgatgtttaggcttcatacggtggtcggccttatgttcgaagtgcttgcctttcttccgtaccggatggtttgttgcaaggaatcgacgatgacccaagtatacaaccttcctacagtgcttaagatacgtactttttgtttcatccatacagtgagtgcaagccttgtaccccttgttggactatccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacatcgatgtcgttaccaggttgcttggggccttgaataataatcggcatcattatgtacttcctcttcatgcatagccatgggggaggttgtagatacacatcataacgggccaagtgctatagccgctgctcatctctccaaaaggattcatgccatccgtactaaaaccaaaccgtctgtttcgtgcgtcctttccaaattctttaaattttctgtcgatgtttcgccactacgaaccatcagcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttcccctagatcgtctcgtctaatcttgtatcgtagtgctttgcaaacagggcacg

SEQ ID NO: 55198 - DNA, 20239 bp, Oryza sativa
  unsure (1)..(20239): unsure at all n locations
tttcgcagtcctccctggcgtcctgcaacatctgaccaagatcatccgcaacgtcgttaccatcagcagctatttcctcctcgtccgtttgattttcttcaaatccaacatactgagcaaagtccagaatattgtcgtcttccacttcatcttcttccatttcaataccttgctctccgtgggatgtccaacaattatagcttggcatgaaccccgactcaaacaagtggaaatgaatagtcctagatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaaaccgtacacaaataattattcttacaataatgacagtcatacaataattataagatatctttattcatacaaaaatcataaaatattacaccaaataaattcttaaaaactatttgtaaaactttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagaaaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctagaggaggaagaagacatataaataggggtggaactttagtcctagttggtagcaccaaccggggctaaagatcaccaggatctttagccccggttggtaataccaacagggactaaagttacgatctttagtcccggttggtaataccaaccgggactaaagatcccggggagcctgacatgccctgacagcattcgaaccgggactaaagatcttagtcccggttggtgatcaaatatgcccgttacccttttgaaccgggactaaagatcatctttagccccggtttttattgcatccgggactattgtggaaatcggccaaccgacgaaagatggtttctccaccagtgatggatagcgtctaacgcagcatggcgcccgagatttaggttgggtagattagtaatgccaccgttacctaatagggaagcataatcatcaccgatggtcaaacgtgtcacaggttcagggattagatcagcatacttttcaaatgcatgccaattcccactcctgtttgcaaatgcgataacattaaggttatcagctcgtattgccagcatcgtgatgtcatcccctcttccagttagatttgtcatcttcatcgatgccggtggatggtacaacctctgtcggtcaagaatatatgtataatcaacatgtagtccacttgaggtgcgaatggtagatgcaagaagtgtttgaaggatggagcagtaagagcccctaaagaagtcatgctgcaaaatttcgaagggaggccaccaaatactgaaaacgagaaaggagaattatatgagctcataggacagacaagagacacaagaactaaattagtacatcgaatgcaaccacaagaaatgcctttatgcatacctctgaaagagttcatttggctgcaatgacgatctcacgggagaaacaaggcacgtgataaccaccaccttaatcataacaaccatgttgatatgtgccattgatgctcgttgagaagcgttgagaagagagaggattgtgctagcttgtggctatgcaaggttggactgaggaacagagaagattcaatttgtggggagaatgcaccggcatacaaggaaaacagtttacctttaagtagtcaagcaatcattgttgttgggctgccgttgtatagtgtcatttgcatgatctcgtttaagaataggcaaggcatgatattacatgcatacaatgtgggacaacattagttcgctggcaaaaaattttacaacatgtcatatcaaacgtttggatacatatatggagtattaaacatagaaaaaaaataactaattacatagtttgcgtataaattgcgagataaattttttaagcctaattagtccatagtttgacaatgtggtgctatagtaaccatttgctaatgatgaattaattaggcttaataaattcgtctcacggtttacaggcggaatctgtaatttgttttgttactacctccgtcctagaatacttgtcgctttgagtttttttcataacttttgatctttcgtcttattcaaaaaattatggaattactctctccgtcccaaaataagtgcagttttacactattcatctccaaagtttgatcgttcgttttatttgaaaaatttttagattactatttttattgttattacatgataaaacatgaatagtattttatgtgtgactaattttttaaaaaaatttcataaatttttcaaataagacggacggtcaaacgttggacacggattttcatggctgcacttattttgggacggaggtagtattatttatttttttctgtgatttgctttattatcaaaagtattttaagtatgacttctccgtttttatatttgcactaattttttaaataaaacgaatagtcaaacgttgcaagaaaaaaatcaaaacgactactaatatgagacggaggtagtattaatctacatttaatacttcaaatgtgtgtccatatatccgatgtgacacgctaaaactttacacccttggatctaaacaccccctaaccttatttgataacgtgggaatcgaagcatgacaagacattaggtttctgctgaaattaatgctaggacagcaatgtacagatgatggaacaatggacattgcactagctttgctaattgctacccttaggccctgtttagagcctgtttaggcctgctcgaaaaaattttcaccctgtcacatcgaatgtttggcacatgtatagaatattaaatataaaaaaataactaattacacagattacgtgtaaattgcgagacgaatctttcaagcctaattatgctatgatttgacaatatggtgctacagtaaacatttgctaatgacggattaattaggctaataaatttatctcgcagtttcctgacggaatctgtaatttgttttattattagactacgtttaatactttaaatgtgtgtccgtatatccgatgtgacaaccaaaccaaaaaattttcccaactaaacaaggcctcactataaaaaacactttttcctggtnnnnnnnnnnnnnnnnnnnnnnnnnnnnnnnnnnnnnnnnccagtgaaaatacaactgggggtcctgcaggttagtaacagcttacaaaaattaattttacaagtgatcgtactaacgtagcagcttgtgaaaataacccaaacaggtattaataatagagtaatatatatgtaggaataagtatgtgcaccttttatttttagagcaatttacagacaattattcaatcgaatccctctcaataataactaatggccaagccaaagaaataagtagacccccacaggaaagagtactaagaatatcgcatataaagatgttatttacgggtaatcaaagattggttcgcatgattaaaattaattcaaaaacataatctacaagataataaattgctgatggcatgccctatatctaggtagaatgaggatatcaactcatgggaccaaataatagtcacaaatccggttctggacacctatgtgtttttcaagaaactcgttcgaaccaataaatttatttgtctagctaacgcaagggttcttagttcacactaaaattgaaagtttggttgaaattagaatgatgtgacggaaaagttggaagttttgtgtgtagaaaagttttaatgtgatagaaaagttaaaagtttgaagaattattttagaactaaacacggcgtaactattcaaatggttaggaacttgtcaggttgtcttctatatctcttcgtgcgtgcttggagaaatgaaccactatattttgctagcttttaaggtcagtcccgactagcattgatcatttataatattatattatattatattatattgtaaataaatgcatgtgtaggatggtgacaagctaaggcagccattgttgctacatctactaatgtaccaataaaataagtgtgaaagcaatattcctagcggcccacgagattttcttaactgtatcataaatgctaaatgttacggtagttattttcatgcagagtatattctacatatgtatagagtgctttattttttttacttgcttacacccgcaacaaattaataaaatagctctatatttttaacatattttttaaacatataccgccttcatatattgtatactgaagtgattatatacaattaattctggtcaagatttattgtgccaaaacaatatcatattactgtactttgtgtgtattttatatgaaatatatttgatatacaatatgaattgaattagagctcaattgtagatataatagaaaaatattatttttgctaacattaaattttaaaagttattaaaaataaatagaatagcaccatagtgtttagcagcatatttctagtttttatggttgttttgatatggtcttggcaattgttttgtagcggtgattggtgatgaaaataagaatgaggggtactgttttagatgtcttttaatcattggatttgtccctgtagaggttgtcgttctgaatcaacatatggatagaagatttgcttatcattttaatagctcaaatgttcaaatacttgggcaatacgttcctaaaattttatagtggattgcatgttcaaggcaagtatgcatctattaagaaaagttggtgagatttaccaagttgtttataattggttgagaaaagatgatagataaggaattactatggtgtgtttgattggatgaaaatagaatattggtagaaaagttattgtatttttggattaatttaaaagttaaaggttgtcatattttagaacagatagagtatttaaaattaagtttgaaatatgtataacagtgtgacatgtaggaccgtgcatgcctcgacctgatggatctgtacgcacgtagaagtcatggcacttgcgccatgctgctttgcctgcttgctgtcgagtctcgcacgaaatcgctaaaaacagtctcgcagccctccgcgacgccgcgcccacgccaggtctcggtttgtcgaagaggtcaggtccccggaaaagctagcgcgcgggttggcggcgagcgttttcggatagtttagcctaactaagtgaagttattagtagataataatggtaattaagatatgattatttttcgaaagatttttttttgtactaaccgattgaaaactttcaagtttgatttgaaaatctttgaagtcaaattttaaaaaatttcaaaactcaatttgaaaattttcagctcaaaatttaaatgtgtaagacaaatttagaaaactttcaactcagatttaaaaacttttatctcgagatttaaaaactttaaagtacagatttgaaaatttttaagttaagatttgacaaaatatgaaaactttcgactcagatttaaaaactttcaactcaagatttgaaaacattcgactccgattcgaaaacttttgactcaagattcgaaaaatttcaactcgatatttgaatactttcaaatcagattaaaaaaatttcaagttaagatttaaaaactttgaaaaaaatattttgaaaaatataagtgtgctaaagactaaaaaaaagtaataaaaaaactaaaaaaaagaaaaaaatcgcaaaagaaaccacgaaaaaacaaatcgcgaaaaaaaaaagagcttatgggcttttctgagccagaagcagctggcgcgcggcaactagtaacgccctcgagtctcggcggcatgggcatggcacgcccatcacttattcgcagcgaccattcgctactgatcgccgcgcacgcaccgcgcgagcggacggacgacaggtcgaggctataatggatcggaatatgggaggctctggcatggagcccaacgaaaaagaaagcaaggcccatagcaccgcaccgtaaacttgaccgagagaacctggacgaaacccaaaggaaacccaaatcccggtaaactgatttgagctttctggatgaaataagttcatctgaggtcttttaacttgtcaacgaatccgatttttatccttcaaccaaaaaaatcagatacaacgtatccctcaactgtcaaaaccagtgcaatataggtcccatgacggtttggacggcggttttcgctgacgtgacgcccacgtgactattttgactcggtcttcacatgacgtggcaatgacatggcgcttacgtgacaatttgatttggaaaatattaaaaattgcagatccacatgttagtttacacaaaaaaaatagattaaaaatggtgggttctcaccctcctcttcttcctcctctctacccaactcccctgtattcactctctctcccctctcctctgtcctctccgacggccgaagagagatgcggcgcgcggcagccgggcgaggaggggcggtgccattctgctgggcatcgtgggcggagcggcgggcggctgaacaacccctaccaggacctcaatatcccctacaagcagctctatgacctccccacctccctggagttcctcttccaggagtcgctcgcccagcgctgctcatggggtgagaacctcacctactacaccagcataggctaactctcgggcgccgccgtagacctcggagacgccgcccgcagcgccgagcccgggacaccgctaagatccgggtgaaccgcatcctcaactcatgcggcagggccactgcatggggaacacgctcagggtcatcggcctgctctatgccgggagcccgggatcgagagtggcatggtcaccgtgcgcgaccgtgacgactggatcaacagcgtcaccgtggggctcagcactggcgcgctcttccgcgccgccgacgggtcacgctccgccgccatcactagtgccatcggtggggtcctcaccggtgccgccatgtcaggcaagcaggcggcgaagagatatgtgcccgccctctgattcgtctgcacagtattctctctgcccctcctcgcccggccgccgcccctcctcacccggcggagaggacagaggaaaggggagagagagagagtgaatacatgggagatgggtagataggaggaacaagaagagggtgagaatgacatgtgggacccatgtgggtcccatcatttttatcttttttttttgtaaactgacatgtgggtccacaatttttagtattttctaaataaaattgccacgtaagcgccacatcatttccacgtcatgtgaagaccgagtcaacatagccacatgggcgccacgttagcgaaaaccgccgtccaaacagccatggaacctatatttagacagttgagggaccggttgtatctggttttttggttgaaggacgaaaatcggattcgttcacaagttaagggacctcagatgaacttattactttctagattgggcgaggatcccatgtgaattgggccttcggggattgagcgaggatggagaaagtctattttgctccgttaactatggacgcagtaaaatcagatatgtagtcccctcaactattaaaccggatcaatttgtctatcggacggtttttattgtggttttgccgatgggtcccacctaccattaagtgttccattatctttatctttatctttgcatgtagcctagtagttgcaatgacctgagtagcaccctaagctcctgagttcatatctctatagcagcgaatttcagatttggttgtttgaggggctaagttccaaaattaagaaggttgcatacattcggttggatgtagatgttgggtaaaaaaaatccttctctaaaaaatatctttgttctctctccctcggctggacacaatcacgcaaagatgggtggcatcggagcctcgttccgaggctagtggctaacgaagaccatcggagccgagcagtgagggcatcatcaaaggggataagaacatcacgaagtagcccccaactccaaacctacggctggtgttgctttttttttcatctggcaacggctgtactttcctcttctcatcatggcggccatggacattgtacctgtggacggccccaaggtggtgcagattttgagcggcgtggtgtcgagtgtgttgtgcaccaactagaggagtggcgatggtggtgagggtaggcgcggtgtgcaacgacgagatcaggggcaggtgcgtcgcgccaacaggaggagtggcggtagggtcggtgcaggcgtcggtgctgtcgtggtcattggacggggagaggtcaaggttggagctacgatcaggtgatggttgggccgaggtagaggcagagccagtctccgaccccatcactccttccctttcctccactcttccgcaggaggggaatgacctctgctgctcttgccaatgacgaggaaccaaggaggaggatggaggggacgtcggccggcgcacatccaccactacctaggcatcttctctgttggcggcaacctctcctcaatgttgtcgttgcttgtagtaccaccgccctgcacagtgctatcgtccgtgcaatttgggagagtggaagaaggggatggctttcactgacttgtggtcctagtcaaggctatgtggcgccacgtcaaaggaaaccagtgtcaaaatcactcgggaggtagattgactggttttttttttttttgaggggcacgaatcaaactcaacctatagttgatggtggtaaattggacttaatccaaagagatcgatcccatacgaattgggcctttggaattgccacttgagctttcactgcggtatgtgggcccactgacaacaacgttgcttaaggccgttgataactttacaagaatacatcgaaggagagtggagaggaaaacaacgagctcatcagtgaccagagagccagaggtccagagcagaagataaagcgcacagctgacaacacacagatgccaaatccggcagcacgacgaagcttctacccgatcgactgaagtttagcgatagccggtaatccgcccttcagattaaaataaaatcctgacgccttgtagaaccccttgtcgcaagcaaaagccccatcctaatctttcccatctgcaaataagaaagaccacacatcgtcggtcggttctactaatcattaaaaccccccccccccccaccccccccgagatctctccacagacacgagaacattgagaagcacgcgcgacaggaaaaaagcactgtccgtgcgacgtcacctcgcccacgcaagacgctgtctcgccggtcgatcgtcatgtacccacgccacgcgagtactaccatcgaacagcacaaccatcgatcggcacagctcggttttacggtcgcgcgactccgaaccatccaagggaagacgccgacggcgacaaaaaagaaacccaggataccgccccgcccgcccgtcccgtccgacgtccgcgtcacgcacgcgcgcctgctcttgccgctcgatccattagagaagtttaattttatagccaactattacttttaaattatttatagtcaaatttttttataggatatttatagtcaaattaataatcaatttatacaatagttatctataaatataataaatatatgctacactattaatttctgatcccacctgtcatacacatattgtttcttaaagttcgtgctacagctgactataaatttgtagcacacgactcttctcttttctttttatcttcttaaaatatatttatggctataaatcttcttttcatctccttagagtctgctcttactgatcggttccgtctccacccaccgttgcgttgagtcgttgacccgcagttcccctttgttttccacgtgtttcttccacaaatcgcttggcgccgcgtccgtgcgagcccccagccgccgccgagcccccacacatccatccactctcgcggactctgaccagctgaccgctgcgaaacccgcccgcacgggcgcacgcgcgcgcccgcgcccgctacaaatatgctgctcccccgcacgtacgccgccgtgtctcatcacgagctcgatcgtttcccttcccccccaacctgagcgttccaacttccaattcaagcgcgcgcgcgagagccgatggatcatggcggcggcgagaggaggagcgccggcgcctacgaggcggcgctgagggcggtgcagaggccggcggcgaagccgtggcgcggcggaggaggaggaggaggcgcggggggatcggcgggtgccgcgggggcggcgccgcccaaggtgtaccgcgtggcgcccagggacttccgggagctcgtgcagaggctcaccggagccggcaccgcggcgccggcggtggccatgggcgcgagccaggctgtgcctgcgcccccgccgccttacgcgggtgtcccggcgcacgggcagagcgacgcggcggcggcggcggacatgttcgactacgcgtcgtggttctccgtgccgctgctcagcccggcctccatgccggccgccggctacgacggccagctccaccatggacatggtgctttactgtagttttagtatagtcgctgtccttgtaagatcgagccaaattttgcagttcgatcgcttcttcttcctgtcgtagaacgcttgtattagtttcttcaaaaacaacaaattcaaagaattcgatgaataaacacatgaattagttctcggcggcataaagaacacaattttcagtgtttaatgatgtgactaccctctttggtttgactattgctgacgtgtaaattattccctggttatcttgggttcatcgttagctaggcctaggcggctgtggttaatagaacttaattaagctatcgttgtcaacgttgaaacttttgttatctagatggctcaaatttagcatgtgagaattcggcttatcaaatttcgcatcttcttgtattaagtaatgtacgctcacagacaaaggtaatggcatgcagttgcttcatttcattatgggcgttcaggggatgcttgactaaccggaccaagttgagtactccatcctccgctccaaaaaataatataacgtttatcttatttaaaaaatcaacataaatatgtaaaaatataagttaaaattattttttatgatttaaacgtcacagcataaataaataatatttatatttttaacaatatgaatagtcaaacgtcgtgaaaaaaaagttaaacagtgtcgtatattttaagacggaggtacgagatagtagttgagtagggatatatttcacctgattttactttcgatggacaacataaaggataaattgtcatcaacaatatcttatcgttaaggtgatcgttgtctactacctccgtcctataatataagggattttgggtgggtgaatgtgtgtccagattcattgtactataatatgctatatccatccaaaatctcttatattataggacgaagggagtacttatctagattagagtgacatatccacccaaaatcccttatattatgggacgaatgaagtacttatctagattagagtgaaaattcgccgacacgttcaattcatcgcttgaacgggctgcggttgatggcacgaggaagtgatcacatagactcagttatatttgaattttataattaacctataggttaatttatccctccccctaaaaaagaaactctagctagagtttctttttctgttgatttatccctccccctaaaaaataatttttggattgctaatagtagaaatataaaggtttaccttaattaaaaattatttgtttgttttttttggttaataggttataaatcagccggtgagactcgaattcttacgaaagatctcagggaaccatgtcccctgaataataatgccacggtaactttctcatgctgatccattggtgaattcctaaagtctcggtacaagtttgatgaacaaccaaggaaattgaaagaaactatatttttctatatactaggtgagatccgagctttactacgaaatgcatatatagatgaattggtgttaaatattataaaataatggatggatatatattaaaatatttgtggaaataatgtgatcaaaatgatttggcatacttatacgagtcatgcttgcatgagatgagattaaaaatgctattgttttgagactattgtcatccaaacttataattaacatttaacatcatagatgagcttaaatgaaaaatttgtccactccaaaattgtatatctcgtctatatctacaactttcatataggttttatcttcatctgagattgtttagaaaatttaaatattcatttatgtaaatagatccgagacattaaaacacagtttcggatatccaaacgaccttcaatcaaaaagtcgtctactataaaattgtaggtctcatcaagctctacaaatttgatataaaatttatcttcatccgactttatatgaaaatgttagataaaaaatacacatatatgagttggtgtcatcataggtgtcatttttaattataaaccggaagaaccagcacatatgtgatgcatatatatactgattcatgataaaaatcgatacctatgacatcacacttatatgtgccggtttttgttacaaacttgtaccgagtgattataggtaccgatttattaattttatacttgaaaaaggtgaaattagttttatacttgaaaaaagtgaaaaaaaaagcttcatgggtgtccttttttggtaaaccggcatctataagaccggtctctatgtgatgttttgtagcagtgttaacttggcatatcagtaaaaccagttatctatactaccggaggacttaatttaacgcagttttataagttaggagttcaatatttctactattacggtttaaaaataccgattaaacttgatgtaaacatgaggggttgcaagtgaacttattatgtgcagaaaccacccccacaaggcgtcaaccttcaaggcctgtgacagtgtctactgtgactgctgggccgtgagctgggcctgagggaggagggagatccgtagagacaaggccacaagtggacgagatagctagttggcgataagtcgcacgcccccctccccgcgcgactagacacatgtcgcgcgtggagagggggcggcgacgcgccgcgcaggtgaggaagagcgagttttccctcttttttttgttttttttacgttttttccgtttctgttcggttagttttcattttttttccggttcggttggtttatctttctttttccggtttctcttctgtttttttccccttttttttaaattttatgaatataaagtttgtattcgtatgtatactaagtttgtatttgtatgtatgcaaagtttatatacgcgtatgcaaagtttgtatacgcgcatataaattttgtatatgttgtgtattttttagtttttttattttttaatacgtatgtatataaagtttgtatttatcgtatacaaagtttatatatgtcctatataaactttgtatacgtcatatatatatataaactttgtatatgtgtatatattttttatacattaaaaatatatttatatatatacgtatgtacttactatatacacacgtgtgtatatatagtatatacatacgtatcagccgtccccacaagtggacggtgcagcatccctggcagggcgccgaggccatggccggcacagcagttcagcagtgacagcagcgactccaattcagtgtcgtggaagacggtatacggatatcggacggagagggtaccgctaaacgattaatcggaatgcggacgattaatcagaatttggcggaaatataacgttttgaaaatatatgtacatagttgataatagttttcccttctatatatccttaaatagaataaccatatatgatatttaaataagtttataatggatagctgttactgtatatctcaattctcatgtagtgatgggttttgttcataatgcatgaaatgaattatcaagagaatgtagtacatagcataaatgaccgtaatcaaggttccaaataacatatgtatcggcttcatcaaatacaaactccaataacgtgatcatcgtcaaaatcaaggaactcatgttcaaactttagaggaagtcagttccttgtcattttacatctttctgccttgtgagaatttcggaagagcaaacttctagtcaatagtagtaaagggcacagctaatgagttggattgtggaatcgacctttgtcaccacgctgattatacggctgattagacggagacggacgatttaatcggtaataattggatttatgcgtttgttaccgactaatgatgaccgcatcggcgtgacgtgacggactgatctccgtatccgtattatcggacgtattaatggccgttaacatcgttttccacaacactgctccaattaggaaaagagaggaaatgatcacaaagaggtaattgatgaccttatttaatttgaaaaccattactcattagcaactacaaattaccccattgacaagtagtgtagcagcattgcagcatcagtaagagaacaagccaagagctagaagcagaggagtaatgcttttcttctctcctgacccacctaaattttgggtgttctctaccactgggcacaggcaagcttaggatgatgaccagcgcacaaatctcacgcaaggaagggaagtcgttttgatcctgggtatgtcccctctagtttgttgaactatttattctaaaaaattaatataaaatcttaatcttgaactcaactcacaataagataaaaaaaaggattattcatagattgaatatgtctttttctgtatgtgtagttgaatttgaacttgttttggtagagtgatagatgtcggtgtactctacatcatcaattgttttgtataactgtttgtatttaatttagaagaaaagaaaaagatgcacgagggacatcactccagtgattagaatccggttccacaatgggaactagattctctgctgttttcccaatcacctgactagcaaagatgtttacacatagctagttctctttattgattcatggcgatgtactataccacacacacgtaccacaaccagctaataaacagagaaaggaacttaaacaagaacacactgcatgcatctgatctgattatagctaattaattaaacaccagaaagcatcacctcaaacttttaaccgcacatatatatatatatatatatatatatatatatatatatatatatatatatcctcttcatcacacaccctacttgtactcttcacagaacccagtgaatccgtggtgccggcgccgatatatcgaactcggcgtttgggagattcagcagtaggcggtgcacttggtcttgcagtcgatggtgcagccgccgccgccgcccccgccgccgtagcccttgccggagctgctgtaggacgagaagcacttcttggggcacgtcaccttcttcctgtagcacgggcccttgtcggagcacaccaccgtgggcaccaccacgccgccgcgcgagtacccgccgctcggcgtgccgtaccctccgccccacccgccgcccatcccgggcacgttgaacccgcccatgccgccgcccatccccgggatgctcccgaaccccgggatggtcgggatgccgccgccaccgccgccgccgggattggtgcccgggtaacccggctgcacggacggcttcctccccgccggctgcttcttggcggatggcgcggcggacatgaggtcgcgggcggcgaggggggctgtggcggagagcccgagcaggaggaggaacagcgcggcggcgacgcgggcggtgctggccatggctaagctttagctagagctagagtgagctcccttctcgtcgatctcgtggagttaagtagggaaggaagagtgagggtgtgttaagtagtctaaagtttttgaaatatacggaacacgtatatgaagtattaaatgtaaactaataacaaaacatattatatattttacctataaactatgagataaatttattaagtttaattattatattatagtatcgcattgtcaaattatagtgtaattagacttaaaagatccgtctcgtaatttatatgtaaattatgaagttgactttttctatatttaatatcatacgtatatatttaaatatttgatgtgatatttttggctaaaattttttagatatagaaaaaggcaggatgggcaataaaggtggcaagatatggaggaggttggggaggccacaggcgcagcgcatcaccagcagtgcaatgtcagtggagtggagttatggcctctctttgaagtttgaagttttggtccggctcgccaccggcggtgctctaccttttgactcacaaatcttccatgtcatcatcatcatcaatgaaggatacattacgatttttcgtttggccgccggccaataacgcgactcacgtgaacgtccgtacttgacacgcccgcgaacgttgtgctacacctgtttttttttttcggataataaaagaagaatattttttattaagaagagtaaaagtatttacaggtgttgcaaaaccaagaatgaggaggagaaagaatacatgagaaaaggactgaagcctactctcacagaacattttgcgaccaaactgtcctcacgttatcggcgttggagctgccatatcaccgtctcttttgccattgccttcccaacctcctccagtttttctgttattgattaaatacatgattatttcgctctttccaaattgaccaagacgtaggagcagcgatagtgtcgaatccttggtgtttggatttggcaattttttttcctgttgtcgcacaaccaaccatgtaaggatcctttattcattggagagcattttgggtgatcgattgtcctgagtatcagccaccaaagctgtctcgacttaggacatgtatccagaatgcgatcgatgcttgcatcatgttgagcgcaaagaacacattggctagggtgcggcaaacccctgatgcacaatatgtccatcgtccaacatcgcttcagagcaaccaatcatacgaagtagtaacaacgcggtggtgcgagcgattttcaaatcggtgccgattgaaaggagactcttgcaaggaacaatgcttggtaagttgattgagaagggaaggaagggggaggggaagagttgggaagtttctcatcttagagagatactaggagatgcggcggcctaaggttggaccatggagatggggcgcaacgacggtatcgctcgagttgtgaggtcagcagcgggagcaaagtagaatggagatgttaggaggcgaagggaggtgctaatagatccgctcaccaaaggtggagaagggtggggcaaatcaactataagagacggatgaggaaggctaggtaggggcacctcaccaaagcatgaatgtgtggtcgaagggaggcgtcaatgtccggccgtccatggtggagatacggaggatgggggtgtataggtaggggtgggcattcggtctaaccgaaaatttcggtctcaatcttcggtctttgaaaagtaaagaccaaatttcagtgaaaaaaatgtcaggaccgacaaattcggtctcggtctcggtcctgaccgaaattcaacaacattttcatatatgcaaagaaataatagaaattttcaacacaaaaatcacaaaaaaaaaatcgtaagcacttatgagtaaagactcttattatgttacatgcctaaaaaaggtaggaatgtgaaaattagagtttaatcctattaaacatagtggattgtaggttgtatttatacattttttgataattcggtctattcggttacccgaggagactaaccgaattgaccgaacaaaattcagtctttcactacctaggaccgaattgatgaccgaatttcttggtctcggtctcggttttttcggttcggtcttttttttttgcccacccctatgtataggaataaggggtaagatctcaaccgttggattacaattgtatggtccaaaaattgccagatttgaacctaattttctatcaaattatatatataggtaatccctctatttttcacaaggaacatatgtttctctttctctatagatttaggtatgtagctaatccgattgcccacccacttagcagcaggttcgacatctactataaaatagagaatccacttcacaaccacgtctctgctaggcagcgtgtggaatggccgggaacggaccaaatggatataatccaagctgagagtggagttacgtgaacagccatatgatggaaaacaactttcatgttcatagagagcagttcttttcgttgagaataagtccttcccacatacaagtctgcaactcagggcctgtttagttcgcggaaagaaaatttttgggtgtcacatcagacgtttaaccggatattggaagaggttttcggatacgaatgaaaaaactaatttcataactcgcctggaaactgtgagacgaatcttttgagcctaattaatctatcattagcacatgttggttattgtagcatttatggctaatcatggactaattaggctcaaaagattcgtctcgcgatttcccccctaactgcgcaattagtttttttaatttatctatatttagtacttcatgcatatgttcaaagattcgatatgatgtttttgagaaaaaaaatttggaaactaagcagggcctcaatggattaacatcccagtcgtgcacgctgtttcgtcacacttgaatcggatgcatggcacgtagtacgtgtggtgtgcaacggtgtaaaaggcatccggtggagcgatcaagcaagtcgccgacagtgaacgtgggaggaattgaaggcgagggagacggcggctgatgctgcggcatcatacaggtcactttctggcaccggcgctgctcctgtgtttcaattcgttcagactttcaggtcatttgggggtgaacatttatgaggctttttatctgaacctggacagtgctgaggctgtttccagattggagaacggaacacccgaattccagatcatttctgaaccatccacattgtaaggccgagtttagttcctaactttttcttcaaactttcaattttttcatcacattaaaacttttctacatacataaacttctaacttttttcttcaaactttcaattttagtcaaacttctaattttagcgtggaattaaacacagcctaaggttggagtaggagttgtagggcctatttgggggagcttctaactgttgcagcttctcccagaattagaagcttccctaaacagtacagcttttgatccagattctaagaagctgtagttgtagaatctagaaaatgaactagaagccagaagctgggaaacccagcttttccagattctgagaagctggctaccaaccaactgtttctcagaatctcaagctcccccaaacaggcccgtaaggccatctacaatcggtatccccaggtcgtgcccctagccgacgtcgtcttgttccaaacggaaaagcaaacgaggcgtcccctcgcaggaccgcgcgacgcctcactgggggacacgcccccagctcgttctcgcgcaggcgctcggggtgaggcaacccattgcgtgggtaggttcttgaggcgacgcaccccagagcttcgatttcctcttccacccctctcccttttgtccccggcccatgtgttaagggcgaggctgaggcgccgctcgccgtcggagagaagaagggagggcgaggagggagg

SEQ ID NO: 55199 - DNA, 12369 bp, Oryza sativa
tccatccgccggggggccagatccggccacggcggcgccggatctgccgcctccagggtcgccaccgccaccttccacgggagagagagagagagaggccggatctaccgcctccggccaccggacgacgacgacgactgccgcctccaccccgtgcccttgattcggaggcggcggcgggagacggtggaggcggcgggagagagagagagagagagggagagggaggcggcaggcggcggcgagagagagggaagcagacggcgagaggaacgacaggcagagggagagaggaacgcgcgtacaaagggagaaagagagagaggggggggaagagcggggtagaattggaaatagaggaagaggatagaggattttttttggttggaacactcattggactactcagatgtggcctgcattgtagaggtgagtaccctcagttagcgagggcactatagaagtggcttatactgtagatgccctaatttagatcaagcttttaagttccttgtatgaaagtgcaaaccaactcaaaacaatttactgcaagagtctcattctcggaactcacttgctgcagaccaaaccagttgcttgcatccagcggcggtggatgttttctgccataaattgctgtatctgctcggctgaccaaccaaattactgtcctaactcatttgccatgcctctgcatcatcctgcagataggccacacaaacagcaagctgcattccattgggagaaaacagctagatgagtcattctaaggaggacccactcgaccatgctttctgcaaatatatctgtatatctctcatatctaactttcttagataatggatggataggaaatcggcaatctccatcctctgttcatatatctgtgatctaagctaagccactctgttttatagtattcctatccaatatgagctactattgtactactcctctatagtctatacacgtaatgaacaccactcaggaatcgctaacaataacatcatgtcgtcgcaccgaaagcagggggcaagtagataaactcatgagttggaacttgcaagtcacaggctaaccaaaagccaaaagcaaccacaatggcggcctaagtgccttttttcaccactgaatttacatagaagagtaactagtagactagatacaatttgtcaaggctcaggtaacataactaattaactgagtagtactaataactattgttgtggggagatggaaacaggatcaaagaacctctgttgtgttcttcccaattgccatcttctgcaggccaaaaacaccacaaaattcccaccctcctggctaaattcctcagcatggcatcatctgtagaactacaaaactagcagaatatttactgagataaatgtataacacacacacaaagaagggctttagttgcattacgaatttgcagaaggggaggaaaaaaaaagcatgtttaccttgatagcatcaggaatcatcttcatcctccccatcttgcacaaaaccccctcccatctcgcaaatccagtcccagaccttcgccggcacgggcatcaccgacagccgaggctgccggagcagcgcgaactccctcatcccctccacctcgccgccgccgccgcccgccgccttcttgatctccccgagcgccaccggccgccggaactcccccaccgcgcggacgtccaccgcgccgccgctcgctgcctccccctccccctcgtaccactccctggcgacctccacgacgccgacgacgcggcgggaggcggcgccggcgccggagtggtagaagaggcagcggtcgcccacccgcatggcgcggaggccgttgacggcctggcggttgcggacgccgtcccacggcgcgacgccgccgccgggggcgcgcgcctggtcggaccacgaccactcccccggctccgtcttgagcagccagtacttgcagttgccggcggcggcggcggcggacttgggtgctgctttcttcgccatcccgcgtggattcggagctccggcgatcgccggggtgaggcgaggcgggttgttttggcgggaaattgggcggctagggcttgtggttgcgcggggaattcccaatctcaccatcgtcttcccactcccgctgcctctcctgctcccaaaacgtagtagaaagatgcaccttggtatgagctgggccgggctatctataagcgggctttgtccagataggcccattatgggaaggcccagcaagatagatagacaggacggactttttcaacttcaaactggcaaggaaaaagtatactgtgactccctcaactatcgccagagtatgattcatatcctccaaccacaaaaccgggtatatagactcctccaattatcaaaaccggtgcaaacaatgtccctcggtggtatactttgactccctcaactatcgcccgagtatgattcatatcctccaaccacaaaaccgggtatatcgactcctccaattatcaaaaccggtgcaaacaatgtccctcggtggttttggaggcggttttggctgacgtagcgcctacgtggtggtcttgactaagtctttgtcctacgtggtgcttacgtggtggtcttgaccaagtctttatcctacgtagcgcttacgtagtattagaataaaaacaaaaataaaaaaaatatgtgcgacccatatgtcattcacacacaaaaaaaaaagcattgtgaaccgacatgtcatcctcccactaattcccttcttcctcccctctctctcccttatctctctctcaacctcccgcctttctcttcatcttggccagagcggcggcggggacggcagtggggagcggcggcggcggtggtgaggacggggtggtcggaagcggcggtggtggcggtggggacgatgacggcggggagctgcggcggctgtggcagtgggagcggcggcggcggcagtcaagagcggcaacggcggtggcggcagcggtcgggaacggcagcggtggcggtggggacgaggcggcggcggtcgggagcagccgaagcacgagctgctccccgaggatgggaggtggttcatggatgtcttccatgtcaccaaccgcctcggtggcaagctcaccaacgacaacgtcattacctacatttgagcaggttggtaggttttcttggtggtttcttgatggaataagtccatattgcctccctcaactcttgccattgtttgaatcatctccctcaaccgcaatattggctcccttggctgtttggatagtggtttcgtcctacgtggcacttatggacccacatgtcattgagaaaaataaaaaaataatcatatatgtcagccattctaatcttaattatttttcttttccctcacctctctctctcccctctctctcgatctccgacgaagcgacgatgacccacccgcctgtgtgtcctctccttcctcggctggagccagcagttcagttgttcgcccgccgccacccctgtagccctatgccggagcaggctcctacgaaggtcatgacagtgccccgggcgagggacaagcacgcggacggcctcgtctagcccgttgacctcgccatcttggtcaccgacgccgcccaaggcaccatgcccactggatttgtgcgtgacaaggccgagggaggcaaatccggtggtgtcgcgcccctccgccacccggcggcacatgtcccgtgctccctcgccgctaggagtgcttcgagcaagaagagggtggaggagtgcttgcgacaagaagtctacgagaaggcaccgacgccggcaagaggtggcaagaagtgctcacgccatccttgcgacacgattcagtcaagcgccaacgcatatgccaaattgccattcttgcaatgcgatttagctctcatcactcacctctcgtctcgccagcaagtcagcagggaaaatcaccattggcctcttcggcgacgaggtccccgccggtgcgtcccggttcttgtcgcttggtgttggctagtcaagattgtgtggggctacatgcaagcaggacggcgtgatgtcacacccggccatcccggtgactgaccggctagcggcggagatggacgccgcacgcacacgcaatgcagtggggacaggagtggcgtccacggtccacccaactcccgcggcagaaggcggcgaggcagcggtgaccgaacaactgagcttgtggcgcccgtcgaggaagaagcgaccgagcgagcaagcgagtcgtcactggacaccggaggtggagagagagagagaggaggaatagagaggtgaggaaaaagaaaaacaaataagtgtaacgtaggacatgtgggggttattattttttttctcactgacatgtgggtcccctaagtgccacgtaggacgaaaccgctatccaaacagccgaatgaccaaatttgctctggttttcaaagatggaggaggcgttatatctggtattgcggttgagggaggtgattcaatcaggggcaagagttgagggaggcaatttagacttattcctttcttgattctggctcaagtgttcgacggtgttgaggttttctgatggcatagatggcttctttgcagtctctggggacgtggaacaggccggcgcggccggcggtgctcgaggacgaggagccccacgcgtggacgcaccgcggccgcctcggttgccgaaatcgctattcagcgactggtcgcgcgcccttccccccgcgcggatggacgcgtggcgcgcgtaggagggggagggggcgcggcggccgtgtgcaggggggcccacgtgggtttttctcccggttttttgagttttggttttccttgtttttttttctttctttgttttttctggttttcatatacgtatacaaactttatatacgcatgtatatactttgtatatgtgtatacaaactttgtatacgtaattttttttctcttttttgatttttttataatatgaacgtacctatacaaagtttatatacgcgcatgcaaagtttgtatacgcgtatgtaaagtttgtatacgcgcatgcaaagtttatatacatgtatttttttatatgtcaactttttggtacatataaaaattatatatacgtatgtatatactttatatacacataaataaactttgtattttgtattgataaatacaaagtttataaatatgtatacaaagtatatacatatgtatatatacacgtagtagtacagtagtacactagtactgttgtagtagtagtactactactggtagtaggagtagttagtagtagtagtgcgccagcagaagcaatagtagtagcagcaccagcagtagtagcaccggtagtagtagcagtaggagtagtagacaagtactagaagcagcagtaggagcagactggtcgcgcgcccacgctcccgcgcgaccagtcgctagttagggccacccctcggttgcctcgtcttcctccgcaacgaggaggccgacaccgagaggatggcgcgcatcgaggcccacctcggacacctcctccacggtgactccagcagcgtcggcggcagtgccgtggccactgtccccgccgccagcgtcgcgcacgccgagcgccgcctccaccagctcatgtcgcctgaccgtgaccaggaggagcgcgcgacgacgtccccgagacccgccgtgtccgtccagagctgcgtggagcgcggctactcggtggtcaccgtgcaatgccgctaccgccccaagctgctcctcgatgtcgtctgcacgctcaccgacatggactacgttgtgttccacagcaccatcgacaccaccggcgaccaagcgcaccaggaatcccacaatactttttttgttatgtgaatgacatatgggtcccacatatttttttatttttgtttttattctaatgccatctaaacaccacgtacgataaagacttggtcaagaccgctacgtagatgacacatcagccaaaaccatctccaaaaccacagggacattgttttcaccggttttgatagttggaggagtcgatatacctggttctgtggttggaggacatgaattatacttggacgatagttgacggagtcaaagtatactttttcctcatgaccctatcatttggcttattccatgaacaaattatttgcaaacaaaaaataatttgtgaaaaaaaacgaggaaaaaaccccaaaatcaaattgttaaatgttacatttattaaaaagaacttttatataaaagttttttttttaaaaaaatcaaataaactcatttttaaaaattgtaataattaatactcaattaatcatacgtgtgctaatataaaagtttttttttaaaaaaatcaaataaactcatttttaaaaataataattaatactcaattaatcatacgtgtgctaaaccaaattccagattcaaactaggcttaatcaatactactgaactcttgggtagttgggtatgaaactaatttggagctatttacaaaacacaaaactcaatatcacaatggtgtgcccaaaatgatggtttggaatgttcctttcatctgtggatgttgcaatgttcctttcaacaactagggcatacagatacagctacctgaaactgttctaacaaaggctagagctagagcatactaatggaatagttttcacaatgttgtagcttcagcgttctgatattgggacttcttgtaagcttggcagaagttgaatcagcaaaactggcttcacttgtgtttaattatgtcgttccagtttgcccctcttttgctccctcttgctgctgctgctgctgcttctctgcccagtacttctgaagaggtggcccaaatataacattcccagagatcactccaatcctgtaattgtttgtaagacagaatgaccatgaatatcaaaataagcttgacaataacaagacatctgcttataatgcaatgaagcagttattcaatggttaagatagcaaacaaagcgctacaacgaaacagcactagctgagagcaaaatcaattaaaaaattcagagaggattccaaatagccactgagccacaatagctacaggcaatcatctgtaggatatggccagtcctaataagatgtgatcaaaggatgctaaggtaatttctttcgccacactgtttggaacagggaaagtttgccccattcctgccaggtaaatttcaggactatgattatctttattacagtgtagacagatgtagatgagcattttcaaaaataccaggatattaacagtcaaaatgacataaacaaacaatttaatgcattacaggggaaagtgggaaacaagcctatagttggacataatgtgatgtacaagttggcgcctactttagtgtagatcttttcaggcatgcaactatcatatctcatattaaagcgtactgtagcatgttagtgactttaagctgaacaaggatgtcaatttcatacaatagtttagatacagtgaaggtacgttcataacaataaaatatgtcactttttatttgcttaagcttgaagtcacggttacaagtgccgattaccatgaattatctcagccagtcagccctaacatttttaatcagagtacagaaatgtatatgcagttgttccacatatatgcagaatccctaatgcaattgccaagaaaacaggaatacatccaatatcttttctaatgaaacacaaggatgcttattcacataagaacaaggcaccattgtattttccccccacaaaaaaaaaaggtatcgcattccatcatacatggttttacttgcaaaatactactactagtagcagagcttcaagaaacactgtttttactatgacatgaaacggcaggattcgagaacaagccttccaaattcaccccatctttgatatcggtggagataatttgtccagcgtaattttgctccatatcaaattactaccgagacacccattactctttccctcgaaacactaacaagtactccctccgtccctaaatatttgacgtcattgacttttttaaacatatttgaccgttcgtcttattcaaaaacttttgtgaaatatgtaaaactatatgtatatataaaagtatatttaacgatgaatcaaatgataggaaaagaaataataattacttaaattttttgaataaagcgaatggtcaaacatgtttaaaaaagtcaattgcgtcaaatatttagggacggagggagtacttcacaatcgttggcttggccgcctgggcgagaatcaagcgtgccacctactagaatagtaatatgagatagcaagaaccagatggaacttcatattagaggtcccatcatgatcggaacgcacaacatcaggagccccgaatcaacgcggagtgaatctggttagcatcaagactggtactaggaaacagcagccgccgccgccgccgcagccgccgcggcagtagatctgagcatcagaccgatggtgcggagaggcgagaggatcggagagagagggttggagaaactcacacgacggcgccggccaccagggggaaggagagccgcatcctgaattcctgatcccccctctcgccttctccccgcgggttcttctgtttcttggccctcgctattttttccccacgatttctccggtcagagacggcgaagctgagacagaagagagagagatatttaaccatttgccacatttaaatgtgacaattaactttttgccactggacccatatgtcatagacatatgtggacccacatgtcattgagataggggtggcaaatagttatttgccaaatctaaaagtggcaaatagttaaaagccccgaagagagaacccctccaagaaaggggagagaagtatcgatcgcctcctgcgccgtccgatcaagatggccctgggttattctatatcggacggtttgaaatttacatcgaagcatttttcacgatttttacagtattatggagcactggagctaagtttctgtattgtttgattctaaaagaaaatatttgtttttttagaaaataatattttccaggctcccgtcctcccgtttcggacgggatcccctccatgtgcgcacaacgtatgctataagttagtttctcgagtgtgatcctctcatccgctttgctagcgtgcccatatgtacacaaaatttgataatttgaccctttctgaaaactaattttgcaaataaaccgtagctaaaacttatttcaaaaatgactttttttcagcgccaaattgtatggcgctgaatttagacacctcagtgccacgtcaactgccgctaaatgttgtgcaccgcgtatgggaggatgagtcggcatgacaacgtgcattcaacgccgtgctatttggtgctgatatatctaaattcagcaccatacgatttggcgttgaacaaaagagtcatttttgaaataagttttggccgcgattcatttgcggaattagtttttggaaagtgtcaaaatgtcaaatttcgtgcacataggtgaccaggtttgtagattctactcttccttgatctcgcctcctcatcttaattactactactatccatggataatagcttactgggcaggcggtacttcatgttgaccattctcctcacacccaagggaaaggtagtgcccgtccatcgaagccacgaagattgttctagaaatacagccagcttgacctgttgctagcgtcatcatggtggcccggtcatcgttgatcatccaccactgtggcaccgatggcatcttggcactcctgttgtagcttggataggcctggtgacaaaccgtgtgagtggtggtggcggtggcagccgactgtttcccctgggttgccatacccttgcgtgggcggtgaaggctgagctatggaagcttcttgactcgaggagaggggatggggaggttttggtctaaaggagtggtcgatggaggatgggaagcaccacagtcatcgtcgccgcaaccattgtgccgaagtagagtgaggagcgctactgtcgtcactccagtaatcatctccatcccttcttcttcctctctcagctcagacccccatcccttcttctctctcttctccgtttatatctaatacccatttcatctcattaatccatcccttcttctctgatacatcaactcaaatccaatacctgatgggtactagcctaatattgacaggcattgagctggtaccgacgatgtattagttgttacctgatgggtatatatcggttggtactaatgaggtatcaaccggtaataatgaggtatgataccgataatctagtacttttttggtattatctcgttcaaacgggatatcgtagtataataacccttttttcttgctcacgcacatgaaacagaattgtgcggttcaaatggatgtcctcattaggagagaattcttaagctatgtatcgtcttcaagagaattcttaagctatgtatcgtcttcaagaatgtggtaagataaacaaaagggtaagttcggccctcgtttttatcattttatactctctcattttctgtgtgcacgtttccaaacggttaatagtatgtttcttgcaaataaaaatttatgtaataaagttgctttaaaaatcattattttaagaaaggttttagctaatactttaattatatgttaatgagccatccggttttagtgacagagagaaaaaggttccgaagttttaggcttgaacgcagcctaaagttctttgaacactacagcctacatacatcttcagagattgatatgtgagcgtaaaaccagcaatgttacaagtttcgaacaacataagttcataattacctttacaaacttcatacatacatacaaacacttaaacttcatacaaactttatatatactttctccactctagaaaaaaacacaatgggtagctcagagaactgcgcctagctcagttattagcttagctggacgccttctcgcacttgattccatttccggagtgtgctcatatttcttcataattattgatatcaggctccttcctgtcttcctgatatccagcggctctattttcccatgatatataggttgtacacacattatcatctaacgtcaagcttgctcgctttcttttttctgctcggcggtttattcttgcatggattgctcattgcaaacgtgcatctactcctctgcttctaattgtgtttgccctgcgtgtagatgtagtccagatgagccacgagcaaacgctccactaggcaatcatcttcttcgcaaccttccactctaccatcgtagtttcccctctccacaacctgtgccacgatacccacaacatgatggtaaaaaatcggttaaagatacgttcaattaatcaaattacactacttcgtacatgcaaatttatcaaaggaaaacatgtcgtgatgcaacatgatatcaaatgtacaactgaaactaaatttaaaagaaagaaaaacagtttttttccttcaccttactggaagctttgctgggttcaattggcccaattctaccaccatggcttatgctgatgggaaggagaagtgctacaaggcaaatggctatgaccttcggtgacatggcgtgttatgtttgtgtaggactagtatcgaataggtcatggaacctgcatacacaatggtgtcattcagacgctttatataggactcaaagcaggggagaaacggtgtcaatcgtatcaattcttttacaaggatttttgtttcaaaccgatttgagaaaaggaatatactgtagacaagtatgggtatagttatgctgctgcggtggcaagtaagagtacagttgataggtttcctgaaaaaaaaaattgccacaaagaaaacatacaggagtatattcgttagttatggacgtgcgcattcagacaattgacaagtgacgatgcttctcgtcgtttattataccggttcatccacgaagaaaaagaaaattaatatatgctcttagctatttacaaattaatattgaagaataaactacgataaaaaatcttaaaattatcttgaaaataagttccaaactattttttttcggctgataagtcaataagcaaatgataaaactgtgtatatggactccacttgtctataaatataagtattccaggcatttagaacttgttcacaaatggattcgtgcgttgcatcaatcatcttagattcatttttttaatttactctatttgtttcaaaataaattaactattggatattttcatatttgtaaccataaattgctttccaatcttactcatttgttgcttcatcaatgggaag

SEQ ID NO: 55200 - DNA, 6758 bp, Oryza sativa
  unsure (1)..(6758): unsure at all n locations
gattttcgtgtgcacccttcctattctgctaaataatatgtttttaatatattttctatagataaattattgttttgagaaaaatcatattaattcaattcttaagtttaaaacatttacaattcaattaattatatcctaatggttaatcctgtttttgcatatcttttttccactctttttttaatccattgctttccatctacactacaacaacccagctttccacacatcgccggcagcatcaacaacagcccttctcttctactccctcggtaaaaaaaaaaagacaaaccctgagtttccgtgtctaatgtttgactatccatcttatataaattatttttataattactccctctattcctaaatataaggcacaaccacccttaacccaaagaccaagaaatagttattatcatcttgtaattgaatcatcctaataaatgtaatgcatgcatccaatagagttagagaatgtgaggatgaaggatttaaaagaataggagtgaatttcagaaaaccccatgttttgaggctaatataacacataaccacaggttttgtttattttctcacataaccccgtgcattcaatccaattaacataataccacaggtttaagtaaaagaaagtgccacaagggcaagtgatatggcaaacctgctccacatcagctggccccacctaccaggtcaatacatggcctattagggtgggatcacgcgggagaacagaagcgcgtgttccctgtttctacgcacacgacacggcgcctcccgtctttcttgcgcacgctggcggtggcgacgttccccaaccatctcttgcatgatggcctccggtgatgatggtgatgttgacctagctggaggaagagaactcgttgggtaccattcctagcaggtaacattcatcccttttcttgtgatgatcatatgaattgactccaaagcatgctggttggtgatttgcaaggacactctgcttcatggttctttgacgaggaattaaatccagccattttgatcatgtttggcttgtcaagaaattaggcctagtaaaatgtaatttaggggaaccattattgttagggcattacaactatgcaatcgttcttctgtttgtcattgcaaaattgcttttcatcatttgaccataattttttaaataaaaaaagcatgtagattggaccgtgtataagactattgtattacaactattatattgcagtcagatataaaactaaccacaattaacatttaaaggcctgcaacatttttttctgcttcacaaaagagcagacatggcttcctctttttttttctcggtaaataggttgtatttttctctgcttcacaatgtatatatttcagatatggattcgttttgcaaatttcctatgccctggacctgcaatgggtcacatattaactgttgctatggtgcttttattcagacatgggatgtttttataacgtttgctccattgttctgcttaatgcatagaaattgtcagttttttcctttcatttttttttcataggaacacagtgtcaggcaccttggtgatcgacctacttacaaaaaattcgagcagaaacattgtcaggtcctgccgtcctggccacgtttaatcaaatacacacacaagctttgtattagaagataggaagtatatgtacagtttgatcagttgatgcaaaacagaacaggcgatgcttgcctttgcatgtgcacgacgagctgcccctctgaacttgtaggaggaggaaaactgccgcagcgagcacgaggaagacgaggggtgcgtcatcgcgtgcgcgggaacagaggatgggtgcttccccgcgctaaatagcccacgcattgatctggcaggtggggccagctgatgtggagcaggtctgccatgtcacttgccattgtgacactttcccacacttaaacctgtggtattgtgttaattggatagagtgcattgggttatgtgagaaaataaatagaacctgtggttatgtgttacattggctccaaaacaatggggttttctaaaattcactcaaagaatagtaatttaatgaagaatacatgcatgtcttatattatgtaccataaaaaagtggttgtgttttatattatgaaatagaggtagtagtatttttattattgttagatgataaaacatgattaatactttatgcgtgacttatctttttaattttttttcatattttttttaaataagacggacggtcaaaacgttagtcacggaaacccaatgtttgtttttttggacggagggagtacttgccctgcccgtacggtgtatacgtgctgtcgtcgatcttgccttacgagactgacaccggcccactcaaaagggataccataccaaccctgtaagactcttaacatttttttttggcaacattgctcatagggttagtacacagtacttgctgatccattgattgacagccgtttcattgggttgatattcaagggcgagaggacagtacattagaagtactagtaatcaacaaaaaaaaaagcattaatttcttcatgtacgtgggcgtgcttacttttacatatgtaccacgcatgcaccttaaattctcttaatttagagctcatcaacagtttgtatgtacacaactacggctgtctgccagctagcttttctacgtatacccttggcaaaataccctaatttacggttatgttaattaattgtgatgaaatatatatcctcctaagtcctaataacagtctattgccacatactaagttctggaggggtaaaacatttcacacacaattcagagaataattttggtacagctccacctttaatggttcttgtctagctctaacttcaattgttgcgatgatcggatggacgttgtttgcgtcgtggatgtaaatttcttctttgtctagaagacattgtcatatgtttcttggtcattggttgtacatacagttgtttattcataggaagtcagagctgctcttttgagctcgacaacaataatttatgtgttggaattaatacgtggctaaaacttatatggagattaattctttgaaaaatcataaaagcccatctcataataaggtatacatataaatctttagtaccacctcacttattataggagagggatgcctcctaaaaaaaggagattgctcttctagttacttgagccatgtgagatgaagaggactagagaaacgcacgtgctcccagacgaggcggcgtgagcatgaatggtcacaaaaacggtatttatttttggaaaccagttttaggaaacacaccgaactgcgtggaacgacatcgagtttggataagttacacacaacttatccagttcggttatacggtgaaatttggtgtttgttatcggaaacataattgtaggaaacacgctgaataatccgttgcgtggagcggcgtcgagtccggataagttacgcgcaacttacccggttgggtttatagtgtaaagatcgtgtaggtgtcctgatcacacgtcttgatatctctctctatataaaccgagccaccacctcctcacaacatacgccaaaacaacctagggtttgtctcctcctctatactacattattgctcgtaatctactacatcccgctcgccggcattcactgatgatcgggagagcaggtctccgaaaccttcgccttcggtttcatgcaccgggagaaggcgacgataagagttttgggaaacgattcgtgcgactggtcgctgttctttcacaataatttgtcttcctctacgcttgacgtaagattaagtgagaaagctattatgttcacattttagacaaggtagtgtcttaaatcactttattttagtctacaaatgtcatatttggcacagctcaggatctgacattttctggagctgggtgttcctagcttcacaaatccatggattggatttaggattacattgataatatatggatgaaccattttgttcgtattttataaaatttcaaactgtactataacttaatatacaaactttaaatttagtgtatctaggatttagagctgtaccataccaaaccagaccaaatttagtacacactccatatcatgtaagaatattaaaaaaatatatagctctaacaaaaatctgaaaattagctagagctctaccaaaacccggagttttcagctgctggcagcccacagacgacaaaagcacaaaatgccatgatacagcgcacctttccctttgggcaccatcatatcagtccagcgcaagtttaacatccgtgacataatttatgtgtacctaatgtggcccccatgccatcaccctacccacaaaaagagacaacaaataactctagtttgctttgctagccactcccttgttttatgaccaaacttaaactttttattagtggccatcaaattgaatataacggcttcccttttagactagaagaggacgacgcagagagaaaactgaaagtttttttttcactaatgtcttgattaatctcaccctcagtgacgatgcgacactagtttcatatctagattgaaattcactaagggcccctttgaatcacagaaatgaaaaaacggaggaaaaaaacataggattttgatagaaatacaagtgtaaaacaggtgattggaaaaaacaggaaaaacataggaatgactgttcgattgggccgcaggaaaaacacggaaatttaaggagagataaaagactcaaagtattctttccatgaggttctacctcatgttaaatttactctaaaacttacatggggaaggacaatccataggaatttcataggattccataggatctatttctttgattcaaaaggctatatagaaaaaaatcctatagaaatgaaatactctaaaatttctatgaatttcctttgaatcaaaggaaccctaaagttttatatcaagtacaaattgggaaattaccggttggtaggctagctaactttaacttaactagtggcgccaattaaggatgtgttcggacccaagggttcccaacacctctccatggttttccgcgtgcacgcttttcaaactgctaaacagtgtgttttttgtaaaaagtttctatacaaaaattgcttaaaaaaatcatattgattcatttttaaaaaaaaaattagctaatttctaattaatcacgtgttaatggactgctccgttttccgtgcgaagaagatttgttcccaacctcccccagcaaacacagcctgaagaagctttcgtgcagcgcggcgcgcgcgcgcttgcttctcctttttctttaagattgcagctaaagcaaagagctaaaaggtggcgaaacgggaggcctttctcgccgcgctgcgccccctcttcttcgtgccatcgccattgccgcgcaacatctgagctcgggtagccattgctagcccatgcagggcctcgcgtccccgcggtgcgctcccttctgcggccgctccggcgccggcgcgggcggggcgccacgcgcgcggcggcagcagggaggtggctgcggccggccgctggaccgcgtggccgggtgggtcggcggcggcatcgccgcggcgttcttcgcctccctcgagcggtgctcctgcgtgaacgtccgcacgcacgacgagctcgacgacgagacgagggactccgaggcgctgctcatcatgttcgacgtcgtcgacggcagcgaagacgctgcctccgccgccgccggcgccggcgggaggaggggcaggaggagcgagaagagcaagcgaggtggcggcggctgtggcgggcagctatggtgaataattaattagcagctatatataatttttgctatgtatgatcgagatcttgatgatgatcgatggatgcttgttaagtttgtgcaagattatttacgtttatatatatatgtctagctttcatcttgtgaaagatacatattttcttggatgtatggatcgatgataaattgtattcaaggtggttttttgaagttcaatggcaatggaacactgattctcccttccttttcattgtgttctcaagatgtattttccatcctcaaatgatacactgttctattctcaagaaaagttttaagttatatgtaaagatcaattatatggcataatatgtttttatatggttagattgttaaaaaattttagggcaatcatcctatattttgttagttcattcctctctttttttaatgtgcacactaaagcagtggtggttctcactgcaacaaaaagcatctctacggattttttttttcaattgaacatgattgaaaaaccattttcttatggggtaacccattttcttataatccacctaggcgttcaacccaaatgcttcctggctctacgttctaacataatgtcgtgtgtgctccgattttctttttgtaatcatcaggagtttcgttctcattgatcgcatataagagaaggaagaaagtgttccattttctttaagaaaaacatgtgctatttcatgtttttaataataggctcagagcctcagattacaatcggtggaaaaatatattacaatgtcgaacaaaatatgctcaattgccggaagcacattgctcaaccaaacagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 55201 - DNA, 1091 bp, Oryza sativa
gttagtgaaatcgctctctaaacctgtcaaggaagttaggccttgggtgtcacatcgaacgtttaatcggatgttgaaaggggttttcaaacacgaatgaaaaaactaatttcatagctcacctggaaacagcgagacaaatttatttcgcctaattaatcgatcattagcacatatgggttactgtagcacttatgactaatcatagactaattaggctcaaaaattcgtctcgcgattttcgtgcgaactgtataatttgttttttcgtctatatgtagtgcactatttagatgtctaaatatttgatgtgatgtttttggaaaaaaaatttaaactaaatcagaggccttaaaataaaagagttaggatatccggtgttggttcattatagtctgcacttattgcgatacgaggggcgtcaaggacaagaagtagagaaaatctcgtatacgagagagacgtccccaccttgggccccagcacaacacaagtccggcgtcgtttcctcacgtcgctccaaaacgtgctgcacccatcagtcgcttccagcccgctaacgggcggagcgatgaacggacggctcacgctgctccctccgatccacgacgcgagccatgagtaccccgcacttttgccgcggggcccataagggccatcaaccgacggccctggtgccgcctcgccccacccgtcggccgtcgggacgggagacccctccctcccccgcgatcccgcctcggcatattcgccgtccttcgcctcgcggcgggcgcagtgagccgtggccgtggcaggcagccatcatgtgggctgtggcgcctgtgagccggccactacctgcgcgccacctgtcgggcgcccgattttttccctgctctttgatctcctcctcctctctctctcccccgtggtgtgcgcctctctattcttcgccgcctatttctactccagcattgctgctgcgcgactcgccgtcctccacttccgcagcgggtgggtagcttgccgcagaactcgttcggctttcgcatataccgccgccgccgcctacctagtacaaggtaaggcgactgccggggctgcaggaa

SEQ ID NO: 55202 - DNA, 9217 bp, Oryza sativa
acattatttaatatcagatgacataacgatactgtcagcatacccgataggagaggtattgacaaataaggaggtagcaagaaggattacaaaatgggcaatggaacttctaccatttgatttgaagtatacctcgagaacagctataaagtctcaagttctggcagatttttttggcagaatggactcccaatgaggtggaggaaaaggaagaagatgaaaaactatggataatatactctgatggagcatgcaatgccactggcgtaggggcagcagtggttgtaaaaacgccgatgaagcaaacactaaaatattttgcaaagctagttttcccatcaacaaacaacacggcagaatatgaaggggttttattagccatgagaaaggcaagagcactaggggctcgtcgattgataatcaaaactgattcaaagctggtggcaggtcacctttccaaaacatttaaagcaaaagaagagacaatggcaaagtacttggaagaagcaaggctgaatgaaaaacacttccttgggataacagtaaaaactataacaagagaagaaaatggggaagctgatgagcttgcaaaagcagctgccacaggccaaccattggagaattcattcttcgatgtgttaattcaaccaagttatgagaaaagagaagtggcaaacatacatggcgagatagattggagagagtcaattctgaagtatttggttagtgaacaacttccagaaaaagaagaagaagcaagaagaatacagttaatgtcaagaaaatacaaagtgatagaagggcagttgtacaagagtggagtcactacccctttgctaaaatgtgtaacaagagaagaaggaatgaaaatggtggtagaaatacatgaagggctgtgcggagcccatcaagcaccaagatcagttgcatcgaaggtgataagacaatgagtatattggcctactatcatcaaagacatagagaagtacattaagacatgtaaggcatgccaaaaatttggtgcaacgtcaaaagcaccaccaagagagttgcaaccaattccaccagtttggccaattccaccaagagcaaaaggagatttacgttttgtcattgtggcaattgagtatttcacaaggtggattgaagcagaggcagtagcacgaatcacatctgcttcggtacaaagattcgtttggaagaatatcatatgccgatttggaatacccaaggataatggaaaacgatccgagtcaggaaagttcaaagatatgtgtaaatgtcttaacctgcaaatcaactttgcttctgtgggtcatcctcgaacaaatggtgccgttgaaagagccaatgagaaaatagtagaagccataaagaaaaggctggaaggttctgccaaaggaaaatggccagaagatctggtgtcaatcctttgggctttaagaacaacagttgtccaacaactggcatgactccattcaggctaatatatggagatgaggcaatgacaccaagcgaggtgggagcgaattcacctcgaattgtgtttgatcaaaaagacgaagaaggaagggaaatcaccttggaaatgttgcacgagataagagtggaagcattagacaaaatggcaaaaaacacagaagaaaccaaaagctattacaacaaaaaagtgaaaatcaggcaaatagaagaaggtgatttggccctcaagaaaacactaaatgaagtggctgttggaaggaccattcatagtaaaaagaaagttaaaacaggagcatacaagctggcacacctcgatggagaagaattaaagcatacttggaatgctgtttccttgaagaagttctatgtgtaaaaaaaagaaaaggaagaagaaaaaaaagagaaaaaaaaaagggggaaacatgttgctcgaagtgtacaataccgaccaccttgtaagattctcttttcttctcggtgttaatacatataaacaggacgtagggtgttatcaataatggattgtatatgtgtttgcgaatcaagaaaatcctccgcacgcttcggagaagaaaagccaactcgataacaaatcgagaaaatactccgcacgctacggagaggaaaatccaacttgataacaaatcgagaaaatcatccgcacgcttcggagaagaaaagccaactcgataacaaatcgagaaaatcctccgcacgctttggagaggaaaatccaactagataacaaatcgagaaaatcctccgcacgcttcggagaggaaaatccaacacgataacaaatcgagaaaatcctccgcacgcttcggagaagaaaagccaacttgacaacaggttaaaaagcactccacgcagttcgacaagttttaccttcgcccaaaaacctaacgataaaacgctcgaacacccttatccgattcgagcaaacagtggaaaattccacgcgatgaggtaaagcgtgatttcgacctcgtcactccttcgaaaggtaagaaggacggcggttttcgaacaagttttaccttcgtccaaaaacctaacgataaagcgttcgaacacccttatctgattcgagcaaaaagtggaaaattccacgcaacgaggtaaagcgtgattttaacctcgtcgctccttcgaaaggtaaggaggacggcggttttcgaacaagttttaccttcgtccaaaaacctagcgataaagcgctcgaacactcatatccgattcgagcggaaagtggaaaattccacgcgacgaggtaaagcgtgatttcgacctcgtcgctccttcgaaaggtaaggaggacggcggttttcgaacaagttttaccatcgtccaaaaaccaaaataacgatgaaacactcaaacactcataaccgattcgagcagaaagtggaaattccatgcgacaagataaagtgcgattttgacctcgtcactccttcgaaaggaaagggggacggcggttttcaaaaaccaaagctaaacgctcgaattcttttctgattcgagtctttgcggaataaaaggaaaagaaaaaggaaaaatgacattgagaggagaaggcattcccgtgtaagggacaattgagtagcgccttttccatattctaagttgacgctcagatggtctaaaagtttgccaaaagttaatgctgctcgaagcattattcgaacgccgttttctaaactcgacaacgaagtcacgcaaactaccatctcgatgttctctttgccattggaaaaattttaaagaaaaaatacaagtgtcatcgtaatgtatttccttctcttcatcatcacatttagttgctttagaaaagagcaacttctcgtgtgttcgaaatgcaacgagcttcatgtttcgagttgaatgatacttgttgcgtcgaaccacaacttttcggttcaaataaacctgcttccccgacaaaaacgaaatgatgatgaagcacaggcatacagagaaaatagcaaatggtacccaaccacagaaaatatacataattaagttcccaaccacaataggttcgacggagcaaaagaacaagcgttttcgaccatatccaaaaagttttccaagttagttttccctaaaataacttcacacctgtgaatcagatttgtgagcgtcaccaccgttgtctggttgactcgaagaggattgtgcggtgtgtgagctcgaagccaacgatgcttagagagaagcaagggtatcttcatagcctttctttttccagtaccaaacttgaaaagctttgactacagatcaaactgccgcatggtgttgagcaaactttgacataaatgtgcatattcaatacataaagaatatgtatacatataacaatatatatatatatatatatatatatatatatatatatatatatatatatataataaacaaataaatgcataatgactgacaagaataaccgctttcgaacttcaaaattttctatcctagtgtttttcgactgaataggaggacggcggttctcccctagcttttgattcgaacacggtttcggccgaaaacacacttcgcccttacccgtgaggggcttgttgtagctaggggtcaccaccgttcctctctattcggcccaaaacactgtagaggaagagattgggtaagattgagtttttattctaagtatccgagtggcaaatggtcattcgaacaaggaaatggtaaaatgttgttcgagttggaaaacactattcgagtcggaaaataccgttcgagtgagtccttgtcactaagtctcattatccgttttgcgtatttcctgagttaataacaggtcagctgtcacgcccagaaattaactagcaatttccgaacttatttgtgcattaaatcctcgtccaggaatcagccgaggtacacaaactgacaattaatatacagattcatcataataataacgtaaatacttacaaaagaaaagaaaaatagcagcggaattacagtctagcgaagctccggctccactcccacaggcagctcaactgaggtataagccaaacgtcttctccttcgcaacttgtcttcaactgaggtttgattgattattgcaaggtgagcatatgacatactcagcaagccacacagcaaatatgcaagtgcacaagaataccaaaggatggcataatatagggttcatttgcaaaagcagcatttagaaaatatttaagaattgtaaaacagtagagtaattaatcatcaatattaatcaacactgaacagcacacccatgctgcacaggcccaaccatcctgaacaaccatacccggctgcacagatctatctccaaaccaggaatgtaccattccaaaccaggagctaaattaattaccatcaattaccacattattattaatgagtagtgtaggactaatcacgaaagacattgttcgacccgcccataaccgcgggcacggctattcgaatagttttactctggccagaggtgtaccactgtacccacaagacacaactccacaatatgtcaccatatcatcatgtgcccatgctaaacatgtcaccatttgtgtagttgtgacaagacccctcgcatatgtcaactcaaagcagtgcaccgttcctagatcgtagtcaccccctcaaaaaccagaggcatggactccccagcgacccccgtgggcttatctctgccacttctcagtctggcactccacgatgagccttgctatgcaaagtgtccagccgttgcccattctggcttgtggttgacacggttaatgtttcacaaccgaaactcgtgaaccggtccttaattgtcatgagcactaccatcaaaaccatgtgctcacaacccaccattatcaagttttagttggcacattaattaattcaccaatcacgattaaccatcgtgagctatcattaaatctctaccattaagtaatagtgaaacattagttatcccaattatgtgctaatgtttctaagcatggctaagcaattatatctaacatctagctgaaccaatatataaagctcaactagtcaaattataataacccaatgtatcaaggaacagtgtaatcaatgcaaattggccatacaaaggaataagttcacaccacccggtgacattcgaaaataaatgcacagttgaaataaataaagaatttaaatatacgatcaacatggtcaaaggaattgtgtttgggatctgtgtgacttgccttgcaataacgggtcttcaattagtcttcttgaacacttccggcgcactcgagaaccttcgaaacgacggaaacgacaagctaacacgcaaaacgaggaaaaagactaataaaaaccaaataaacaatacataagaagtaaacaaacatgtagataataattttagatgaattaggagacttgaacggcctcactctgacttcatatgaattaattatgaattttacaagatttaatctaattaaagcccatttaaaaaaattaaataaatttaattcaatttatggataattttaatatgtagatctttattttatacaacttttgcaacttgaaccacattaaactgagttacaatgaattagttatgaatttttaaagattaaaccggattaaagcatttatatagattttaattgaattatgacgcaataatgaattatttttgaaaagcaaaagggatttattgcgtcatcaaagatggtccacggtagaccgggtgcatagaggcggtctacgaaaccaacggccgagatctaatctaaacaaaatggacggccaagatcgatctaatccaccacgggtctacggctgacgtcgacgatgacgtcatcgccggtggcggctcggcacctcgtgctcgccggcaatcgatggcgcggcgacgcaaacggagggcaccaacgggtagagggcgacgcggcgaactcaccgagctcttggatgacggcaaacgacgacggatgacgacggcggcgaggtcgaagcggcggcgatgattgggtcaacgacgacggtggtgttccagcgatcttcggcggaaacggaggggtggacgaggtgctgctcctcctcgcgatcccgacggtggcgacgacgaccgaaggtggtggctggaccaacggcgcggcgtggctggaccaacggcagcggtggagagcttcggggcgacggagtcggcggcgctccgatgatctgcggcggaaacggaggacgggacaaggacggcggcgaccttgcgaacctggcgacggccttcccgagtgacggcggcgactagagcagcggcgcggcacggccggactcacggcgacgacggcgacacacgagctaacgcggaggcggcgctacaagcgttggcgggctaaggcgaaggtgacggtggattgaggaggtctcagggatccttttataggggctaggaggcggcgacggaggcccacggcgaccggcagcgagatggaaggttttagggtttggaaagagatgctaaccaaatcggcattgaatccgacgatttccaaacgaattagctcggtttcctaaagagaaaaggaagaggagatcgaggagattatttcccctcaattgatttggccggagaaggaaggaggcggccggatttggaaggagatcggcggcggcttgcggctacagtcggcggttggtggctggaggaggaagacgacctgacaggtgggtcccacctgtcagcggctgagagagaggagggagggcgcggcggactgggccgaacgggccgagcacgcgcaggccgggggaagggagagagagacttgggccgactttcggcccaaagccaaaagggagattttaaaacctttttctatttaaattattcatgaaatgatattccattgattaaaaatacttccttggctcaaataaattccagaaaaatctaggaactatagaagcaagagaagtatttaacaaaattttatctagcccacttttatattgagatttaacaaattaaaattagatcttctcttttaggcttttaagatcatttctaataattccttttaaacaacaatttataatttaaggatttttaaacaagaaaagcacttaacataattataattagatcattaattgattaactaattactgaactgttctttgtatcatttaggaattgagctctgaaaaatccgagaaaatttcagagggtataattaatcatggagaatttaataaaaattaaatccagccatgctttatatttaggaaattttatttcccacatttaacttcacttgtaaattaatgaacatttaatataaattctaataataatttattaaataatttataaatcctgaaacggaaatcaggctgtgacatcagctaccggataagtcggaaatggtggtcgagatggaaaagactatttgccatggaaaagacccgtagtggtggaaaagacccttagtcgaggagaagatccatgttggtggaaaagactcttggccatgaagaaggcgacttggacaataaagatgccaagagaatattcccagggaccactcaaccactccatctagctggcaccaaaagactataatgacccccataatgtaccaaaatgcccttagggtctgttgatatgcaggggcacgattgtaatttcatgtgggcccaacaaagagcacaattgtaatctcacatgtaaagctgtgtactatatagagcagacaaaaagcctgtagcagacaggacatcttggaatactaaaaatcttgtcactcagggtgtgatcatttggtattcgggctcatttctcaggataggcgggaaaagggtgttttcctgtctatccccaatcttgtccgtgaccttgggtcacgacagtggcgccatccgtggggacgtgtagtctccttggagtgggcttgaatagtaaatgaaacgtttccaaaggcaaaagtcagtgccaattcgctacactgacacttttgcaagcgcagcagcagcacttgaaagagagtgggaagaaatgactggataatcagcacaaaccggagtagagaaagcaatgccgggaggaaaaactatcggtccaacaagagaagaaacaagagaaaacctgccaagtgaagtagagctcgccgagatggtgcaagcacaaggtgctgttatggtgaacaaagaacaatatgaagaactgcaaagagaattgcaaaggttttgcatgatcaaaccatgggagcaggaggatctggtagagaggcagagacactaaacactggtaaaggtcaaccgaatcaagtcgggaaagagacccaaagaaatgttggaaatgaggaaaaagagaatccccaagtagggaatgctccggttgataagccaacgcaagaagttcctcagaaccaacttcccactcaaagcttacaatccgttcaaaaccaacttcccactcagatcccacaatccgttcaaaaccaacttcccactcagatcccacaatccggtcaaaaccaacttcctactcagatcccacaatccgttcaaaatcaacttcccactcagatcccacaatctgttcaaaacaaactttccacccaaattccacaatccactcaacccttgcaaactactcaaaacctatcttccattcaaacccaacaactcatacaaccacagttttacaaccagacccattttcctcaaaaccaaatcccccaaacgg

SEQ ID NO: 55203 - DNA, 2754 bp, Oryza sativa
cctgcagcccgcctgcttactgtctccttctttcccgaagaagtctatttcttgtccctcgcctcttttcttttagcccagacaaaagtctgtttcaccttcctatcgctacagtactccttctatctctggacagaacccgagctcctgtgcccactgcccatgcaactcgacgcccccgcttcctctgtagaatccgttgcatcccgtgactcgtttcccaaattggttgaagggatttcttcccttatcctcctctttctttcccctcaagaatcggagcaaatcccatcgtatatcgcttggattcgaagcggagttcatctcctattttcccggcgaaccttaaccaatccgccgccaaatcctcacgggtccgagcctatttcctccacctttgcctataaatagcagtatcaatacctcctcttccgtttctatctttttccagagcttttccctaaccttagccgcctgcccgcgctcgtctcctcgctccgccgccggccgccgctccagtcggtcgtagccgtcgactccgacatctccggtcagcgccgtcgcctccaatgggaccaaagcgaagagtggaagaccggccaccatctgcccgaagccgaagaccccgggaagcccttcgtcgccgttaaggccgagttcgccgtcgcgttttgatcttcggcgaagccccgctgctcctcccgtcgtcgcccagcttcgtcgccacctccgttgggttcgaaaggaggagctgcaccccggccacccctccgttgccgccgctcgttgtcggaaagccgccgtcgccgccgtcccgatctcatcgccgcctctacctcgccgccggccgtcttccgttgtcgttcgtcgtcgtgccgcccctcggtgagctcccgtcgtcgtgctctttcttccggtatcctcgatttgcgccgccgagccctagatcgccggcgatcgttggaagcccctgtccgtgatgacatcatcgctgacgtcagcgcccgttttccttttctaagataaatcgtaaatccttttctgtatataaggctaaaatcagattaatcttgtaaaattcataactaaatcatatgaagtcagaataaggctgtttaagtctctaaattcatctaaaatcatgatctacatgtttatttagtttatatgtactgtttatttggagtttcttagtctttttcctcgttttgtgtattagctcatcgtttccgttgttgcgaagattcgtgagtgcgtcggaagtgttcaagaagattaattgaagaccgattattgcaaggcaagtcacatagatcccaaacacaactcctttgagcatgttgatcctatatttaaattctctatttatttcaactgtgtatttattttcgaatgtcaccggtggtgtgaacttatacctttgctacggccaatttgcattgattaccttattccttgataccttgggatacaatttgactagttggcctcatataatggttcaattagatatattagtatagttacttagatatgcttagaaacattagtgtggctgtgtttgcaaccccatgttcccagcccctctccatcgttttccgttttccgagcgcacgtttttcaaactactaaacaatgtgttttttgcaaaaagtttctatacgaaagttgcttaaaaaaatcaaattaatccatttttgaaaaaaaatagctaatacttaattaatcatacgctaatggatcgctccattttccgtgcggaggcactatgttcccaagctgaacatgcgaacacagcctaaagcttcactattacctaaagctggatatttaaaggtagctcacgatgataaatcgtgttatgataatcaattgataattaaaacttgataatggtgggttgtgagcgtatagttttgatggtcgtgctcatgacaattaaggatcggttcgcgagctactgttgtgaaacattaaccatgccaaccacaagctagcatgggtaacggcatttccttttgtatagtataattcattatggggcgccagactgtgaagtggcgagaagtccgtgggggtcgctggggagtccatgcctctggtaattgagggggtgattatgatccaggaacggtgcgttgtggtggattgtgttatgcgaggggtactgtcacagctcctttccgaggtatcgtggtggtattgaggcgcatggcaacgtgttgtggggctgtcttgtgggtacagtgatacattggcaacgtgttgtggggctgtcttgtgggtacagtgatacattgatacatctctggccagagtaaaactattcgaatagccttgcccgtagttatgggcgggtctaacaatgttttcgtgattagtctcacactgatgctataactggtaataatttgcttagatcctggtttggaatggtacattcctggtttggagttagatctgtacagccgggtatggttgttaaggatggttgggcctgtgcagcatgggtgtgctgtacagtgttgattaatattgatgattaattactctactgttttactattctcaaatatttgctaaatgctgcttttgcaaataagccctatattatgccatcctttggtatccttgtgcacttgcatatttgctgtgtggcatgcggagtattccatgtactcaccttgcaataatcaatcaaacctcaattgaggaagttgcgaaggagaagacgtttggcttataccccagttg

SEQ ID NO: 55204 - DNA, 9106 bp, Oryza sativa
cagattcctcactgccttacactagccaaagtgggaagccgattaactatgctgcagggattatcccaaatggtggtggactactccttcagtgatcggctatatggcccccaagacaactaatttactatatgggcaaactcatgaaccgattccagttgaaacttgtaaaaggaaaagcactaagcaatcggatgtcaagccatcggctgctaaacctcctgccgcctcgaaaaaggtagcaaagaagcaaaagtttgctgccgatgatctacctcctttggatcgtgatgtagaggaggtcctggagaatgaagaaatagaggaggccattgataatgctgctgctggcatgagtgacaccagggccttatccgcaagccctacgggtcgagctgggacacctccagctggtacaccaagtcccaacaagacgccagatgctccaacaccggcccctaaaagtggtggtatgcatctttcttcacattatcatccgattaagtgtgcatcatatgaatttattgccatttttccagcagacgaagaagccaagggctgctaagaagaagaaatccactccgcctccattggtaaccttaaacttgtgttcttactcctattagttgccacaaaaacttaatctcctcccctttttgcctcagcctcctcgatctccatctcctcgtcggctagcatctagtgagcacaccccgtcggctgtggacagtcatcacttgggaacaccagaacatccacctcttgttgtgcctgttagtactattaaatcttctcatatcggctgcgatattttctttgccaataatcccgatttatcttttctccaggtcttggccaatatgttttcctttgacgttaaacagttcctagatgaagaagaagaggaaaccaccagtggagccttggtccctcttgatgatgatctcaagaccaaactcatggatattgctcaacggctagggagttccttggattccttggttactggctgcgggtcaatcagggccaggtttgaagagatccaccaccagatcccagaagatgaagccgacatcatttccctggctgtatatctagagcaacatcgtttcaagctggaaagggcacaacaaagaatagcagacatgcgcgagagagctaaactggaagcaacaatcgaagctaatcggctcttcattaatgaaaaaaaagtcaagcttgatgagatgatcgtcgggctaggctctactcaagtgaacatagatcggctaaaaaccagggaggccgaactagtagctgagcttgaagcgtgccgatttccctagggctattgaagaacaaacgtctaaattgaggaaatccgtcaagcatctctctgaattgagcaagtccttgaaggtgattcctagtgtcacgcccggaaattcactagtaatttccgaacttatttgtacaaaaaaccttcgtctaggaatcagccgaggtacacaaactgacaatttaatatacaaatccatcataataataacgttacatacttacaaaagaaaagaaaacagtagcggaattaatggtctagcgatggcttcagctccactcccacaggcagctcaactggggtataagccaaacgtcttctccttcgcaacttgtcttcaactgaggtttgattgattattgtaaagtgagtacatggaatactccgcaagccacacagcaaatatgcaagtgcacaaggataccaaatgatggcataatatagggctcatttgcaaaagcagcatttagcaaacatttaggggtattaaaacagaagagtaattaatcaataacttttaatcaacactgaacagcacacccatgctgctcaggcccaaccatcctgaacaaccatacctggctatacagatctatctccaaaccaggaatgtaccattccaaaccaggagctaatcaaattattaccagttatagcatcatttattatagtgagaagtgtgagactaatcacgaaagacattgttagacccgcccataaccgcgggcacggctattcgaatagttttactctggccagaggtataccactgtacccacaagacacagccccacaacatgtcaccatgcgcctcaataccaccatggtacctcggaaaggagctgtgacagtacccttcgcacaacacaatccaccacagcgcaccattcctggatcataatcacccccttataaacaaggcatggacttcccagcgacccccgtgggcttatctccgccacttctcagtctggtgccccgcaatgaaccatgctatacaaaggtaaagtcgttgcccatgctggcttgtggttggtacggttaatgtttcacaaccgaaattcgtgaaccggtccttaattgtcatgagcacgaccatcaaaaccatgtgctcacaacccaccattatcaagttttatttggcagttaattaattcacaatcacgattgaccatcgtgagctagcattaaatatccatcattaagtaatagtgaaacattagttatcccaattgtgtgctaatgtttctaagcatggctaagcaattatatctaatatctagctgaacaaatatataagtccaactagtcaaattatcacccaaggtatcaaagaatagagtaagcaatgcagagtggtcataaaaaaggaataggttcacaccacccggtgacattccaaaataaatgcacagttgaaataaatagagaatttaaatataggatcaacatgctcaaaggaattgtgtttaggatctgtgtgacttgccttgcaataatcggtcttcaattaatcttcttggacacttccgacgcactcgcgaacctttgaaacgacggaaacgacaagctaacacgcaaaatgaggaaaaagactaataaaaaccaaataaatagtacataaaagtaaacaaacgtgtagatcataattttagatgaattatgagacttggacggcctcattctgacttcatatgaattagttatgaattttacaagatttaattccaattaaacctattaaacggagactattccaaattaattaaatcatttacaaatgatttataacggagataaaagattaaagcaacctccgaaaaagattggatcatatttggtagatgatatatattaaaaagaaataatatgccactgaaaagaggagaggatttatattgattttggacagctgagattaatcttgaccgagtcgactaagatcggatggcttggattgatctggcaagcgagcctcacgagataccgactcaacgagtcaactccacgtgacacgagatcacccaaatgatcaaccgaaaccggcgaacagaaccggcggctctgaacggctctaaactaaaggacgactcaacacagacgaatgaacgaagcacggggaacacctcgttcgaacgaacgagcgaacgactcaacaacggctgcggctaaaccggtcggctagacacgattcactgtaaagccctagtacgacaaacgataggccggtaggaacctagggttgcacctacggctacacaactcgactaaaagcagcggctaagtttaagcggcacacagctgcgacacggcggcactaagacaacttgactcggctaggcggcggctaggcggaaacacgcagctagggttagggtgacggcacagccggtagcgaccatgcacggctagagcagcagggctgcgagcaaaaacgcaaccggcacggctgcggctgtggcaaagcggcaaacagcggcagcggtagtgatgcatgatagcagcgcggtgacggactgcggctgcgctaagtctaggcctctagggcaacaacgcggcaaagcggcaagcagctgcagctaagcggcttagccggcacacgcgcagcagcggcatggcaagcagctgcggggcaacgcggcaaggcgcgacgcggtagcgactaagcagcggtggctaagaggctcggtagagcgacggcaaaccgcaaccgcacggcgtgcagcagctacgacacagcgacgacgacacacacgtggcttacataaacatctaccctaggaatcggagaggaggcctcaccgggaaacggtagcgaacggagaggaagaggtgacggctacggtccgacgacaacacacggagacgatgacgacgctagagccaaacaagattagattagatggaattaagaccttagggataaactacaccggtgaacgacataggagcggcggttactggcgaaccacggcacaataatgcaaacggagggcaccgggaggtagagaaggcgacggcgattcttaccaacacttacacgatgacgggcagcgacggaagatggccagcgatgagctccgaagggcggcgaggtactgatcaacggtggcgacggcgtttcagcgacgggagacgacaactgaggggtggacgggcttcaccttgctcctgcgaacccaatggagtcgacggcgaccgaaggcgacgacggacgacgacgaacagtgcggctggagacacggcgacgacggcggcgctcgggttcacgacgacgggcaacctccggtgggatttggcgcaaaaaaaccggtggccgaggtagctctcacccttgcgaagccgagggaggcgacggctcaaggcggcactgaccaaaggggcggcgcggctcggctggagatggtggcggcggtggagagagaagacaagcgtggggagagcgattccggcgaccgcggaggacgggacttgaggggataggtagaggacgacgagggggtcctttatataggcacgggagctcgggatcaagcccacatcgacgggaaaaactcgggaaagtttaggatcctcgccggaaaaaggaaagattgatccgcgaaattggaaaggatttccatagaaacttttggggatttcttagggaaattgtagaggagattgagaggattccattcccgcaactaatttggaaagaggagcaacgaggaggccggatttggaaggaggagcggcacggctgcacaggctcgggacggctcggctctgtccaggggttgaagacaacactgtagcgagagggaggataaacagacttctatgcgggctgagaggaagggagagaataggagggaatgggctgaatagggcccaagactaggaagaagattttattgcttttccaaatatattaaccaatgagatgatctctcaattgttaaaaatacttccaatgctcaaataattccaagaaaaatcttgaatatacttgaacactctaagtatttaacaatattgaaaccagaccatttaatgattaattcattagttaaataattactgaaatgttctttgtattgttaaaattaggaattgagctccgaaaaatccgagaaaatttcagagagtataattaatcatggagaatttaataaaaattaaattcagccatgatttatatttaggaaattttatttcccacattaacttcacttgtaaattaatgaacatttaatataaattctattaataatatattaaataatttataaatcctgaaacgaaaattcaggctgtgacacctagtaccgatgcagccgacatgcgagttatagacgaaatagaacaaattaggcagcgagctgtatcggccatttataggctcgtatctgggtgaatattcttgtaataggacgacttgggtgacatcattttgctgaatttcctttatatattcgattgtaatgatttccatattcgtcttaactcaaaaagcttcgaaaacccatacgtaaaatttttcaaagatctcagtcccatctgtgtacatatgcccccttaattttgcagtgttgaaaaaaattggcaaaattacattggtctaagggcaatatattcatatatcggccatctaaaggcgatgtaaaaacatcagtatcttatattggcttaaaccaactgatccatagtcctgaaatcttccaagggtgataacacacatatcggccatctagaggtgatgctccacacatcggctatcatgagtcggcacaaacccgccaatcatgcattgacccaaatacttggtaaatatttcttcaagtattttccgttgagtgctcttccgtaaacttctccttcgagaccttgtaacatgtaagctcctttagaaacagacttgtagatccagaaaggtccttcctaattcgatgaccacttgccaaatttattgtcgtgagttcctatcggcaaaatcaacttccaaaccaacttgccttctgtaaaagaattgggcacaactttcttcttataatgacgagcaattatctccttatcctttgttactttttccacaacacgcatcctagactgaaccaactcttttgactcgtccaccatgagattgtgataatcatcggctgttaactcatcttggatagcaatccttctcgagccgatggtactttcccacggtaaaacaacctcatgcccataaacaagcttgtaagtagggacttgaattgatctatgacaagccatccgataagaccacaatgcttcagctaatctggtatgccactgcttaggaaaatcagaaatcttcctcttgatcaacttaatcaaacttttgttagaggcttctgcttacccattagcttgtgcatggtgaggaattgaacaatttaaaccccatgctttttgcaaagatagatccttgatcggttgtaattgtctgtggcacactaaatctatatataatatgttctcaaacaaattggattgcgtccccagaatcaactttcttcaacggaactgcctcaacttattttctaaaatagtcagtagccaccaatataaacttatgtcctttactcgagggtggattaatttagcctatcatatcaatccatcaacctctgaatggccatggtttgattattgtattcattgccgatgctggcgctctctgaatagctccaaatttttgacagccttggcagcctttataatatctgaagcaatcttccaacattgtcggccaaaaatacccaactcaccgaagcagccacttcatcttatgaggcgattggtgagtaccacatataccttcatgtacttcccccatcacaaccttggcttgatcggcactcaacatttgagcaatactctatcaatcgtccgataatacaactcatcatccaatagaacatatttcaaagctttatattgtaatttcctcgaaaccggttgagagggatccttcaaataatcaaatacatgatacctccaatcatcgaccgtaattgtagagacttctatctcaatatctttcaccatcggcttgtatcccgatgcccccctgagccaaatcattagcttctgcattttgctctcgggaaacatgcttcattgtcaccatccgaaaactacccatcaactcttgacacttttcattgtagatcatcaaagtatcgctcttccattcatattccccagccaattggctagtgaccaacaaagaatcgcccatgatttcaacagcatcgacttcaacctcttttagcaactgtaatcccttaagaactgcttcgtacttggcctgattattagttgcataaggtttaatagtataggcaagctcgaaactagccccctaggcgatatgactaccaagccgataccacaaccatgagtgcaaaccgatccatcaaaaaacaatgtccaaggccctatatcaaccaggctgtttgaatcattacgatgctcaacaatgaaatcggctatagcttgccccttaattgccttaggtgattcatctatgagatcaaactctgtcaagtcaaaaatccattttccaactccccccttcaacactggggccgatagcatgtattttacaacatcggccttgcaaactatagtgcattcattggataacaaataatgcctcaatttcgccacttagtttttaatcaagtgctctagtattaggactctggataaagaaagaagtttctacgcgatgatagagtagtaattaataacttagacgtggtgtctaggttagtctgttaccttcgtttgttgtgtgctccacagaaagtgaggtaggtagcgggtggtgacagccatgtccgtcctttgtatccctccatgtttggatacatcaaatagctcaacgccaattttttgtaagattctttagtggatttggtaaggaaagaaattgatcactcgatggaagcctatccagaaaagaccgagtttaagaaggaatcatgaagactatggtatgacaatttagttctatctattaattagacaggatttaataattttccgctacaatctttaggaagttttgtctagtgtccgatcaggacttgtattgttccttctatctttaggaaacttgtgtcgtgcccgatatagaacttgtatctacccgtgggtataaatatgtccacccagggtcattgtaatttatctcacaaatcaatgcaactactctcggcgcatcgccaccctcttttctatggtttttatcaccagcgtaacttgtcacctgacgcacggctacatcacttcgatctccatcgaaggggtgagccctaagttccactggccaggcaattgatctgctatattggcgttgtttaaggctacatcgttttgctctcttggattgctttggtttggttggtatacttgtctatccgacatttcaattctatctttaattgcattgtgtctagagaggcatcgatttagttgggattatctcggtgttgacggtccttaaatcataatatctgaccgtcaatacctgcatataatgaactaaaatatggtattcaacttagtggtagggattattattaatcatttccactagtattggtgaaatatgtgtatgcaggtattttaaggagaaaacagacccgtcatgcgacaaaatgaacctccgcacattcaggagtttacatggactggagggcccatatgtcaatgaaaaccatttaggggccaaaacatagtatatgatgttgggggcccattaagcta

SEQ ID NO: 55205 - DNA, 12655 bp, Oryza sativa
  unsure (1)..(12655): unsure at all n locations
cattctttgagtttgatatctttttggagtcatccgaaggtgaactgctatagcggtattccgtgcgcttgcggatttatctgtggtcataagaaataccaacaagcatttctggcgccgttgccggggaacggttgctaatttgttcgagtctaggtcatcctcgtatctttatttttatttcttcttctcttatttctttccttgatggagcaacccacaattcaaaccctttctgctccttgggctgatctttgtgagccgtcctgttcttcaaaaccaatcctttcggatggctacgaaatcggtcctggctttatagccatgatttgagagcaaaccttctctggtagtattggtgaaaacccgtacttccatcttcgggactttgagctagtgtgttcatgtctatccatcataggcatgacacatggaactctcaagtggaagttgtttcctttttctcatagagataaagcgaagcaatggtacattatttctgtcaataatgtgaatggtacattaaattccacggtgaatgggaggagctaaagtgcaaattctgccttgctttctttccattaacccgtgtaattaatcttcgattagacatcctctctttccgacagaatgagaaggaatctctcggtttagcctgggccagattctcattgttaactcaatctggcccagacttgtctttaccagaccatgtgttgttataacattttcggtacgggttagacaaggagtctgccgcaaatctctgtatttccgccgcaggatcgttcgcacacaagagaaccgccgaaggaagagaactcctagatctcatcttagagagcgattctttctgccgcagcgaagtcgtcctggaggtcgagattacccatgaggaacgtctgcacgtggagtcggaacccgactcaactgtcgaatcctcattccagttgctggagccggaagaagaagaaattcatcctccgaaaattccattctaattcagggataatctttatgaagatcatggaaacaccctgaattattccagcaatacaaaggctcatcccaagcatgagccgttcgagggggtgatgtttgtatcttcgtttgtttcttctgaacctattgtccgtcttcatgaaactgaacgacccttatcaccttcgatcaagcctaaccttgtccctctggccctcagaacgttgttcttgtttatcatcaagacataacccagttcttgcacgatgcatctcttgagaaggaaaaccttcaggccgcggataagcttgagacatcgactctggaggacgagagaaaacattccacatatgagcatgagagtttctctttcaaaatcccccaggattcatgctcacataaagaatccccagagtcctgtttggttagtaccacttccctgtgcgaggaccactccacctttcggtcctcatttctaacgtgtttagaaggatggttgtggatgcttatatttatcataaatactacaaatatcgtatttgtggcactaatcttgcagcataatgtccccatggtcaagcttgtgaccataaacaaagcactgtggggaggtaacccggattgctatggtaagtttcccttctaataaaagcaagaaccaatttttaggataatatgcaccttcgggtattcttggtcgctaaacattgcaagttgagattaagaacgagagtcatcagatgcctaagaacacggtagctacatcaattacacactttggtgatccttggtattggaacaaactctataggagactccaacattacacacttggtttttgatgtcttgtgacacacaagtccaagtgtgggggtgaatgtcgatgagcttgtcataacgagttccatcaaccaaggccaccttggtttgaagttggggttagtcctagcttgataaaaaaaagaaaaaaaagaaaaaaaaagaggagaaatgagagacggaaggagaaaaaaaaagatgggagaagaggaagagagctgatgagctatatctatctacacccagtccctctcttgagctcatgtgccgccttggctaagcctttatccactcctagccatgcgcaatttctcgctcccgcagcacatacgggcatacaagcaggaggagattcttcttcatttctaggcgtttgcgtttgctgccccactctagttgacacttgcacatttgctcgaaaagagatgcatcctacgcattgtgccaacggatcatgccttcaagaaacaaggttcttgcacacgagctgtgtgcataactagaccgctcgctggagttggagtgatcaaagtgccttcctccactacaatccgcattgagatggaggagaaatcgacaatcatatgtgaccatgccactgccccagagatttcaaaatatccatcatgctggcggtaagtacactcaggtatgcgaaagataaaacaaggttcaccaaacctttactcaatagtaccaccatgtgaatatggcttgatcatacatgattatgtttcctttgtctattttcatatactcaggtttgggtgttttcgtgagacatcgataggctttttaaattaagcatggtgcttaggttaaactagtctgctttaatcgaattagacatggagtcgagtttgattaatgaactcttagagttaatatgttcatggacattagatatatatcttccatagactaacccctttaggaaagttttcaaattcattggtaattcgtcaagttcaattcacactggaggaaagtcaggctcgggaaacaaatcagtaaattgctacatgtaaaggatgaacacagtgcacgataagtatattgtcaaatgttcctttgtcatgttcgtgcaattttatcttaagccttgtatgagttttgcttaaacgaaaatttggtgaataataaaaattttgaaaaaaaatgtgtttttagaataaaaaagagagtgtctcttgaaaaataaaataaaaagttgacaaacttatgggatccacgcttcttaagttttgaatccaatttccttttagcgtggatgtgaacaactaaactcgaggctacgataaaatctttgcaattcttatagtccctcgggtatttcttgttcactaaccttttgcagataataaaatgacaatcaaggagcagtgtacaataacttcaaacacttatatcacgctccttggtccatgggaaagagatgcacagggaaccaaacagaacaaatgcaaaacattttacattcagttgaggtttaagcttggtaaatatctatctggtaagaatcttcaacaccttgtgcatcctcatccaatgttttcattctgccatgatacccaccatatccatcgttcccataaaaaaagagacaaaataaaacaaaataaatgtggttccttggtcttccaaccaagtgagtcatttttgctttactcgtgtctttgtttttctttttgtgtccaataaagagtcccaagtacaaaaacaagtgtgggggtgatcttgcacatcaatgccgtaaccaaagcaagatcaccccaaaagtgatgagccatgacaaaccacacaaggggaattgatgtagtcagatccaatgaggggtcaaccaaacctccagttcggctgaaccacctctaccatgaatcgtcttctgtttcatacagagcgcaggtttgcacaatttttcctttggacatccattctatcctgagttcaatttgattatcaattctaaaatattgaagataattgaactcaagctagggacagtacaattagagtttatggtctccctgaaaataacatgcatgcctattattcttagctcgttacttgttgcttgtggtgacatatccaatagggaccccatgttatctaggtaattgatgaatgagatatagtctgatgatagaaatcctactctttatattgcacacttgggaattttatgaaaaggaaaaaaatatataacgatgctaaactcctcattgatatttttattcccattagagccataggttgatcattcatgattagcttgctatatacgctgcttgtcattacattgagcattgtcaagttttgtgactcgtgcgaaatgcttttcatactttcatggtcaagatcgcatacactccacatacatgtacctatgcttgacttctacactggaagttagtattcttcatttgtcattcatttcatccatcatccacaaaataaatacttcatgtcatttatgcctcttcctccaaagttcttttaaaaaaaacaagagagagagagagaggggcatggctatgaataaaaaaatgctcatacaagtatggagcatgatgatgaaaaaaagagaaaaagaaaaaaaaagagatagccatgcactctcccaaatttcaaaagagaaaataaatggaggagatatacaaaaggagttattgttattagtatttccccttttccacccacaaatttaccatacacatacacatgcacattcttgacggccagaaagtatgtcttgtatttccgtggatccattatttgacttttgcaatatatgtgatacaagtaatgctctactcttttccacaccctgagctccacataaacattattagatagtaggaaaagaaaaggcacaatcatatgcctttgtgaggaatcatacacttagagcgatcgagagaatcaatggaggagcacggcaaagttataattttgtgttacttgaaaaaccccaattcgttcttcatgaaaagttaaggtgacttgagtcaagattttttcatttctcaattgcccagtatcgcatggtagacactagaaagacccacaagtacatgtatggctttgaataatttgtttgcatgattattagtaaggaagtcataactctattgtagagtccatagccttcactccggacgagcaaaggttaagtgtgtgggtgttttgacggtccttaaatcataatatctgactgtcaataccttcatataatgaactaaaatatggtatccaacttagtggtagggattattactaatcatttccactagtgttggtgaaatatgtgtatgcaggtattttaaggagaaaacagactcgtcatgcgacaaaatgaacctttgcacattccggacgtgtttacactgattggagggcccatatgtcaatgaaaactgcttagaattgggccaaaacatagtatatgatgttgggggcccattaagctacctcccagccgaagaggcggccgggaggagggttttccggttcggccgaaccaccagttcggctgaacccattttatggccgttgatcgccatcttccacgtgtacgctcctgatcacttcccaatggctgttgtggggcatttccgacaattcccatcaatgtaaccttcatttggagcctataaaaggaggagctcactctcatttccaacacacaactttgagctgaattacaagaggctctattgtatcttttgtgcattagaataagagtaaattgcatcactggtacacgaacttattaggtgggtgcaatctagtgcacgaacttgttaaatgctcgttttggtgcatgaacttgtctggtgtgtgtggagaaaggcgaaaagaatactatatggctaatcttattgatttaggggccgattaggatactatgtaaacatatatctgagaaggtttctattagacatacacctctttagtaaaaatagaatggatatactgatcgtagaaaaagattaaagaaaccgagcaatgatataagggttagaaatatatgaaattcatcgtttccatggtgaaggataaagtagagatcaaatttataaatattgcatgtcttatgcatactcactacacgtctgtatgtcacatcctaatcaacatctgcttcataaaattaacattgccaagctattttagtctcattcgcacaaactagacaagttcgtgtgccgaaacgagcattttacaagtttatgtactaaataagctctggaggggtgcccggaagtttggcgctccctccaacttctttctcgacgagtgtagctttctaggaggaattctggaggagtaccggagctgtcggtacactctgctccgggttcggagaaacttctattaagtaagcattcgtgttcctttcttatgttatttaattacttagtctaaataagatatatttcccctttgcgggttcattgtttagtattcgtactaagtgctctagtactaggactctaaataaagaaggaagttcctgtacaagtactatagtagtaattaataacttagatgtggtgtctaggttagagattacctttgtttgttgtgtaacccacggatttgttagaggtaggcggcaggtggtgacagccctgaatctcatcccagtaatcctccatgttcggatacatcataaagctatagctgaaaccacactggcagactagcaggggtcggtgcccgaagcagcagataggaaattacctttaacttagcgtagataattaaaacacatagaaagtcttctctagcctagctagcaaagtagcagataggaaattacctttaacttagcgtagataattaaaacacatagaaagtcttctctagcctagctagcaacctatagttattgtccttggatagtcttagccttaggtagattacacatgttccctgagttcaatatccttttggggtcatccgaaggtgaagtgctatagcggtattccatgcgctttcggatttatctatagtcataagaaataccaacactcggttaggtccgatcatctatcttagtcaatatacctatacaatcacaatgttgtttagatacatttgttatatccatcactttatacatgatttatcgacattattgggtttactcgttgctataaacttaatgctgtatcggtttagtctgatctagccaggtaactcatgtatactgttttatcggtgtgctagtcgataagttatctttacaacggattttccagccaatgtatgctttaaccatggagcttacatttaatattttgtatcaatatcggccgattggttcattagacatctacttcatcatattatcatcggccgattggattgtttgttcaagttcttccattgtatttatctaagtgtcagaatctacatcgactagtgtcgacattggctattatcgctacatcggcttattggccgatcggctctatgatcatcaatttatttatctaactgacacgctcgcatctcatcaaaaattaggacctgcactgaagctaaacagatttcccaggccttcgtgtttttggcatcaacagtgcctgaagcatttggtagagttttagctttaacttaagttagctagttgaatccataggaatcctctctagcctatcctatcattagttgttgtccttggttgaatcccattcttatatatacacgcatgttccttgcaattcaatacccttagaatactctgaggtgaagtgctacagtgatatacgtgcgcttgcggatttatatgtgactgtatcaagtaccaataaggagacagcnnnnnnnnnnnnnnnnnnnnnnnnnnnttaagccctcggcaggcacacgaccgagccacccgacgcgtcgtcgccacacggcaccgatgctcgcgcttcgccgctgcacggccacgtgctcaccgttaccacatggccgcaccgcacagccctgtcgtgacatcctgtccatccaccgtccgtccaccccgccgcatggctgcgccgcgcattatttggccacgctaccggctctgcaccactctagccgctgcgcctccccggccatgtgtcgagtcaacaggaagaagaagaaaaggaaagagaaccggaaaagaaaggaaagaaaggggaaaaaatgaaagaatcttctggttttgcaaaaaggtcgtggcagttttgggaaattaagcgcatatttttcagcagtggaaattttgcgattaaaacccaagagctttatgaaaatgtatatacaccctagaaatttgcaaaatcaatgaaaaagcatattatcgcataatagagccacgtgattttgaatttgatcccgaccttgcaagttgaggcacttttattgttgatgtttatgattaagaaatttatttattgtatttatgattattgattatttgtaatgcttttattacctttaattaatatttttaaggtaaaatgtatagatttgcatagaatatattggaattatttgcgggaattgatgtcgtaggctctccagatcttccattatatttcagagatgaagtgaataaatcaattcatcaaacaagcataataaagtatttgatgcctcaagagaagaatattagagacattgctgggcctttagcctaccagtcaacttcagcctgagatgtgctcgtcaaaccactcgaaggcggcgaccagatgtgttacacattcagtagacttgacaaaatggctaaagatctacaacatgtcaaatattcttaactcatactcatgtgaatctagttcccaggatgtgcactagattcacactttcatcttaagcatggaaatacatagcaagatacatttaagacgaaagtgatcacaaattacaactacttaatagatacatgggccgaccgaccaaatatagatatatcagagaacagcggaagcttgactacccaaacacaagcacaccgactaggggtttacccccaataagttcaagtcctagaagaagcagtcgaaaaacccgcattactcaacttaatctaaacatacaacctgcacaaatagatatttcaacatagcaggagtcagtacattatttctattcaaaggagcgcaatatgcagttcaattttagcataaatcaagttttgtttcacaatacttttgtaaaggagttgatgattcaattaatcaaaacatttttgtaagttcataataaatatcattatatcatcataagcatactcttgttgtcttccttgacaacaagtcatataatcatcatcacactcacacaactcaatacatttcacccattccaaatccaagtttcataacacattttaaaacataagtctatactcatgacactttaccaagcactcatgaccgtgagcatggctaattgattagtttttagactctgcagagtttgtatagctttatccacatgaggtgaatcgctctagtttgtctggtagccatcggtaccaccacactttacatattgagtgggtttacaggtcacaacgaggcttttacattaagtattgtataatccttgcataagcatgatgactgttgtttcacactaagttgtcacagcctgattttccgtatcaggatttataaattatttaataaattattaatagaatttatattaaatgttcattaatttacaagtgaagttaaatgtgggaaataaaatttcctaaatgttgtcgaatggacaacaatgccacatcgaaaggcgtgattctctcaacagtagttggaatgtaaaagcaattgtattgattcgtaaatttttttggggatccccccattacatggccctagaggtctatttatagccttagcacaagcctggaccttctagggtttagggttacagaggatttaacatggttgcccttatgaaacggacatttacatgggtatgcagtgtcatttgcacatatgggcctttaatgggctgataggctgctggtctatagcaaacaggcctaaaaggccgggggcggcctgttgggcctccttgatgccgaacttgtcatggcaaagtctttgtagttcgcccgagatgccttcgcccgagatgcctttactttcggagtaccgatgcggctttccagccttcgccatcttcgcttattgctttcaccataaggcttgcctgaatggtcttgacggctttggcttgaatccttgctggtactatggtttcggcaggtccggccgaagggcttcatggcatgcctccaacaagcccctcacgggcaagggtgagtaaggagcttcggccgagaccgtgcaaactatacggtatggcttgaggctccccctttcggccgatgttcctgtcgaaacctctttttagactcctgcagaaaaaatatgaacactggtgttcgcctttcgagaatggtgaagctgtattatgacactgggtgattatattttccaagtttgtctgctttgcgtgattcttaacttgtattttttttctttcccttttttccctattgttttagcggggatttcgccgaaagtcatgtgttcggccccctttcggggattggcgaaaagatttgttgacttttcagctttcgacttccattttcgactcgtagcattttgcgctgggaaaaacgcttatgttttgcgtaagttgaatgtaacggtgtttggtatctttattccgaaacaagctgtcgcggtttcaaagttcggcgagcgatgcttctgccgattcgtttcgccccccctggtgttttcatcgatcaagcgttcgccttttatgtagctatgtggttgtcaaaatggcgaattggaggtgaagacatcctggtcgaaccttagaggattacgaccggtgccacatccagcgccgcgatgacattgccacactttggttagacttcgaaatgactaatcgtcaagctgctttcgcttgacgtcggtgtgtatttcgcctccttccccccttaaagtcgtgtatagtatagatgacgaaccgtgttcgccggacttagtaggggcgaggcgaaaatgttctgaaacggatgatgtaattttttgctcctttgtgtaacacgtatgtgcttttgcctgatggagcttgtgcgtgtttttatgtttcttttcgctatcatcgcatttggtaacttgtatgttcggaagggcgaagcatgtcggcccccttgcgtattagcgaaaggaattcacattgacttttcagccctcatcattcactctcgacttttggcatatgcgtccagaaacgcttaagtatttgcataagtcaagtgtagcgatgatcggtatgttttccaaaaacgagctgtcgcggtttcaacgttcggcgagttgtgcttcggccgattcgtatcgcccccgtggcgtttttgtcgatcaaacgtttaccttggggtttttccaaaaatatcatacacaaaaaaggcgaagacacccatgaattttatatgactgagcgtcagtttgcaattgcccagcctcgacgcagcataatcctcgtttttccttcttcaccgctttaaattttttttgtgttgatctaacaactagcgatgaagaagatgctcaagggggtagtcctttgccattgaggactgcttttgctgatgaatcggatgtaaagtccgaatccattttggcgggcaatggaatttatctgtaacttgtgctttttggcaaataaatggggtgtggtgcgtgttgcggctgttcggctcgtactttcccctttttgcctttggcaaaggtatttttaggtactttaatcgttttgaccgttgccgcctttcggtctttttagtactttgacctttttaactgttaccggctttcggtcttttctttagtgctgctagggttttgcctttcatccctttcggctgccccgtttgtctacgggtgtgcaaccgatgcgaactcgatttcaagttttagcccctcgcacatttcattggacttctcggagtcaaaccgcttgttattgccggtaatgaactctttcggaacactgaatcggcagaaaatgtttttccgaacagatttttacactagtgccgaaggtactgccttagcccatcgaaggcggcttgacactcaggtgtccaattgagtttgccggccccttggaccatcttgaaaaatgataaatctctttcggctactcttgggagcaactccttatctcattttcgcccccagcccttgtcgccgtaactcgctggtactgtggcgaagggcgtgggtgtggcgaaacctgttcgcctacagcccttgatgccataccttattggcattatggcgaagggcgtgggtgtggcgaaaccacttcgcccgcagccctttacgccgtgcctcattagcactatggcgaagggcgtgggtgggcgaaacctcttcgcccgctgcccctgacgccgtaccttattggcactatggcgaaagacgtgggtgggcgaaacctgttcgcccgcagcccttgatgccgtaccttattggtactatggcgaagggcttggcatgtggcgaaacctcttcgcccgtaacccttgacgccgtgccttatgggcactatggcgaagggcgtgggtgtggcgaaacctcttcgcccacagcccttgacgccgtaccttattggtactatggcgaagggcgtgggtgtggcgaaacctcttcgcccgcagcccttggcaccgtaccttattggtaccatggcaaagggcgtgggtgggcgaaacctcttttgcccgcagcccctgacgccgtaccttattggcactatggcgaaaggcgtgggtggg

SEQ ID NO: 55206 - DNA, 8609 bp, Oryza sativa
tgttgtcgaatggacaacaatgccacatcgaaaggcgtgattctctcaacagtagttggaatgtaaaagcaattgtattgattcgtaaaattttttggggatccccccattacatggccctagaggtctatttatagccttagcataagcttggaccttctagggtttagggttacaaaggattttacatggttgcccttatgaaagggacatttacatgggtatgcagtgtcatttgcacatatgggcctttaatgggctgataggctgggcctggtctatagcaaacgggcctaaaaggggcggcctattgggcctccttgatgccgaacttgtcatggcgaagtctttgtagttcgcccgagatgccttcgcccgagatgcctttactttcggagtaccgacgcggctttccagccttcgccatcttcgcttatggctttcgccataaggcttcgcctaaatggtcttgacggctttggcttgaatccttgctggtactatggtttcggcaggtccggttgaagggcttcatggcatgcctccaacactaaacataaagcatggctggatttaatttttattaaattctccatgattaattatactctctgaaattttctcgaatttttcagagctcaattcctaattttaataatacaaagaacagttcagtaattagttaatcgataaattaatcattaatgatctagttataattatgttaaatgcttttcttgtttaaaaatccttaaattataaattgttgtttaaaaggaattattagaaataatcttaaaagcctaaaagagaagatctaattttaatttgctaaatctcaatataaaagtgagctaaataaaattttgttaagtacttctcttgtttctatagttcctatatgtttctaggatttatttgaccaaaggaagtatttttaataaacggaatatcatttcatgaataatttaaatagaaaaaggttttaaatctctcttttggctttgggccgaaagtcagcctaagtctctctctcccttccccttggcctgctcgtgctcggcccaagccggcccataccgccgcgcccctccctcctctctccctttcactgacaggtggggcccacctgtcagtcgtcttcaacctccggccgctcctagccgcgccgcaagccgccgcctccttccaaattcggccgcttccttccttctccggccgaattgatagaggggaaattatccacgggatctcctctttcctttctctttaggaatcttcggctaattttgtttggaaatcattggattcgagctcgattcggatcatctctctccccctaaccctagaccttccatctacttgccgccggccatgggcctccatcgccgcctcttagcccctataaaaggacccccgggacctcctcttttcgccgccaccttcgccctagcccgccgtcgcttgtagcgctgcctccgcgtcaacccttgcgccgccattgccgccgcgagtccagccaagcgccgccgctgctccagtcgtcgccgtcgctcaggaaggccgtcgccaggttcgcaaggtctccgtcgtccttgtcccgtcctccgtttccgccgaagactaccggagcgctgccaccatcgacgacccgaagaccgccgccgcctcgacctcgccgccgtcatcaatcgtcgccgtccgtcgtcatccaaaccgctggtgagttcgccgagccgagctttacgcgtagatgccctccgtttgcaccgccgcgccatcgtttgccgacgagcatagtgtgccgagccgccgccggcgatgacatcatctctgatgtcagcgctttgtcagccgtagaccgtggtagaccggatcgatctcggccgttcgattcggtcaagtttaggtcaattagatcttggccgttggtttcgtggaccgcttctgtgaacctggtttaccgtggacggtctttgatgatgcaataaatcctttttcttttcaaaataattctttattgcgtcataattcaattaaaacccatataaatgctttaatgcggtttaatctttagaaattcataactaattcattgtaactcggtttaatgtggttcaagttgcaaaagttgtataaaataaagatctacatattaaagttatccataaattgtgttaaatttatttaatcctttttaaataagctttaattaggttaaatcttgtaaaatttgtaattaatttatatgaaatcggaatgaggccgttcaagtctctaaattcatctaaaatcatgatctacatgtttgtttactttatgtgtactgtttatttggtttttattagtcttttttctcgttttgcgtgttagcttgtcgtttccgtcgtttcgaaagttcacgagtgcgtcagaagtattcaagaagattaactgaagaccctttattgcaaggcaagtcacacagattccaaacacaattcctttgagcatgttgatcctatatttaaattctctatttatttcaactgtgcatttattttcgaatgtcaccgggtggtgtgaacctgtttctttgttatggccaatttgcattgattaccctatttcttgattacctcgggttataagttgactagttggatttatatattggttcaactagatatattagatgtaattgcttagccatgcttagaaacattagcacacgattgggataactaatatttcactattacttaatgatggatatttaatgatagctcacgatggttaatcgtgattggttaattaattaattaacttgccaactaaaacttgataaaagtgggttgtgagcacatggttttgatggtcgtgctcatgataattaaggaccggttcacgagtttcggttgtgaaacattaaccgtgccaaccacaagccagcgtgggcaacggctttaccttttgtatagcatggttcattgcggggcaccagactgagaagtggcggagataagcccacgggggtcgctggggagtccatgccttgtttataagggggtgattatgatccaggaacagtgcgctgtggtggattgtgttatgcgaggggtactgtcacagttcctttccgaggtaccgtggtggtattgaggcgcatggtggcatgtcgtggggctgtatcttgtgggtacagtggtacacctctggccagagtaaaactattcgaatagccgtgcccgcggttatgggcgggtctaacaatgtctttcgtgattagtctcacacttctcaccataataaatgatgctataactggtaataatttgattagctcctggtttggaatggtacattcctagtttggagatagatctgtacagccgggtatggttgttcaggatggttgggcctgtgcagcatgggtgtgctgttcagtgttgattaatattgatgattaattaatttactgttttataattctcaaatgttggtcattctaactgaagaggtcagtgacaataatcaaaattagtatctctttcgttgctattaccatatgagaatgtgtatctcaacctttgcgaatgttgctatttcagttcatagatttcatcctatagaaatagttgtttgcagaaaaaaattaccgtttccaatggctactattacatttatctctaacgccttcatgtgtagctctccatttctacctagataatcccgcagcaacgcgcagggtattatctagttacttataattgtcagagcccaagcaggggttaaatataatataatatctagcatttcaatctctctttggtatctctatgttactctcagaaatgagtactctaaacgaatgagcacattgacactctttttactacacgaaagattatggtgcacaccatacctctcatagagcaagaatgggtattttcaactatgattcacttataaaaatgacctagagagtacagtaatacggtgcaccaaatttgcaccgaatattgtggaaactcttgatgttctatctaaacatgacgaaagtcgcacgcaagtatcattagtacgcatgcaagaagtatgcctagctagttgataataaaattgtgtaacatataggatagtgtttactagaagagtattgtcttcccaaaccacctagtgtatttacctcaacgaaagaaaaggaaaagtgggagtattacatagttcaaggtgaacaatccacaaccatgtactcatgaatacaaaaagaaaatgatgatcctaatagcatacccatcatgaattgagggggataactcctaccctatttgcatggctaaggatgtagaatctctcatactagaccgcatacgtcctaaaaatttatatcagaatagaaaatctttgccatagttgccaagcaagaagctcgctatgaagttaattaaatgcgacgtatcggaatactttgttgaatcaatctactttgtcatcatttgttgtaattttttagtagaatattgaattgaataaatggttttatccaagtagagcatacacttttccctacaacgaacggttatttctagtataaattagcatatttaaggtatttactattttgttgctattttctagcacatggttataatgctttgaattttgtgtagcactcaaacataaaaaaaaggaatgaattgtggaacgcataaccacaaatagcactttaagataaaaaggtatttccagaagcataaactggaaatataatgactattgctagaagcaacaactaaatttgttggcctagaaagcatcacagtcatattacctatggagcaattatgcactttgtagaagaattgattgtacaattaaccctcttgaactctctaaaagtgtgacgatttgggctacactatcttttagcaatagatttttggtcatattggtcttagaattataagaatagacattacaactcgtatagttatagcacatatatgcataatttcctaaatcatgaatatttatgtgccagtatgccccaacaggagattaatgcatagaccacataccatgaatgtataattataacatcgaattggattgcatggaatacttaccatcctatttttggtactatatggatagagacgcttctcaagtagtgaacatccaatgcctattcgacaccatatatttgccaagattgatccatcaagagcatataaatttgaacaaatttcactaatcatctttagaagtacacaaggacaatgctagaatagcatttgatgattagtgaactagcagcatgaagtaccaaatatctgcatgaacggactaaatataaactatgaattgtaatactttctatgtcattgttataatacctgcagtatgaatggacatgtagtcttgaaatcagcggattctgaaagaaaattcagaccattagcatgaacatctgctctgcaactagtactattgcatttactttatttgtgtgcatattccactatcatagtgcattgcaaaagactctctccgaaagtcaaaaactttgaatgaaaatagttatgaagcctaaattccttaactatatgtatcattgatggtggacccaaatcacacggatgaaatgcatggagatcgagctatatgtatcacttgttctctccatgcacatattgatatattcatatataatattttcatgtgattgacatatgcatgtgagactaatgttttgtttgagtcttatcgcttgtttagtctatttacgttgaggacgtggagatgatgaaggtatgcatttattttaatatctatatttgataaatgccttctatttttgtataggaaaagctcccaatgtttcatctctatttatgcatactcttgcttcacacaaatattccgtatgcatacatttagggggagcaaatcctataccttagttatgcatgtatttgatctaagttattcactttaatttaattgggatctttatatttgagtatatgacacttgtggtgttgattaatactcatcacttatccatattcttttatatacgtgattggttggtcaacatgtgaaggttgacaaccagatcattgggactaataattttattgagttgaataagagaaataggtcccaaggattacaaaggtgttgatgctcatgtgatatcattacacctaaaattaacaagaatgacaaagtggagatattgaagatgtgggatacgaaatggctactatggcaagacggtgaagggcaagcgatgctcggtcacgatggaccatgcggcggtgaagggcaagcaaggggcttggcgccgaagaaccaaatccggtggtgaagggcgagtgacggctttgtcatgatggatcgtgcgaggccatttgaagctacaagtaaccgcatcaatcatttgaagactatatggtgaaacggtttcggcattgcgtcccttaagacaatgaaagaaagatggaaagaaggcatttctattggtataatttttttcatatttacatttgagtttaggaatgctgtactattaaaagggatgcaacgtcgaggtgtttgtgtatgtctcggtactcaaagtgacctatcatagtgctaccttgagagaaacccaagctttaacctatccttttgagtggttttagaccttgttcttggttgagttgcgtagtcctctaagtgagctttgcatagagtctaagatcatcaaaaacggactcccgagcaaaaagttatggtcattttactctgtgctttccggaagttccgaaaaattattggaagttccgaaaattccagtctttgcctccaacagctagttttttaggggctcgggtatataaactcctccatccctcctttgagtggctgctgttcttgtacagtattagacacatccaaagccaaatagccatccccatttccctacctttgtggtgtctctttgtgagagggatttgagaaggggagagagttggattgagagattgagaagttgagagctagtgagcttcactccatactttgagcactcaagttcatagcaagcaaatcttcgattgtatttgttactcttggtaaggtctcctagacagctaggcatctccggtgagcacccaaggttgtggtgtgccacggaaagtttgtgaaggcttctatttctcctccgcacgggaagaatcaagagtgaaaccgaggagtgcatttgtgcaacctcatgaggaaagggttgaaataggcccggcccttgtggctcctcaacggagacgtaggattcgtggatctgaactttgggaagcaaatcatgcgtctcctctcttggtttgcccattcttgcattctcttatattgtgcttgagcttgcttttacccgatctacttgcatacttaattgatttagttggtgaacttatatcttgcttagatatcttatttgtcaccttttgattcatatacattttgtttgtttgaggtacaagttcatagctagtgttttattccgttgtccgcctaacttttcggttgagaccggaacttcgaatcccataccggaagttccgatttgaatcgaaagttctcatcattccaatatgctattaagttgtgataatttttaggaacgcctattcacccctctctaggcgacatcaaggtcctttcaattacaccagaagtgtacgaaaagaattgaaactactaaatcactttatgattacttttgtgattgtgaagagtttgactagttgcataattgaaatgcaccgaaggagggtgaaataccgaagaaagtaaagctatccctcatcttgtctagaggccccaggtaaaaataataggacaagaaactccgactcttcacaccacctaagtaacttgagactgttggtatttcttaacgacattactagaaatataattcccagcaatggtgcagaaatactcctggtatattatggttacagaattcatccgcaagcgcacggatataccattgtagcatttcaccccgagagtattccaagggtatcgtatttattttatcccgtgggaagatcatgtagagagagcttgactaataatttatatgttacttgtgataatcatattctaagcaggggttaagataatccaatggtagaatgacacacaagaattattactcattctcataatatattatcttagcttagtggaaagaaaagagaaagaaaatctattcctatacgtctaatacacatagcatatatacattctagttaactggtatactagctaataccctctatctgatgccctcctggtacttcaagaagccacccctgactgccgagttccttacgaaagcccatcatgaccatacaaccggggctaaatacggaggaataccctccccaagaaattaacttaggattatataccggcgcggaggaatacccgtactgagttgtcaccatcagcggcccacctctcatccgcaatatataaccccaaataatgatatcccgtaatctagacaccacgcctaaactaccagatacttctctaatatcatcgtcatgacatagaggaattgcataagcaaa

SEQ ID NO: 55207 - DNA, 21949 bp, Oryza sativa
  unsure (1)..(21949): unsure at all n locations
agtatttcaataccataaatgtatttagaagagtattctaataaaagtacanagcttacaaaagagaagaaaaaagctactagagccatacccgaactcttccgaagacttccgaactcctgatttctactctattcctattccaccagctagatactactaaactaaacttgagagaaatgagagagctattgcttgaggtgtgtgttgaagtgaagagagtgaactccttaaataggcaggtaatgatggttatggcggttggaaaggtcggtaataccctccaatggccatagggagtgaatctccaccgttccctcaaaaccctacatccatcggcgctggcataggttcggccgaaccctaggctggcccaaccagcccacaagttggctggtggcctccttaggtgttcctcttcatagacttggcccagtgtgtcgtgtcatttttgagttcttggcccattcatacataagtctggttctcgacatcgtccgattgatttatcgtttgtgttgatgtcgattctcctccactttattgtcattctctacaaaaggttattaaacctaatactagtggaatattattgttctaacatatttatgcattgcaagcatcactagttctcctctattttggtaatattgacggtcgaaattgattgataacgaccgtcaacaaaaccccccaagcttaaacctttgctcgtcccgagtgaaggacgaaaggaaacaaggacttgcttgttgatcaggagttgcaactatgctgcatatctcaaagacacaggtgcaaggtatatatactctctctcagattaaataatctttggcacggtggcttacccttacccctgattcccacgagacgctgcttctccttgccttgagaagttgaaagatagaatagcaagttagagtaccaatcacccaatctttattcaactcttattccggaagttttcaaatgattttgcaaaagaaagccaagttcctcaaatgattcactcagtctctccaagtgtatcaatttgaattcctcaccaaattgttgccttttttattcctactctaaggttttatatgtggagctcggtagggatcaaacatggcatacttgcattcacatttattactaagtcaaaaacttagactaaagcagataactaaacatactcaagatcaagatcgtgcaaaatgtgtgtgtggtatatggtggaaatggtacatgaagaaaaataaagaaaatgcttctcctttgtgcttactttcttctcccaaaaatccttcttttattgcttaggagagggcatggctacattttttttatttcaacatcatgctcatgcttgatggagcataactttatttctcataaccatgcctttccctccattttttttaggagaagaaagcacatgaaagcgtggagagtttattttggtggtaaaatggaaatggaatattgcttagctccttgtgtaggagtttagcatgtgcatatgtgtgggtgtatgatcttgatcatagagcatgagaagtacctacacgagtcacaagagtttgacaaagttcaatggaatgacaagtaaccaaaatgtatatggtttaatcatgatagcacatttttggctttagtaggaatttatatcaaatgaggaattctcaatttatcattttgaaaaacaaaacatctggaattcaagtcaaactagtatcagggtcatagcaactcatatttactatctcatatctcgcaacaacctagacttagatcagcaagtgcagcccatttacctcaggttcccggataattgttggctacttatatttaacctttgagagagcatttaccaagaaaccatatataagagatataaaatagagcaactattcatcatctcaacaaagagaactagcttgtcttacctagcatgactcaaacctatcctatctttttggtatattctattttgcaaatttttatattgtttttatttttataagatgcaattggaaagggaaatatgcaatgtgatacaagttaccttagtagggggagcgatgtctcccccctaagcttggctttcgctcagggtacttgataaggattgaatccctgaaaacgaaagtacgcctgaaggtcatcgtgctgttgctgcatcatgttgttgatgttggcaaactgagcatcagcagattgttgccattcttgtgtttgagctatgtgttccgtgaggttgtactgaatctcccccgtctgcatatcaagggtgtccattctcctagttatttcacccaagtcccaacgagaggaactcgagcgacattcacttggagatggaggcgcaccacttgacctgggaggttgattgtccccccattggatatcatgaggcgcatgccacaggtcctcactggcagttgcccaggttgagactccgatgctatggcgtggagcttgggtccatccgggtgcatccccagttggtgcccaacctgcctcatacatctgcacgggtgttgaggatgatgaactctctcgttcgttccttgtcatgctgcgcgtctccctgtatgttccacctgcacgagattcttctatggtctgcaggggaatggttagttcacgacagtgtaggattatggatatcattcgttctaggtttcttgcaaattggagcaccagaaatatctttccaaaacctatttttctcgaacccagaaattcctttctggtgatcgattttacaggaatcgtgaaaaccaagaagtgtacttaagcctttccatgtgagtgtgaactcattacggaaaaagtgaaaagaaataccatctactatttctttcaaagtgcacagaaattgcaaagtaagcaaacaagaaccaagctcatctaccatagcaaatctctgccaaccaaaagctttccaaatagaacaaaattcaacatccatacctatcattttcagcaactccggtgagtattctcgcgtgtgagcatactcccggtcgctcagcatgtagtaggcttgtctctcccgatcactgacaagatcgaggtcggtgtcgttccggagtcgtcacggagcttcggcgtcttccatcgagacatcggctgatgaacgagtactagactcgtcatgatgacttgatgaagagccggaccctttgaacagacgagacaatcgcctcctcatactgcacaatggggcaagaatggactaactcggcgggggttaggaatgacaagagtttcacccgccggttagattcaccaaagcaacttgtatgtatgcaactaaatatttgaatttgagggaaactatcaaagcttgaatgaacttgagagcaaactttggagagggaatgaaaatgtgttgaaatggggtggaattccctctctcagccggctggcttttatagggtacccacaacagtcagaaatgacatgtgggacccactagccgttaccctgccaaaagcggcaggtagccgttgcctggctggttcgactgaaccagggtgttcggccgaacccctggtgggcccaaccggccccacttttagccgttggattccaacggtcagtgtagtcatggcatagcgaattttcgttggaaatattattttggtttgctctgaaaaattcatttgaagaatttcctcaaaattcaaaaatcctaaatgcaattttgaaattcaaatatgtgatgatgcaaaaattcaaattgttgaaagtaaatatgcggatacataccaatttacttgttggtgaaggttgcgtcgtttaaagtccaacgtgcaagactgtacctcctttcggttcagtgcccggattttccacccgtctccggaggtgatggagcggacatctttggcttttccttccacaccttctttggttttggtgcggaagacggcttcttttgagccagctgctctaacttcttggccagtataggtgattttaccggcgtcttccaataacggttcctgggcatcgttgtttccttttccaggaaattctacatgaatttcaccaggctgttctccgttcccacgtcaatgttggctcctgcggtgctaaggaacggacgccccaggatgagtggtgtctccttccccgtgtccatgtccagcaccacaaaatcaaccgggatgaagaaatcccgtatcttgactggcacaatctccgctacccctgcgggtaacggactaatgaatcagccagttggaggcgcatcggtgttggtgccaacaccgtgaagttgagtttgtcgaagacgtcttttggcatgacgctgacactggctccaaggtcacacaaggcctggtcgaattgttgtgccacgatcgagcaggtgatcgtaggacaccccgggtctttcatcttctccaggaggttgtggagtatcaggttgctgcattgttccgtcagcttgaccacctccgttgttgggagcggtctcttgttgttgagtatatctttgagataacaggcgtatgtcagtacttgcattgcgtccaacaatggcacgttgatgtggatcttctggattacttcaacaaaacgagcgaactgttcgtctacatacggtttcctaatccgttaaggaaatggcagcaactatgtgtcgcagtactcttgcggcacggtcttttctggctgaacctccttgtcagccgtgtcattagatggtgcttcgtttgataatccattagttcctgcagggttaggatacgacggatcacgagtggacttacctcccctcgtcgtgatcgccttgacattttcaatgtaggagtcgggttgccccggaatcctcccagtttcagttgcagggactaaggatgccagctgagctaactggatttctatcattttattaaagctcagctgattttgaaaagcagaagcaaagccctctagtttgacattgatgttttctacgtccttgtcattggcagcaagccttttgcttaatgcatcagtagttctagcttgcacgaaaacgagattgtaacaccccaagtaaccacgtacctagagtgccacaccataaatcactcaaaccactaacttccaaaattattagaaatttcggcagagcctccccttcaacaactaaaagtctatctttgattgccaattatttagaggtaataaacaatatctacgaagtcaatctcatggaccataggccacacttgttccacttataataaactttctgagtaactagaacgaaagcattatcctcaaaaactgccctgaacatcaatagatcctgaattttctaagaaactcaaacattcaaagtaaatgaattaaatccactcaataaaaaatcaatgtgttgggtgcgtgtaattgaaaagaaataattcgaatatggaaggtcaagcaacaaaacaaacaacatgataatatgggcgtggttggtcaaggagggctggttagaaaagttaccgttattgttacctccttgataatatgggcgtggttggttccacccctaacctccatgtggacggtacccgttgttgttgcccatgtacatcgcctcctcacgggtttccgggctgtcattcccagaatgacctatgttgccacagacctcacacgtgacgtgagagtccaaggccttgacggtgccttgtggccatttctcatggtcgtccaagcgtttcatgaggaggtccagcttggcagcaagtaattccatctccttgacggtgtgcatgcctcactgacgggtctggagtcgttcctcgctccaacccatattggagaccatcttctctattagttcaaaggctccttgaactgttttagagaagaaggcccctccagctgccgcgtccaggtgatcgcgggacattggggtgagtccattgtaaaaattctgcaggatcagccagtcgtccatcccatgatgaggacaggcggccacgtactcctgcagtcgttcccatgtttctagaatagactcgtcccttgtctgctagaaactggaaatccttccacgaagggcattggttttgtccatcgggaagaatttcaagaggaatgatgtagagcatttgttccaggtgttgacagcagcacggttggcataaaaccactgcttcgctctcccgagaagggagaacggaaacagtcgcagcctgacggcgtcgggactgatgcccttgatggtgtacgtgctacaaatctctaggaactgttgcagatgagcattggcatcctcattaggcttgccacagaacgggctagcctacgccatcatgataaggctggacttcaagtcgaaatccacgtcccctatgttgacctgtggcccaatggccacatagtcagcagagagagcagcgaactcgcgaagagtcttgttggccatagtcttgaaggtcggtggcgctggtacggctggtttctctgtcggtagagttttctgcggagcaacaactcgcggcctgacgctccggatgaaagcttctgcattttctttgaagttttccggcaggttgaaaccagtcatgcactaccctgttttcacaacaaacagtgaaaacaaccaaggttagcctgcaaaggaaaatgattatacagaggtaaatataaagtattagttcaagtaatctctattatgaatcttctcgggcaacggcgccagaaatgcttgttggtatttcttaacgacattactagaaatataattcccagcaatggcgcagaaatactcctggtatattatggttacagaattcatccgcaagcgcacagatataccattgtagcatttcacccgagagtattccaagggtatcgtatttattttatcccgtgggaagatcatgtagagagagcttgactaataatttatatgttacttatgataatcatattctaagcaggggttaagataatccaagggtagaatgacacacaagcattattactcattctcataatatattatcttatcttagtggaaagaaaagagaaagaaaatctattcctatacttctaatacacatagtatacatacattctagttaactggtatactagctaataccctctatccgatgccctcctggtacttcgagaagccacccctgactgccgagttccttacgacagcccatcatgaccatacaaccagggctaaatacggaggaataccctccctaggaaattaacttaggattatataccggcgcggaggaatacccgtactgagctatcaccatcagcggcccacctctcatccgcaatatataaccccaaataatgatatcccgtaatctagacaccacgcctaaactatcagatacttctctaatatcatcgtcatgacatagaggaattgcataagcaaacattatacccgcaccaaagcatcttctagataagctagccgtatattcagtataacatgaacataatgtaaagtaggtactcatatactcggaaagtatttcaataccataaatgtatttagaagagtattctaataaaagtacaaagcttacaaaagagaagagaaaagctactagagccatacccgaactcttccgaagacttccgaactcctgatttctactctattcctattccaccagctagatactactaaactaaacttgagagaaatgagagagctatttcttgaggtgtgtgttgaagtgaagagagtgaactccttaaataggcaggtaatgacggttatggtggttggaaaggtcggtaataccctccaacagccatagggagtgaatctccaccgttccctcaaaaccctgcatccatcggcgctggcataggttcggccgaaccctgggctgtcccaaccagcccacaagttggctggtggcctcctctggtgttcctcttcgtagacttgtgaattttggcccagtgtgtcgtgtcatttttgagttctcggcccattcatacataagtctggttctcgacatcgtccgattgatttatcgtttgtgttgatgtcgattctcctccactttattgtcattctctgcaaaaggttagtaaacctactactagtggaatattattattctaacatatttattcattgcaagcatcactagttctcctctattttggtaatatcaatagatacgtctggtgaaaacagaggaagaggtactatcatactcaaagtcactaaaagtacccaactgaataaaaagggaggcagttgagatctggcaagtggtatggagcctcataataaacacttcccatcaaggaagaaaatcagcagttagagtacacacaacgctggtacactaagaggatcatgcccacatcaaaaagcattaagcaagaagaagaaacatatgaaaaatgcatatcctcgtatatctatggatactcgcatagagtctcatacaaccaatagaagttaacaatgagacctattatgggcaatgtttcctttagacagtaaaacttattggcaatcaaccaggagttgaatggaattaatcaactagaagttcaaaaaaaaaacaacctgaatatagacaacactgaagataaaatctggatgcttttcaggagcttggattggacacttgcataacagtacataaaaaagtacttagtcctaaaccaatatgtaatgtatataataatctataaagaattgaagaagcgaactcgttcattttgaatttgaatttgatttgaaattgaaatgtttggctgaatctaaatcacgcttagacttgcagctaaaaaatatgatagatggaagcttagtacatcagtccaaccacacttagaaagtgatcaaggtgcatggctttggagtagtcaattatagctaaaattgggacgaaattccaaacacgagtgtgtgatagcagcactcgaatacttggctaatcgggactaaaccgaattaagtatcattgaactatacatagccttggcatggctttgagagatggttacatcgctccagcaatcgtggttcgaaaattatctcaaccccattattttatttgaaaataatgtagcgtatgacacacaatgcaaatgagttcacatgaacaaactcactcaaagcatatgaacctcccaagttcttctatgcacatgaattgcatataaacaacgaaatattgcatgctaagttatgtgaaaatcttgctgattttatcactggtcattgttgacatcttctcgaatagatgtgtccaaggaaccagaacaatgagacttgtaagaatgtaaaatttaaggggagaatttcactgattcattcagaatcttaatatagaaaattcaaatacccaacaaatcaatttagaaagattgaacgaagaattggatgaattgtactctttttcccttgataagttattactggagtttcttatcaaggtttttaatgagacaattcgtgtgacaccgcatgaattttttgtagagttttgatgcacaagcatcacacaatgagagcacggagggagtgttagggaaccagcggcccatgaagagcggatcactaaatatgaaaggtggatgaggctatacctataaatagtggggaagagatgatagattgtacacttaaaaggatgaaagaatgaatgaaaagctgcccctccatatatcttgtgtctcagcacctctgaactatgcatgtagcaagactacgcatataacagatgggttgtataatacacacaacgggttacactaatattaatttccccaaacaccatagggaacagctgaagatcagcttgccatgtcatcaatttttgcataaacgcctctagttttcaggtgataatacgtacgtccgcagtctcttgtcatgcatttcgaccgttatcatatactcttgcagttaattgatttaacttagcatttatatcatgtaaatgcgaaagaaaaatagagtaagggcacgtacaacggcattaattagccggctctctccagtgccacataggcaaatcagatgacgtggaagagagatgatcgatgagagagaaacaacgatgctatctgtgacatcgttgaagcatcggctcctctcgcgcaaaaaacgagcagacttgaggagagccctccgttgtagaatcggtttccagcagagccgtgcctccagatccaacgtaaaaattgcgcgcggaagaaatttggcgcgggtgagggatcgggatacgggagggcgggaatcggaccagagatgcgcgccatccaatttcttcgaccccaaatatggcgctgaaatcggcagatcgggttccagtccaatacgtcgccgctacgctcctccacctcgctgctgccttggatcctccacctcgccaccaacctttcccctccacctcgccgccgacgttgctcctcaatcactcactccatcggcgttggctgtatggctgggagacggacaaaggtggcatcggtgcctgagacatcctccgtcggtaccaacacctccggcttctgcttcacctcaactgatgcccccgccgcctttggtacctttcctccctatcttggaatacctcccttctctgcatctaggataagcgcggctgcgacgggtggccatatttccccatctccttcatggatacagacagacaaaagctcagataaagctgctacgccggatttgtcctcgccacatgcaaatatgcagagctggtaaccacaaatcccagcaataatctctactatcttacgaagattcagttctgcaagttttttgttctctgaatgaaattattaaacggttgccatgttctaaacttgatatattttctgaaaatacaatgagtaaatcagtccaagattttctgaaatacatcgttcaaagcagtccatataaattgacagataaatattggtatataatccataaggttactgtttgttcatataggtctgtacagattaagttattgtacatctttggccatgctgaaactgaagagacctatagttgccatgttatgttatttctctgtacaaactaaggtttctatattttttgggagtatgtcacaccctaaaaatcctaaatatataaattgttgtttaattggaattattagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggtttttttaaaatcctcttttggctttgggccgaaagtcggcccaaaaccttctctctctctctcctggcccaatccggcccgcagccgagccgcccgctcgcgctcgtgtccgcccgctgataggtggggcccacctgtcagggctgtcgtcttcctccggccgcccgccgcccgaaccctagcgtcgcgccgccgccgtctccttccaaatccggccacccctttccgtttccgatgaaattagtagaggggaaatgatcttcggaatccactctaccttttcccttttggaaacatcgtctaaatcgctttggaaatccgtggattcgagtttgattcggatcgatctctctcctccgaaccctagactttccatcgcgtcgccggtcgccgtgggccttcgccgccgcctccttgcccctttaaaaggacccccaagcccgccgctacctgccgccacccttgcctttgcccgccgccgtcggtagcgccctagcaccgtgcagccgtgcgctgccgtcgccgccgttcgtccagccgtgcgccgccgccgctccggtcgtcgtcgtcactcgggaaggccgccgtcgtgatcgccaagccatcgccgacctcgtccgcccctccgtcgtcgccgtaggccgccggaacaccgtcgccgttgtgaagccgaaggtcgccgccgcttcttcctcaacgccgtcgccgttcgttgatcttccgccgttgttttggtcaccggtgagttcgccgcgtcgccctctacgtgttggtgtcttccgttcgcgtcgtcgcgccgtcgttcgccgacgagcttgcgcgcccgagccgccgccggtgatgacgtcatcgccgacgtcatcgttgccgtccgtcgtagaccggtcatagaccgttggatcttggccatccgttttggataggatcgatctcggccgtttgtttccgtgagccgccgccgtgcacccggtccaccgcgaaccctagccgctgacgcaataattcccttttccttttcaaaaataattcattattgcgtcataattcaattaaaatccatataagtgttttaatccgatttaacctttaaaaattcataactaattcatcttagctcggatttagttggttcaagtctctaaatttttctaaaatagagatctacatgttaaaaatatccacatgcactgttcatgcttgtttatgtgctgttttggtgtttttgctcttttctgtttagattccaacgtttccggagagttcgttttcgcaggagaagaatttgaagagttccaaggccagcaagacaagtcacacagatcccaaacaaccttttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgggctttatatattggttcaactagatattagatacgattgcttagcaatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagctagcgtgggcaacggctttaccttttgtatagcatggttcattgcggagcaccagtctgagaagtggcggagataagcccacgggggtcgctggggagtccatgccttgtttataagggggtgattatgatccaggaaaggtgcgctgtggtggattgtgttgtgcgggggtactgtcacagctcctttccgaggtaccgtggtggtattgaggcacatggtgacatgttgtggggctgtgtcttgtgggtacagtggtacatctctggccagagtaaaactattcgaatagtcgtgctcgcggttatgggcaggtctaacaatgtctttcgtgattagtttcacacttctcaccataataaaagatgctataactggtaataatttgtttagctcctggtttgaaatggtatattcctggtttggagatagaactgtgcagccgggatggttgttcagaatggttgggcctatgcaacagggtatgttgtatagcgttggattaatattgtttaattattacttaactattttattaaattctgaaatgtttattaaatgctgtttatgcaaatgaaaccctactatgccatcctttgttatcctgtgcactttcatatttgctgcgtggcttgctgagtatgtcatatactcaccttgcaatcattcatcagaggaagagttctacagtggtgctgatggtgtggaggattaggtgtagccctggtcaagctgcctgtggagtggagtcgtctcgctgtttatcttattttttccgctgcttagatctttattgattgagaggaactatctacctctgtaatgacattttattcgcttattaattagagtaataattgtactctattatcaatttgttctaagcacgacttagtagatcaaacttaactgatgcagcactaagtatgaaaagaaacataatatctagacaatcaagccgttgactgagttttcatggtggtagatgtctaagctaatctaatctagcaacgcgatttagccgataccggcagaaaccctaaaacgagaagcagccgatagagctaaattgatatgctaagactagattaacaaagacatatgataaataggtaggcgaatatatcatccaaaccagagcaatccaagaggtcgaatgtactgatgcagccttgaacgacgccgacgtagacgatacaattgcctaggccgacggaacattggacttaccccttcgccggagatcgaacaccgatgcagccccgcgtcaggtgccaagtcccgccggatgataaaataaagtagaaaaggtaaaaggtggcgatgcgccgaattgtattgatctgtggagatagattacatataccccgggtgtacatatttatacccattggttgatacaagtccttgtcggacaagaaagaaactttcctaaagataaaaggaaaagataaagtccttataggacactaaacacactttcctaaagataaaaggaaactaacaaactattcctaattaatagataacttaccatgccgcattctctttgaactcggtctcttctggataagcttcctttagtagatcaatttccttaaccgaatatagcaagaatccgacaactgacgacttgaaaactctcattggctaatctcaggacttcgaagccgatgctgactctaagccgatgactactccgggcttaccaaatttcactgttaacattaaggcactgaaattgtgagcttcttgcaggggaaatggtacacaccgacctggaggattcatgagtttttttcacaatcagccaaatatatctcaacattacaattttgccggcacgccttcacactacacaccattacatgctaatggttcttcaccaccacttgctaatggtggttcttctatgccgcttgcaacacccactccacccccatttactgggaatcaggaccatgtcaatgttgatagtgatgatgacactagtgtcgctcggaccaaattgaagctaaattggacccaagaggaggatgttagactggtgagaatgatgcagattttacttgatttgcattgtgaatatgtgtgcataattacactttcttttgttatctttgtagatgatcttggttgaacaattcaatggacccaattaatgggaatgataagaaggctgaaaaatattggggagatgttgctacagaatacaataaaaccacaccacagaatagatggagaagcccaaagcaagccaaggagcgttggcacaaactcaacacacggacggatctgttccaaggctgttggttgaaggctaagcgcacatatactagtggttactctgaccaaatgtggattgacatggcccataagttcaatgaggccgataacaaaaaattaggatggttcgttctaatagatgtatggtacgcatgccgtgatcagcctaagtggaatgcatataatgatgcactcaagagagatctaaaaggaagtcgtctaataacagatgttgaagaaaccccacggccaatcggacaaaaagctgctaaaagagctgcacgtgaaagcaagggaaagtccaacgatatttctgatgctgaagagatatacaagttagaccaagtccaatctgatattcacacaagacgcatgaagatgatggaaatgcaagagaagttatctagtcgtcaggttcaatcatcaaagctttctcaacttgctgcacgagaaaatagattagcaacaaaggaaactaagtgtttacacccaaatttggcacctaggattaaaataggaaggattgccaaaatttggaagtctaccggtttcctccgagtgggccggtctgaccgccgtgtgttgggcggtcagaccgccggttgagggccggtcagaccggcggtgtgtggccggtctgaccggcagggccgagtccgattgtgtttcgtctagtctcgaggtttccttgctcgggaaggcatgtttcgggtttcctttggtttctaccccgagttggacatggaggagggcctgtatagggcaagaccaacccctatataagggacatggccggttcattgtaaaaaaatctaatctactatcaatcaatcgaatcgttttttcatattactttttagttttctcttagtttgtccatctttgtcggtttgcaccgtacaccgtacgccgacactgcgagagtgcgacacctctttgtaggtttgtcctgaaaaccttccttttgcccacgagacgggtagtaatctagaaatctgctccgctagctggtttagttatcaaaacccatcttaatttggccctttggctagatcgagttggttggcgactccatatcaccgcaaggcgtttaggtgttgcgatcgtgcttgtcgacttgtcacaaaaagttaccaacacgatttttggcgactccgctagggaagtcctatggccggtaattggattatcgccctgagataacatgttttatgcttttaggttcatgtatgttcaccaaaaaggcaggggggcatgtgtttacacccaaatttggcacctatggacgaaataggggaaaattgccaaagtttggaaagtgacgggtttccttcacagggccggtcagaccataggtgtgtgggcggtctgaccggctagtagggccggtctgaccgcaggtatgtgggcggtcagaccggcagggcccgagtccgagtctgttttcgtagggtctcgggtttccttgctcaggaaggcatgtttcgtgtttcctttggtttttatcccgagttggacgtggagaagggcctgtagagggcaagaccaacccctatataagggacaaggccggttcattgtaaaaaatctaatctactatcaatcaatcgaatcgttttttcatattgcttttagttttctcttagtttgtccatctttgtcggtttgcgccgtaaaccgtccgccgacgttgcgagagtgcgacacctctttgtaggtttgtcctgaaaaccttccgttttgcccacgagacgggtagttatctagaaatcggctccgctagccggtttagttatcaaaacccatctaggtttagctctttgctagatcgaggtggttggcgactctaggatcaccgcaaggctttaggtgctgcgatcgtgcttgtcaacttgtcacaaaaagttgccaacatgatttttggcgactccactggggacgggatccgttcatcgtcaactgaacttcgacttcgccatgacgaagccgccatccaagacagaggtggagccatccaatatgatcccggtcacattggatgacttcgaaggagaagatcgtaaagctatgtaggagtacatcaacgagctcacacgggaggcgttgatgagggcaagcactaggacccgtcaaggcgtaatcatcaagcccggaccacgtcctaagctcgctcccggctcggtaagcaatgatgaggtatcacaatctatccaacaacaaattgaatctacaatagattcatctatgattatttttaaagatcagttagatgcaacttttgagggtaaatttgatgagtttttaagggttaaattcggccctcttttggccgatcacatggtgaaaaataaagcctcttccactgctaaccaacctcctataggtcaaaccgaaggaacggtgtatacggccggtccgaccggccagacggccggtcagaccgggtattaccccggcagtcagaccgggactcaggccggtccgaccgcgcctcttgacgccggtcagatcgggcattgggccggtcagaccagcgcaattattcctatacaggggatagatcctatgactaatgctagttatttgtatcatcttagaacatttgattcccctgtatctactgctacgagtagtccccaagttcccccacatgttcccaatgcttataacgatgttgctaggggatatcctcccgatactagacaaggccaatataataatattgcgccacaaacacaacctattaggccaccaaatccaccgccaaatcaacaagggcctaataatatggaggatataattagtgatattatgaggaatagattcgggatcaaaactaggaatcgtgctagaacttacaaaaagccgtatcctgattattatgataatgtgccgtttcctcgtaattatagagttcccgaatttgccaagtttaatggtgaggatggtaagaccacatgggagcatgtaggtcaatttttggcgcaatgtggtgaggctaatagtgatacttttaaattgcgcttgttttctttatctttgtccggtaatgcttttacatggtttacttctttaccggcaaaatctattcatacttgggctcaattagaagaaaaatttcatgattatttctatactggagaaactgagcttaggttatgtgatttgacatcggttaagcaaaaatacaatgaatctgtcattgattatattaagagatttagggatgttagaaaccgatgttatactttgaatataactgatagagatttggctggtcttgcttttaatggtttaattgctcctcttagagaaagactagatggccaagaatttcttgatgttagtcaactcatgcaaagggctctggctcaagaaagtcgggttaaggataataaaaaatttgctagaccatttgacaaaaagcctaatgttaatgtagttgattaccctgaggctagtgatagtgaggaagagggtgatcatgatatttatgttgccgaatggtcatggactaataaaaataagccttttgtttgttctaacttaatgccgactccacgaaagatcggcaaagtgaggttaaatatagttttgatgtggccaagtgtgataagatctttgattatcttttgcaagaaaaacaaattagattacctaaaggccatgtcataccatctcaagaagagttgaaacgtcgagcatattgtaaatggcatgattctcattctcactctactaatgattgcaatgtgtttcgacgacaggttcaatcggccatagatgaaggacgattgaagttcaccaatggttccaagatgaagcttgatgatgatccttttccggtgaacacaattaatttcaatgataagaaggtgttgattcggccggagcaagccgaatctactaagggaaaggaagtggtcattggtgaaccgaggcctaagatgatagtgccaaagaagccggaggtgggtgtttggaaagaaaataagagtggagcttcgacttctaaggcccctaggaagaccaaggtgacttttgatatgctcttggagaaatatgagaggcaaggtggtgagaagattcgcaacagagggaaaagaccaagatcacctcctagggagcgatttggtcattcaccaagacggtcgcattcaccttcatatcatcatccacaagacatgtcatggggtccctatccaaagccgccgccgggttatccttatccctacttcaagccatggggggcaacgccgccaatgtacaattatatgcctccaatgcaattcaaccaagggtggggaggaccaaggaggccaatccatgagcgtctgtcttcaccaaacaatagccggttttatggtaagaatcgggctaatgaagaaaagagggaaggaaagcgcgtcaagatggaggaaaggacttcggaggtgattactatcaaagtggggtctcatgatgtgccaataccttctggagatggagttggagtgtccccgaacaagaaatccgaagccggtaccagctcctcgcagtcggccggtctgaccaggccttctggctggtctgaccgcggccatacggccggtctgaccgccgacctgacgacggtccgaccgacgcctcaggccggtctgaccacgcgccacatgtcggtctgaccggcgcgtctggccggtctgaccggtggtctacggccggtctgaccgggctccagcgccggtttgatgagagggctgcaataggcgatgtgagggcttcatcgtcttcaaacaagattaatagagggcattatttacctcctggaacagagccgaatcctaggtggatgcctaaggatttgacggctacgcaaaagagaaggttgcaacgtcttcgggcccaagaactaagagagaaaaaggccgaagaacaaagagataaaaggttcaatgagttgcgaccaccactggtatggaggcctaaatccatagagaaggaaaaaccgattgatgtagaggagaaggaagaacaatcggttaacaagggtgaatcgtctccaaaagaagacatggatatcaacatggtatgtatgttgtctatggtgttttatgctatggataaagccgaggttgctcaactttcattaggtcctaaagatgtggtttttgagaagcccgatgagtcaaaccgtcacatgaagcctctctatctcaaaggccatgttgatgggaagccggtctctaggatgctagtggatggaggtgccgccgtgaacttgatgccgtactcgttattcaagaagttggagcgtgaggatgatgagttgaagaagaccaacatgattctcaatggcttcaacggtgaaccaacggaggcgaagggtatcttttcggcggagcttaccgtggggaacaagacgctaccaaccgctttcttcatcgtcgatgtgcaaggtaactacaatgttattttgggtcgttgttggatccatgccaattgttgtgtgccttctaccttggatcaatgtttaattcaatggaacggcgatgatgttgagattgttcaagtggatacatcggccgaggttgcaatggccgatgctacttttgaatggcgtcatgggaatatccaatgcctatcggggagggatctttctagctatgattttcttagcatctccgatggccaatttgtacctatctctgtaaagccggctagtgtagcacggctaagccatataaatttgtataatgagtaaagaggctaatttagagtggttacaaaagagggtgcaagaatatcggtctacaaagaacgatattggtgaaaccgttgaggattttgaggaaatagagaagcttggaaaagggtttacatcggccgatcctttggaagaagtagacataggtgatggaactaaaccaaggccgacttttgtaaacaaaaatatgagagccgattataaggttaaagtaatcgagctacttaaagagtatgttgattgctttgcatgggagtaccatgagatgccgggtcttagccgtgagcttgttgagcatcggcttccaattaaaccgggttttaggccttataagcaaccacctcgtcgttttaatcatttactatatgaccgggtcaaaaaggagattgatcggttgttgaaggcggggtttattaggccatgtcgttatgcggagtgggtatctagcatagtcccggtggagaagaaggggagtggtaagattagagtttgcatagattttagagatttaaataaagctactcccaaagatgaatatcctatgcctatagccgacatgatgattaatgatgcctcgggtcataaggtgattagctttttagatggtaatgccggctacaatcaaatctttatggcggaagaggatatgtacaagacagcttttaggtgcccgggatttgttggtttgtttgagtgggttctcatgacttttgggttgaagaatgccggtgcaacatatcaaagggcaatgaatttgatctttcatgatttgttaggtattatcctagagatctatattgatgatattgttgtcaaatcggatggtat

SEQ ID NO: 55208 - DNA, 9909 bp, Oryza sativa
tcctgcagcccatgtcactgccataaggtgtttgaggaagatcttgtttctggacttatcttgaggttagttaataatttactggaaatgatttaattgattatgacctagtttacatattaatctacatatgatgtaacctgaaatgtgatttgattatatatgatttgatggaacctgaaatgtgggcatgctcaagatgatatctcttcaagttgctgaaatgataatataggctataatgtcaatagcttgctgtatggagcagtgtttctttaagcttgctataggactgttattctattccctattatgtagaagtaatattgagtccatgtcttcaaaattattgcctaagtggacactttggcagacaacaaaaaaagctccaattctgactttaaaatcagaatccgaaatttatgagcagtgattcaatctgaaatttgtgattgttgggcatgtttatcttttgaatttgaatagtatatattgatatatgatctcactgaagctgaatctgaaaatttataattatgtatctgaatctatttttttagtatgtcaggtaataatatctagaagatctgttcaatgtgggtcacatctgtgcgattggaagaatgcaatgtgatcttctgctgctgcacatgtaaccggtcgatctcattgccaagcaaggataatttacttcctagttgtctgaacatgtaataattcactttgttgctacctgaacatgtcacctgggaccatgatattcattgccatgtgattttgatatcttttaccttgcctcgaataatgatacatgttcctattttaatataaatgatgattttgtttcctttgttgtgtgaacatgctatctgcacatctgtatacatgtggtttaaaattagaacgatagaaccagtgttgagtccaacaaacaagtccaatcttctacattgtcagaccatacgatgtctcccaataaaccacctagcagatgacgtcgaagacaatgttgatgtcgacattggcgactccaaccttggctctgacgtcaaccttgatgatgatgccgccgtcgacaccgacctcgcccttgaggatgatgctgttgtcgacctcgacctcaacgatgatgccgccgatgacgccgacctcgacctcgaggatgatgctgccgtcgatgtcgacctcgacgatgatgccgccgtcgacgccgacatcgacctcaacctcgatgatgatgccgccgtcgaccttgaccttgacgatgatgctgccatggaccttgacaactttcatcctatgaatatatacagcatggatgactttatagccgaagcaacctttttggatgaatatagtgaacagattattctcaggctgaaggagaacataacatctgagccacctcgtcgtctatgtcaaagtggtacaagacggtacgtaccaagaaaccgtgaagctggcaatgcggatcttgtggccaactacttctccaagtctccaatctacacagatgagatgttccgtaggaggtttcggatgaggaagcctctcttcctacgaattgtgagtgccctgagtgaatggtctccttattttactaatagattgaatgccactggtagagcaggacattcaccacttcaaaagtgtacggctgctatttatatgctagcatatggaactcctgcggatcaacttgatgaggaattaaagattggtcctagtacagctttggagtgtttgggaaaattcactgaaggagtcattgaaatatttcgcaaagagtacttgcgagctcctaggagtgatgaggttgaaagattgctacaggttgctgagtcatgtggttttcctggcatgtaaggaagcatagactgtatgcattgggcatggaaaaattgcccggtctcatggcgcggccaatttactcgtggtgacaagggagttcctaccatgattctcgaagcggtagcatcgaaagaccttcacatatggcatgctttttttggtactgcaggatccaataatgacatcaatgtgttaaacaagtcacccttattcattgaagcattgagaggggaagctcctcgtgtacagtttagtgtaaatgggaaccaatataacacagggtactatcctgccgatggaatttatccagagtgggcgacattcgtaaagacaatacagcttcctcagacagacgaacataaattatatgcaggtcggcaagaaggaacaaggaaggatgttgagcgagccttcggtgtgttgcagtctcgctccagctcggatgtggaggcagggcgacgttatcaacataatggaagcttgtgttattcttcacaatatgatagttgaagatgaacaggaaatggctgaaattcctttggatttaaatgagaacccaggagcatcgttcgttctgccacctgaagtgaggaactcctctgaccccaaccctttctttgctgcggtattacgaagaaattcatctattcgtgatcgtgcaaaacatatgcaactcaagaaagatttagttgcacatatatggcagcgttttgggaaaaagtagaactactttatgtaacgaaataatgtaatttagcttatcatttgcttaaataataatttcggatgtgtgtgctggtaggatgcacatcatcttcttttatatggttatgttaacacaatgtagcgttagttctatagggaagaaatacaaatatatgtatggctgaaatttacatttgattacatgcaatgaatttattagctatttattaccttgtattaatacagagttggttaaagagacagtactttgtaggtaggagttttttttgctgatgtggagtacagagagagcccacactgagctctacctttgaacatgccctaatatctattgcagatcatgcaccatgtcttgaatggtaagtaagaagaagggataagtccattttacacccctcaactcttgtcattgtgtaaaattcgcccccaaactctaaaaccgggtatccaacaccccctaactattaaaactgttcaatttatatcttttttatattttagacggttttggcccacgtgtaactgagatggcagtccaatcagcaaaaaagtatatataaaaaatgtggtaccatctgtcagtcaaccttcctcctttttttctttcttcctttctcgatatgtccaatctcggcgcatggagaaggtgatgttcctctctcgatctctactctcccctctctctcggtgcagggaggcgatggtgctcggcgtgtgcaggtggaggcggcgtactccggcggaggcggcgacctagaaagaagcggctcggagcggctacgacgagctctgtcagaggcgatgacgctcggggagacaacggggagccggagctcggtcttgttggcacacgaaggaggaggcactcgggaaggtgggggagctgaagctcgagctcgccagcgcatggaggggaagaggagctcaccggcgcatggatgaggaggcacttggggaggcggttgggagatggagtttgagctcactggcgcagatctcatgggctcgagctccccagctcccgcctccaggagctccatcttctccatggaattgagctcgccggtggagcttgcgctgcttggggatgcagagttcggcggaggtgacggggcttggggataaggaactcaagctcgacgaggcggcggcggatgcggagcttcagctcgacctcgtcctcgaccaaccggtgacggtgctccatagggatgactcctccccgcgcgtgtagctccggcgaggtccgcctctttcgcgcggggcaacaagctcgtgattcctgtgggaggcggcggcgacctcctcggcctctcgctgctccaggcgccacccccatcagatcccgtgccaccgttcaccgcataatctcccccacctcgtcatcgatgtcgatggaccacccggggaggggggctcgccgagggtggagggatgatgctaaggatggagctgacagagggagggagctcgccagtttcttttgcttaatcttatctaaaggggaaaaaaggtggatggagatggtctgaccggtgggacccatgctgacatggcgcccgaaactagtctaaaaccgctctaggggtaaaatgtctggtattaacaattggaggatgtattatacctggttttatagtttgggggtgtattttagacaaacataagagttcgagggtgtaaaatggacttttccctaagagggaaattgagggggtaaccgagtaaccattgattccctgaattcaagagttatcatttacacggcggaactagccactgataatttccgaccgtatttgtattgtgaagcggaagagaaagccctgaatacaatcatactcattttaacctttcgcctattataagcaacaaaaatataaaatgtaaactatttgactgttacacgttttttttctgaatgcggatgacttgtatacccctacaagcagcaaaataaatcagcacttttgccaatcactttaagtacatcccattagcaggttcaaacatgtaatgatgtcacataacatttcagtttgaaatagagaaacaaactggagccagacattccctatgaaactactaatttacattcagcatgcccccatcacataacccgtttagcacaaggtattgcgtgctgagatccaaggttgggcatgcatacgtaaaaaggcttacaatgtctgcacgatctaactcaatattcaaaattcaccatagaaaaaaaaacattttttcaccaggcataagcattaccagagaggaagagaggaaacagctcagctccgggatggtctccagttgtttatccattctgtcagtgtgcccacattcctactgatatcctccacattgtcacttcgcaagggcatcactatctcctctttgtagctctcccttgcctcctccaggagcatctggaaaatttcacattctatgttgtttgtgagcttggcacccatataacctctgtgaatagaactcttagtcagaaataagcatttcataatggctattccaacaggtgggtgattgtgcagttctgcatgaattacctgctagtcaagcgatcatgcagaattgagttatctgtttggagcacaactacaaggtcaaaccaacgttctggaaagaaatcacatccatggtaatctactagtataccaccttcttccatcacgtcctcaagctcatcgcaaacctgtcaaaaaaggaaccattcagtgcaattctaaccaacaaaagaaatgatatacagccaacttaagcaatttgcaaagttggaacaaccaatcatgtacttcctttacttcacagttcacatctgtgaggatagcaaaagtgcagaagggagcagaccaaactggtccagataggatgataaccaatcaccaaaaactaccctggacgtcagattttctcagttaacatcagtgggcatgtaattcattatgctaatgattttttttcgtatgttcattgtgagaatgcaatggcattttaattgtatacatctcagaaaaaagcaataataaaactctctcaggacatttacaagcatccatatgtacaactaggtgtaattagtccagaaaatcaggacatgaggttcagcgctgaattattttttggggggtatgcagcatattgtacggccaaaaattaatatttaatatataaatgagtatcaaaacaaaaaaaaacaaaattgcatgatgcagaacatccaaaatattgatatcttcatactagtttttgttcggaacaactttctgccggtgcagacataatcaattcataagacagattgagcagcctgaatcaattcctacatgctttcatataaataagaagggaaaatcattttattgataaagaaaaactgatggtcaatccatgaactagcaaaccagccaccagactgatttgattccctagtccaacattttgtactggcttcactaaagattaaaataaattgttcatattgcattgctaaagacaaatgatgcatatttcttttattgtacagcctccatatttttgttacatggagcacttaacatacataattttaattgtaaaacttagctttacactacatatatatgctatcttaggcctttcattttaagtattattctggagactaaattgaaaaaagtaacaatatgtgctagtactaatgtgtaatattgaagaacttcaaagactcttagtaaaaaaatggtgcagggttggtgggagtggcaaattcactgccatcaccaccattggctttttctaaaaggacatagatgcttagggaccacctatccgtgaaaaacatgagtagttatgcaaaaacatttgttatttattgttttaataaagtatgattaacttacataaacaactaaatcaataaatcatacacttatattaaaagaacaccctgatcaaacatagggacataaatagcccaaattagcaactttgtggatttataattattagcctttttgggcatcaatcaacgcaacaaattttaaagctgaaaagtagctctttatttagcatacctccatctagaaattcaacttcaaatctaatgtgttcagaaaaaaaaacaaaggtaaatcactgccaacataattttcgtttacaattacacttttataatgttataaatcataatttctacacaggactgacaacctagaaaacattgtttgaagagcagtagtaggaagcacctaaaatgcaaatgcgcatcataaaactacaaatacattagaaaactatcacaaaactacacatttcacataactatatttttggccacttataagtaggccccacagtctagattctgtcgcgtttaacatcagtggacaaatgtgtagtttgcaaagtttactccaataaaaatgcaaaaaatgcccataatcaggccatctaatatgtcgctaaccaaaagttcatggtaatacataatacaagaatgctaacactgagtatacacatcactacaattcaagatgcataaatcctaccctaacatatagagctagcgttcaaacaatattgcaaaataaaaattactgtccatcgattagaattgccagcagatggaatcatacaataaactccattattaggttatggttgttgtaaattcagggtgcaggtccaaactgacaccgctgtcaaggaggataggtcagtggaacatcacacacaatgagaatgagcaactttccatggcttgagccatggacactacatcaagctaaaggagaatggggacacttatatggaaagtgttctcccccagattatagtgttttcctactaagcaccagcattggtagagtcatagaaggaaatcctaggtctacaaccatcatgaaagacaagagaactttgctccaagtgctacaacttcttcagtttataacattatgataggcagataccaccataccagcctgtaatattgctagctttacagattacacgctgctacttctttatgctctacctatactcattcttcttgcatgtacatgttttcttctgtatactgtaatgcgctgattcttcagcatatttacatgcaagtatgtctgctgcatctcaagtaactactgcaagtgatgcttctttagtaaaataaaataggacaaaaaagcaggcatccctaagtccttagtttttatcaattaacagaatagacaactcaactaatggatttggacctcctgttccatcaaagttgcacaactaggcctttcactagaaatgcagtctatattaccttcattatgtttgagtgtaataccagaatggcatgatcactatttcaaaaagcacaagatagtgctcacttaatagaagtgtgagtgggaccatgtatacaaaacaagcacttcccgttttcgaattatatttaagtgtctgagaatattttcctgaggctctttaacccaaaaataaactcgaggaacaactctggattcacatttatgaaagaatgagaacgacttttatgcattcttgatcgagtaatgaacagttgatttgtaggatagtttcaggacaagaaaacacaggccctttctttttttggtacctgaggaactgtgcatactggattacttggttgtggtaatccaatgctttccttcatcactggcaaataaaattagtttgcttgcgctataattttcagccattataaagcaaacaaattcacagcttcatatccaaccctgcgtcacaacttcaatctactacaatccaaaatctaaggctaatgatgaatatagattgttcggaatgcagaatcgaacagagatttggattggattgggagagatgcgcggtagggcgggctaataccaggtcctcgttgatgatgtggcactcgagctcctcgtcccagccgtcatggaggctcttctcgcggacgaggtccccgatgttgatgtggcggaggtccaccgcgtcggcgaggagtgagcacgtcgtcgtcttccccgtgcccggcgtccccgtcaccagcacgttcggccgcgtgcgccgcgcgccgccgccccgcgacgccatcgctagaatcggcggctggttagggttttttcgtcctctttttcccggagagaatgggccggcgacgtcacactgctgccctcctggactcctggtggtaccgtgtaagtctagtggttgtcggctggttgggccgggccatggttgagtctgatggtttgggccgtcagccatgtgtccctggtatataggaataagtctattttacctctcttgtcttctctctggtcgaattacatccctcaaacataaaactgggtataacacctcccctaactttaaaaaccggtacaaattgacttctttagtggtttgggaagcggtttttttgctgacgtggcaggtcgacttggtacaagtgtgctgacgtggcagcccagacattgaaggaactaaaaatagaagtggctcccacatgtaagtaataaaggtaaaaataaaaaaaggtgaagcctatttgtcagcccacttctccatctcttcttcccctcttctatttctttctcgagtagctgctgctgctgctgcgttgtgcatacacggaggccgattcgaccacgtgcggcggctgggcggtggtctcaggttgcagcgatgaaatccacggcggcagtcgtctccaccatggcaccatgcggcaccactcgctcgcgaagatgtcgatgaaggcctcggctggggtgggcggcgccgtagtcgccgacgcaaaccttgttgaagacgaaagggaggccaccccatccgtcgaactactttgggcttcaggaacatgcgggttggtgaagaacgacgcgcacatctcagctacaacggtttactggcacaggtggtggtggggggtgggcactagaaaggcggtggcggtgaccccttatctctccctctccttccttctccaagtggtgcggcgacgaggtgcggtcgcggagcatgatttcggcggtagagacggtgatggtgcggtagagatccggtccacggctctgcagcatgcgtcatggcgctgatgacgatggtggccaccgtctgctccatcgccgctctttcgcctactgtcaccgctccagcccgccaccgaccactccctcgggctccgctgccattggtccagctcccggcccctgcaaaccgacgaaggagagagagactgaaagtgaaagtgaaagagaaagagaaacaggagtgagggaggagaaagaagggaaaggagaaatgatgccgatatgtcagtggacc

SEQ ID NO: 55209 - DNA, 4618 bp, Oryza sativa
taatgttttcttgcagatttgcactctcagagtatgtctgttaagtggaattttgttacttctttccatgctatatatattgttaataggatctgctacttcaccctttgttttcttgtaactggccttacaacgtaggaagtgaagttccccatatcctcgttgcattctccaccagtactttacttatgtagtactagtactgtatgttgcttgttatcactcttgtaaatggatagttttcacttgcatgtcccaacttatatttttatttttctaatggaaggactaaggatgtctttctgttcattgggtacatttattaacttcaaaattatgagcactttgctatgaccggttgccgataattttatgttagtttttgggagacattactagaaatagaagaagaaggtattaggcccttttagaatctggttttttttaatcagttccatgtgaactgaacgacttcgtataaatcacggggaaaattcttgcattctaaacagggccttattaggaggtccacaaaaccttgagactgacgttgaaagtgggctgctactaagtgaccgagttgtgagttctgacaagtgaataattggcttccacccctgctcattttgcaccaaaattgattgcacaccagtcatcatcctcggtataagaaattagaaccttaaaaaaaaatctatactcctttaaaatggagtagtggtggtagtgagtgatgattttttttttatatttttagagaaaggccaaaggcctggcttctattaaaagcccggggggggggggggggtctgggagatcccagataagcgtttgcagcacagagaggactttgcctcaacaaaagtaaaggaaggactgactggactactaaagcagaactcaacttgacagcttcaggtttagtatataaacagacactaacgagaaacagaagcagccacaaaacggagacatcagccaattccagttcttctattcccaaatcttgtgttcaccattcttagcttttctatcagcacctccagacttgctagctcatcagcgcgtcctaaagccttccactgcataagataagaaacaatttgaaaggagagatgcagaggtgagtaaacaatctttgacctgaaaatcatattattcctagtgttccaaagaacccagcaaatggaggcgagtagagccgtcataactctgagcctcacttttgaaacctggccaacaaacctaaaaaagtcatcaaaacctccaggacaagcatcccaacccagtgcgtccctctacagatgcaccaaacgaaagtggccatagggcagtcaaaaatgatatggtcagtcgtttccttgttgccacagagcaggcaattttcagacccaaccgaccctttaagtttcaattgctcacaagattggattttgtctctcagggctagccaaatgaaatgtttcaacttcatagggcaaggacaacgccagacaaactgtaatctctcatctaaagcacctctgaacaaaatagctctgtacaaggattttgtggtatacttcttattagaatttagacaccatctcaaggtatcaggggaagaggacaagaccaggttctcaatgatcagcttaatttgacgccattgttccaattctatgggacccatagatccaagtgtttcaggtctgcaatcaaaatctcttgttgattgcagatcataaatagctcagtaaaaatgatcttcagagggcagtcgccctgccaaatatccagccaaaagaagatgtgagtgccattccccacctgccattctgagcccaagttaaaccactttcttgtattgagaattcctgaccaaaattgagaaactctctttgaggagcactgaaagacaccaccaaagatcaagtattttctcctcagtaattccacacataaactctcatcagaggattcaatcttaaaaatccatttggctagtagagcagcattcaaagtcctagtctcagtaaggcccagacccccaaactctttaggaaaagcaaggtcagaccacttaaccatgtggtatttccttccttgcttattccctgcccaatagtatctgcctctaatggagtcaaagttctgatgtaaaccctcataaagttggtaaaagtccatcgcataggatgagtgatgaatttgccatcaccaactcccaaaattctgatatgtgaccatgtgggatcaccatctatccactttctggtacaacagtagaagtcacggactcacggttagaccttggagctctcaatcatgttcatccttgcacaccaataataactagatccttttttacgggagtgaacctccaattaattctaaaagtaagctccaaaaatcaaaatatatttccgctttgcaatgtgctgattcgattttttaattccataacaatgtgcaacattttggtagtatagtaaatatctagaaaccatttgtaagctctaaaaataaaatatatttcctctttgcaatgtgctgattcgattttttaattccatagcaatgtgcaacattttggtagtatagtaaatatctaggaaccatttttgttttgtcctaaattttcaaagttttggtagtataataatgttgcctttcattcagcacatcttggattagatgagcacactgtggattagatcattacattattaagtttttccaaacgagaattatttctagagcagaacttctaaccaccatttggcatttttgtaggtgtcactgaatggctagaacaatgggttcaacacctacctactgctcttaccaaacaaatggtgttggcgctttaaagcaatcacctcatatgcaattccaacaatcgtacaactatggagttaggttcctaaagagggataccctttctgtgcggattaacaaacatatggccaaaagaatagcaacaagcactggaatttgcactaagcctaggaggtctcacatgcctatagtatgctctgctggaatgacaataatttttattgcaactgaatgtcacccatggtgcaaaactggaggcctcggtgatgttctagggggactgccccctgctcttgctgtaaatattctttgtcacgtattgttaaatccaacagtcagatcaaacctcagtgtttctagcaaaaaaatatattcacaaacacaggggtttgatctgattctgcaaacaatttatgctcctgttcgattgcacattcttatgcaactaggtttcattgagataactggttgaagttgagttaacaagatacaagttttgtacatcatgctaatatttaatgcaggatttatcattcatatgttttttcctacattgcattgcacttgccctttatgtacagttcatcttgtgtgaagaaactcattttatcataggcaatgggacatcgtgtcatgacaatagttcctcgttatgatcaatacaaagatgcatgggatacaaatgtccttgtcgaggtaaagtttttaaccatgctgtacgtatttagctggatttaacttataccagttttctgatgttgtagatgctaatttttcctttttacttctgtaggtcaatattggtgacaggacagaaacagtgcgcttcttccactgctataaaaggggagttgaccgtgtttttgttgatcatcctatgtttcttgagaaggtctgataaaccattaattacctgcgttctaattgagtgatgcaaagttctaaaagttttggtatctcagtacaccctttgaatcataaaactttcaggtatggggcaagactggaccaaaattatacggtcctaccactggagatgactaccgggacaaccagttgcggttctgccttttatgcctcgtaagtaaatgcatagatgtgtcgcaacagcctcagccttgatgtacaaagccatgaagtggctacactaagtagttctacaaattgtattgttttgttctatacagagacattcattagttgagatatgtatttatacactaagagaacagaatctgtaaattccatctgataatgtcatataaacgtccccagtcaaaaaaaaaatgtcatataaacgtcaggtttcagtaatttgatacgagcttttaaagtggtccctttttctatctatttatcttttttttttaatttgcatgtgggctcagctaatcacagttgtaggtttgggcaaatctaccattgactgtcagaaattgcatggaattagttttttttcttctaatttgtattatttttgtgcaatttcttctaatctgattgtccttttaggctgctttggaggctccaagggttctcaatctcaacaattctgaatatttctcgggaccatatggttggtttctgtatagtataaactatcacagataattgtctttctccctcattctatctgactgacattcatatttgttaatcaggtgaaaatgttgtcttcgttgcaaatgactggcacactggagtcctgccatgctatctcaagagcatctatcaggcaaaaggaatgtatgtgaatgctaaggtacatcatttcgctatctcttgcaccttatgcact

SEQ ID NO: 55210 - DNA, 6192 bp, Oryza sativa
  unsure (1)..(6192): unsure at all n locations
ggcgttgaggggagccagccaggcatcgagggtgaggagctggcgccacttgccaaggaaaacgtggccactccctgaaattctccatgacggtgcctagcttgctggcttgtttaggtgacaggcagcctgataggatcccatggacttctgagctcgccaccggcaaagccactatttgtatccctgcaggcttctgccatttctctcgtctacttcacgtgtaatataatcgcagatgttacttagagatgatgggccagatggcatgcatttgcctgtttctctctcgctccttctgcatgtgtaatagtatatttggctgtgaagttctggaccctgtcagtcgctgtcctcgtactgcatttcttgtaaggaactactccctccgtcccagaataaaccgtcccagaataaagtaacttagcatgggatgagatccatcatagaatataggatagtatatcttgacatagtatgtttttttttaatctatgccagctttgctggttttatattaagaaggggagaaactgtacaaaagcaccgagaaagcagcaggaagaagagaacaacattaggaaggctgcaggagaaaagaagggaatggaaaatgaaaacagagtacagggagcaggcagagaaggactatgggctgctcatggcgctattctcgctaggttttttttgccccacatgctatccatacattgatttcatcaagaattttggtcaactgtggaattgcaagctccttgttctgttcctctcacaccagattttccaactgagaagcatgtggatggagcgcattccttttgtcttgtccttgtcattttgctctgttcttctctcccaccagtcaagaagtgtttcatctgggttgtgttccatggagatgtgatcacagtccagccttgtggataccttatcccaaatgtcccatgtgacattgcaatccttgaaaagatgttgtgtcgtttctaagtttctgtagcacaattgacaaaagtaattgtttggccattgttggagctgtaggcagttggctgtccagattctattttgtagtagcaaccacgtgaagttcttgcatttggatggcgcccatgttttccaaatcaagcaggcagccctcaattcaattctaccgctgaattgcgccaaataagaagatttcgctgaatatttgccgctgctcgttcatctctaaataattgtcttcagtttcctttgatagaaccgttgcattttcccataacagacggaaaacaatgaggaagtcatgtagcagtgccatgctgaggtcatgtctgatgtcctgaatccattgctccccaagcagtgcatcatggactgatctgtacttccccttggagtgattgtagagtgctggtgtgaggtagttgagcggttgatgcccaatccaattagaatcccaaaagtctgctttctgaccatttcaattagaatcacatggcggtggagtcccaacccaaggttttgtttgggcattcccaccgaaaccagagccatcgaagcatcgaagccttagtgctcttgcaaatttgtcaaggtctagaatcccagaccagcaaatcaaacaagaccagcaggggcctgatccaaagggaatcaaacagtaggaaaccaccgtgttgctgctagtcatgtgatgttaagctgaaacaaagaagcaatgcattggcgttttgaggttcaagaataaagtattcatgattttgggttgcacattctgaaattgaattgattcgggagattggagcttgcctaggggttcatttcacccgattagcaccattctgaggactaatgtagcatcgctttcacaaatttgtggagtttgtgcggtggatgaacgagcgtacattggcgcattagaacactttcgcttttttatttaggcgcagggtatagcacagctccacaaaaattttattttatcaattgcttcctccgttcaaaaatatgagtatcagatttaattggaatctaaaccgagaccgatggagtagggttttcgcaagtctgccagtatctaattgtggccatgatgtggatttaactgaagtatgcacgaaataagtctattttgcctcccttagctggtactccggatttcctcaactgcaaaaccaactataacacctcccctaacttcgaaaaccggtataaattgactcttttggtggtttggaaaaaggtttatgctaatatgacaaaatgaccgtggttgactcattgaatcagcaggagagatccacatgtcaatgaaacatgtaatccttctcccctgtcctcccccctatcctcttttccctatttgacgactacaacaacagtcggcgggccgaggtttggtgaaagattcagggcctgatgctggtggcgaaggggagggctcgctaaccaaatgttatcctcacttgcgacttctcgcaaccatccgttaccacctcctctaatgctggcacgcccgcaggggcgcctgcgttgtccgcctgctccaagatgagcatcaagagccaactcccaccgtgtcatgcccagaaattcatgaaccaaaatttcaagcagaatatgcattaaaaccctgtccaggaccgaccagggtacacaaacgacaaagttgatatatagatctgcgtcttatagaacacaataaaaagtcttacaaatgcagcagaaaggtaaaaactagctaaacttgggacaactgatgctagtagcgcacaactccactccacagatggtagcgacgaaacttactcctccgagcagtagtccagctctgaggtggggaagatagagcaagactgagtactacccattaattgtactcaacaagtcataccaagaggatgtatgatgtaaggatttcgaaggaggctaggagttcttttgcataaagcagttgaaagcggtaaaaactattgtagtaaattaagcaatattaatcatcattgtccaatgctaaaccacgttgcgataggcccacacctaaactacaccagttccattaagttaaattattaatgatgagactaatcacggtgaagctagttgatcacccataaccgtaggcacgactattcaaatggttttaccatcactagaggtgtacaactatacccacaagacacaaccccatgacatgtttctgtgcgccgacatgccatcacgacataccataaagaaactgtgataggatccttgtcataactccccataactaagcgcaccacgctgaggattcaccttcaccttaaacaagggtgggcaggcccccgtgcatggcagtaaattcgacaactgattaacccttaagctgggtccaactgttgatatttcttacaacctgttgatgtaaaaacacgggaacctgggagatctgcttaactccagtgcaggtccaagactagtctcgagtgtatcaagggcgtgctagctgatttgatcctgcaatcagtaagaaagacaaaagcaaagttagtcaaccgatagccgattggccgatagcgtatcgttggtggtctcagccgatgtagttagacaagatcggctatggactggatagattagtggataatagatcctaaacatgcctcatcggctataatactgcctatcaagttcgataaagaagcttaagacaatattatgaaaatagccgatggaacaatatttagagcataataggataatgtaccacctaatgccctagtacggacttatataggcaaatcaatctatataaatatatcaaactatgatcggttagtagtttagataacctagccgataccgatttagcttgatatagctatatggagtgatctgtctatataagtggcaaatataaataaaacttagtaaagaaatatgtatattaggtaagatcggctgaaattccgatactatctttcattataattgtttccatgttagtttttagggttcaataaaagactagggatgatgcaccacaaagtagataaagaaacctagagtctaaacaatcaagtaaagaaccacttttcaggatggtagatgccttaactagtctaatctagtaggaagatttagccgataccggcaagaaccctaaagcgagaaccagctgataaaggtaaatctagatactaagtgtgggagttatcgtaccggggtagcccacaacggtactcggaggctagatcttttgcgagatacgggcctaggcccatgtaatctgttactataaatgatggggaataggagaatggaaacctatcccgccatattttgatggatggcaggtacccagattgtgagggataccacatctaccttgccgccgatcaccctgctgctatataaaggggatcggcagcaccctttggaggtgggacactctcttcactcaacacccaatacagagagaatccaccaaacaactggactagggtattacctcatcctgagcgcctgaaccagtataaatcgctaggtcaccatttctttcttgcatctagcgcaccctataaattttattgctgatttttgaaatcgacactaagagtagattagctaagacatatgatagcaaatgacaatgataaaaggactaaaacatctaaagcgacataatagccctgatagcacaagccaccgatacgtgttacctcttgcaaagcgaactcgtcgaaaagtaaaaatgaaaagggtggcgatgcgccgaagttgtatttgtctcccctattacaatgctaaggggttcatatttataccccgagtacaaacttggtccattatggacacgacttaaacctttctaaatataaaatacaaacaaaaccatataccacgttctcttaccaaaatctctaacaaaccgacataactaacctaattaatagatacaattgccttattttagctctatctctaattgtcaatgactgttatctcaatctagacccatgtcgagcccaaatcataccatatgggctggatcagccatcggcttcatcaactcatatcttatttccagccgatacgatgtccagccgatacgtagtccgactccaaattaaacttgatttcacaccaaacccgcttctatcttcttcttccttctccgaatctgatgcaaaattctgctgttaacacatgcccccctaattccgctgtattatataatgcagcagaatttgctctcggcaatcttgtgaaaatttagggtttctgctttgactgttaagcttttaagcaaaggctcactgcttccaaaatcctctttttccagccaagcccttcacaaatccccttgctataaaaaccccttcgtctctggtgatctctccggtgattcaatcttccgatggcgatctccccttgttctcaaccggttctgcttagatttgcggtgtacccagagcgatgccaaccacttccaatgttcacgaagtaagtctgtttttaccatcaattttcccttgtaaaaaccctttcccagttcttaaggtttcccgctttttttctgactttttcaacaccttaaaggccaagtcttgattctcgtccttcatgctaacacccaacattttcttggccccatgagcgatccggatcccacgatgttcattaatgctgagacgaataggatcccttttagagaatcaaaccagaactcagtcattggccaaatgtcttcagatcttggcccccaaaacttcatgagtggaaagattagtttaaaagggtattgactaccaagcaatcgtcatggaggaagacaaaaatagaacagtgccttcaactgtctttagccgatatgccaaagaacaaatctatgttatcggccgcaacatgtttctggtttaacaccattaatgccttcatctttggacatgggttgatgacaccaacccttttggacatcaagatgctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttttctatgcaaacttatcgaggtaacctcagccatgttaatgataggtttgactacgtacttccatattgttgatagtcatcaatacgataaataaatttcttaatcataaacatcaacaataaaagtgcctcaacttgcaag

SEQ ID NO: 55211 - DNA, 1643 bp, Oryza sativa
taaggagaagaactcaacaatttaataccataagattcggtaaaactcttcacttccttagacataaaagaagcaccttggtccgtagttaatgtttgtggaataccgaatctatggataatatgcttcaaaataaaatcaattacctccgtatgagtcatattcttcaaaagcacggcttcggcccacttggtgaagtaatccgtagtaactagcacgaacctatgcccctttgatgacaaaggataaatttgaccaatgaaatccaaagcccatcctcggaatggccatggtttgattatggggttcaacacggcggcgggcgccaattgaacattgccgaaccgttgacaagcctcgcatcctctataatatttgaagcaatcatcaatcatcttcggccaatagaaccccgctctcctaagcaaccaatttatcttgtgggccgattgatgagttccacaaattccttcatgtacctctcccatagccactttagattgatcttcatctaagcaccatctatatttcggcggtataaatctccatcaagcaatgtgtatttgaacgcttgccgccgaattttccgatcaaccttaagtgtgggatccttcaaatattgaatcaaaggaattctccaatcctcttttgcatcctgggcacaaatgtccgaattcacaattaattcggcctccaaattgattgaaacatgccccccagcgctctgtccaaaccggtcagaccggccacacagagccggtcagaccgctcgggatcgccggtcagaccgacggcgtgcggccggtcagaccgcccctggtcaccggtcagaccgcccctggtcaccgatcagaccggccgtgcaatgccggtcagaccacccctggtctccagttttgctaatttcgcacaaagatttaaaatcaagcaccggctcttctaatattaaaaataatcccttcttcacattatagccagatgcttgttgtgccaagtcatttgctctagaattattatgcctagcaatatgtctaatagcaaaattatcaaaattggcaataatatctaaacatgaatcaaggtacctatttagtgatccgtccaagcatttgtagactccggcgacttgttgcaccaccaattccgaatcaccaaaagcctccacatgtttagctccaaccatctccataacttgtaagccgaacaataaagcattgtattcggcttgattatttgtacaataatattccaaacgaaccgatgcttcataacacatgccattaggtgaaaacaaaactacccctatgccttgaccttctttgcaagaagaaccatcaaaataaatcttccaaggtataacttcaactaagcaaacctctccctcatgagcaatatctatatgatggtctactataaaatcacatacaatttggcctttcatagatttcaatggttcataagccaaatcatattctatcaaagcatatgcccacttgccaattctcccacttagaattgacctttgcaacatgtgtttaataacatcggcttgacaagtaactatgcatatactagataacaaataatgcctcaatttggtacaagcatagtataagcatagacaaagtctctctataaaaaca

SEQ ID NO: 55212 - DNA, 4198 bp, Oryza sativa
ccaaggatatatttatatgcgggatccttgtagtgcagtttgtttaaatatcaattactcattggatggaaataatgtagtgaggaagccaggaagttaaaaaccatttcacaaatagcatgcaatattaccaacggtctaatagatgccgctctggcccagatgtatcctgcccatttgcttcgagcatgttccttagttcagcagttgacacatgcttcttaagttcatccttcaatttccaaagtgtgtcactctgctctttaagcttttcttgaagatcagaagaattagcattggaatcatgtgatacaacagctttccctttatcttctgctgtgccttctgatatactcctgattatcttgggagctttgcagtcgtgtatatcattctgattattcttgcgcttggaacccttagaagatgtttgcccttgagaaacaacaatacaaaatatcaagtcagattacgaagtggcgcgaagaaaatttgatgcccatgtttcattacctgagctgggggcatctttcttaacaagatcaagaacagctcttttatcctcatgcgacaggatctcccagcctgagaaattctcaacagttgcagctggggacatctccagaaaacagctggcgtgataccaaccttgcccttcaagcttagatgaaacacgaacctagacaaacaaataataatactattacagaaacaacttagagtgaagacaaagaccatgtttttacattacaagttgccatatcacagttacaattcatatgttttcaaaacatacattattagctaagtgcatgactaatagtacttctggatcatcaaacattttcctgtatataattctccacggtaattattgtaattcattaggagtactcaactaggagtgtggatgaataagaaatatgaacataataaatactcttccaattaatacatttgcaggttacttcatttgataaagtaaacttaacacaaaattcagagttctaatgcttgctagtggcacgtagcagagtaactacaaaataaatgggaaactgtggcctttaggctttctggtcacttggaattccagtgcaaaagcttgggcattatatgcaacatgatgcaggccacagggaatagggtacagaaaagaacctatggtgtccctgcgtatcagaaccatacatttcccagatgcaagttcagaaaataaaagaacatgccaatggcatagtggtagggaagctatttaacctccccagctacaagtgttcaagtgctaggaccaagtcgggtatccatttcatccttagtgagcgctaaagttcatgttctaaataaataaagtatagaacaacaaagtaacatgcagaattttggacaatacagtatttttcccagggagtaactataaggaataggaaacatgttatgattaattattcttacatgctgcatcaaggttcattcaagaatgtgaaacttctgattatctatgattgttagctgaatgctcatataagactgtaaggtgttaatcatcaagaggaggttattttcatgactataatttgaaaagcaacaaagtacaaacataaaattttcatggcataaaacttcctatcctcaagggacgaattagaaagcatataaaaaattaatagatcaaaagatacagaccgttcccttttttatcttttcaccacaccgtctacaggaagtacgggcagatttagcaacctcaatggtgcatttatctgaaatagcagctgcagaacttgcagtagctggtgcacttccaacataatttcttatcttctcttggtcatcccatctgagtgtgtctattccttcaacatcatcaacactaatttgaaatgaagaatcgacactttgagttaggtcagatttccaatagatgcaataaagattaataaaccataatactatagcgtgaaactcatgcaaacagtaaaagataaagttgcatacgattttatctggtttttcttactgaggatgcaactggcatggttccacatctgaaaaagagaaaagggcactaaaattaattggaagtggtcaattcgtaaaattgatatggaaagatatgtcatataaccatcgagttttctcttctgcaccatcgagaatctaccatgaccaaaaaaaagttccaaacagttatagttcttgaataaaacaattactataaacatagaaaaggtacaacgttataaacactccatattaaagaacatggtcaggtaaaaaataagggccatcacagaaaataaaaagatatggtcaggtgaaaaatggcatgcagatccaaaagtaccccctaagttgccctaaacgatcctacatttcccagtgaaataatttgagtgtctagtccacataaccacatgagtactgagttgatccgaccaaaagaaataaagattcattatccaaatgtgcaatataaaaaatgaaaaatagaataaggactcccctccaagttttatcttgcctaatacaggtaagcacttataatacacatgcacccacaaaacaattacaagaggcaaactagaaaataaagcgggcaaacgaatacctagattataatttgcaaactacacatcagataagaacaaaaacagattagcgaacacactagattactaacattgtcattggttgccccattgccatgctaaaagcctaaaacagcacaaccaactggcaggtccgcataataactaatatatcaaacaacttaggaccattgccatgctaaaagcctaaaacagcacaaccaactggcaggtccgcataataactaatatatcaaacaacttaggagaaataccagttaaattgcatatgtcaaagttggtgcccacaaaagcacctctatctattcttgcgttacacatatagattgcataatggattagaaacagcaataaacccaatgctggaattgacggatcatcgacaaatcgacagagcaccaaaccaaatgcatcaagaactccgcattcgaagaagattggttcgatcataccccacaaaatcatgcgaaattaccctcagaaacatatttttttcgggcatcaagatttaaaaccaaccacccaccaaagcagaagattcttatggcaaatgcccgcaaaacccacattagcaatgcacatcaagatgaaaaccaaccacccatgaaagcagaagattcttgtggcagatgaccacaaaacccacacccgcaatgcaaatcaggatgaaaaccgatcacccatcaatccagaaaattctcagaatccaaaccaacctacaaaaaaccctcaagaacacgatgcctgccacaccaaaaccctaccctcccagaccctaaagatcaaagcaagattcatcaactgaacggagaaagatcgtcggcgaggagagcgggtggagggagaggatacggacgggcattaatccgtcgaactgcgtggcctggaccatcttgccgagccggagctggtccttcccgatgggggacctgcacgacttgcacgaggaccgcccggacttggcgtactccgccttccaggccttgggcggcgccgccattccgccggccggtgcggctggtgccctcttcctcccttcccctccgccgcttcttggcttgtcctagggcctagaaagaacccacacaacgagaaaggagaaagggaagggaaaggcctgatgatgatgaggtgtaaaaacgttaaaaaggaaaaaaaaaatctcccctcgaaaatttggggcgagttgagttaatttgatggtttttcttttaaaaccctgtgccatatcctccccgaatgtgtattctcatatgccatttttcttacgggctttacggactgtttggatgggttaactgtatgatttctcacgttttgccacgaaaattactaagtatttctcaatatttttttcgacaattaagctaaaagtaaaagaaaaaaaataataaaacatcagagtttatcagtacttatcataaaacaaacagatgatacctgcgttttaatgtgaaacatattgataactatatgtttaatactataaaaatgatagatagatttgtgagaggtgataactggatatgattgcatgttgatttgtagaattaaataaattgtaaatgatgttgtatatttgcatg

SEQ ID NO: 55213 - DNA, 3017 bp, Oryza sativa
accactactattcgtgatattggctgggtgccactgaaattttgtaaaattagatctatgacatcaccgtcacatttttctaattcacatagaaggatgacaactcgtagatccgttttgcattcgctgatctaattacgaaaatgaaatactctctccatcccgttttgtttttgccgttcctggtgaacaccgcaactgtcgacttggagtcgccggcgcaagccgattggggtatctccacacaagatgtgtcgtatcgttccagacagggacaggcaaaagagcaagccatcacgcactagcagtcggcctccacgctcgtcttgtggcctcgtcgttcgcgagacacaagcccgtgcgagctcatcccatcatggtcgagtgcaccttcgtgcatcgagccatcggtcgtcacgctgtcattggccgaccgagccactttttggcatcagccatggagggagagagaagaaaagaaagaaggaagaaagaagaaagaaggaagaagaagaagaagaagaagaaaggaaaggagctatggcttgtagttgcggctgcacccgtgccgttcgcaatgcatgcgtcaagtccgtcgttcaacgcggcaaattcatgttggcagctacgcccattatgcgtcgacatcactgccccttccactagttttggtaaatatacgtatgcaggccatttacggataaaaatgcacccgacatgcgataaaatgaacctcctgctaatcatacatgtgtacaaggattggaaggtgttgatgtgaaaaacacacactggcgaggtttgctttactctagtgcaggtccaaagatttgccttcaggttcagggcgtgctagttagtttgatcctgcaaccaacaagaaacaaagaatccaaagttaaatccataaacgatagccgatcggctggactgccgatgacatatcatttagcaccaagccgatgtaacgcaggtcagatcggcaatgaagtaagtaacgagaaaagagttagatccactcgatcggctgtagatatcaatgatatataatctatatttcaagaatatatttaagctaagcgattgggatagatcgggcagtgtgccgagacagtataaattacttgcgcttaaaagtgctttggagtaaagattatacatattcatagcatagctgatagggtaaatctaatgcgtatcgactaatactccgataccactcgttactcattagaataaaccaacaaatttaatatatttcattcaaaagagatcttaatataaagggtagattcagtatgtcgagtaagcatataagtaacgagacaactaaatcaggcaagatcggctgaaaccccaatagtatctctagtagcagtcatgaaacaagctagatattacgattccaggtaatgctttaatggatcaaacttaactgatacaacattaaacatagaaagaagcataaaatttaaacaagtcgatggcaaccttttgaagatggtagatgcactatgtaatctaattcgaagtcagtatctaaccatgtcgactgttttcgatgatagaggctagccgctgaggttaggtagcaagatcgacctagattacatagcatatatgataactcgacgatttatataaacaggattagagtgtcatgaagatgtaagcactaatcccgagaacgcaagccgctataacaagctttacctttttgtcgaaacaagattttggcaatactaaaagggggtggctatcaagctagaaaagtggatgggttcagagacaagggattttatacaggttcaggccttcttaatcaagaagtaataccctactcctgtccggggattgatccgccgagtgtattattgatcgtatgatctgggagaaaatcgtgcccctagaggcacccggacccctccttatataggggaaggggtccgtattacaaagtacaaaccatatccctaacggaataggtaattacagataaaatacaatcgtaaccgactaggatcccgggtatttccttgacatacaagtttggtaattaacccgagtccttttaaagatattctatctatacatgacaccccatacccagtcggatatacatgccgtgtaggaatggggtatccataatctccacagtagcccctgagacctttacagtcgacggaataatcttctctcataatccgaaaagacaatccgagtgctttagcttcatctgttttgatctcccgagtaatataatcaaagactgtgaagggctgaaaaatagaaaaaatcaggtgcatcgactagatgcacctaattaggtgtagccctcgactatatggttagttgaacaaactaagcatatagtcaaggaataaataatccaaccaaccgagtggtttttgataattgttatcaaccaagtgacttgatatcaatatatagcatatgcagtgtgaatcccccaaataatatgatccaagtgatataccgactgctttgcagaatatgatgcgtgcaacctaaagttgacaacatttttggaaattcacatagcaaaacagctataaagaagagcttgatgttgtgaataaagaaatttccaaagtattgggcatacaccatgagcacacttctttaacagatgtgcttaagtccctaaaagacacatgatttcaccacacctgaaaatatatggcatatgtggtgtaacatccgagtaaataaactcgtaaacgatttaccaaccgcctggaaaatgaccacaatatataatcagccaaagccataatattagttaataaaaatgcacacttacgtggcaaaaagcaatgatattatatccaatcaactgctttataaacccaaacagcaccttgactatataaaaaagtcagtagggcagctatgtaaagctttactgtttgacaccttttaagatgcattgtaccaactcctaaaaagttgagtaactgcggtataaaaggattttaaagtattgggcacttgat

SEQ ID NO: 55214 - DNA, 11511 bp, Oryza sativa
  unsure (1)..(11511): unsure at all n locations
cagatgataaaagtccgagtaaaaactctcaaaagacctatcaaatgtggcataaaatctgataaaagacgagtctaaatagcctaggctatgactcatgacataatcaaaataagcatataacatgccgagtggatgactgtattaaaaccagtcatctcaagaaaacccaaacaatctttgcagcctaaaaaggcctacaaaattagtataacacttttatgttatgcacctttttatttgcatcgtagtaattccaaagaattatctaactgcgtcaaaaaggattttaacagcattgggctatactgttgtgagcaagtgttgacgaaacaaaaacaaatgcctaagtccctatggatcacaacttaatcacgctgatagcaaaactgggctgaagtactgtttaggcctaggcccattagtactcccgataccctagcgaaataaacgccaaaatcggagcgtcgtttcgtcttccccgccgagactctcgccactttccccatttcccgctacagtgcaaaaccacaccggcagaagcaagcacaccggcggaagcaagggttaacaaatccactccaatccatcctcctgagctccacaaaaaccctccacgcaaccaccgcaccgaatccccatccatttccagccatatctcggaccaaatcggcatgggacgactggatgttttcttcttcggattggtttgccttggttgtttcccggtcacctctttattgccagattttctagcattatcgccttcatcatcactcagaaccaatttcctcttgcgggagtccgactgactggttgatttcgaggtgtttgtttgagtgtcagactgaatttttggtcctccactcgcctgaccagttcgccagcggggtgatcggcgttgagcaattggaggatccgacttcatcaaagcgaattcctgggtataacatttcgagttttcaattagcttaacagcagataaaggcatgcttttgagaaaggctgaaatgtttgaatacataccggtggagaaggattgaaggcgttgtatggcaccactggcagcaagtgcgaataactaactacaattgcattcgagaagattttatacattctttccttcataaccttgaattcaagagattcaggatcttcacggttggtgtcatgtttgccatcaaatttgaaggctgtacaggatctctctttaattggagctagccggctcttgataaaatgccgggtgatctgttctccttgcagaccttgctccttcagcttcagcatacggtccatcagggcaagcgcctgagcggcttcctctcccattggaagtgagttccaagagtcctgataaactggagggagacaggagtactcggggagtgcaggctcggggttttgtacatagaaccaatttgcatgccagcctttgtttgaggttttgaagggcatggagaaatacttttggctcagagttcccctcaattgaaatccagcccccccaactacgcatggtttactcttgtttggttggggcttgaggaagaagatgcgacggaataaggcaaaatgtggcctgacgtccaaaaaagcttcgcaggcgtgtatgaagttggcgatgtgaactatggagttcgggtttaagtgatgcaaactaatcccatagaaatcaaaaatcccccggaagaatctcgaggttggaagagaaaatccgccatagaagaaatgagaaaataccacgacttcatgtgtgtcgggggtcgggaatgcttcgccgaatgctggacgccatccaatgatctccttcgccagaagaacgccgtgcgccaccatctctttcaaattctcctctgttacatcggagggcgcccactgactctcgaagctttctctctcttccgtcatgaatacgaactggatggtgtgatttggtccgagatatggctggaaatggatggggattcggtgcggtggttgcgtggagggtttttgtggagctcaggaggatggattggagtggatttgttaaccctagcttccgccggtgtggttttgcactgtagcgggaaatggggaaagtggcgagagtctcggcggggaagacgaaacgacgctccgatttgtactgatagcataactcaaactcgtaggaagccatctgacatagatctttctggaaaagactctgaaccgactgacatggagacgggttcttcaaaagaagatcacccgactgcagaagatcacccgagtgacaatcaaccggcgaccgacaatgtagaacccagcaacgagcccccgactgggaaccagtcggccgaaactggggttggtgctaatcaggagcccccgactggaaaccagtcgggtacagaaccaaacaaagatattcctgaagtagaaactcaagctgacagccctcctaaaaaggatgccagcgtcgatctagggtccggctctcttgttaaattacaagggcctactcgtccccgaccggaaataatcacaagtaaacacatcctccgaacccattttgatctgacagactttcttcaattgtttcacctttattcataaatgcctaaggcccaatggtcggcgacgaagaagaagtcctccggatacagtcagctgaggattctcgtccacctattttagtcaaatggtgggacgatgatatgcaaccttagggaatcgtgataaacaagcaaaaggaagatgaggaagtatgcttgctgaaaaaggcactcagccaggctactcgcatcgtaaatataagtctccttatacatagcttcaactatcctgtttcccactttgctcaaatgccgataaattcgcattgcagagaatccatctcaggaacgaggcgaagaccgcgactcttgagaatttagttcctcatcttggaacccttgagaccaccagaaaccagctgcacaaggctaaggagcttgccaggaaaactgagcatgatctgagggatcggatcgccgagcttcaagaatccaactttgaactgagcggttcgtcaaaaggtaaatacaatctatgtctaacttacttatgctgccatccttgtaatatcaattaatcaagaagcaatacagtgcaagccgccaagatatctgaactagaaaagcggatccaaactctggagaatgacaaggccaaattggcgaaacagagggattcggctctgaaagatgttgaaggtactggtgactaatacctcttatctttatgcctactcgttgatataaatctatttacgcagatcgcaaaatcaagtctcaggctcaattcgatgtcttggtcaataaaatcaaaaggcttgaaggggctagggatgaagtcgccaacgctgctaccccactcgtccaagccatgttcttcaataacaatggtccgagtacatttgatgcttccgaaatcttcgacaagctgagaatcgctccggatacatactttaagaatatcaaagaggccggaagtatgggagcaagcctggcgttggcaatgaccaagtctttataaccgaagattgatgttgacaccattgatggatttgcagacgggacgagcgaagaagccgcccttgacctcatcaacgatgcgtagaaagccgccgacaagatagccattgatgtagttgagagattccaggacaacgacctccggccgactggatctaataattccgatgatgagaaaactgatactgattgatattatactgtaacagtgattctgatgatgatgatgatgatggaggcacaatttgtacaatactgatgaatttatgttgtgcttgatatttcaaacttagctcccgatttcttaaaagtttttgtcaaacctttttgagcctaaaacccacaaaagttgttaaaaaactttcagtcctcattgactaagccaaaaaatcaaacaaggcaatgataaatcaagtaagcaaattgaattgataaaagtcacactccattattattatagtagcccccgactgataactcaaggaaaagcttgatgttagcagtcaaagctgaagatacaaaagtaatgcctaagcataaaaacgacgaagatgttcaatattccaagagttgtcgatatgagtaccgtcctcacgcttgagtcgataagaacctggccgagtgacttcagaaattatgaacggtccttcccacaagggagataacttgtgccgatcccgtgtagtttgaatttttctcagaactaggtcgccgactaaaaaagctcgtgagcgaacattgcgattgtgataatgacgcaccccttgcaagtaccgagccgactgaattaaggctgcttcacgggcctcttccagtcggttgatatcatctactcggtcttctccgtagcgctcctcgctgaagttgcgaaatcgtagagattcaaattccacctcactcggaaacattgcttctgctccatagactaggaaaaacggcgactggcccgtagctcgactgggagtggtgcgcagggaccaaagtacggacgacagctgttctacccacttgccggcataaggatgcagtcggtcgaaaactcgcgcttttattccttgaagtaccataccattggcacgttcgacctgtccattgctcatggggtgcgctacggaggcataacaaattttaatgccgaagtcttcacaaaagtctttaaatactccgccggtgaattaagtgccattatcagtgatgatacgattaggtaccccaaaccggtgcacaatgttgatgaagaaatctctagccttgtctgccatgattgtaatgaccggtttagcttcaatccacttggaaaatttgtcaacagccacaaagaggtgagtataaccaccgactgcctttttgaatgggccgaccatgtcaagcccccaaaccgcaaacggccaagacaacaggatggtttgcaactcctgagctggtaaatgagtttgtcgggcgaaaaattgacaaccctcacatgttcacacaattttgtcagtgtcggacacagctgtgggctagaaaaaaccctgccgataagccttgccaacgatggttcgtgcagcagcgtgattaccacagatgcctgaatgtatatcttttagcaattgccttccctcctccaaagacacacagcgttgcaggattcctgatggacttttcttgtacaactcggtctcatgaataacatagagtttgctgcgcctggaaatccgctcggcttcatctttatcttgggggagttcttgtttgatcagaaatcttatgaggggctctctctagtcggcttcaatcatacttacgtcttgagtatccgtggcttcaattgtttctttccttggcacggttggttcgtaaagatgttcaacgaacacgtcggaaggagctacttctcgttttgaaccaaaattagccagtctgtcggctgcctcgttattgtgccgaagaacatgagtgagttcaagtctatcgaatttgtcttccaacttacgtacctcctgccgataagcggtcatgttatcatcaaggcaggaccactctttcatgacttgatcaacaaccaactgagaatctccacgaactatcagacgccgaatgcccaaggagatcgcgatccttaatccgtgaagcagcgactcatattctgccacgttatgggacgcggaaaaatgtatccacaatacgtagctcaatcttttctccagtcggggagattaaaacaaccccggctccagtgcctgaaagcctcttcgacctgtcaaaatgcatggtccaatactccatcttctcctcgggcatgtcttcttggcactcagtccactcggcgacaaattcggctaaagcttgggacttgatcgaagttcgcggcttgaaggatatatctaaagacatcaattctaaggcccactttgcgattcatccatttgcttcgcgattatgaagtatatccccgagtggaaacgatgtgaccaccgtgaccgagtgaccttagaagtagtgagataatttccggacggtaattaaaacaccatataatagcttctgaacccgaggatatcttgtcttggaattagccaaaacctcgctaacgaagtagattggtcgttggactttttgaacatggccttcttcttcacgctcaacaaccaggactgtgcttacaacctgggaagttgccgacatgtataacaacagcggctcttgcggatgtggtgaagctaggactggtggagtagtgagaagttttttgaagtcttcaaaggctttctgtgcttcgagtccccactggaaattgtctgtcttcttcaacagcttgaaaaagggcatcccccgctcgtcgagtcgcgaaacaaacctgctaagcgccgccatgcaaccagtcagcttttggacatctttttgtgagctcggcggtttcatgttgaggatggcgttgattttctccgggttggcttgtatgcctctatgggacaccataaatccaagcagcttccctgacggtactccgaagatgcactttttagggtttagtttcatcctgaaggcgcggatgcttgcaaaggtctcttctagatccgcgatcaaatcatccttctgtttggtcttcacgattacatcatccacataagcttcatcattgcggccgatctgagttgaaaaacatctctggatcatgcgttgataagttgctcctgcgttctttaatccaaagggcatggtgatgtagcagtaggccccgaagggcgtaatgaatgaagtcttcaagcagtaggattcttttagtcggatctgatgatatcctgagtagcaatccaaaaaaactgagtagctcgcagccggccgttgagtcaactacctggtcaatgcgaggtaacccaaaagggtctttgggactagacttgttgaggtcggtataatcgacacacatgcgccattgccccgtcttcttccgaaccaggactgggttagccagccagtcgggatgaaggacttctttgatgaagcccgctgctaacagcttagtcaattcttccttgatcgcatccttcctatcctgtgcgaaacggtggagttgttgcttgataggtttagcgtcttccttaacatgtaaagagtgctcaatcacctctctgggaatacctggcatatcagatggtttccacgcaaagatatctttattattttgaagaaaggtgatgagcgcgctttcctatttacaatctaactcagcgcctattacagcagtcttagtaggatcagagggatctagaggaattttcttggtcttggcgtcgctttctccgctctttggcaccttggttgcaggcacttctccttcgcttgctgtggacgcagccagtcggatttcttctcgagcgagggtgatctcgcgggtctgggccatcttgcagctttccttgtcgcatgtgacggcttatttaatgtcgctccgcagggatatgactcctcgaggaccaggcatcttcatcatcatgtaggtatagtgcgggacagccataaacttggctaacgccgggcgtccgagtatggcatgagacgctgtctcgaaatcagcaacttcaaaacaaacgttttctgtgcggaagttctcccgagtgccgaaagtaaccggaagagtgatctggccaagtggtgtagcagatagccctgggatgactccgtgaaagggcgcattactcggttttaattccgtgcgagggatctgcatgttgtccagagtcttggcgaaaaggatgctgagcgcactgccaccatcgatgagggatctgcgaagcttgacgttgcgaaccacagggtctagtaccagggggtaccgccccgggtggaccactcggtcaggatgatccgagcggtcaaacttgattgtcgtctctgaccaccgaagatattggggcgtgtcgggctggacagcattgatctcccgttcagtcaacttttgctttctcttggattcataagccaggggtccgccaaagatgtggtttagttccttgcgatggtcttgaaaaccagtcggggcatcgtcttcatcatccttcttctttgacgtgctttgatctccgtcagcggtcttgcgtgcgttcttggcgtattgctctgcaaactgtttgtagacgaagcaatctttggccgcgtgattggaatttggatgatgcggatattgggagttcatgatcttatcaaaagtattgacgcgcgaacgttgtcgggaggatggtgtagtggttgccacaagttcctcgggcttacgcttgcgatccttgtgattggtacttccactcccccctgtgttcggcatatttttcttcagcttccaagtggtgcccgactgcttggacgcggtaatagcatcttcggctttggcatactcgttggctttctcgaacatctgcttgaccgtcctgggaggcttgcgcccgaacttgccgactaggtcgtcgtggcgaatgcccttggtgaaggcggcgatgatgacgtcgtcggtgatgtcggagatcttgttgcgttgctcggaaaaacgccggatgtaatctcgaagggattctccggacttctggacaacgttgtagagatcgtctgagtgccagggcgttcaaaggtgccctggaaattggcgatgaagtggtcgcgaagtttcgcccaagatccgattgtgccacggggtagcctgtgaagctaggaccgggcagaatctgctagggccataggcaaataattcatcatggctttgctacctcctcctgctgcgcggattgcgagaccgtagacggtgagccaagactccgggttagtggtgccgtcatacttctcgattccactcggcttgaagccggctggccaatccactcgacgcaggtcagtcgtgaaggcagcaactccatccacgtcgtcgtcgtagcggtctggtgaatggttgggagcacagcctcttgccgcgcggcgctggttgatggtatcgcgaagatcgatggggtgcctacgaggtcgttcaactcgacgctccctgtgtcgttcgggaggcgaatggacagatcgctcgtcgtgacccctgctcctgcgactggatcccgcgccgatgacgctgaggcttggttggtgatagtcttgagatcgaagagggggaactcggctgccagtcggcgtgcgggtgcttgcggagttagccgggaccgaggcggcgatcatggtctttgtctggtttaagatgttgacgacgtgatcagcctgattgagcgcgtcttccttgaggagggtgtcgaggagggtgatcgctgcaaccgcgttctgttagggtgtgcggaaaaccgctgtcccgtcgacgacttgttgcccgatgagatctcgtgctcgtcgcccggattccaaggcgcgctgtcgtcgatcctcagcctcctttgcagcccgttcgcgatcttgttgttcacgctgtagtcgttctcgctcttgtcgttgtcattcttcctccagtcggcgacattcagcttcttgtcgtgtgcgttcttcttccgcttctcgggctcagcactgttctgccgtctcgttgttggccatgaatacaccgaaaaagagaggcgtgtagtcgtcctcgtagctgtcgtcgaagttaccgtagtcgtagcgatagccgaagtcgtcgtactcgaggatctccgttggtcgagaactgacgccgggggagctgaggtagcaatccaattcttccgtcgagaccgtcccgagaggctgaaatataacgcctacctccctagaactagattggatcgaagccgaagccggatcccgtctaggtcttcgggtgggagatgccttggtcgtgaagacagcagccagatcatcgggaagtctcatcaggattgggggataggacccatcatcttgatctggtcgtgtccgagtagattggatctcgtacgagtggtttgaagccaactcggcagagatgatcttggggtagacctcggccgagttcggggtaccgaacggggcggagatctgacctcttcccgactggttcgaatccgagtcgaggagagaaatcttgccgaagtcgttggtgatgaagtcgaggctgccgaaccggaacgcctgtccgggagggaagacgaagtcgtcgatgccggagacggaacccatcacactagtcggcgaagaacttgacgctgcccctacctggcgcgccaactgtcgaaacaagatttcggcaatactaaaagggggtggctatcaagctggaaaagtggatgggttcagagacaagggattttatacaggttcaggccttcttaaccaagaagtaataccctactcctgtccggggattgatccgcagagtgtattattgatcgtatgatctgggagaaaatcgtgcccctagaggcacccggacccctccttatataggggaaggggtccgtattacaaagtacaaaccatatccctaacggaatagataattacagataaaatacaatcgtaaccgactaggatcccgggtatttccttgacatacaagtttggtaattaacccgagtccttttaaagatattctatctatacagggcaccccatacccagtcggatatacatgccgtgtaggtatggggtatccataatctccacacttttcgtcggagatcgaaaactatgcagcccaactcgaaagcaagaactcgtcgaaacaatgaaaaaagggtggcgatgcgccgaaagtgttatcgaactgatgttgtttgtttacagggtcctgggttatatttatacccaaaatacatgatatgtccttgccgaacacgactctatctctattacaactcaaaaatacgaacaagtcctgtggactcttactgaaaatatctataaggaaactattagaatatcctaattaataggtacaattgccttctccggactcaatccacacttggcaatactggtgtagcacttgaaccgatctagacaacaatctcctgatcgccttgccgggatcagttatatcggctcctccttgcccgatttggtagcagccgatgcaacccgtagctgatgtgggttctgtttctgaggctacagatttccaccaaatccactttggttctgacttcggatccaatctttgatttaccaattttgatcattaacacatgcccctcaagtccgtgatatttgcgatgttgcggatgtgctcgattttgtttccgcttgcatctagggatccttttctgtttanggcgtaaacgcgcccttttaaatagtgtcaaccaccttgaaaatttcacggcgtctcccccgcttcaattgccttggccaaaaacttcccccaatcactccagtaattcgctcagcgactctgcaggcgatcccttgtttcggcggcggcccgacttcggcaatgtcttctgccaatccctcaagcgctccggtggtcgagttccccgaggtaagcaccatcggctaggccctttct

SEQ ID NO: 55215 - DNA, 912 bp, Oryza sativa
tatatattacaaattgaacaaataacttaaaattatatattataaattgaacaaataacttaaaataagtgatctaacaaatgtagttgaagaaaattttatgagaaaacgtatttgtagaagcatgacgcagataattcgcagcaataatcaggtagaatgattgcgttcatcttaagcctaagcgagataaaattttgcagcatttggtgtactagtgtccagaagtgtaaaaacgtattgtcattaatattcttttaaaaaaaattactcaccttccaagataggtcttgagccatgcagttctgaaccatttcttggaatgccggtgtgttgtactgcttcagagcccgtttgacagttgaagcaaccgctgtgacgtccactggatcaacagtttcgcactacaggatgacatgacaaggctagcatgacgaactctttcctgatcttgagggcaatcaaaaagtggaaacacactgctccttacctcgacattgaacaaacccatgtggaatccggtcacgccctccttaaccgtgtcgacaagtcctccagtagatgagcagatgggaacctgtagtttgcaacattgtgaatttgattttctttttggtggtattacccacagtgtagttttactttgaacttttcaccacattatgatgaatacaaaaattcaattatgttgtattgctgtgattcataataacttcatagttcatactgcaagcaaggatataaaaattgactagtaatatagtatcaaggactgtctcattaacttcacaattgtgtaatcagacctaaagtgagaatacttaccactccatatctcatcccttgcaattggatgagaccacatggctcaaacctactaggaacaattataaaatcagccccagcaaacat

SEQ ID NO: 55216 - DNA, 16508 bp, Oryza sativa
attcctgcagcccaaagttatttggttggttgtattggtttagcatgactagtatgggatgttgtttggttgcttgcatgaaagatatggtttgaaagaaattttgtttggttggatgtatggattgggtgcagatacctctttatttagttgggtgaggttacctcttcaatgttatatgaaaaaaaaattacctctcaaatgttatatgaaatattctgagtaaattgtactacctctatcctctaatataagggatattcactattttcatataacgtttgaccactcgtcttattcgaagaatttatgcaaatataaaaaacgaaaaattatgcttaaaatactttggataataaagtaagtcacaaataaataatgattttaatttttttcgagtggtcaaacagtgcaaacaaaatatcaaaatctcttatattaggggacggatggattactttgcatcatgttgcctccaaattaatttcacttatctagatgtaaacaattgatcaggacgattagggttcaaaatcgtgaaaagaaaattattttgacccaatatgaccgatgtatggtaactaacctgaaccccacgagtatatatccagtccaaactccaaacgcacttgacttcctcctcgtcatcgctgattgcattcgctccgagatggccacgccgcctcccaccgactccgaccaggttcgtccgctgcttcctcctccttcgccgttcactcccgcgttcgattcctgcttcttttgcgctccgcctcgttgggctcacggatccaagcccaatcaaccatcccgcgaattagctgctgctttccctcattcgattcgctcatactcagattgattgatccagttaggttgttttaacatgctcgattgcgtctgtagcagcaatttgatcgattccgctaggtttgcttctcccctctaatttgattgctgatgcgactgtgtacaactgtaatagacaatcgcccatgggtggctttttcttaatcaccaccatgaatgttttattagtccttaatcaccgtggcgattataggcgcatacatggtcatatttcattcattgctaatttctatactcttgtcgtagttcacaggcaattcagaaattcgactagtttactgcaaacagattatgctaattacttgttacatctgggtaggtcagttttatctcggggttcaacttcaaaccattctgccgtagaatttctacagataaaaaataatagcactgtcttgtgtttgacgaccaggattgtttccgtatcctctgttcgtctcaactggcctcaacaacacaactattttaaggaatatataagcagcatggagagtttaaactccattctaatttggttcggttttgtctgttgtgcgtgtaattaggcatttaaatttcctatttcatgttcgttgccaaacggccaaatggctacactctggtattcgatgtaacaattttatcatatcgggaactgttgttatgatctgtatcttcttcgtgtgctgtctactacaagtcttctctgtacaatgtcatactttttatgattggttctacctgctactgagaataccttctgctatttctctgtttgccaggttttggtagaggcaaatggtgtaacacggacattgcttatgaataggccaaagcagttgaatgccctctcctctgcaatggtatgacttctaaagaaaaaaagtgacaatgagtcaataagtaatggagcatatatggtattcgtggctacatatagggtgcaggaacactgatacgagaaatttatttttgctttcattttctagataacaggatttttgaggtgcttcactgcttatgaggaagatgaaggagttaaactattgattgtgaaggtaatgatcgtgtttgagtcctacaataatgaaatatctgatgtggtccatatttaaacaatgtattttgaggtttatctttgattaaaaaaaagaataacgaggtactagctaacatcaaacatgaattacccgattaaatttccaaaatcgagcattcaaagtttcatccgcttattgaagtttgaatcatgtacaaccaagttgtagtaacgtaaaacaccaatgctgtccatgctttttgttgcatgctaactgtccttttgccatttgtaaatgtaattgattttctgttgctgatatatgagtcttgacttattgggataattccaactttactacctcctgctgttacctttactgctgctgtttgtgctcagcttgatttctataactccctaccattcttgtcatcacttgttttttcctttgtcaggggaaaggaagagcattttgtgctggtggagatgttgctgcagttgtccggtctataaataatggtaaataaaacatatcatgcatccatgagaccctgatgtcaaatatcttgagcttccatgctgtttttctttaacttgcattgcctttccatttgctatatgctaatccactgttaacatgcaatatatacagaattgtgttcttgacatttgattactactactatgcatttcttatatcagatagctggaaatatagtgctcattttttccgaaatgaatttctgttgaactatatcattgcaacatataacaaacctcaggtgagctatcgctattgctttgaaactgcttgtccacataattgttattgtcattattgctcaatgcttaccactgaatgctacaacactcttatctaggtttcacttctcactggaattgtcatgggtggaggtgccggtgtttctatacatggaaggttccgagttgtcacagagagcacggtatatattacggaacaaactctatatgaagcttccatttttacttaaatattttcaaaaaggatgtagcaggggtgcagaaaaaagcttgcttgattcttttcatgggataaacagcttaccagcatatgcctagagtttgactctgtatttttactactatctatgcaggtttttgctatgccagaaacagcattgggtctctttccagatattggggcctcatattttctatctcgacttcctgggttctatgtggtgaactattttcctatctcatatctcctttattcaactgaactttcacacatgatcatatgaattctctttgcaatgtctaaaactgattattaatactgaaagccccatgtgctatgcatccttgagtgcttatcatattattacatgactttaaaatgtgtgggtgtggaaatatatgtggccactctgtttctcccatcatcttaataaattttgaccaaacctccatcatgacctggtaaaaagaaagaaatgtatgtggccagattttttattgcctgtccactaggattcatctgttgaattttgatataattgtaaattagttataattttacaccatataagttataggttgatgggagactatctttggagatcgttttcactgatttgttgttatgtctttctcaggagagtatgttggtcttactggtgtaaggttggatgctcctgaaatgctttcttgtggcctggcctcattttgtaccttcagatgaaaaaaaaaacccaaagtcagctaagagtaaaacttgttttgtgaagaaaatagttaagagtaagatgaaaattgtatagagttttgtaaacataacgtttttttttatttttgaaagtattactaaataggaatttctcccttggccaactagaaaaggggtggggcgccttttttgtcttttcctacagtcgtatggctctgataccagctctgtggacccccgtttttataacaggaatcaatcgtgtgaacagtaccatttccctggatcaagtagtctggtacacacgagttcatagctgaaataccaaatgcacatacacgaaagtctagtgcggattattacatcataagcccgcaggcatagtcttagatcatcagaccgagcggtccggaatacattccaaaagcagagtagataaggcagcggagtttaggcagcggcacgccattgccacaggcaacgaccgtaactaagacctattgggcgccatcgtcttcatcaccctcctggtagtacgcgtagggatcctccgaagcttcgtctccggcctctgattaagtttatatattgcaagagtgagtaccaaccgtactcagcaagccatcacagcaacaatgcacatgataggggtattcaaaggatggccatggttctttgcgcaaagccagttttgtaattcttttcacaagcctaagacccagcattgactgatcaaattttagtaccagtgttcacagttaaacaacgacggttctgtctaccatccattgtgatcccaaggatagcttcccgccattgagtcgtcatggttttctgaggacgtccaccttccagcctctcaggaagtggctccaacagcataaaaatcatcatgcaatatcccatcccacacaagtcaagaattttgagtctagccaagtgtaatacacgtcccggtgctcaataaccgcgagcacggctattcgaatagatttggtttactcacactgcagtggatgtacactttacccgcactccgtgactgcccaacacatgagcctcgtcccaacacataagacgcgtcacgacaaaggttttcgataaccccgcattggcagtacccgctccatgaacttaaatcctcatgcactctaggcgtccatgtttctagcagtgagaggagttctggcgctcccgggaaagagaagtctcacacacatattaaattatggttcaagttaaattctctctctcatacactcatggcagtcctaccaatggcgacaccgatgtagggcacgcctctcggccctacctcaacgcctgtcccaccgtagcgcacctgcctcactcaggggtgaaccatctatgcagggatattgcctccgctcggctatctaatccgctaggtctatacccatacgagaagtacggttgtacgggggtcgtttcatgcttaacttcatggctcagtccttaattgaccggggacggtactagccttttccagataccacccaaatcctccgtccgccccagtcgaaaacaattgtttaattttgtttctcctttcacaaatcatgtcatcaacatcatggcaatgtggcgctcatgtctccacatgccgcatctcaattacctgcccaagcatatagcatttgataaatatgagtatgcatgattctagaatagcatttttaagcaattgtcatacttgactagggactcatacgtaatcatggttacaaggattttaagggtaaacaataatcaaggcatggcataataacaagtaggatgtttatcattgcatgcaattttatttgtaaacaaaacaatttcgcaattgggatcaatatgttcaaggaatagtgatgacttgccttgctcgtagtcctgcgggtcttgaccctcgttcggatccgcaactccctcgggttctaaaattacgtgcgaggaaatgatttgaattcaattagaattcaattaaaatctaaataactcaaaaggtcgaatgtgaatcgatctttttatattgactacaaagtttgcgaaaccactttattcgaattgttggatcttttaacctaagtcattttgtgatttagaagtacattcctaagaattcaacataattatttagctcttaataaatctaaactcctaccgcgaattgattacttatagagattaccaaaaataatctataattatattaaattttgcaattctacgactataattaatctataattaaactctaattattttaaattttctaaacctccttattctctctctaattttctatttatttttccttttcttttcctcccttctttctttctcttttccctccctttcttctttttcttttttctcttttttttctttctttttcctctcttcttttctctctctccctcccggcttctttctccccgggcggcgacggcggcggaacgagggaaggggcggcggcttaccgacggcggtggcggcgacggcggcgcaaggcgaggtgacgcctggcgcggcacacggtgcggcgcggcggcaccgagggcagctgcgcggcggcacaaaggcggccgctcggcggcacgaggacgaccctgcggtggagaggaaaaaggggagtaagaggcaaatggagtggggaataatggagaggggtgaaggtatttatagggaagaggggaaagagagacagagaaggaggggggtgatgcgacgccggcgcggggcgcgaggcggcgaggagatgggcgcgcggcgacgagacgggcgacgcgacggcagggcggggctcgaggcggcaaggagacgggcgcgcagcgacgggacgggcgacgcgacggcggggcggggctcgaggcgacggcggcacgcgcggcgcggcagcgggatggcgacggcgacggcgcagcggcggcggcgcgcggctcggagcgacgacgggacgcgacggcgacggtgcgcggtggcatggggcgcgaggcgacgcgacgggcggcagcggcgcggggcgcgaggcgatgggacggtggcgcggcgacgggatggcgacggtgacggcgcggcagcggcggtgacggcgcgcggcagcgacggaagcgacggcgacggcggcgcggggctcggggcggccgggcgcgcgcaacagagatgggttagggctagggactgtaattgaacccctggcggcagatgaatagtgacttttcctattttatccccattttagcttatttcttatataaatttgattctatgaatcctaaattttgcataaatgaagtttactccatatttgtattattccacccaatggatccactctagattaattttactcatattttatttttatatcatttacttgattttaattagagttaatccttattccatcgcgtttaaatctaattgatacgaatatggccgagataatattttatttatttctatcttcacataatctttatttttagattataatttaattatttctttaacccatctagttttagggtttattcctaattaattcttctttattcgcgatctatgaactccgaaatcaaaatccaataaaatcatcgaacaaaatcggcatgatgcaatttattcaaaaagtttttgaagacccatatttttggagttttgatttttgttggtcaaattttcagggtgttacacttggcttgttccaagtatgattataggtaaccagagtattgctggttttctaattcctagtatgctcactcttgcagaggctggctttgttagaagaatcacttaaaaaggttgatacatctgatccctttgctatatgtggaattatcgatcaatattcgcaacaaccatctctgaaagaaaaaagtgctctgaataggtaagcgtgcaattgtccagacattatctattcatgcatgtcgagcttattctgcttcctttgtgtaccctgtaaaaatgaggtatccttgacaggtgggatattctggttcacaccaagttatcctgtcgtataaattcttttggcatgttaaacttagattgattaatctacaatttttaagttactaatagctgcataaagttccatagttataacatccatataaagttcatgcaggaaactctcctcaatttggggcgtgtttgacctatttatcttctccaaacaactttcttttgggtcctctctaccacaagccctagatagatagactagtccttttgaaataatattagcttgtaatggagggcaggtggagaaatgtaaggaattggaatggggaaatgtagggaagcaacagcatgcacttcccacatcttgtgtctcctttcaatagatggatgggcttcaacttataaaaaagcttggtaacggttgtctggcctggctttaaataagccgttccctatgccctaacctgttacttgtgtgttttctatattctcctcatctttatggtcagtggcttccctatgccacaatctcgttacctttagatcatttgaactcattttatgtattgcttttcttaatctggtttgaaggccaagaaggcttatctttatgcattgtaacttggaaggacttattttagtttgtcaaggagattccatttgttcctattttattgcaaggttttgttttctcatttcattctcagatcaacttttattgcctaatccatgtctgctacttccatcattttgattccaggctggaaatcatcaacaaatgcttttccaaaagaacagtagaagaaatcatagcctctcttgtgagttatgctaagtctttgctttctatagactcaccagttctgttgtgctaaatttgatgtgtatcatgttaggaacaagaggctccaaatgttgctgatgaatgggttgcttctgcaatccagtccctgaggaaggcttctcctactagtctgaaaatatccctgagatcggtatcctctcaaacatttccaaagcatatgtctttatgttactcgagtcattctatcttggtgccttcttatgcaaattattgtagtgtaaggcattactatttatttagacccatcaatcctttatatggtttcatatgaccagtatttatctttctcaagtgcatacttcatatggctttatgaactgaaccctactcctttgtgttggcacaacagatctgccctatagctaaaaaaaacaaaccttctaggcttagagcttttgcatagtcaaattgcaagtatgggcataccagttctaaaagctttggaaatgtctttggaactagtcgtcggagggaaaacaaggattgttcactccacagaagagtacgtgtactagaaaaggcagccacttaaaaacgccaactactttttttaagccttatttagtttggttgcctacgcttgatctctggcgtgctatggcaacaccccctgcttgcttctttctgctcgacatggagcttgcagcctccccacccttgcttacaacctattcttaatagaaccgatctgattttcactacaagaggaatttcgtgcttctgccggatcctccctatctcctgatcgagcttgtgtatgtaaatattgcttagtagggcccatagtagtacactgtttgggacagagtcagtgcccttctcacatccctacgagtcgtccagcagaaactgtttgtttagttgtatgtacaactagcagaacaaagcagttagatggttcactttgtataaccactacaattttgacataaattagtgttatggttaatttctagccttttaaaatcttgtgacctatcctttgggagttccgatctttttcgccaggccgacggcgaaggaagccccaaccaattttattaagatcaagaggagtaacgtactatttacaacaaacatggctgtttagggattaccctaacacaggaacacaagtactgtttacaacaaacatggttgtttagggatcaccctaacacaggaacacaatttaaaagctcagggcaggccctgagtcagggagagacacagaactggttgctggcacaacagggcagccctctatcagcgccaaggcacatcacacgcttcagtgatcaacattcctcccaaacctgcatcacgctaagtccattcttctatgatgcagccgacttacctcagaggctgatttgctgacaccgtcaaacacccgagcgttctgttctttccacatcatccaagagattagagttaccactatgtcaaatgggagttccaatctcaccatgagcttcgaggtgtcaaacctccagctatcactacctactaaagtggagcttagtctctaggaaaagtttgttttgcccctaacattcagtaggaaaggtctttgttttactgcagtatacgtagtttgtgagacgctagccatctgtgcccatttatgttcttagctttctgtatttactgtgggttcagataagagaagggcgaacacaaactgttggtgaatgcttacgtcgagaatataggatggtttgccatgtgatgcgtggtgacttcagtagagacttctttgaggtaaatatctatctacatctcccaatgacatgttcactcaagatgaacatactttgaactattcaattcctgttgcagggatgcagggctatattgttggataaagatcgaaacccaaaggccagcttgtaaatcttggttgcagaaaattcgctctccacatgtcgcctaatctggcatgggcatagcattaaatctaatcctgacatctttgctaattgcagtggatgcctccaaggttggaagaggtgcacgacgaggtggtggaaaaatatttttccaaagtcgatgatccagagtgggaagatttggacctacctcctagacgttcccatggaaggaggcttgttcccaagctttgattcaatgaaaagcctcttgtgaaaaactgaagcctttgttggtgcttctgaataacagacagatcgtccccagtttgagggatacatggagacaagcgatgaagtttatttataataaagctgaaacatattataggttaacaattttattagcaaattagagaagtccctctcatagtctcatgcgatgcttatattggtatcgctattgtgcttttttcaaggtgtgaaggtacgcttcaagctaaagcccagctgcattcaaacggcggcccatatgatactgctatcaggccatcctattgggctttgaagctaccttctgcttgtagattccaggtaatcttttatatattgtataaaagaaattcacaatttcataagtttgcaccgtgttgttttttatagtaaggcttcgaaaaggttgtaagatccctagtatcgtgtgagtcttgtaatgcacttgaactgacggcatttcgttgatgaaatgggagaggtccactctctttgtcaaaactaaatcagtaaatcataagttccctttcaaacacttgcggaaatagcaatataacatccccacgttacgcaaaattttttttagagaaatcgtaaaagctaagacaagaaacgagtagccataaacagaatccaaaatcgtttgccttggcttcatcgaacaatctaaatttcagagccttcagctactgaagaaaaagataaagacagtcgtagtagcaagcaacagcatgccacagtacagtagtaaattttggtctccatcgtacccagccgagggaagccatcgctttcgctggctgcttttaaccacaccgtagcagccactcattttttttcctctacctataaatacagcacacttcacattttctagcttaatattgtaatggtatcataattaagtatgcttctacagaaatagtcaagttcacgagcatatggaaaaagtcttgtgtctctttggcgtgtatgtagccacgtcaaagatgaaggtcttccttttgttttatcactgtcttcaccccggacatattcttcttttatcttctctttttcactgtgtgtggttcagtttttccttcctttagctccatattttaatttgatgattcttttgccttgaccatatgaattacttggccatgcatcatccatcacatgcttagtcgtactgatagatctcaacacacgtttgagattgaaccatgtatagttgagagcctaattaatcctgcttaattaccctatatactaactgcgaccatatatatgaccggtgaattggcatgtacttgtaccgaactgattaattttaagttttaggacaggaagaggcaggcccaaccactagctggaccagcatgcatgcacctaattcagttaaacacacttgtatacaggcatggcctcctcttcaccaaaaacttctctgatatttccttttcagcgtttggtcctagcttcaccgttgatgtccctctcatttatcaccggtactggttatgcacagtagtagtagcttgtattttgtgcaccaacttactagaaaaattacacaatcttttttttattacacgacgaacgcacacgaacacacatgcaacatcacctcacactctgcatatgtgcccctaatatattctccaagagacgcatatctgatctcactaaaattttgttgaaagtccacccgcatatgcgtaatattcgtggacactagaatttaaatcctggtggatgaagtcatgcactcgtaactccactactataccactaaggctctgtgcgttctggggagatagaggagattgtgtctcgttttacgcgcgcacgcttttcaaactactaaacggtgtattttttgcaaaaaaaaattctatatgaaagttgctttaaaaaatcatattaatccatttttgaaatttaaaatagttaataatcaattaatcatgagctaatggctcacctcgttttgcgtatcttcccaatctcctcaaacacaccctaagtgattcgaaaaaaaaagaggcaatttgcttctatatacatgccaaaatatgtgtgcacacccgtgtataaacaatacagtgccaattaatactctgtaagattaaggctgagtttgtttatgctgatgacaactctcttgttttccgataacacgttttccaactgataaaatgatatattttatttaaaaaaatatgtacagttatttttaaaaatcaaataaattcattttaagtttgtaattattaataattgattaatcatgcgtcggggattgaaattttgtttcaaaatttccgaaatttcggaacacccccccccccgccaagtcaatatctcagacatttccagtttttctcattttttttgtgaatttagtttaaattcaattaaattcagttaaattgtgttgaaatttcggttataccgaaatgacataaatcgaaattgaaaaccctatcatgcactaataattaattcttgtttttcaagccgccaatagctccagcccaacagcccaagcgaacccagcctctctaagagcaaggtcaatagtatagccaactactggctccaaaacatctatagccaatctaatagttcattcatacaatagttaactataaaaatatactacaccattaatattcggtcctacctctcatacacacataacagcttggagtccgtgttgcagccggctacaaatctgtagcccgctttcttctctctcttctcttttcttctcgatatatggttatagccggcttatagcatgctattgtacctgctctaagagagagcttttatgaggctattatactttcagagtgactcaatgactcatctcattcgaatatatacggagctaattaagttgtcagctaactgcccgtgtcatcatttattacttcaatgatctaacaggtccaaacgtcatggtctgataaattctttaggacttgtgttagaacaagagtaaagttttgatacttgagagcgtaacctaaccggaaccaacgttttaaatttccctcaaatttttatgatcactggctctggttggaaatgatccaacgagaggcgtacttttaattattgtctatgctatactattactacctccatcccaaaatgtttgacgccgttgatttttttaaaaatgtttgaccgttcgtcttattcaaaaaatttaagtaattattaattttttttctatcatttgatttattgttaaatatacttttatgtatacatatagttttacacatatcacaaaagtttttgaataaaacgaacggtcaaacatgtttaaaaaagtcaacagtgtcaaacatttagggaagtagggagtatatgctaagtattttcgtttgttgcaagtactaattaattatagtttcatcaaagatataattagatatataggacctgtctccgtcatccgtcgaccctagtttcgagtttaatttaatgttaaattgcacatactagtatactaccaactagctagttcatcctctaataaactttgtgcaaagaggaaagatggcagctcactgcttgcgcttgagaagcaactagattccagagagctttaacgaaatctcttggggtttgcagagaaaagtgcatgtggacatacatgtggctgttttgcacggaggatgcagggcaagtaatgaagaaattaaacatagctaatcaattaagctagctcatctgcctttcacgcttgtagatcttgtgatattggagtccggctgggagacaatgttgacaacgtccgtgcactgcaactctctttgattgctgatgactattggtactggcctgtgtagtcctacatttatcctagcagtgactgctactgctagctccctgcaactgtcctactgtttgccaaaaggaaaatttcgcattgattgataatatactctcaccgactcatcaccatcccataatatagtcatttatcccgaaatataactactactactaacatacttctccatgtacttaatcataactacatatatcttatttaatttatttgtttacttactcatctcaacaaattatacatagtctgttatttaattttattgaaaaattttagaggaggttatattttgagacaggtgaagtagttttgcagtactgctgtactagcaggaatagctaatgccatattggtaccagtttttacgagaagcagtacttgccaggagaagtgatgattaattagtggagttactgtgactaatggccgttcaagatcgatccagtcaattcatgatagtaataataatttagctaggtcccccctacatggatactcgatcgatcgatcactgcgtaaattaattaattagtagagagaagatcctgcgagcacgtacgtagaagagttttaaccagttaactactgagttttgtttgtgtggtgttaaagtgctaattagtcaaagtctcgctggcttgccataatgcatcgatgcatgtgggtcgcgtgtttggccaatcaggagctgcgaatgacgtggcattatatatatacatatatagtacaatacgttctagataatgatacggtctccaaaatacatatttgactatattttttattataatatgtacaatatatatacctttttatttttattatagtattttgtaagataaatctatactccaaactaaatatatttaaagttattgataaccatagttataaatatttaccttaaacttattcgaaatgtcgagaattatatatgatattgctgggagtactccagtataagccaagtcagccgacatccatattctatagcctctgcttttgctgacctgtcaccattttgttttttctttagtttattatcgatacaatgccggtcttaaatattaattaattatgcccagccatcgttttctacaaagaatgtagtaataagaatagtaataaatgcatgtacagtacttggggtgaaattaaacaattgtcatgcatggattcggtttgtcgtttgatagctagttttatgctgggctagaggtagatagctgctgcacttgttcttcgtcgaatcttcgtagtgaaaccagtccatcggacttgaaatcataaatcttgataggggtactcacgtttaattattctttcagtgacaggacatcgccagcgagacgctagtggtgacttcgtgaatctaaaaatttgccgcgttgtgacttcgtgaatctcaaaatatatcgacccagcctttcggaagcattaatataggagtgatgtgtacatgtgtatgttcacgtagaaatgaggtgtacatgtgtacgttcgcgggtgaatgtgcgtgttatgagtatatgtatttgtaaaatgtttttttaatataaataaataagaagtgactactcttgttgctgacgtgcatgtactgctgctgttattttaacgtattgcatgtaaagattgattcgcctaatactacctttgttttaatatatggtactgttaaattttttataaacgtttaactattcgtcttatttagaacttttatgtaaatataaaaaaataagtgatgcttaaagaacatttaacgataaatggagtcataattacatagctattttgaataagactaatgattaaacatatctaaaaagtcaacaacatcatatattaaaaatgaagggaggtcaaattaagttgtggtgacgaatgaacatgagtaatcccgcccattgatcggcatcattcatagtagggcaaattttgctacgggatattgtgacttcgcagttttagctgtaggacacggcacgaagtgacttttgggggaaaacactcctaaaggttggatatttgctggtggacaccgcacccattaaaataataatttccggttgaaaaggagagag

SEQ ID NO: 55217 - DNA, 5643 bp, Oryza sativa
gcgccggagcgcggagtgtggaggagcgccggcgcgcgaagtgaggaggcttctggcactatcacggcggctgctccgtcctagccctctcaccgccgccggcctcgcctgccgccgtcgtcgttgacacatgagatgagagataggagagctgatatgtgggcccaaggacatttttgatattcacacgatttctctctcctcttcaaccggaaattattattttaatgggtgcggtgtccaccagcaaatatcctttttcccccaaaagtcatttcgtgtcgtacgctacagctaaaaccgtgaagtcacggtgtcctgtagcaaaattttcctagtagtattatgtatggatgtttggttgtatttaatacctcctccgtttctcctccgtttcatattataagttgtttgacttttctcctagtcaaacttggttaaatttgatttaagtttatagaaaaatttagcaacatctaaaatattaaattagttttattaaatctcacattgaatatatttttgataatatgtttgttttgtgttgaaaatactaatatatttttctataaacttagtcaaaagtttgactaggaaaaattcaaacgacttataatataaaacagagggagtatttttattttcatttttttccttttagattaagatgccaatgtgtaagatagtagaaattaagatagtgtttgaccattgcatacgcacacgtatgaatgcataatgtacgtatacgagtactctagctaataaatttggccttcactattgcttactctagctcatatatttgaccttcagtattgctttgctcacgagtgttccacctacgacctaacgaccttgaacaaagtgtgaacgcctatatatgatgattaatctttgggatattatgcatcagctactttcagcagcttattctttacttcagactattatttactcccaataacgttttaaggaatatattttcaaaacaaatattctattgacttaagctatttgttaggtttgttttcatttacagttacagacaagtagatattttttgatgtttaataatcctgctgaataatctaaattaattaacaatacatatgttgtttggaacgaaatcgaggagaggacaggacactacccaacagcagatccacctcccaaacagatcaggcggtcacctggactccgtcattgccatcacttttataccgaatagctacctataaaaaaaataatcgattattaattcctccgtcccaaaataagtgtagttttgcactattcactttcaacgtttgaccgttcgtcttatttgaaatttttttatgattagtatttttattgctattagacgataaaacatgaatagtactttatgtgtgactaaatattttcaattttttcacaaaatttttaaataagacggacggtcaaacgttaggcacgaatatccacggctgcacttattttaggacggatatagtattagtcgtccagatttaatggtgatgttggctctgtcacttacacttacctagtacaccctgtgtgtgtgagagagagagagagggggggggggggggcgtgcaactgcaacggcatgcgtgtgcatggctctgcgccgcgttggatcgaatcggatcctaagctagctaggcagaagcttcctgatcttgacggatcaattagcctaggtaaaagcaaggataataataaagtcagctgcttacttatagcctatctatcagctcactcatataatggttaattctttactataaatatatgatctatatgtctgtctcatagatttttttagtttctgtgcctaagccggctgtaaacttacagcccgcttctcatctctctcctcttttctatacttgctctaagtcaggccgcccacgccttcttcactgcatgccgatcgatgccgtccatcatatccatccatcgggcttaattttggtcgaaggtgcagattaaggctgtgttaatctgtgtttagatccaaaagttgaatccaaacttatgtttaaattcaaaagttaaatctaaacttagtacttttctatcgtatcaatctgtcatacacaaataatttttcagtcacatcattctcaatttcaaccaaaatttaaactttacgctgaagtaaacacaacctaattatccactcgccgaccctagctagctactcactcgcgcgaggtgtactacgtacgtacagcctacatggagtagccagctagtaactcataaatacatactgtacgtgcataatcatacatactccctccgtcccaaaaaagacaaacactggtttccgtgtctaacatttgactgtccgtcttatttgaaaaaaatataaaaaaaataaaaagataaatcacgcataaagtattaattatgttttatcatctaacaacaatgaaaatattaattataaaaaaatttcatataagacggacagtcaaatgttggcacggaaacacagggtttgcttttttttttacggagggagtacttgtatatggccgagtttggatctaaagtttttcttcaaactttcaacttttccatcacattaaaacttccctacacacataaaattttaactttttcatcatatcgttttaattttaaccaaacttctaattttggcgtgaactaaccacacccgtagctatatgtgtatgttagcatgtatacaaatataaaatcgaatgttgtgttctaggctttctagccagcttactagcagctagatatgtaggagtatacgtcatcctatacatacgtactccggtatatatatatatatatatatatatatatttatagtaaaaaggatatagaaaaaattgttcaaagattagaggatatccaaattataggagaaattcctatgaaatattgggagaaaaatgctatcgagtgtaaaattaatataataaacccagaatatattattaagaccagcccaatagaagcaactccgaaagatatagaagaatttaagatgcatatagaagaactgctgaaactaggagcaataagagagagtagaagtccacataggtctgcagcatttatttgggcgtggaagaagaaaaaaacgaagatttcagaagactactcaaggaggaatccagaagaaggaatccagaaggacaccctataagcataaaggaacaatatagggtgcggtgaatgacatatcactgtgaagagtaaaactttcggtggaaaggcctcgactttagccagctcccgtgaagatacagtagcgaagagataagcaggaggcacaggcgacgccatccctggcctctataaaaggagacgttggccttcactccggagacacacaacaacaacaacgaagacaccattcagagcaaagcttccaagcgcgctctcaccctccattccaccgttcttagtagtagtgactttagcctaccttgcatagtatattgaagcaaggagttgtgtaataacgctgtgtaaggtaagaacagcttgcttgtacctaccttcgggtttcccgaaagggaaaaccgtatgtaagcttatctgtttaatatgaagtaattttccttaagtattcctgcacgtttgttctagacaagtgtttatgctaaggaccctataggagaaacctcttcggtttgttctcgtttttagcctgcatcttgcataggcgtctggagaattggtatccgaagagaagtgttccctttgggtggaactgcctggggagacgataaactcttagctagaacaagtgtgacttggaatatcttgttaagttgcttctaaaaagatagataggtgaggcatacggtgagtaccgagtaggactttacatcatccgaagcaagcttctgaggctgtctaaataggattcgccaccctgcaaagatcctaaagttaaaatatctctcgaagtgaacagtattgaacagtaatttaaacagtaaactgaatagtgtttttgaatagtaatcagccgaataaacagtaaactgaatagtattcagccgaataaatagtgttttgaacagtgtatattgtctgaagcataggtttgtctgaagcataggtgtggtgtatattgtctgaagcataagtgtggtatcagagcctggtaatcatagagaagctaaatttagaagctaatattggaaagttaataaataccaaagataatatcgacataaggtgtagactaagccatactgaagaacatagttggcactctaataatagccaactaaatttaattgtagatttaatatataatttctatataaattggagtaagagacaagaagatttagagcaaaagttagaagatatatataaagaacaaaagcaatttgtagaacaatattcttttcttaataataagctaaatactacattagaattattagaagattataagataaggcaaaataaaatttcacagaatagtgattatattaaagaattactagacaaaatcaactctagtaaaggtaaggaaatagttttggcttcatctggcatagtctcatcttcacaagccattaattctgaaaaatggacatatctaggagtctctttagaagaatagcaagcagagatgataactgttctgataaacaaaaaggcaaatatgatgacatagatgagctgaaagatgttgcacaagtagataagcagctcgaaagatatcaacgagatactttaagggcaataaggcctcaacaagtatactgcatgggattttttgagaataagaatgggctttatagaatatctagagaagtagaattaagtgttctaacaaagccagtagaattaaaaatagtagctaaagaatttgaaaatagtttaaaatattcaggatataagtatattcaccaaggtatgtacataataggaatcaaaggaatgacaagaaagaaattaggagctaaagtgctaataaccttattagataaaagatgggacacaataaacaaagcatctttaggctatctagaaggagatatgaatgaaaatatgttgataacctatatagcgcctgatttaatgatgcctgtaaatgaattcatagataaaatgagttttggtttccaaacaaaaggatacgaagagtttaagggaacaaatttattaataagtatagaatttataggaagattgactaatagaagtgcctccaaatacaaaatcaatgtaaatgatgtgatagaaaaaatgcattctaaaggaataaaattcatgagccctttaataatagactctgaagaaagagcaggagaaaaatggccaattagtgaatttataaaaaataaaaccttgagtcagcctgaaaacttcataagttaccaagacagcaaagggaatgttagtattagatttacaaattataaaaccagagcttcggatgatttggatgcagaatcatctgacagagatattatagataacagaagacatagtatatctgaattgatggaaaaattagaccatgaaagtgaaataaaatattatgaagataaattaagagatatagcagatgaatataataactctatgaaaagtgagtggcctaaaattagagacaaggaa

SEQ ID NO: 55218 - DNA, 1217 bp, Oryza sativa
ttatagactcattggatgaggaaggtttgcataatctagataatgcaatggaagctatggaagtagatttgggaacaggaaaaaggaaaagatacggagagggttctgtaaaaaatgaaggagaaagagaaagaccagccagggcagcaggaagatggcctccagaaaaagaagaatattcatatcattatatcccaggacagtataggcacatgggcactaaaagaagagattttgagaaaccaataaaatttcaaaatcaaaaaagtgatggggctatactaaatctagcagcacatgatcccatagactggccaaatatcattagtatttggaaggggttaatagttcaaaaatacatacaaaatcagcataatatagggaataaggtggaggatatgataacttatttagaaacatttttgggtgaatctgctaaagtcctatgggaacaatgggttgaaaagaatcctaataactatgaagagctaaaaagagcaggaagtaatcctcacaactttgaaaatatagtatctaatattatcatagctgaagacccagaattaggatatacaaccctgcaaaatgaaagattaaaagaaatagaaaaattaactttaacaagctggaaaggtataaaggaattttctcaacattatctatataatgcaacaactgctaagcaaggatacaataagggaatagttgagcgatattttaataaactacctgacccattaggtagtatgatttttgaggaatataaaaaggaaactgaaggagctgaaattaatatttcccaagccataaccttcgtgttcaaacaattaagaaaaatatgcacaggaatacaagcccaaaggtcaatgaaacattctgattataatttttgcaataaaataatacaaatacctttatcatatggagaagataggcctagaaataaaagaaaccatagatatcaaagtagaaatagcaataatataaagacaaagaaaaggtacttcttaagaagatcagataatagagcacctttcttacataaacgaaatgtaagaagatataacccaaagaaaacttatgataagacatgcagtgtttcatatgtaattcaccagatcatttaagtagaacttgcccaaataaagatcaaaaaagatattctagtacatatgaagaacaagagagagttttaattatagatagcgtaaatgaaa

SEQ ID NO: 55219 - DNA, 21048 bp, Oryza sativa
aattgatggatcagttaaattgtgaacatgattggattagaggaaaaggagattataacattaaatgtgctttttgcatctattacccaagccaagataatagagtaacctgtagtatatgcttaaaacaagcttgtgctgaatgtataaaagcaaataaacaaaaatggagaaaagagatagaattagaatcagatgaaaggatattatctagtagagtacgagttttagaaaacagaataaataaactagaagtggaactagagaatctaaaaattaactatgatattaaggcattaccagaaaataaggatatacaaaataccgaatttaaagagcaagtgataacattaaaagacagtaatactgctaaaataattcaactaaaagatgccataactaattttggaaataaatatatagtaaaactgcctttcaaagaaattttgggaataagaataccggtaaaagtaaaactatcacccaaggtatcatataaaattctagcactagtagacactgggtgtacaaaaaatattattcatgataagtacttcataaaatgtccagaaatagttcatacaattgatgataataaggcagaagtctctacagacatgtccggaataaagaaaattcataatcagctagctcataatgttgaagtatacattaatggaactaaatatataatagatgagattacaataagaaacttatccatgataagtgatgacatgataattggcctaaggtttttacaacaatcggtacaaaccacagtaatacatgagcaaggaattacttttatcccatatcaaaacaatgtgccatatatctcagaggtacgaaagcgtggtggagccagaatcaaacccgacaaccttgaagcacttaatcttgagtctgaagaaagaattaatgaatatgagcttagtgagaatatagacaactattctttctcatcatatcttccaaaatctatggaattgccaggtaagacatcatgggaagatagatatttattaaaagctactaaagattttgaatatatatgcagggaaatggcttcacagaagtctgaatggctcacaaatatgagttcatggagactgccccaactgcctagaggccatggagaacgatttaatcacaatttcagaataacagagctacaacaagggttattaaacctcttgtggcaaacaaaaaacaaaaaagaaaaagctcatgccttaaatggcctggcatattatttcaaaaatttcgtgccctcagatcaaaagataacagaaaaaagggctaaaatacaagatatccctcatcatgaggaaaggttactagattatcgcgaggagaaatcccgtgatggccaagataaacttcccatggaagttgaacaatctatggcaacagataagaataccaaggtattctcagataagattttgatctcagcagatcctgcttcgagcatggttgctttccacataaatatcaataacctattgcaatcttttccacataataaaccatcatcatccacaaaaaggcatgataccattccccaaacaccatacatactgcataatcatcctaatttattccttccacaatatatactccggacccagccaaaagcaccatgtagatcttgtgcctacaaagattcttgcaaaaagaaacttaaaagccaaaatcccatgagtactacatacgaaaatctccaacccagattaagcttcaaaacggaacaaactttatcctgctttgggcaagacatcctcgatcttgtttggcaaaagtttaaggagagacaaatgaaaatattccttggactccaagattatttctttgatctcttagaagggagagaaagaaacccagccatacgagtaatcatatatatgctccctctcttaagactagatgatcaggcaatttctgacccatcctatagattcctggttctcaaagctgagataaatcttcaaagattccggaacctacccacatacaaccatgaagaaatatctctccaaaccattatagatcatggtcttgtgaattccatatatgcaaccctcgatcagatccttcatctgatttaggaaacgctgtgaaagatgtatgcaggagacttggacatggaagatacaggattatcttctcctcaataccaccaaaattcacaccacctgttcgtccagcaattcattatatatatatcatgaagggacaatttaattttcaagaagacggtcctagcaaactatcggatgaagaggaagaaatatatacaacagttgctaatcatgaaaattggagattattttctgaagctgcagaaattgaagaagctatcaccacagattatgaatatcagctggttttccaaaacaagatcacaaggatttttatcagcaaattctacaaccaaagttatgaatacttcaagggagcagggcgcataattaaaccggattttggaaatgaatgctccaagaaaagttactacagaagcctggctcagtggtttcagaaaacagagccatcagagattgacacggtgcaatcagcaccaatgataatcaacgaagataatgaataaagatcttgtcatccccgacaaagatcactattcaagataaggaatctacactattccagataagtatggatcttggtggtcatgggcagccagatgaatagaattctttaagctaaatatgtttttcaatatatattgataatagaatatcaataatttgggcgtggaagaagaaaaaaaacgaagatttcagaagactactcaaggaggaatccagaagaaggaatccagaaggacaccctataagcataaaggaacaatatagggtgcggtgaatgacatatcactgtgaagagtaaaactttcggtgaaaaggcctcgactttagccagctcccgtgaagatacagtagcgaagagataagcaggaggcacaggcgacgccatccctggcctctataaaaggagacgttggccttcactccggagacacacaacaacaacgaagacaccattcagagcaaagcttccaagcgcgctctcaccctccattccaccgttcttagtagtagtgactttagcctaccttgcatagtatattgaagcaaggagttgtgtaataacgctgtgtaaggtaagaacagcttgcttgtacctaccttcgggtttcccgaaagggaaaaccgtatgtaagcttatctgtttaatatgaagtaattttccttaagtattcctgcacgtttgttctagacaagtgtttatgctaaggaccctataggagaaacctcttcggtttgttctcgtttttagcctgcatcttgcataggcgtctggagaatcggtatccgtagagaagtgttccctttgggtggaactgcctggggagacgataaactcttagctagaacaagtgtgacttggaatatcttgttaagttgcttctaaaaagatagataggtgaggcatacggtgagtaccgagtaggactttacatcatccgaagcaagcttctaaggctgtctaaataggattcgccaccctgcaaagatcctaaagttaaaatatctctcgaagtgaacagtaatttaaacagtaaactgaatagtgtttttgaatagtaatcagccgaataaacagtaaactgaatagtattcagccgaataaatagtgttttgaacagtgtatattgtctgaagcatatatatatatatatatatatatatatatatatatatatatatatatatatatatttatttatttatttatttatttatttatatataggacactcatatggggcaccatggtatctaatgcacaaaatcactcaaattttttaaaatttttaaattgtgagtatataactagttataataatttgattcatacctatacttatcaacaaaacaactcaaatttaactttatttcacaatccatgattacatacctaactaattatatgtatggatgctatatacctagaatcaaaatctaacaaaaataagttcaaattcagttcaaacttgctttaaactagttagtaaagtagttaatgttaatacctaagtaattgaaaaagtttcatactcatttgaattgggtatatactcaatttcaataatggtgcccgggcaccatggagcaccaaacaaatttatatatatatatatatatatatgtatatatatacatgtatacatgtatatatgtatatacatgtatatatatgtatacatgtataaatgtgtgtgtgtgtgtgtgtgacgcgaacaataaatctgacctttcgaggcagctatacatagccatatagcaatgactcatatacgcatgcatggattcaattcatggcacgcttccacactttgagctaggttagttatacaccaagtgcatttgtcaccggaagtattttggttgcgtttagatccaaagtttggatccaaacttcagtccttttccatcacatcaacctgtcatacacatacaatttttcagttacattatctccaatttcaaccaaaatccaaactttagatccaactaaacacagcctttgtacgggacgaattaatagtagcttcattgattagattacttgtggtagaacctatatatttaggttcaattattacttgtggtaggcgaccacgatggcggccttgggcgtgccaccgccccaccccccccccacacgtgcctgagggtccagcccactgggtgacaacgacacagcggcggcggcgacatgggaagcagccgggccgccattgtcctcgggggtgggaggggagggagatcgaagggtaagacgagatggccgctgcctacctctccgccacggctgccgcctacataccaagttgagtgtgtgtgtctatatatatatatatatatatatatatatatatatatatatatatatatatatatatggggcaccatggtgcccgggcacatggtatctaatgcacaaaatcactcaaatttttcaaaatttttaaattgtgagtatatacctagttataataatttgattcatacctatacttatcaacaaaacaactcaaatctaactttatttcacaatccatgattacatacctaactaattatatgtatggatgctatatacctagaatcaaaatctaacaaaaacaagttcaaattcagttcgaacttgctttaaactagttagtaaagtagttaatgttaatacctaagtaattgaaaaagtttcatactcatttgaattgggtatatactcaatttcaacaatggtgcccaggcaccatggagcaccaaacaaatttactatatatatatatatatatatatatatatacacacacacacaaagtgcatttgtcattggaagtatttttacaaggcgagcttgatttgattaggttaattgtggtagaacctataacctgggttcaattattaaacttcacacggttgtttatatttatagctaactatttttttaatgacaggtcagtgcatgtcgataggtagagatacatgctttgattttgtcaattttaaaatatgtatatgtgtttatatgggtgagtgtgcatatatacagtacacaaaagtgtttacatttggacgtagcatgttattataacaccagtataataccagtgttgaagtagtaatcatacagtaagagtattgattagtagtagtactactagtatcaattggtagtagtaggagactagggctctgttcgttctggggaggtaggggagattgtttctcttttttcgcgtgcacggttttcaaactactaaacggtgtgttttttgtaaaaaaattttatagaaaagttgctttaaaaaattatattaatccatttttaaaatttaaaatagttaatactcaattaatcatgagctaatggctcacctcgttttgcgtatctccccttctcctcaaacaaacactaggggtgcgtttgaggagaaggggattgaggagattgggaagatacgcaaaacgaggtggtgtgtttgaggagaaggggattgaggagattgggaagatacgcaaaacgaggtgagccattaattcatgattaattgagtattaactattttaaatttcaaaaatagaataatatgtttttttaagcaacttttatatagaaagtttttgcaaaaaatacaccgtttagtagtttgaaaagcgtgcgcgcgaaaaacgagacacaatctcctctgtctccccgaacgaacagagcctaggagtacatgatattgcagtcgcgtgcacgcagcttttaagcagcggcaaccgaagtactccaccgccccatcaaatatctcgtgggagagtgcatcacaaccggccacgtgtcataccacctcgagatctccatcgcaattcctagcttgtcaaacacgtagagctatcccccaccctgtcctgtccccccttctactactagcagtattttacgcggattaccaagctactcagtcagtcagcctgtctgatcacactcagaccagtcttttgcaactgcagctgacatgtgggcccacgcgcactgtggggccacactatcatcgagagagtacggctcgggagctgtacgtacgtgtttatattatgcacttcgtcctaaatcagtcgtcgttttcactttctccatgtaacatttaaccatttattttatttaaaaaatagtacaaatataaaaaaataaattatatctaaaatacttttaataataaaaaagttataaataaaataaataataattttttaatcttttgactaatatgaatgaatggttaaacgttataaattaaaaactcaagacgaaaagtattttgagacggagatattatatgttgaatattagtagtattaccgtagtagtagtactaatatacttcttcgtcccaaaaaaataaatctatagctggatgtgacatattatagcataattaatgaatgtggatagaggtatgtctagattcttaataaaaggatgtattacatcctccagtactaggttgtttttttatgggacggaaggagtactctattaatcgaaagtgtcgcgtctaaagaaaagcacttcactatttgctaaatgaggtatgtcgtgcgcgagagaaaagcatcggatttctacaaacttttcgccatagatatgcatgagataaacaatgaattcgtgattgtttagtactagtaagaaagaagagaaaaaggaaaaagatgaatgcgatggagtgtgctttggaaggataggatggcgacgaaagatgccttctccttgttgcaacatcgatcgatcagggtatagctagcttaattagatagatgtggcagtaaagtctcactagatagatagatagacacacgttcaccgatcgagtagtagtttcgtgtcacgtgtaccgtttcacgtgacatggaatcactttcaccaagctaccaacactttaatttgtttcttttttattttgggaaacactttaatttgttcatgcgtgcatgcatatatgccttcttacatatgcgtacttacgtcgtcggtctgttcggttcagaccgatgtacactccgtctcctaaaagatcattcataacatcccaagatgaaagaaaataatcaaaataccctttaattactatatattgaaagaaaaaaaagtaattgtaatatgtaggtaaagagtattgaatagataaaacttctcgtttattcccgcgtctgtactatgtttttttaacgatggaatcacattattttctgtaagattaatcacattgctaatttgtaagaatgagatatatactagggcaatttttaacgatcacgttcaatcgatccgtccatgcacatatacgcatgcatcagtaactaattgaatgcatgtcacaccagtttgtttcgtacgtatacgtatgtatgtggcttcgtatacatagacgtgtagagggatcgatacacgtatatatagctagcttctaggtccaactaatcaagtacgtacgtacgtactcgatgacaccaacatttgtttgaccttaaacattcaccacaaattaatgtctacgtatgtacgtacgtacgtatttatgtggaccatgtataaacgataaatcaatcacatcgcgcgcgcatgcatgaactacaggaaaaagattaacactagtattacgatcgagctagctagcaagagaacaaattaaaaatcgtctcgtgtcacgcacaacaagacaagttaattggtacgcaaacgtttgcttttgattttccttcgccatccatcgagagatgatcgttcgttcgtcaacttttaattgctgtccattattacgtatcgtgttgaaaaaaagagtttacatggactaattaaatacttaatctctctaagtgcctccagaaatttaaccaaattaactaaaatcaatatatatactaagctggtgtccttttcttctgaagatgaagataatgaagaagttttttacgtaaaacgaagtggtattaacgtatgattggttaagttataattattataaacttgaaaaatagattaatatgatattttagagcaactttcatataaaaaagttttcgcacgaaacgcaccgtttaacagtttgaaaagtgtgtcacacaaatcttaatcttcatcaaactcttgttggagaaaagaacggggcctaactagaagtcactataccgatgtgtggtggcacacacttgacacgcaaaaatagaaaaaaaaagaaaaaagaaccgtacgtacgtgcaggcttgacccaaccgattatgtaagcgtcatatctcgatcgttcaaaggcatagatagatgcagctagctaattgcttggagtattaacaaaatatataattaagaaattccaaaaagagatgtataaaaatggaaatcgtcatcagatggatcggacagtgaagaagcaaatcgcagcaaggaaaaggcaggattaatacgatgcgatgcatatgaatgaattccaattaattggatgcatatccacgaccaagttttaatgaggtaccaaattaaacaaggcaagcaaatcaggaagagattaaacccccccattaaccacacactatatcagtattattattaacgcgtagtaccagccgcccgcctgcctgcctgcctgcattccatttactatttaccacgtacgtgtgcaccggaattacagccgtgggccatccctgtcagcgagaaagaaaaaatcactccacgcgccgttccgttccgttccgttatgggtggctgtgctgtggctgggccgtggcgtcaccgtcacgccctgccccccgagtcgaaaaatttctaaagcaaagcagccatactactactctacctctcgggctctgctcttctcgtcttcctcttcctctccgctacgcagccgcggcgcaagtgcttcctctccacgccatcaccgacccaccaccgcgcgcatccgttcccgtccctatccgccgccggagccctagatagataccgcgtcgcggccatgctggaggagccgctcgccgccgtgctccgcggagacgggaggtaataagggaggggagggggaggggttcccgatcggcggggagctggggtgggggcatgagggcgccgcaggagcgcaccgtcagggatctctacgatcgcacgcgacacaaggatctcgcgctccccgaggtacgtcacgctcacgcgcgcaccaacccctcctccctctactgttgattcattcattcgttcatgggttgattgatgatacctcctccggttcgctggtgttgttgctggtgatgtgggtttcgtcttcccttacccgcggattagggattagggattggggattgggattggtgggggtaggctaggctatgccgattcgaggtttcgttgcgcgtgtaccgtacgaattgtttgtttggccgattagttttttttttttttcatcagggaggcgttggacgcggttttgcgataggtcaatcagaaattgatcgaatcctttgatttcatgcctcctgctatttgttttcgcatccaattaggagccaatcgcagggatttggtgggggtgtcgatgcgattttgcggctggagtttttcgagggttgcctgattgacgcgcgccttcttctgtttgtgccgttcaggaatcagtggaggggcgtggcagtggacgacgggtggaggggccggggcatcgggaagtggtcgccaagatggaggtgagcatttccagggtgtggttttctctgtatatgctgacaatattctgctgggctcagaattttgcgcctgtttgcctcatcatctcatgcccacatgagagaaaaatacgatttcaatctagattattcgtctattctaatgcgctcttggactgcatgcagtttagctgttgtgttgtggtatagatgcttggaggtgattctgatcccacaatgctgtctacaataagggtatattaatatgtcagtagtgcaactcctgcttttggcatgacttattctcgcttggaaaatggcttggcagtacttgaatgctttggcgatctttctttccttggtggattgatgtgacgctttattcatctttacttacttgatgaatgactctgatcatggttttgtgtgctgtaagagagcactggcaattatctttccttgttgtctttataacagtccattttctcgttaagtgcttgtggattgtcattcgtcgatttactttaatagctctgagtagtctaattctccaggattagcaatgtttctgataaatagtttaatcttttcattgaaaatccataaaatacctgaggtctcattgtatgcttgttatgtttatgcagttctggcagggattttttttttgattgtttatgtttcttttttttttcctaggacaagcttacagcaagaaaaagaccagtaccactcgacagtcctaatgtgaagacagaatctggcacttgtaatgtctgttgtgctccttgctcctcgtgcctacaccgaaatattgcactcacggattcaaatatggactgtggatcatctcaaacatgctttgcaaggtcagaaacaaaaaacagttcgtttgttcgtgttgataaagggctccgtaccaaggctaaggggggagaaaatgacgatgaattcagtgctacttcaagccctgcttcctattctgaaaatggtgaaaataaagtcatcgcaagatcatctgttgcagcagattccgaggttgacaagccagcaaaacgtagaaggctagtaaatcacggttctagatcacctatagtagaatgccatgatgatagcaactcatgtgttactggagtatcagcagcaagcaagcttctgttagacaagaaaaaggataaactatctacatcagcatcaagtcgtgaccttactgttaactataaggacaatggcattaacagactaagaaactactgcgccgaagaatctacaggaaagaagagatctgatgttcatgccatgcaccgaagttcatctgatagatcattgcctgccgagtctccttttgcaaccaagaggttgctgcgtacccaatcctctctcagtgcatcacatggattatctcctaagagaccaacacatgaatttgggaatgcacaaaataatttagctcaccaaccttgtgagaaagcttcttcaaacaagaccgtagagcgttcactgggaggaaaatcagatccttctgtgcttggtggtgagaggcacagcatgatgactagttgtggtaccagtaatagggataaaatcaaggctggatctttaacaaagaatctggaaaatggcacctcatgctcaagaaatggaagtctagaacatgctgacatccaatctaatgatgctgtcaataggaatgacaatgataaacaagaacgtaatcaaggttgttcaatggatacaggtagtggtagaaagttgaatacacagaatgatgtgatgacggactctgggaattcagagggcttaatagatgtaagtagtttcctgatccattctgttcattcgtgagtatactgtatactccttcaaaatgtagttcttttatactgtgtttctatgcaaaacaacgttagtttacactaggtttgatatctgtccatacaaaaaaagaattttgggtcacacttggggttgattgattgaaagtgtaacatgtaactgggatttggttggtcttggacacattttcttatcatgacacttaacatggagaggaactgtgcatatcatttgcccttttagagtatgagatgttccttatttcatttgcttcttggctggttatgccactttttcatgtgaaagatagcttgaactggtgaagtttaatgatgaagctttcacttaaaatagtcttccgtgcaatacctgaaataactaattactagcacctagcacatcccactgggtagaaaaagttcgtacatgaaggctaattcctgttcttttattgatcgaaatatggtggtaggaaattggtgttttgtttcttcactacatacaaatgttcttgtgctttcctgcatataccatcatctgattaaaatcaagactaattaaaagtttgctgcatatctgaacatatttggataataggatttatttggctctttgatttacaatgcttccctcaatctgtacagtgatgtttccattgtttcatattatttacctgtctcttttgtgttgtaccccaggttaatgtttgtgatatatgtggagatgttggaagggaatatcttctggctacatgcactaggtgccttgaaggggcagagcatacgtaagttactaaccattttctttgtattactttctaagaaatatgatgtattattatatttaacagctatttcttcacactggaacatcatgcacatattaaactagtttaccaaggatggatattattcacaccaccactcttttaagtcttgtctggcaatgacgcttgtagcctataaatgatcgaatctaggtgtatttgtatcaaatgatctattagggtgcaattctcatgatgcgttaaactaatgcttttaagctgaatgcaagtcctttccatggttttgtttgatattaatttcactggagtatataataaagaggaaaagcaagttatttgggctagcatgctggtttcattcctttgtgttttgtgcggaaaatgtatatgctgcaatatgctagcttttgaatttctgtttattgttgactagttattgcatgcgagtgaagttagagaaagttccagatggtgaatggttatgcgaagaatgctgtcttaaagaagatgaaaaccaaacaagaagcaacggtggcacatcaaggaataaggttttggacgggaagaaccaaaattcagaaagtacaaacaactctaagacattgaaggttgttgtgactgatttggacagtcaacaaatcacttgtggcactccagtaaatgatcccttggctggtagcaatcaaaagttgcatcttgcgtcatctgatctggaagcacggcaagtgaagtgtgccaccccaactgctgaaagactggatgtgaagaacaaaaattcaggaattatgggaaatcgcaagaagttgcaagttgttacatctagcttggaagcacgacaatcctcttgtaggacaccaacgtctggaagcttggataagaagaatcaaagcttagacaagaggagtcaaagttcagaagtgttgttaaaacgtaagaagttgcgagttgccactgatatggaatcacctctatcaaatgatggtgtacggagtccacctaaatcatgcaagagatatgcagaaaatactttatcctctactcccaggctcctgaaggcggacagccctaggaatcatgatgtgttctccagggagaactcatttaaaagctctaacaaaggaagtataaagtcgcctgataatgctccaatgaggtctcaagcagttaatagttccgtgaccttacctcggtcatattccttggggaacttggcaaatgttaaaacaccaggtccttcaccacgaggtttggccaaagtttattggtatataacctgaaattatttctttatttaatttgttttgtacttccgctaaccccttagcttgatcttctaggccttttatcaaagcaaccatctttcaacaactccagtaatgaaccaaaggtcaagcaattagctgaacctgtgttgagcaagttgaagccttcaaaacattcaccaagagatcctagagagtccatccggaaagttatgaaatctgggcctcttaagcatgaggcttcaatttgcaaaggctcaagttcatcaaagcaaaagcaatcagttcattcatctcaaaatgaacaaccgagaatattgaagcccgtgaaaccaacaattttgttagaaaggggggcttcatttaatcttcaaaaaccaaacatttcttcatctccaaggcctgatagttcaataaaatcaggggatccaagaaatgaccaagacagcccgaggcctggaccaagcatacttaaaagtagcaaaaaaccaggtatgttcatcattcctttagtaattattataaagaaaaatgccgtagttcggattttgacaaacttcctttatggcttatcaaaattaggaattgttgaaaataagcatagctccattttatctaaaagtgatgagcaagggattacttcaacaggagttgtttgttctaaagacacctgtgtggtgaaggcatcagatccactaatcccaatggataaaataaaaaatgatagcacagatggtgcatgtgaaagtccactaattttggtgaataacgataatgaaatgtcaactaaacctgaggtgctttccattccacgtgcttcaaagacttgtggatctgatttccaagatattgcgccaacaagttcctcagaagatttgcctccagaagaggtacagtatgaacagaaagttgtggaaagtgatgggaacatctcctgtaaaagtgcagcggcgattcaggcttccgaagaccttttgccggagagcccacaaggctgtctagtggcacaaaatccgtacagccctgacactaaatcgaatgacctgaacttaaagcagcaagctttggttgatcaatcttctactgttggaagttctttgggggctttagttattccagagcagtcttacatctggcagtatgtcctctcttattttcctctctttacccccatgtaccaatttgtgaaatgtttatgtatatattgttttatttcagaggtacctttgaggtttcaagacctggaagctctcctgaaatgtacgatgggtttcaggctcacttatctacctgtgcatcgctgaaagtacttgaaatagtgaaacaattacctcagagaattcagttggtagaagttccacggcattcctcatggccactgcaatttaaggaagtaaagccgaatgaagataacattgctctttatttctttgctaaagatgttgaaaggtaatgctcactgtttcactgatttaaattcctttaccataaataaacaagctgattcttttctgttcttcgtgcagttatgaaagagcatatgggaaactgttggaaaacatgcttgctggagatttgtccctcacagcaaatatttgtggcattgaacttctcatttttacgtctgataagctgcctgagaggactcaacgtaaggcttatcttagctaatatagtcatgttattgtttgaaaaatggctagattactaattcaatttattcaatgattatagggtggaatggcttacttttcttttggggtgtcctttatgccagaaaggcaagtagttcaactgagctgcttgtcaaagggatgaatcatagtccattagaacaaattaatggacctgttaatcaacttgtctgttcccctaagatgcctcagtctttgggcatagatttgaatgagtgccctgttgatgaattgtatgatccagctgtatcagttcaaacggagatggagaatcgtggtgcatctgtaaaccatgagactttgttgaggtccaaccatgaggctgaaaggctgaatttatgtgaaatacatttcccagaaactgcagggactgggaaaattttgttaggaactcctactgcagttccctatggagttcatgttcacacaagttcaaaacgtgaatgcctcaacattaaaccagaatatccaagtgatataataggtgcttacatcttttaattaaatgtagttactgatagagcccaatattttcttttcttgttttacatgtgtattttgttcatttcaggtagcgaaggaacagcgggcagggacaacatggaggaggaagagagctttaccaagaatggagttccatgctttactaagcagcatacaggtgcaaccaccagatcagtatctgatgagatattggcaaatacacaggcacgcgtatcctttcaagaagtatccccacagcattctgtcaggccaaagctttctgatgatccaagtgattcagttttaaaggactttgttttgcctgattctagttccatctacaaacggcaaaagacctctgagggaaaatactctacttgcagttttggagatggtcaactgactagcaaatgcttgtccaagatacccttgccagctgatcagcatacttcattagatgatgtgcaatatattggtagggttccagcagatccctgttctccaactaaaccaatcttggatcatgtgatccatgtcctatcttcagatgatgaagactccccagaacctcgtaataatctgaataagacatcactgaaggaagaagagggcccttctcctctactgtcactgtccctttctatggcctcaaagaagcataatcttaccggttctgatacaggagatgatggaccgctgtctctgtctcttgggctccctggtgtagtgactagcaaccaggctcttgagatgaagcagtttctgccagagaaacctggcatgaacacttcattgcttctctagatatttgagtgtacagttttgtgctgtgttttactttatggggtttagacagggtagtagtatggtatagctgttaaattatggaaacctttggtttatttcactgttctatgcatctggttgttgctagagatgctggtctggtgatggtattaggcttctgcattttgtgtgattatggtgttttagttcccaaacgaactggtatgacataaaggatagatcagaatgtgaagtttgataaatgcaagttttttccatgcttaaattggcacttcctctagcagggaaatccttaagaataaccgaatcagcatatctgttcaatcatctcaacaaatgtacacatctactagtctctcatcgataacagatttattcaacttattcggttaccagttctggttttgtatttttgcttatcagcttgagatgcagagatttagaaattattaaccagcttcatcttgatgtgcccgaagctctttcattttgtggtacttctctttatcctttgacatcttatagaatgcttgcatactgttggcagctcatttgtcctttttttcctgttatgtatttggaaggtgttgactgaagtcacagcatttggtatgagaagggactcgaagattcacccctaaaactttattcaagtataaggtaggtattgaaaagttcattaatgactgctaattgttatctgaccacatctttttagaggttttactttccttctaactatatagcagataataactgatttttgctactatagtggttgaaaaactcagtttgccacctggccaattgtccgtttatgtttctttcctgccattttctctgtctagcacaatttaatacgtagattctcctccctctttttcccgtatgctatatagatttcaccgttagtatttactagtttcagtttcagctgtccaggtttcccccaagcatttttcccaaactatttacgtgcaacatattaaatgtttcctctgttttgcgtttatgtcatcttaggtccctctttttcaaattagaccacagtatctaatgatgttctattcgagaatgaacagcttgtaatcacaacttcaaacgaacttgatcctcttgtgtcctttattctttgaatttcttggtcattgctgcttatagttcctatggatttttattgaagttcctgaaaatgatgagatttattgaagtactcgtttctatgtatatttcgcatgtggacatgttgggcttttgttcaaggtggtcaagcactgaagctgctggatgtcagtaggtcatggtatggactctctatacactttattgaatagcttcatgcctgtatatccattggtttctattcatcatatgtcaatactctagctgctgaaggccatgtgtggtcctgatatcttgtatatgcaagtgaatgttctcactattagcttattttttattcttattgtaatccaatctgcagtagtgtggcacagcatagctgggtgaattatgtataggaagttcgcatgttatgagatgtccttctgttatctgggcccatgatattggttcagaatagggcccccaaaattctgggtattttattttcaagctaggtgcgctgttgtttgttttcaagcattgtgcgtatgcactatgcactcttgctgtactgtttacgacagcagcttttaacgtgttgaaattacacattataaggtcttggttggttagttgatcagtttgttagagtacctatatggaccttttcagctagactatatcatgcttaggcacaaacccaagcaaaacaaatatgcaccgtttgtctaatatatgttgtataatagttggtacgaggtaccttgtcctagtgcttattgtttttgggtagtaggatgaacacgattgattttcatcagctcataaaatatgtccgtgtcccaatgcttcaacgattcatcccaacgatttgtttatttgtcttgtttctaggcttttatgcttttattcttgtatatatatatatatatatatatatatatatatatatatatatatatatatatatatataactttcagctatgatttctgattggctgcaagcagctggcaatgatttgctcgagaaaagaagagtttgcaactgtgtatacatctgtgagtatattagcatggaaagacacggacgcatattagtcggtaaggatggttcaatccttttttttcccgcgttcaactcgtacttggtggttcactagagaatctccgtttgctatacatggaataggatacctgttatatctatgtatttccaaggattattgtgttgaggctctgcgacaatattatcagatgaataccagtagccctgtgctcgtttgttaacgtatgacgcatcagtcatcctttttactttcaattttcgatgagctcttgcttgaagttggggcatcggctgcattgcactcttgctgtactgtttacgacagcagcttttaacgtgttgaaattacacattataaagttagtcggggcatcggctgcattcccccctctcccgcgcgcgcttttactctttgttgttgatgcatcatggggcagagcctgatagactctcaacaaatttgcagtcttcaaaaaaaaaaacaaatttgcaagaagcaccatttaccaccggagcgatcgtttgcatcttgacctgcctgatcggtcttcgattccctcaatatccatttaagtttcattgcgatagttccatcaaatcgaagtgtgcagacaaaattaatcattgcgaaagtgttgaaaaccttgttcggttaatccctctcgattcctttcacatggtgggattaataaccgaataagtcataaagaaaatttagcccgctaatggctcaaagaagatgaacggtccttctaacatcaactaacggcccaaagtcaataaatcatggcccacctaccccaaaatcgaaaaaaacgactactaacggtacgattcaaaatattcaggcccataaaagcccatagtcataaggttaatattttcgaatttgaggacaacgatctcaaagctaatgtttcaaatattaatggttttttattaaagggtaatacccatcaattttcaatgaacgctaacacgtaaaactaatattcacgaatattctgcccaacgataccaatgctaaattgctaatacttgtgaattttgaaaaaaaaatattgaagcttttttttctaaaggtatactcatgaattgtagagagctatagttcatgaaaatttggactgaaagctaaaaattacggatttttttatgcacaatgattccaaggctaatactcataaaattttaggttggaatagaaatattcgtgccttttttttgccaacctttcatactcaagaaagtttggtccgaggcacggaaatatagactgaaggctagaaaatcacgtaattggttttaaggttaatattaatgaattttgtacccaaagatcccatgctaatactcatgaaattttgaaaaggagaaaaatattgaagtttattttctccaaaagttgatacaaacgatttttggctgaagactataactcatgaaattttaggccaaaagttaaaaaacatggagtttttattcataaggttaatattcacaaatttgtgcacattgatcccaaggctagtactcataaattttttggaccagggaaaaggttagtagtcatgaaagtttgttcgaggctatgctcacaaaattacaagccaaaggctaaaatcacgaaatttttggtcatactgttaatactcaggaattctgttccgaatgatcccaaagctaatactcttgcaattttgggctggaga

SEQ ID NO: 55220 - DNA, 52881 bp, Oryza sativa
ctccttgctcagtatatatttcttgccactcagaacatttacgttggtgactaaaggcatggtcacccactctataattagtgaagcaattaatagaataaggcacggtttgattagcaattcatgtatgaaacaacacagtttcatgacatcaacttcagaatactgggaaaataaacgaaactcaaccttcacctttgagtacatgtttgatgcagtaacaaattaatatagttttacaacaaaaccattagacccaataggtcaaattctgatgcaatagacttgctgaacagaactaagatttgttgtttgcataagtaaataaaatgtctgtagagaaccatgtttgtatttctacaagtgtcttggagcatagcaatatgatgaagtttattttgaaacattatcaatattttcaggatggtgtagcggccttgaaaaatatattgcggtgtacctgaaaaaaatatgccaaactcaatactattagaaaagactatggattggttacattttttcccttcaaataacataatgctgcaagcaatttactgggttaatctgttttgcctcggtttcccttctttttattagtatttttttatctcacaaagtgtacatgaatctttaaattctactacatttcaatataaatattccgaagcaacccgcgcaggatatcatctagttttaagtggtggaagcataagtaaaggtctggtcaaggatgaaactgaatacttgttccactgctgatgcattccaatatcatgtgcgtctcaattcttaacagaaagctattctacactatacagtttactctagacagctcagcaggagtcatcagtcttgaacttttttgatatcaagtgccacctagtcaacttaaatgaccttggaatccaactattcgcatccttcccagtaaccatgacgtgactcaaggggtatacatcatcgtggccacgttgttaactctttttaatgaaagaagcatgttgttacttgtattctagatttgccaaaggccgataaaccaggcctctcaatttctaaaatatagagcagatgcaaaaactataactcttgacaattggcacgctaagtcaaattaagccataaggggaagaaaaaggcacaaaatgcacaaattaagttatgtgactgaattactaaaacaagtacagcaaaaaaccttatggagcttcagggactaatctgcgcagctggtttttttgctttctgaatagtttcaccttccttgtatctcttgactcttcctgctaagcaagaaaatattaccacaataatatcagtaaataaaaatgtgttacatatattatccattacagattatatatacatgaacgcaatatattcaggtttggcacattagcatgatggatatgatcaagaacaagggtcagtttttcccccacagtaaccagaatgaggcacaaactgacattgtcgccacttctcacttctaatacaagagcaaagagcagtaactagaatataaccatataatacttgctgtaagacagtttttaatatggaagcagtaacatgctatcatacaaatgaagttacacacagaaatgaatcttaataggtcttgcataactagaaatggaccttacatgacaaaattacatatatacacaccaaaaaaaagggacaaaaaaaacaagaggaaccaaattatccacgtttcctttctttgcagacctgagtaattcacaacatacatacagatgatgaaatgcttcagttatactggcaatcccacttcttggttctttttgcaacaaccaaacagcgagaagagccaggtccagaagcttccccgatctgttttcttctggtttgttcctcttgcagcattcaaatcattcatatacttgaccacagcctggcatgcagaagaaacattgttaatcatttaaagaaagcgaaggactaagtaagcaaatatggcagaacggcagtataatgtgtacctgagcccctaactttacaacttctcttggtggaaattcaagtggagtctcatcagcatgaaatacacgtagcctcgaaagacacctgaacgaatctggcagtacccgtatctggttactgcttatgtccagctcctctagcatctcaagatttcctattgatttcggcagtgctcttaagtctgcaaaattcctgctgagattcaacttcacaagacttgtcgcaaagcaaatgttctcagggattacttcaacctcattaaaactgacatccagctctctcaatctggaaagtgaacccactgttgtaggcaatcctttgattctgttatagtgcaatgtcagtatttccagcttctccaacttcccaatggcctctggaagggcttttaactgattgaaatccaacctaagctccacaagagatgtgcaagatccaatagtatagggtagctcctcaagctcatttgtctcaacaattaatcttctcaagtttgccaattttcctaaacaatctggaagagccttcaacatatttgagctcaggtcaaggtttgctaggctcgtgagatttccaaatgatgaaggaagagacttaagctggttggcatgcaggtcaagatcaattaggttggagagttccccaaacgcgtcgggcagattgatcagctgatttgagtgtaggtcaagctttgtcaaatatctaaggctgccaattgttgatgggagtgccatgatcctattctcggaaagatcaagctcggtaacatcttgcaatttgccgagtgaaacagggagccactcgatctggtcgaccagtttcccccggaggctgagttctgtgatccctttctttgctgatgactctatcaggcttgccacttggataaggctcaatttttccatgtcagtacctgcagggatattgacaagtggaacttaggataacacaagtactgacatctcaaaaatgctgatcacatttatggtaccgttacaaatttgatgatcactacttgcctaagcatgattaaggcctacattagatagcacctccaaagtcaacaaagcaaaatgactaattgctcatgattcatatcgtattcagacaaataattatgctattgcctaactggtaacaaatgaattaacaatatcagatcaccaggcacaagagacaaatgatacaccaggtccagcagtgaccaacaagggaatggtcctccaactaccgcaagaaaattaaaaattaaagctgggaccaacaaacgactaatgcattatgtcaagaaaaaagaaatcacaaaatagcacgaaattcctttgaagaaatggatgtgatgtgacaattggctgcagaggtggttgttcacatcaaacgctaactcatagcgaaaggtgaaaaatcagttgcggtacactggtaccttgtagacatcaatcgtgtaatttgctaaaccaacaagcagaaatacagaatcatcacaaactacgagaccgctcctctatgtttccaattatagtactagtgaaacaagaataggcaatttataaacagtgtgcaattaaatggcaactagttgaagaaaatcaaagcaacactaacaaatcagtacgccattacgtcagttgacaattatttctagtgattctttctatataaaaggtagcaaccacatcgtaatggaaatattacgcccatatgcatgacatgagcatccaattcgtgcaaggtagtgaaatttaaccggaaaaaaaaacagatactgcaaaattatgtcgggtccatagaacacggcagcatcgaaaccatcacacatggatatatagtagtacaaagatttttaggatttcgtgattccgacaaaataatactgtacttgaaagcaaattacctgcagagacatcacggcgtagcgaggagatgggcttggactccaagcccagggcagcgagacccttgcttccgcgctccatctccgcgacggcggccgcggccgcaaccgccgcctccttcttcctcagctccatctccaggtccacgctgtccgcaccaacaccaacgtatccatcgccggtggttccccctcccgcttcggcggcgtcggaggaggaggagaccacccgcgacgccctctggatcaaatcgtcgaacaccttgaagcgcctctcgagctcgacgacgtacgcggcctccttccgctgctgcagcgcgcggagccgcacggcgttgcgcctggcctcccgcagcacggcgaggagctccccgtcggcccgccccggcgccgccgccgacgaggacgctgaggccgaggcctcctcccgcgccacctcatcgaggcgcgccgcctcctccgcgtcggccgaggccagcacggcctccgccgcctccacctcctcgacggcggggcgcggcgggagctcccggtacagcctcgtgagctcctccaccgcctccgccgccgacgccatggcgcgtcgcgtgccctcgatcgaggagagagaaaacgacgagagatgagagagagagagagagagaggagtgggttggtaataaatgagatgagatgcggtgcaactgcaagtgggagtggagttgaggagtccgccttataaaaacagcaaaccagagggtccctcccggttgcgaagaaaaagtcttctcggtataaggagggtggggttgagattgggaaggaagtagagggggtaaagcgcaaaatgggctaggcggctgggtggggcccacgggatgagctggcaacgcatcgggatgtgtcaggtaggatctggaacgaccaccttttcccaagattacccaccatgtggtcaccgctgtgtccgactgtacagtactctctccatccacaaaattatccatattacttttgtcaccaagaccaagaaaaaattaaatcacattgaatgttacaaaatcaaggagtaaatgcaagcatacaaccaatgagtatttagatgactccttgagttctaataaaacatttaatttatcttttcatttaaatcttaaatgtataaagactataaatagaaacaacttatttggaaaaacttaaatgtgaaatatgtataacttttgtggacgagggagtatattgcaggagtaattcccaagtcccaacccaaattactgtaattaattgatgtaggaatagtttaattattgacctactagtacgggtagaggtatcagagcaagtttaatagtatagccaactactagctctaattcatctataactaatctaatagctcattcataatagttatatactatgctattaatacctggtctcacctgtcatacacacactgtgtcttagagtccgtgctacaactggctataaatctgtagctcgctgctcttctctctcttcatttatctcttagggcctctttgaattgcagagtagaaaaaacgaaggaataggaaaaacacaggattctgacaggaattgaagtgtaaaacaaagaattgcaaaacacaggaaaaacataggaatggtcgtttgattggagcgtaagaaaacgcaggaatctctaatcggatgagagagatagactcaaaggaaattttccaagaggttagagctcttgctaaatttcctccaaaatccacatgcaatgtgccattccataggaatttcataggatttggaaagcttcaatcctttgaatcaaagggccaaatatgaaaatttcccataggatttgaatcctatgaaattcctacataaatcctttgattcaaagaaccccttaaaatatatttacagctggcttatagcttgctattgtacctgccctcacgagtttacccaaggctgcgtgctctacaggggagtactcctattccgctagagtagattgtattactcctagagtgccttcgtttactagagtggattaaattagtgacgtaggttagattagtggacgaggaaactctgttggagtttgtcccatgttcttttctgtctatcaacttgtgctacgtcagcaatgctaaacatgggcttatatatagtacatcacaccacggggacagggtcggcatatataggacaagctaagctgtttgggttcgttggtgcgaccaaccccttcacataaacgacgaccacaggccggttttgccagatgggaggtaacgggataattcactacccaaatacaagcccgtttgtgatttatttcctacttagtattattaatcactaagataaaaataatctttattgtaatagatggaaaagtaatccacttcatttgctccacttatatagttctagcagtgacgaacacagctcctgggcagatcggatggctgcccgggctccgtcactgtcgtcttcattatcgttagccgttgatacgtaaagaaaaaaaaaatcgatcactactagtcatccgaactttacgacgatgctatctccatcactgatgagttgcagtttttatctagggttggtgtgtaaaggaacggtaagagtggaatctatgaccatggggaatgtaaccaaccgatcaaagtcgatggttggttagttgcgtggaattccggccatgcaagcgagagtagctacgctggctgcaggaaattaaagaggaagaggcagcatcagccatcatgcatttgacagcatcgacgatgcagtgtcaaagttggcaatgtagggggagcgagcatcccttttactactatctcaaatgtcattatcaatgtgcggaatccgacgataacgaataatgccggccggaaatgaatggagtacacgcacagtgcagagttactttcgagtcgatcataaaagtagtagtaattaaattataaaaactataaacatatagcatgtttgtactttaaatgtgatgattgttagtgaatgatgatgtggcatctttgtatgttaagcttaaggagtcagtggagaataactttatactaagcttgtcagtggatgatgatatgtcatctttacatattaagcttaagaagttagtgtagataactttataataggatacactatacttggtaggagtacgatagaaaaaaatgattatgggcgatgatttgtaaaaaagggatagagattaatggagatgcgggggatcgaaccccgtgcctctcgcatgcaaagcgagcgctctaccatttgagctacatccccgattttgtttacttctctgtatcacaatttataacaggttcatgtctattaacttatcttgccgttaatacgcaaacaagcggcggaggcccattggattggatcgttagtggacacaacctaaaataatcgtcttcggattagtcaagccgagcagcaaccagcaaataattcaacttatcctaccctagcttgcactaccatatgtactagtttaatcgatcggacagtcgtgcatatatatatgagtattcgatatgagcaacagcataatacagatgcgagttatccacccactagcaagaatcaacctaacgtacgtgcagtacgctttcctcccactagtctataatagtgtactctacttcctcggtctaaaaaatatagtacaacaaatttatataaaggccccgtttaaatcccctgtcaaaaatttttactctgccacatcgaatgtttactacagtaaatatttattaataacggattaattaggtttaataaatttgcctcacagtttacaggcggattctgtaatttattttgttattagtctacgtttaatacttcaaatatgtgtctatatatctgatatgacacgccgaaactttacatccctagatctaaacacaatcaaagttatgtatatccatatttgtattaataggatgtgtcgcatctagacatagttggtttttttacggacgggagtacatgcaagttactatctatcacgtactaccatggagttcgtacgacccaaaaacacgcaaaagtatacaacaattacttccaattttctcgagagaacatctagatggatgcgacatgcatgagacgtgagggatggattatggatagcccctgcctggccccctgtcttgattgatgagcatacatcgtcagcatgcatgattggagaagatgctagaacgtgatcccctgggaggtacatcttccgtcttcaaaataagtctacttctaagtttaaatttgaatataatatatgttcagatttaaattcagaatttcaaaaatgatttttctatacggagggagtacagtatagtgtaaatttgagcgatttaacggcatgctgcgatggcagcctcagcctccagtggctgcgctagccgacggacaattaatttgcccttctagaatcaacccttgtcaaatgggggcaatccgtcccttaattaatagctgcttaattaatttggtgattaaaaactgccgtttttgctgcttaaaattcatcttcttctagaatagaatactgccggcgccgccacatagagtactactagtacgtgctagccaggggaggctgttttgaaacttcgtccaagtcaccaaatggatcaaacttcttttaatggctttttccagcacagcaaacaactgctactatgcacagctcaaggtactcctcctatgcacagctaaaggtactctgtaccactagatctcagcatatctgtaatgtcgttgcagattggaacagcaacccaggtggtagagcaagcaaagtcgttggtatcgaacgaacacacgcacgtgccagcaatttttcccagcttctattgtcagcagccaagtgcacgccttgttaccggtcttgggcctccagtccagtccagtccagcagtaatagcggcccatctatctttcgacattccttccttgcatcccagatgcagcacatagcagagaattaaagttagcaatctggattccaaagttgcaaagtatttgggctgccgatctggaaattcagatggaaaatcaaagcacaaccacaacgccggcctttgcattccaagtccaacttgcacacagacacctgacaagtgacaaccgccaacatttcacaggtgtgcttgtgcaatatactgtatatgccacctggcataatgtcaaccactagaaggcaaaagacgacctgacggctgctccaatgtcaagcactgcagctgccaaaaaaaaaaaaaaaaaaacaactataccttcgtgagcttaacctccgcacaagtccttctcaagagaaccggccatgggccgacgattgtcgtccaatcaaggcacacgagcggcttgccaacttctttaggtctttcccaacttccatgtgacttcattcaataatggtccacagcagcgcaaagtcaaggcctcatccttgccttcaccttgtgtgagcatatataatatatcagactcaggaaaagaagtccctgccttcaccttgtgtgagcaatatatcagagtcaggaaaagaatgaaaaatatgtatcgtcttatgacttgtgagttgctcaacatagagaaaatattgtcctctcagttcctgatttttgggacaccttgcaccacctgcctgcagcaagttgaataaatctcagtccaaaacaagcggaatggccttaaagtgagggcaaggtttggaaagagctgcagtattataagtgtaggagttatgtaaaagggatcaaaatgttcattcaagaatacctctgaacaaactgaacaagctaaggtagagttaaaagaaggttgccaaagcagaaatattgcatagttggatgcaccaaactgatgtgcatcgagtcatcgaccaaactaggatcttcaatgttatgcataatcttcttaggcagaatagaagctaagaataaacagcattgataagcaaagcagtttatttgattaaccatttcagtatgctggacaaaacaggtcactggatcaacatttctagtttccagaaaatatcggtctatgacattagttagcctgtatttcttgttaaggaccagtaggttttacagaaaagctccacagcagccagcttatttgataatcctttacaagactaatgagatataactattaatccaatcgaaataccatcagatatcttcaccaccttacaaactcaaaaatttaaacaaaatcctcaattaactattgataattttatatttgaataaggaaagagaaaccatgacaaggttagatcttttttggcaatcttttgtacatagaatcagaccactcaactgtatcaaaatggtactgcaagtgatcaatgcaatcaatgggtgtctttcattgatatagtttgtgaattgtttgtaaagatttcacaaaatatatacaagcaagctatcaatttttttccctatcacatgcaaaggaccatctatcactttaaaggctatacacgatagcaacattcgagaaagcacacgaggctccttttttgcaacatagttgaattacaaaagttaagtgcgtatatggtttcttctattattgcaggacagaactcatataaaataaccttatgtggggaggagcatcacttgcttcgagcatttggtaccacctattttgcattgccatcttgtaagaaacctcagcatccaccaagagtttcaggccgcaccaatggcttgtgctccagatcccagcaataacaagaatagctcgtcgattcttcatcagcaagtgaagaaaattagcaggattcctttttcatggggagcacatgcatggggtataggaagagaagatccaagaagggctattcatgctctcaaggttgggacagcactcacactggtctcactcctgtacatacttgaaccgttgttcaagggagtgggaaagaatgcaatgtgggctgtgatgaccgttgttgttgtgcttgaatttactgcaggtaacgtgcataatccattagcatcaggataataataataatatgtgttcttcccagatgtagcttttcttgttccaaataagtgattaccgaaattcatgttcctcacaagtgactgctgaacaacaggtgcaactatatgcaaagggctgaatagagggttaggaacaatcttggcaggatctctagcatttataattgaacttgtagcagtacgatctggaaaagtattccgggctctgtttgttggatcatcagtctttctgataggtacgcaccttgtaaagttctttcttttttttttactgcaagatcatagcttattgtgttggctttgtttccttgacaggatttgctgcaacatatttgagattcttcccatccattaagaagaactatgattatggggtcgtgattttcctgctaactttcaatctataacagtatcaagcttccgtcaagaggatgtggtgcctttagcacgagatcgcttaagtactattgcgataggttgtgcaatatgcctattcatgagtctttttgtattgccaaactggtctggagaagacctccacagttctacagtacgcaaatttgaaggattagcaagatcaattgaaggtgggtaaatagtagataggagcacttatatgttgcatcttaaataataagagcataggtgcataacaagtatcaagaaccttaccaaagaatgattgcagcttgtgttactgagtatttccaagatcaagacaaggatgataaaattcttgataagcaggcatcaagagcttccattcacattggttatagagcagtccttgactcaaaatcaagtgatgaaaccctagtaaggaactatccttttgatgatacatttttttccttttctcttgcaatctctctctataaagtgatgatgtgcagattacatactgatttcaatattggtaccaaatcgaccaggcacactatgcaagctgggagccaagacattcaatgcaatgttacagttatccatggcaaaagtatgtgaagattggatctgttcttaggcactttgcatatactgtcgcagcacttgatggatgtctagaatctgagattcaggtaactgcatcagcccaatttctcgtgcatcatcctgttgtatatccttagcaactgacatataaacatgaatatgatgtataatttcaatcaagaaaattctccttgaatgaactgttctgacatggttgtctctattgatgttgaagactccaccatccgtcaggtcactattccgaaacccatgtactagagttgcacgagaagtggtcaaggttttacaagagcttgcagtaagcataagagatcatcatcgttgtgcccctgatgtgctgtctgatcatcttcatgaagcactacaggatctaaactcggctataagatcacagccacggctctttctcggctccaaacatgcatgtgcaaatagtcatgtgctgatggaattaaattctagcaagcatacagccacaagaactactctaccatcattcaagactgatggcacatccctattagaaaggaggaatacaaaagcagaccaaccatcagaacggaatgagcggggcacattaaggccaacactaagtaagatagccatgacaagccttgagttctcagaagcacttccattcgctgcgtttgcttcattgttggtagaaatggtagttcggctggagatggttattgaagaagtgaaggaactggagagagcagcaaattttagagaattcactggacatgactatctgaccattgatcttacttccaatgacaagatgagaaacccaaatggcgtaccattagacagccacacaatttccactgcagctgagtaagtactgaataatagatcaaatcagtagatgatcactctgaagcagatatgtatttctttttggactaagaaaatatggcctgtgaggctgtgattcccaataaatgttgttagaatgacaactcataaaaaaacaatattaaacctacaggatgtttatcggagttggatgatgtaaaaaaaatttcagcagaaagtactcatgcttttccccagaatccagtaggtcatgcctttgttttctgaataaacccttctctgatgcatgacatgttctactacgcacttgaatgatcatgagattcatgaaacaatttccttcctaacatctggagcacagtctaaggtataacggccaagtcttcctgttcgatagaggttgagtaatttcatagcaacaagtttacgcacatcctcacttagatcagcagaaaccctgaaagcctcctgcaaggctataaactggcattctatcaaactctttaattcattctcattttctaaataccccttaaaagatgatatactatcaaaaagcacttggcgaacagccttcacaacaaaatcctgcaaaaatacaaaacagtagttactattctatccatgtgatgcctaaaatgtgacctcaaaaggatctaaatgagatatgatcattgcctttcagtaataataaaaatctgcatgatgatgggtacaagactgaattgtgctctatggaatatcttgacgcgcttacttgggtatgatctgaagcatattgccttttattatggtgactgctggatgacattgcatggctgaaagaaggcatatctcctgcttgattcatgttctcccacttcttgtatgtctcccttgagttcaaaattgcaagcagaaattgggcaatctcaaactcctgcatcatggaatccttgattgctcctgtaatgaagtttgcatacatcagtaacaacttatagtcacaagtcaagccatggattaccattgtagctggtacctgtcaaagctagtagaggaccagactcgtcattaaaaaatacaggagacaaaacaccaggagtgtctaatacatatatatttggatgactagcaacctgaaaaataagaagtttgaatcttgttaagatttggaatggcacttggcaattagatagccatacaaggtgatgataacagcttctaaaagatggtgttcacaacaaaatacaggcaccagagctatttccgcactcagcattgctgtctctttatgaagaaaatataggtgctatgcgatttagagttgcccaggtaattaatttgttacaatgtccataaggaatacaaagacccctctatccatttcctctaaaaaactaaggtgttatgacagtcatgcagcatggtcttatttccctcattctgctgggtcgaacagaagcaatgcattatatcgaatcaaattaccttgtaaccacttatgtccttggtttctcctggatggctgctcacaatggcatgcttgagctttcccttctcttaaagacagagcaacgaatattacacagttgtgtgaatcacagttagtgcaactacagtatcaacagtaataagctgcctcacctgctgccccaatcctcccaattcgatgcatggcattgacgattgctgacttcccaacattaggaataccgaccaagaggacggttccagtgcaatcgctctcaccaagtttaatctccctgatctttgcccgcacagcattcaacagctatttcacagttaaattagcacccaatcaaatcagccgctaatgtaatcaacaggtaagaacactagaaacagcattacctacctccttgatgccctccctgctgtgcgaattaagagcgacgcaggagcagctcgtttgcttcatgtacgccatccacttctggagaacaccaacaccaatacgaacaacgctcgcgtgtgtgtatcagatcagaactgatcacttacccatctcggggcagtcaaaatctgctctagttacagatgagggttgggattagggttacctcggtttgagaggggtccgcgaggtcggccttgttgagcacgacgaggcggcggcggtcgggctccggggagcggcggcggagtggcgcgaacgccgaggcggcgggtacctgcggggttagactcagcaagcaagcgcatggggggaaaacgatgcttgactctgtctggagcagcggaagacaatagagaggaggtggagagcagtgggcgccatacccgggcgtcgcggacctcgaggacgaggtcgacgagggggaggcggctgcggatggcgcggtcggcggcggccatgtggcggccgtaccaggcgccggagagcccccgaacggcatcgctcaggcggcgcgagaaggcctccgtcgccgccgccattgctgacgtgagccaaaggcatagagacaaggaataagtccactttgactcccttaaaagtggcccaaatctaatccatggcccttaaccgcaaaaccggatatctcgaccctcaaactattgaaaccggtgcaatttgactcccttggtggttttagatggcggtttcgctgacgtagcaatattgacctaggatgtgggttgacgtggcgctcaggtggcatttgaattaaaaacgcatacgtgggacccgtttgtcattcacacatattaaaaattgtggggcccactgacatgtgggcccacatgtcatctcctccctctcttcttcctcccctcttgacctggaatgatggtagagagcagtcacgcgaatccatccgtcagctcacgatcgaacgcctttgcgtggagctgcacgtccggctgcttcgctcctttgttatctgggcctaggcccaacaagcacaccatcgtcagcccgttgctcccctttttggcgccgtcttttcctttttggcgcgaatcccatctgcttttcccgcgagtgaacgtgaggcgtcggcaagagggtgaggcgatcggcttctccgtggagcacgagggtgaggcgatcagctgcagtaaaaacagagaaaacaagatcatgctcgcaggtttgcacagtcttcatgtgtgtgtgtttagattgcaacaatcttcttctaatttgtttgccatcctctcctatgttagcctgtgtggaaatagtttaacgaaacatcaacttgcgattcatcaaaaaatagaagcaggatatatgagatggaagaaaagaggtgtgtaacccatgcttgtttctttctcccaattaggggtgaaaacggtaacggtaattaccggccgaccggcgttcgtttttgactttctaccggccgagccatatggaaatggtaatcgaccgaaacaaaaatggaaatggtaaaaaatatggaaatgaaaacggaaatggttttgctgttataccgatcgtttccgtatttaccgtattctcgcggaaattaccgtttcttataatatggtaattaccgtattctaaatatgtcgatattataggacatgtctatacttgacccacagcttatagattgaatgactcttcaataaaatctctaacttttgtacatggctaaaatgaagttaatttataatttatatagtataagcttgaatttatgtatatatatataacatacttatgtaaagttaaatatatgtttttatagtttaatgtttccgtatttgttaccggtttccgatctgtaccgacatgtttccgtccatattgttccgtttccgattttccgatatttccgatatcgttttcgtttccgactttaccgtttccgatttcgtttccgagaaaaatatggttacggaaatggttgaggctgttttccgatcgtttccgaccgttttcatccctactcccaatgcgtacagatatattttagttgcttatcataccaccatcaaattaaatattttgtttgctgtagggatgggttttcccctagtttgttacctcaagttggcatggaattcagcagtacagatgaggcttggatgttttggaatagctatggaggtcagaaagggtttgaggtgagaaaacggtacacaaacaaaagaaaatcagatgggaaggttaggtcctgcagatatgtttgtgcaaatgaaggccatagaaaggaagataaaagggatcatctaacaaagtgtcctacagctgaaactagaaccgattgtcaagttcgcatgggtgttgtactagatctagagaaggggaattataaagtggctgatcttgttttggaacacaatcacatccttcagttgccagaaacctcgcacttgatggtgtctcaaagaaaaatttcagagttacaaggttttgaaattgagacagccgacgatgcgggaattgggcccaaagcagcacatgagttggctagtatccaagttggtggctcacttaatctcagatacactcttcgtgagcacaagaattatttacggggcaagcgccaacgagagatggcatatggtcaagcaggaagcatgctcatgtattttcaagataaaattgcagagaacccgtcgttccaatatgcattgcagatggatcaggaggaacaaatagcaaacatattttgggttgatgctaaaatgctcactgactatgcatattttggtgatgttgttagttttgatactacttttggaacaaacaaggaaagtaggctttttggtgtatttgttgggttcaatcagttcagggaaacaatagtttttggtgctgttctcatgtacgatgagacatatgagtccttcaagtggttattcgagacctttctaaaagcacataatggcaagcaacctaaaacaatctatactgatcaagattttgcaatgggaaaagcagttaaggaagtattttcagaagtatggcatggtctgtgcactttccatattatgcagaatgctgccaagcatctagctgaagtcgacaataaagaggaatccagtacttctcccgaacagatagttgaagacaatgagaaagaaccaagtattctcgcagattttagtgcatgcatgtttgagtacgaagatgaggaaacatttgaacaagcatttaacaccataagggcaaaagcgagcaagcaaagttggttggatagtatatacagggttaaagaaaaatgggctgaatgttacatgaaggatgtgtttgcattaggtatgagaagtacacaattgagtgagagtctaaatagtgaactgaagaggcatttcaaatctgattttgatatcatttgatttcttaagcattttgaaagggtggtggaagataagaggaaaaatgagctaaatgctgaatttgaataaaggaagaaaatacccagaatcaaaatgaggacacctatgctaatccaagctagcaagctgtacacaccaattatattcgaagcttttcaaggtgagtatgaaagatccatggtagcatgtagcacggcattggaaggcaaaaattgctatcttgtggcaattggcagtcttgaaaattgtacctttgagaaggagtacaatgtttttggtgatcctttagagcaaactagtacatgcagctgtaggatgttcagtagaactggaatatttgtgtagccatgctttaaaagtccttgatctgatgaatatcaaatctctcccaacacaatatgtactgaagagatggacacgtggagcacgtagtgggacagtacaagacaaccatgggcgaaatataatagagaacccaagattaaatgagatgcttcgctacaaagatatgacccgcaaatttctcaatttggcacttagagctgccagccatctagagtctaccttattagtaaacaacacactggacatccttagcaagtaagttgaagaagaaatcaatgcatgcactgatactatggttccggtcactgctcccacaaatgttactcctccaattgatttggtgagtacagcatgcctaaagaaaaaggaggtgcaaacaaaaagctcaaagcggaaaagaaattggcttgataagatgcacaagtccacagagaaaggaagtaagaagggaggtaagaaaaaggaaaaaggatcaaaggtatgtgattacataaaatgtatttgattctcttttactgtgctcagtgggaacatgttcagtttatttttcttttatttgaaggaacaaggaactataaagaagggagggaaaaaaaaggaaaaagaagcaacggtacaagacagtgcagcggtgcaaaatatttatcctaatacttctttgcccatggaagaattgtctgaaccatacatggccatcaataccttctctcagatattgacggtaatatttcaaactaacacaccatttttctataccatagatggccatcaatacattctctcaattgtttttctgaaccttttattttacaggggccaattacagatgatgttttggctgatttctagtagcatggacagttgctgcaatctgaaatataacagattgtttagggggatagcttttgcttttgtcgaagtgtaaagttcagggaattgcagaattgcatttctgaatagcagagcattttgtgcatctctgaacttgcaacattcagaattaccttttattcaattccaaacaatttacaacacaatgacaatcacaagttacagtcttgctagctctagcacaaatgtcacttcacaagcaagacaaccttcctctgttactcactgaaaatttcagacatagcacacgatgaataaaacacactggaaatttcagatatatcgactccaatcactgctatcctacagacatcattttcagatatgtcgactccaatccctgctatcgtacagacatcttctagcttaattggaatcacggctgtggcaaccctccagcgggtcctatccattctgagacatgctacaattgttgcgctgcctgacgaggccatgctgctgcagcagaagctgtaccgcggcgtgcggggcagccgcagtggggcaagtgggtggcgtagatccggctgccgcagaaccgggtgcgcgtctggctcggcacctacgactcggcgacggagtagcgctcggcgaggacggcgacggagcagcgctcggcgggatggcgcggcgctgctctcggcgaggacggcgccgctctaggtgacgacggcgacgggacggtcctccatcctcgactgcaagtccggatgacgtggtggcagtgaaccctttccttatccatagaagcacttgttgggccgagccgctgaggcccagtgtctgagaggagtagcgttagatccatcgttcgattgcgggtggacgatgggattcgcgtgactgctctctaccatcattccaggtgaagtcagacgatctgattccctttctttctctttctcttctcgccccttcggccggccgcgggggtcacaggacaggctgcagtggtggcgggcgggggcagagcggcggcggcgagctcaccttccacgacgaccgcgtcgacctgcctcgccatgacggcgcgcgctggtcaccgcccaacgccccagcgctgtccgtggcgcgtaccgcgcaggccaacggcatgtggttgtggagctcaggggcgtgttccgcatcgtggccagcgcggtgcccatcatgagggaggagtcgcgccgtcgcgcgtccacaactacggcgtcaccgacgacgactgcctcgtccacctcgacctcggcttcaagttcgaggcgctcaccgacgacgtccatggcgtgctcggccagacttcccttcatctatctactctactgatttcatttgatgatgattacccatttaccctcatgagttactgactgacatggacgaaaattttataggacaacttctcgaatgcctccactaattgccaattagcagggcagataatctccccaacaaccaacacaatcatgatgcactgatacacggtctgaagctgcatggactggaccgccggcgactccttctccggagcggcgtagcgcctccgcctccgcgcgattccggcaaccgcggagtccttcgcctacactcgccgcatttcatgccctaggaggctgccgtctcggccccccatggccggaaccctccacgaccccaactccgggtcaggaggcgaaaagcggcgcccactcctactactactcccgtggtcacgctgttcgcccagtacgtagccgactcctcctccacattgcaatccgccgccgccgctctgtcccccacccaccgccgctgtagcctatttcccccgcggccggccgtaaggggagagaagagaaagagaaagaaagaggggaggaagaagaaagagagagggaggggatgacatgtggggcacacatgtcagtgggccctacaattttcaatatgtgtgaatgacaaacgggtcccacgcagtggcgggcccaggtttttgaacttgtgtattcgaaatgagaaggggtaaaaaaaattgttcatacacctaaaagcctaaacatatcaaagtgccaacataataacatatgaaatacaaaaatgaaagaaaatgataaattaggaagaaatcttacaatttagagattaacttttcgacgcttgatattttgaaaataatcgatgatgtccttgtccttagcttgcaaattgaaatttttttaatgaagccccatcttgtttctccaaaaaagagtttaaatcaacagctggcccttcttcttcatgtttcagttctgaaaattaaacaaatttgataatatggtatgaactatgaactaccgtccagtgtccactagaccactacaaactaagcaagcaagtacattctcactaaatcagtgaattgcagctcccaatcctaaaattttcactacatttattcaaatttgtgtactcactaaatcagtgaattgcagctcccaatcctaaaatcttcactacatttattcaaattttgtgcatgtacagatttagtcactcactgtgttgtcactgttgtgctgctcctgtcctgcgcggcttgctgttgctgtcctgctcctgcttctgcggtcctgccctgcgcggctgagccggtcagccggccaggccaggtgccggcagccctcagtggcgcagccgcctaccgccctgcgcccggcgcggcgccccacatcccacgaccacgagcacgagggcacgagtcgcgcggccgggccggcgccacaagccccgcctgctcggcggcgcgccgccagccgcacgcctgcgcaactgtcgggatggatggggaggcgaattagggttagatgggaggggaattggggatatgtcgaaatgggctgagatgcaaggttgacaacggcccaattagaccgcgggctgagaggaaagggggaggggagtgggaagttttggcccaatagagaagaaatggtgaaataaggtccaatatgagcagtttaaggtttcttttttaattttttaaatacatatacgaactatagagtatatatacctattttttgtccaaaaatcttgggtatacatctgaatacccttgaatatacactgggcccgcccctggtcccacgtatacgtttttaattctaatgccacttaagcgccacgtcaacccacatactaggtcaacattgctacgtcagcgccacgtcagcgaaactaccctccaaaaccaccaaggagtcaaattgcaccggtttcaacgggtcaagggtcgagaattaaattcgggtcacttttaagggagtcaaagtggacttattcctagagacaacaaggtacaaaaggccgaaagacgaagacgaaatacattattgaatgggctttatgggccgggactcatcacgtgctagatgggctttatgggtcgggaatcatcacgtactagtatcagctgtattgctcatcatcagttgttctcagaatcttaagcattctgtgatgcaaattgtgacctgattttgacttgcagaggacagattttatacggaacgagaaaagttaagaggaaaattcgaaaaggcagcgccgtcctctcctctaatgtttgtttgtctggccatacaaatcaaagattcaagagatccgattctattcttggaatgacggtggccatttttgtgttgcggcagtagcaatggcatcttatcaatgctcttccttcatgttaacattaacaatggtctccccttttcatctttcgtggcgcctcggcaaggcactgcttcactccttgctgctgcgatgttcctaacctcacgtatcaatatcatcacaatttcttactgctactactgtaatcattgtcctttcgttgctgttacttttggttaaacctgctactagctgctatcaagtcaaaaagaaaactgtcatgcatctgtgacctgtacagagtggatacgttcaggctgaagatattccaatttaacttccccctactacactgtaaatctgtaatccatttcaggctgtaaattggaatatcttcagcctcaccgtatccacactgtaccaaagagtaaatgtaatatctgactaatgtcaggctaagcacacagaaaacagaaaacaaaggcaagagcttatagacatactatgaattggaacttttataatatatatattgtatgaattgaaactgcactgtttgagatgaagattgatctaccagcaacactaccttttagcttacagatcagtgttacaagtacattaactgaagaggatacataacccagctctgctgtatgatgctacagagaagatgtattacagccagtaactaaaagaaagctcatcacctctgtatccatacagattataggcatatttatgcatatataatagatgacatatgtctgtagtggctgacacgtggggccccagttaggaatggctcaaaaatataccgccatgtgtaactaacccgggagcacacgtgtcatggttgactcgttcagaagacggacatgttgtcgtcggcggccgtgaaccacgccgtgaggtcgtcgccgtcgctggcctgcctgcacagcagcggcgccgccgccgcgttccagagctccccaccgccgccgccggagtagccgcccagggtgtcccacttgagctcgtgctccgacacgcttcccatgacgtcgccgtagagaggaggcgctgcctgcgtgaagccggcgtcggagaagaacgggtcctgagtctgaggcatgcacagcggcggcaagtcgaacccgcacgcgtcgccgccatggtacgggacgcagctcggaagcagctggaacgggtcgccgccgccgccgccgacgaacatctcgtcgacgagcgggctgccattgttggtgggcgtgaacgacggcgaggcgttgccccggctgctgagctggtgttcgacggtgacaagggacgagctgctcgacaccttgctgatcattcctttcgccttcgccgccggcggctcgccatggaggcccgcctcgtgcctcttgatcacgcggcacagcgcgtacgccccctgcaccagaacacatctcatccgatcagcgcgccattgttgccgtcgcagcaagcaaagcaaaggcaatccggagaaatgaactcacgatgaagttggagacgccatgggcgaggtcctggcagaggcggtactcgtgcatgacccagtcggtgcgctcgccgccgggagcgcgacccttgtagaagacgagcgtcttgcggaggccgaagacctcgccggcgcaggcgatcttgcgatccttgccggtggccttccagtacccggtgctcgtcgccctgttcgtccgcgacccgttcggatacttccggtctcgtgggcagaagaagaaccactccaggtcacgcttcggcaagaacgacttctctgcacattttcataatcattttcttcttcagaatttgatttgatcatatttattatcattttatgtcaccaaggcgaaaccaaattgcaagagaatatccgaaaagtttggctttgcggttgcaggaggaattcattcttgaatactaaaattaaaaggtgtgtgattaaaaagacttatcagcaaccggcctagggaggaaaaagcccagatgcccgtgtaaaaaggtcgcttttatctgtctagaaaatgagaaacgcctctgggaaaaattctgcatgttcctttccaattttctaccacctgtttctctcttttcaggaatagatttgcgaaaaaaaaaaggctagcaggtcaaaggctttgcatattgtttagctactttccacagttaaaactgttttcaccaaaagttaacaatgttgacacgaccaaaactcaactatgaaacaacaacttgtgctaaatatatttgatgcagaatttcaactaccaaaaatgaagtaacatgaatcaaatggaaaaattgacaaaggcacaaacctggtagctcccatggctcgaacttgtagagatcaatgacagggatgacctcaagctcgatcttgaggctgtcgactttcctcttgaggtagtagccgaccaattcatcgtcggtcgggtggaaccggaaacccgggggcagagtcatggtacccatgatcaaatcaaccgactgaatttcagacaaatgtacacttgcaaaacctattcaaatatcttgggcaagcaagcgcaaacctaattgttcaatcgaaggttaacaatggaaagaagaggcaaacaatactactaatcggagcaaagctagctagctagctagatgtagtgtcaatttgcctaaatgctaatacttgaggcagattggcacaatttatcacatatatatggttgaatgcttgtcaattagaggcggcagaggcagtatctattgaagattgggaagatccagaagtagaaggtcttgagctgctcggaatccagcggacaggtgttgatgaagctgcctccggagttcaagatcattatcctatggtcaatcccctagctagcaagaactaaacaaccaaggaattcagttcaggctccttgatgaacttgaactgaactacgtacagagatatcaattggaggagcaattatggacgagaagaagaacaagaagaagagttgagagattcttgctagctaggtgctgaccaattaagaaataagaggaggaataggagagtgtttgggtttcgttttgtgaattgggggagttgggaaggtgacacggtaggggagtttatatagaggggttgagaggagaaaaagctaaggtaaggcggcgatgatgttcgtacgagcgaagcaattcgaagcgtcctctactctaccacggtagttgcaactccaagtagccgcaaaagacattcacacactactcgagctttactactgcatcttccattctctctgattagctcctgtccaaaccgacgtgtcaggttgcctctgtgattagggcagcgcctaatccactgattgatcagatatctgggcatgattaatgacatcgcttttggataatggcaacactgacatatgtaatgcatggtgatatattcttcttcttctctgaagaatcatactgtcttaccattcagggaaggggggaagtacgtacatgcagctagcaagcagcctctcccaaaagtgaaattttgtttcatatgcgctttgttttgtctatgaattcttgtctgcgtcacccttgatccgtgcttagccgttcggtttagttcactgatttgattttcttcggataatatcttcttttacgggtgttcagataagtttcgtggccgaatttactatgtttttacagctcgccttcatactaaacatttccgctgattgatttcccgctgaaactaattacgaattcagtttccagtacatcgaacacgtacgtcatgtgtaccgattgtgaattcctatgcatagtcagtactgacagggaattccagtggcgacgattcttcttgacctatggttattctgaaattgttatgaattgacctctcctactgtcctagtacatgatacacgcctgcttctgaataagctctatcacttgactagatatttttttctgcactgaagtagtatctgaaatggtatcaagttgtgagtgcccaaccgacctaatcatcaggaattagttcctgactttctgctcctgttgcgatgttcacttgcacagttgcactgaatctacatctgacaacagaggttggtagagtctcttgattacatcttgcccttgataatacatggttttttaaaaaaatcttcgatttgaagagaaaatcataattaaacaaagtgttcagagtcattaggacgatggacgaaagcacatgtgaattctagtcagacggattctgaaaccagtagctgtagtattctgctgtattgttaagtcgattagacatgaaaaaaatatatgcagacaatgtatctgtacaggtgatatggtgcagcagtatatctccttaatttcaaacagctttacatcgacgcgtagtataaagtactgcaagtcatgttcattacgatctcaatgttgcaacttgttctcctgccgacagccttcctagccacaaaaataacacaacaccgcaaattctcaggctggtccatagttctgaaaaactataacaatgagaacttccaagtttgcattactagatttcctccctattctcaggctggtccatatttttgaaaaactaccgtttgactggtttgaatttggcgcggtatcataattcacagaactctctgccagtgacgttttctttttcaaaaaaaaaaaaaaaacttccggcttctacaccaaactaagggtgtacacgaccatatttgtggatactgggatttaaactttagtgaacggacttgtgcactcaccactctagcacaccaatgatgctttcccataatgatgttttgtaagtccaactttccaatgaattttgagcatacacttagagtttatcagttagtataataaatataaaatacttaactactatttatatcccaaaatatagcaagttttagcctttcgcatggctattaacgagatggataaaatgacttatttgtctttcggggtggatgccatgtaggtctggactagttgggataataataaagcagagatgtggtatgagtagtttaatagtaaaaatgaccttttatatatatgcactatgttgttatatttggataaattttgaactatattagttattatattttaaaacggacggagtatttactaaatggaggctagtcttagacaagaaaaggtagattgtgaaatggcatctagcctagtggttgctgtgatctgagggtgtgtttagttcacgtcaaaattgaaaatttggttgaaattgaaacgatatgatagaaaagttggaagtttatgtgtgtaggaaagttttgatgtgatggaaaagttggaagtttgaagaaaaaatttggaactaaactcgtcctgagtagcaccttggtcctgaattcaaatctctataggaacgaattttagattgggttatttgatggctaagcttcctatttgataggctaattttctaatttaaaaaggctgcatatatctggttggatgtaaaggccgggtaaaaaatacacttctcaaaaaaaaaagaaaaggtagatcattaaggccattctttgatgacatcaagctaaattgactgctgcatgacccagctttgtatagtcactttcctcatagctatcttgcacttgcactttaaagagcacatttttccatcgtcattggctcacaacatgagcagccatgctccacatggggacaaatgtacttgtcagttggcattgctcaccaaacaccaaatctgagcaaaagcctgagtggttcagtcaaaacaatctccatcttatcactactttgtcactgtcaggatagggagttggacctcaactgcttgcttacccttgaccaaatgctagtgcttaacttcacaaggaggttcaaataggggaaaaaaacttcatgaattcaggttagctggtttatgactaactaggttaatttcaagctaactgaaagctagcctttcggtaattagtagctcatgtactgttgtatgctgaatactgtagccaacagaacagcttgatcaagcttgaatggatcatcttcaggtatgcagaaagaaacaagtgtagcctttgtggaagtgaatgcatgacccactgatcatgagtcattagcttttgattagtttaattaacaacatcgaggactagagcattagctgcatttgtcaaggcagaaatggtttaaggacagatggctcaagtgatctctctaattaacctgaccgttcttagatatgaacgctggtggcctggtgggtgcccacctgaagaccaggattgcttttataagcagatgtaggggcctgctagttatgaactgcttgacttgagcatccctggctgcatgaccaggcatcttgcaccatcagagctgcatcagcaaagccgcactaaggttggcttcttttaatccctagcaaaccctcccactgcttttcatcccttcctgttgatcttaattatccaggtattgttaaatcaaatgctatagagtagtagcattgttagcaatgatctgacacaacttgattaatttctgaattccaagtcgtcctagctagtatgaaacctctctgtgaacttttttgacacggtttatttgttttatacacctctgttgttgtatgatcaggcagggcatcagcattggatctttaagtggcactaactaagctagtatactagctgctgagctggaggtgagactgatgcatgatatatgcatcatcttatcatgactgcaagtctgcaatgtctttaacttatctttaacagattacattacctcaggggaaaaaaatatgcagttcagcttaactgttgtaatcaagaatctcattatgttcatatccagaaatggtaggacagcatgcatgaatgctcaatctttaactttcaggcgacctctgttcacctgaagtcctgaagacaagactcatgctgggtgtacagtaagtcagtagtgaatcaatcataatttcgagtaaattatgatcatgtctatccatgatggagactaaatagtaccgtttattagtcgcagaataattcgattctcctgttaattaagtaattaaggagcgcaaaaagtttcttcaagtcggaagactctgcactgtgaagtgttgcttggataatatatgttttattatctgcttcctttccagcagctgagattagtgggttccacgtaataattgttgataaattcaacattttcattggcaaaaaggcactaactaaactaactaactaatgtaatttaagatttaagaattaatgttatgcatatctaggacaagagaaaaaatattcagaggtgggcggcacaaaataatgtaatataagtagcaaaagcgagttttcagttaaaaatgtacaaaaccagcaaagctagtgcaagagagacgtttagaatcttcacctacggagtatgtgctaaacatatcctgtctagtagtgattagcagattaattaactaccatgtgatgaaatgaagaatctttgttagtggagcgacggggcacaaaacactcacaaggcatacctttcctaattcctacactaatgtaatgggatcctgaaaaacagcattagaaaactagaaaagaaatgcctttgcgcatagtataaccagcatagcttagctaggcagtgatttgcttctcggccaagataccaaagcaaaggagattcaaagcttaacgggggcctctcaggaaaggaatcgccaattaattgacgaaggcggttcggttttagtagtaggcgacaaaactcgcctttcattaacccaaaaatagtctcacgcctatttcgttgtaaatcagagaaaactgattactagtaatagtattaattaggaaactttgtaacttacaatttactggtaagaatatactgccgccataaaagggagaaatttctctccatatactataaccataagaaaattactatgcatacaactcaattgtccacgtacgactaaatttgatcaacggttataaacgagtgcagtgcgtataaacaatgattgatatatggctgcatatatctcattgtacatgagttgtacaactgaattgtacgtatagcggtactatttttataaatacaaatcactaggtaattttccccgctcaaacctattccctatatatctcttgtcatcctttaccatagcaaggcacccaccatgaatacattgtgccagatgggcaaggacggacgtgtggccagtggtggagttggacacaggtctaaaataaagattgctggagaagctcgataaagataaccaaacacaacatatatataccattgccatatttatattactattgcacctctagtattataaaaattgaagatgtttatgttgatactttggtacgtcatccgtatttaagtcggtttttaagtttattcgcttttgtaaatacatatggagtcgtataagaaatcctttaaaaaaacccgtatgctaacttggaacttagagtcgtactcttaattgctttagaattcttgccgggccataagaaagcaacgtacataatatggatgtcatcccaataagacttccaaattagatatcaatactatcaaaatgaaaatcccacatattttttaaacaaaaaaatataacaataatatattaaaatagctttcatgcattgcaacgcatgagcttttttttctagtaaaaaaaataaagtacaatcaataaggtaagacataaaagaacatccaagataaaaaaaaaatagagtacaactttggagtcgcctagcctatttgattgctatctctatggcatcaggcaagcgggaaacacattgcggtgtcacgccccgaactagtcccgaccgggactagcccgtgacgctccaatttaacctgttaatcgataccagtcccaggaaacagtgctggtatcacagggagatagaatatcacagcatcagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcatcagcaggatccgcttcatcttcttcagcaactgggggggaattatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaatagggttggcacccggccaacagcttttcaaacggccacccgggccaacaacttttcaaacggccacccgggcctagctgatcccgtcagctgctgatttttcaaacatcgaacccagtttcacaacagcaatttcataagcagtagtcagacaaaactacgctaggaatcacctcacatccgcccatgaccgtgggcacggctattcgaacagttcaatgacctctgcagaggggggtacactttacccacacgacattactaacccgggtcacccagcccgtagggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgtttctcagattttaagtttgaaggcgaccgtcgatactcgcacagagtgcacgaatatcgaggtgcaactgggtggttacaaggggacatggtataacaattaataaaggaatgatcaaatgcaacaaattaggtaggtctgccaatctgccttgcagacgggacaacagattaagtgtgatcctatcaatgcataatatttcgcaagcaatataattaaattttaaatataggctcaagatgttcaaaggtggcttgccttgctcgagatctggagcttaatcctcgaaattctcgcactgcgggtcttcgggctccgaaactacacgcgaaacgggacaactcaacaaacggcgaaaataaagccctattaaagacctctaagcgtgccactagatagatctcgagatttgggaaattttagaagttgaacggagtcaaacggaattacggttgggaagatattgaatttctaagattattggatttttggtctaaaggaaaaggatttaattaaatcctttttgaaaaagaaaagaaaagaaagaacagagggatggaaattagacttttcctcgggtggctagggcgcggtccaaggtaaatggagcggctcggccgagcttaacgggccggccggcccaagacggcccaagcgcgcgcgcgcgggagggaggagagagagtccggtggaccgggctcaccacgcgcggtcccaggtgggacccgcttgtcagcggctcggctcactgtgcggagggagtacgtggctcatgcgcgcgggcggggaaaggacgcggtgcacgcgagcggtccgtggtggacgcaggtgcggcgggcccacgcgcagcctcacggctcgcggtggaacgcgcgcacggggagggactgaccggggtcggctcgatccggtctaggctgagctggcgccgacgtggcacctacgtggcggccacgtgggctggcgggaggtagacgacgacccggcctcgaatggacggcgggcggcggcggcgagcggcggagcgaaccacggcgatacgggcaacagcgagcacaccgggcggttgcacgtgacaagggaaggcgagccatcggctcggattcgccggaggttgctcgacggcggcggattgcggcggcggcaaccggcggcgggagaagagggaaacggcgacgaggtcacgagaggtcgattcccggcggtgagagcatctacgcggcttcgggaactcgacgctagcgtcggattgggtggaactacgccgagcgaggccggcgacgagcgggtgctacggagctcgagcggcgacggcggcgaacacacggcgagcgacggaaacggtcggggcggcgccggctaactacggggaggctactcaagctactaccgaaagctagggggaggagatggagcgaggaggaagaacggagagagacatcaccgagaagaggaggggcgctgtgacgagaggccggcggcgcgggagtaatctctccggcctcgggctgaggaagaggaagaagagggcgcgcccggagtccccttccgcgtccatgaacgcaccggctctcccggcgcttggcgatggacggtggaggcgaggcagagcacgggagcggcggcaacggtgaggaggcgaatgggagaggaaaggaagggaggggggagacgggtttaaatgggcggcaatgtcggtttgagagaggggaaccgacatgggcggtcaagccggcgagctggcgctcggcggtcgcggccaaagcggcgacagggaggatgacgccggcgaggaggaaaaaggggaaaaggagggggagaaagggggcttgcccctttgccgattcgggaaaaagggggaggggagcgggggcgacgcggcagagagaggaggggcgcggcctccttcccttggcggcttgcgcgcggagtggcgggggccgggcggtgacgacggcgatgacggcgggcggtttggagcggagcggcgacactggcgacaggcgcggcagacgctgacgacggcggcgaccgggcggtcggccactcggcgcgcgcgcgcgggaaacaacgggcggcgtccgcgcgggcgcgcgcacgcgaacacggcgcgcgggaagcgtctttgcgagcggggagctcgcgcgaggggaggggcgctcggcgcgggcgactcccgcgcacacgcgcgcggcgcgcgggcggggcggagggggaagcggggagagaggcgctcggggcggctctcgcacgcgcgagcagcgtgcgggcggggaagagagagagagagagagagagagagcgggagagcgcccggggggagagggagagatgggccggggaagaggggaagatgggccgagcgagattcggcccatcgacctcgggggagacaaaatagacttttgcggaggaatttgattggaaggaattggattcggagttgaactcgacgatagatcggggattgagatcttgagatggcacggacactagacaacaagcaaagaaacaaatttcgcaattagggtttttaagagataattttcccgctaggcgccacgacggaacgggcgctacatgcggactatggagcaaaccggcagagtcatggttgcatacccatgcaaaacacggtgatggcacacatattggctctggtagctagtatagtcatttgcaccacgaaggggatgagcgttgagagacaagcaacggaaatgaacagttggggactcagggcgaaggggagcgtaatcatgaaattgaaagatgaaacaatgattgattgcctcatgaccaacctggagtaattcattgatttgattggctacttatgggttggtggttgatgtctaacatgtatggtccagtactaaaggagggttctggaggtggggggcgatgcggatcgtagttgggttggtcgacccacctaccttaccaaataggtaggtttgcccttgcgtacgacacgaacagagggatgggtcaaatgggagggaatgactcaaacgccaaagggatcggaggttcggctcacttgggaccgcaatggaataactctataggaaggttggggacttaagcatgaaatgactaaaataaaaaatattcttaattttgtggaaaatttctaaaatgttcttgtttatactggcaatactacaagtaaattactatactgtaaaattcctcattattattattattaacctgaaaaattcagttcgattcattctgatgaagatctatatcatacaaaatgtgtgctcaattaattctcctccgtcgaaatggaacctacgaagaagaattaagatcgattgatctgctaggttgtacacgtgagatatgcatttgattacataattaagtgaggcagctagatgcatgtcagggggaggcgtgttcctcgcacatgaatgtgtccctattatggatgcaaccatttttggattgtttggggatggtcggcaagagataaatagatagataccgtcaaacagtgacatacacacgcagttcaagtggtaagtggttacaattagtcaagggggtgaatagtgatataacgatcgggacaccctaattaactcctcgttcttgttcacgcatcggcagtatatttctgcaggttattgccatgccctctctcggtcagctcatctcgcttaccaactaagtaactgaacaacaggttaaatgtactaagcgaccaagcatatatacgcaaaagatcgttgcaatatgctgtacagcaatggaggagccagggatcaggggatggcgacggcggcgacggcgatccttgggtggccggaagaggcgacgacgacagagacgcggaaacccgacgagctagcaaggtagcggtcgaattgagagggattgatggacatggacgtgaacgctcctaattaacctaaagcatgatttcacattccaagaattgaagttgcgcgacgacgacgacgacgacgacacaccactcaccattccgaaatggaatctggagtggacgacagagagggtgcttatatctagattagattagaggtgtaaagttttaacgtgtcacatcgagtattatataaggtatcatatgtgatgtttagacactaataaaaaaactaattacagaatccatcagtaaacaacgagacgaatttagtaagcctaattaatctggcattagcaaatatttactgtagcaccatattatcaaatcatgaagtaattaggcttaaaagattcatctcgcaaattagttatttttttagcatatatttaatactacctccattccaaaatgtttgacgccgttgacttttttaaaaatgtttgaccgttcgtcttatttaaaaaatttaagtaattgttaattctttttctattatttgatttattgttaaatatacttttatgtatacatatagttttacacatatcacaaaagtttttgaataaaacgaacggtcaaacatgtttaaaaaagtcaacggtatcaaacatttagggaaggagggagtactttatataggtgttcaaatattcgttgtgacagggcctgactgtcgtgctactctcccgtttccaaatagaaacattttacggtattcagatttggtatatacagacgttgtaaacattggtcggccaatccttcttcagctgtcacggcaaaatatatatgttataaatatttctcggacactaatttcaatccactgcaaaattattcgcatgtctagaatcctaccaagagaatacccccatttttatgttattgaagtaggattgacgaataagaaataaacataatattatttattagtgtcgcataaaacccgaaatggggcgtggccaagtggtaaggcagcgggttttggtcccattactaggaggttcgaatccttccatcccagattttttctgatgaaacgaaagatgaaatcgtattgtattctgcacgagacataaagtttattaaagagaatttttttctcttataatcaagcttttatgacatcaactacgtacttattaggccttgctgaattctggtgatgtcgtctctcttgaaaacttaattatgacaaaaaaaaatctctgcaaagttcctgccttttgactttagaaaataagtccgcaaaaaagttcatggtattctcaatcgaattcctggaacgcctggtaataaggtttgactagtgactagtactatatggtcttcaagtgctgtactatactactatacattttacacggtcgaacaggtcctcgcaatgcaagtgccaaaattttaccaaattttataatggcattgcgagccagcaagtcgtatagtgttggagcaataagtctatgatcgcaatgcatggtcggcgcatttggctgctgaaaagagcatgtctatatattctctgaaacagactaactggagattagcagccaatatatatgcatggagaagaaaaaggttttgggttttgagaatattagaattcatgtcactttctggtgtgctgcactttcggcagaacagtcctgcatcaatcgtattctttgattggctcttcatttttgtttggatgcgaatcagcatgatcactcatcagtcatcacatattgttagtgtgtgtatgtaacaaatcttattatgtttgatcaaacgagagaaacatcatatttattatctaaaaaagataaaaacatcactatagtttgtcttgaaaattaaatacccttttgtttttaacaacagatctttttttgggcaggcaaacatgcaacatagagacaggttcattttgttatctgtatggaaccaataagctttaaagccttttacatcaccaatgcagtgattaattttcttatcattcttgttgtagtattgaacgggagaggtgtgttgtgccgcgcgctctctccctctcttgatttcgtgcgtatacttctcttctcacaagaaaaaaacatgttttgcacatcgacatggttttcaaagatgtatctgatcactaatttctactgtgaaatatttatgagccccaatccaaagattatgatattataaaattactttttcagcaaacatatatgcccctctgttctaataagcccttgtttagttttaaactttttctttaaactttaaacttttccatcacatcaaaactttcctacacacacaaactttcaacttttccgtcacatcgttccaatttcaaccaaactttcaattttagcgtgaactaaacacaccctaagaatcaatttctagctataaacagcttggatggacagtgtagaaacgatctgtttttttttaactttttggttctttttgaaaacttatttcataaataaacctctggataaaacttattctagaaatgaaccctttttgcgttgccgacatcatcggtatcgtggtccaatatgatggtgtcaacgacattgaccatgtcccgcgctcgaaactaagttattgatgtgaaaaagataccaatttgtaaataaaaattctgaaaatgaccctagtagtaataaaaaaatatttacacatagcacctcggcgccaatagcattggaccctttacatagctgaggtcttgttcggttaatccctcccacaagaggagggatttggaggggatttattccacacctattatggtgtggaattattcccccttaatccccattattccccctcttagggattaaacgaacaaagcctacttagatatcgtcgtgctgaaatacggcaccaatgacgagttgaattatggcaccaatggtgataatatcacgaaaatggtcatttttaaaataagtttttagtctatttataaaataagttttcaaaaagatctaaaatacgaaaattacagtagaaacgattgtcctgcattcaatctaaatacttgaaaataaaacactgatgttttagtgtttttatactttaactaaaaacatactttctctgttagaaaaaataacttcttgctatgtatttgaaagttgattttttcgggacggagggagaacagtacgtgatgtgcctcatgactaaggtcatgtttagttcacaccaaactttccccaaactcctaactttccatcacatcacatcacatccaaaatttttctactcacataaactctgaacttttttttcaaactaccaactttccctaaacttctctccaattttagaaacccaactttttttttaaactaacaactttccttaaatttctctccaatttcagaaactaatcacagcctaagtacatacgtggagctgtgaaaggacgaaggagatggctcaaacatcacagctttatacacatagccaaatgacaaggcagaggtagcaaacaaatcaatgagtccagagcaagttccctctttttctacgcacttttatcgttatctcggcactttctgctgttacaagtcccgaattcaaagcgtccagtcattgcagccaagctaggatgctcttcgtgttcaccggaccccacacatcgcgctcacgcactttcatttttctgactcatttttttgttcttttcctccgcatgttaggacaaaatgtagtttttccatgagggctttagcttttcatttctttttttaaaaaagaaacaaaatgtccttttagccctgttccctatgagtttaaaacttttcttttgaaatgcttcaggcgcttaaaatcttccatgtttccattcgttacatttcactattttacattaatcatggaaaaactttggtaagcagcaaaatacaatggctgaatagatgccaatgcaaaccgaaattgaggactggaggtctcatcagatggttcaagcatataggcgatgtgtaattgccaaacgagaaaaaaaaatttgaaaaccatcaggttccacatgatgcaatgcacatcactacaaaactgaaccataccttcaaaaggttaaagcagcaagtaacacatcaagaacatggtagaaatgaatggaatttagatggctctagtttattctccatcctaggctaatcacaaggaacccgcctttcttcacactatcatctcacctggggcccaaagattccaatggaaaacgaaaaaaaaaggtgaaattgtcagaaaagcatccccttaattacaatcttctcatctcatcaattctctcgtctctagaggagcactgcaacgcaatgatcagcaggtgtttgctcacatcacccgagaaacaaagtgcaactcagactcaaaagcgtagtataagcaatgcctctctgccttttgccttccaggtcacaacaacgccactcatttatcgacatttgggcggagattgcacaataaaacagtgcattttcaatcccactcctagtagtgcaacagtcgtcccaatgaacactcatcatcatcttacctttttctgttaaaaaggcaacaacagatttgggggtgaaaccatgacttgttcccctaacctcgccagctattttgcttcttggcctcaaaagtggctccatcgtttagcatatcttgtgcgtcagtttccatgccgagctttgagagagcaagggcttgtaggtagaaggcagttggccactcgggcatgcagacctgggcctgcattgcgtcccggagagcaagctctgactgcccattcatcaaataggagaaacttctccgggcaaaaactgtggctgaaggcactgacatcattccaacaagctgcatcatggcaaatgagcttgtcataccatagggcagaagatattcataacgctcactatatataagtcacataaggaccacataaggctactagtggctagtagcactcgagctaacgggctgagggccaaactgtttcagaaagttgaactttttgaccagttagggtcctttcctattataaagctccaaaacaacttgtgtcaaacaaacaatcgtgaagcaaaatgtcaacattgcaaaggtacggtagcatagcctaggtaagagaaaacaatgataccttggagtagtagtcaattgcagtcttgaaatccttgtctctaaatgcaatgtcaccaaacttcttggtattcagcatctcttgcacttgctgagtccattcttgaaaggacagcttcagtttttacatcaccataaacatgcacaaaataaaactagcttatcttaacaaaccaaatgaatgtgactccataatttctgaaatatttcagcaagtggggacagcaagagaagagctaaggtacataaaatgaggttagcttttgaaattataaacaagcatgaatgtggtggttggtgaatgcaagtaatctctcttcatagcaagaaaatagatcatgatgcacaatccatgttttctagggcatttcaagaatgagtaaattcagtgtgtgatatagctcagatgcatcatagactaggaaaacaaatgcaacaactttacagcaagatagttacctcattttctgcaccttcttcatctttgtaacctgttttgagcaatatatcatgtactgctgtaaggtccataccggaacaggccttcccaaggggagaaagaatagttggcaacaccgccgtggcttttgtaatacccatcaacacatgtgatgctacctagaatgattgatataagaaataaatggtgttaccaaatgcaatgaaaaacattagcagccgacaaaaggctgtcaagttatttacctccttttgcttctgaagaggcccaacagaagacaagagatactttatattgggtctgtccctcgcttcaaattgcaagcatttcgacgcaaggtcaactagttttgaagcatcttcattagcatactgcccttctaaggaggaatccatgagcaacagtatattcttccctcttatcaaatcaagtgcctggaattccatacaaatcaagtgagaaacctactgacataaacattgatagttgacaataaaatatccttggcataaattcactattccgcagtcatgctctatcagatgcacggcatcctaggaataagttcattgtcacatattctactagaagtctatggtctgttatttgagacaagaggccactgtctgttatacaaatttagtggacatcagtaggttaaaggttaaggttcaaatccgattgcagtccataacactttttatcagttgtcaatgtgacattaaatacagatgcagtgttatccaggatatgagagtaatgataaggagaagcgctgatatatatatttcttgagaaaagtaaggatttaaacgaagcatacatggctaggaggtatgtgcttcccactcaaaagatccaaaagaactgttccatagctatatatcacactctcggcgatgactctgcctgtcatacaagtgtcatgcacaaattgttcggtgcagtcaaacaatgttagtacttgggagtaaatatatagcaagcttgaaataagttgacatgtttcatttttgctggaaaacatcaatagagtaaggtgcccatgagtgcggtaataaggatcatgtgtaaattcctaccagttcgtagaaactcaggcggggtgtaagccagattagtgctataacttttcccatcgcggctgttcttcattagtccaaaacttgacagccgaggatcaccttcctgatagaataaatcatgccaaagttagaattctctcggtagttacagacatcagcaaagcttcagaaagtagtaaattttgatcagaaagcatccgagttcacaggaggaaggaagtgaaaagcaatgcaaaatcagcagaaacaaaaggtgttttgagtggaatgtactagcagcaacaaacatacctcatcaaaaagtactctataagcattcaagtcatgatagatttttcggttctcggcattgcagtgatcgagtgcctgcgcaatgtaatacgcaacccttaaccgcatttcccatggcaagggctgcttatcccctgcagaaaaaaggtagatcgcccttgagtcaaacaagaaagaaaacaaaagggggaagtaatgtggcgagccaggttgtccgggcaagcaacatccatccacataagtagcaagtgctagtagcatttggcatgaagagcacacacaagtcaaatgtagtaatggtgagaggtgttccattaatgcagacgagattcgtggtttgatctacggatcatcaccaagtacgtcacccaagtagttactcctagtagtggacatggatacggaaatggcgaaatgaagaggaagagggtatggtagtagagtacagtggaagagatgcttggaaagggtgtcgttgggcatgtactcggcgacgagcagcctctcgtcgccctcggcgcagcatccgatgaggttgacgaggcgcttgtggcgcaccttccccaccccggccgcctccgcctgcaatgcaatgcaaccacaagagaaaagcagtaatagtgaggaggatgggtggcattgcgagatccggagagagagagaggcgaggagaggtacgaggaactgctgcgggtcgggccaggagaggcgggagaagcgcttgacggcgatgaggcggccgccgtcgaggcggccgcggtagacgacgttgggggccttctcgccgctctcggagacgatgaggtcggcgctgaagcccttggtggcggcgcgcagctcggcgaggccgaactccctgaacaccgggaccgcgcgcttggcggcgtccttgtcgtcgccgccgccgtcggccgccgcggagtcagcgccgccattcgcggccgccgcctctacaacaaccaagcaataggagtagattagattaggaagcaagagcggtggtggtgtggggatggggggttagggtttaggagggcggcaatggcggcggtggggcttaccgggatctgcggggttgtcggcggggagcgcggcggcgtcgttgggcgggaggggacccgcccccgccggcttggacaggaagcaccccattggaggcgcgacgcgaggtggtgagatctagggcgaggcggtgggaacgcgaatgcgagagaatatttggggcggggggaatggcggcgagtgtgtagtagggaagcagtgaagcgaagtggggaggcgaggcgaggcgaggaaggcgaaggggggcagggccgatagaagcggccgcacagaagcagatgatgtggtggggagatccggccggttggtgcgcccgcaacacccagacccagtcacccagagcacccaccccacccacgctctctctctctctctaagttttttaaatctcattttcgaagggaatcaaatttctttgctccaaccaagtggagtggactaagagaaagtttaatagaatagccaactactagcttcaattcatctataaccaatctaatagtttactcatacaatagttacatactacactattaatatctggtcccatatgccatatacacactgcgtcttagagtccgtactgcagctagctacaaatctgtagcccgctgccattctctctcctcatttatctccttaaaatatgtttgcagctggcttatagcctgctattgtaccttagcccgctgccattctctctcctcatttatctccttaaaatatgtttgcagctggcttatagcctgctattgtacctgctctaaggctgtgttcgagcgcaggagaaagcgagaaagattgtttcgctttccgcgcgcacgcttcccgaactattaaacagtgtgttttttgcaaaaaaatttctataggaaagttgctttaaaaaatcatattaatccatttttgaagtttaaaataattaatactcaattaatcatgtgctaatagctcacctcgttttgcgtatcttcccaatctcctcaatccccttctcctcaaatacaccctaagactatgtttagattaagggcaaaaatttttggcgtgtcacatcggatatatgggcatatatttaaagtattaaacgtagtctaataataaaacaaattacattgtcaaatgtttattaaattgcgagacaaatttattaaacttaattaatccttcattaacaaatgtttactgaaacaccacattgtcaaatcattgagcaattagaattaaaagattcatctcacaatttacacacaatctgtgtaattagttttttatatttaatatttcatacatatatgaaacattcgatgtgataaggtgaaaaaacttaccaggagatctaaacaccttaatacttgtactactgtaaaaattattatagaaccttttttttaagagataagcatagaagtactactatctctatttagatcagaatatgtcgttcaaaaaaatatttatatcagaatacaggtctcctttgcagtgaaggtaacttcacacacaaaagaaaaacagaggggattgaaatggttcttttgaaattcctgtaaaatttctatgttccaaatgagtcattgatgtttttatcttagtttgttcatggcatcgtatctatttttctgtatcgggtgatttttcttcagctggcttggtaatatttacatcaaagtataggtcttcctttgcagcgaaggtaaataacacaacccaaaacaaaaacaaaagaagaaggagagggggattgaaatgtttcttatggaattcatgtagtaatatttgtgtttcatgcgagacattaacattctatgggcctgtttggatccggagggctatttaatagccctccgaaattttgttatttatgagtattaaacgtagattactgacaaaacccattccataaccccttggctattttgcgagatgaatctaacgaggtatattaatccatgatttgctacagtgatgctacagtaatcattcgctaatcatgaattaatatacctcattagattcgtctcgaaaatagcctagaggttatggaataggttttgtcagtaatctacgtttaatacttataaatagcaagattctagagggatatttaataccgggaagaatccaaacaagacctatatgtaagtttgttcgtagcatcatatctatttctgcgtgtcagattacttttcttcaacttcaaaacttgtttagcactcttgtactccccaaactaaacagtgtcattgttcttatttgggggagtgaaatcgacaatgtaccaattggtcaatgataatgtatgtctggacagaattggttccatggacaatgatgaggtcaaacatttttgctcacacaaagtctcaaaagtacacactttgacatgaaaaatgctgcctttttgcgttgagtgggattcagattccacattctatatccctttgcatcatccactgaacagattgctcatttgccacttccatggtcttgtttatgatacagcgtgaagttcgtcgatcaagtggccatagtggagaataccacgagtttaattcaggcaacgctgctattagtattactatgtactccatccgtctcaaaacaatcaaacatatgatatcctaatactacgaatctattaaaaattttagtactataatactccctccatctatttttgatagtcatatttccaaatctaaaaaatttatttttgataggcatatttcaattcaacaacctatcatcttaatgatttttttggatttaatgcatgactctccattcttccacacaagattggctatatgggtattgagaaatgtaaacattaatgaatcgcttatttacgaggaataactagtagcatatttaaatggatgataagtagaattacttatccttggtctatttaccaagataaaatatgactatcaaaagtagatggagggagtatatcatactaactagtaataggcttatttattttgaaatggatatattacgtatcggaagaaaagaatatagttattgcggacattatggaagaacagcctcccctgtcgtgttatattgccatttattactctacgatactccctccatctatcagtcatatttctaaatttaagaaatttatttttgataggcatatttcaatctaacaacctatcttcttgatgattttctcggatttaatgtgtgactctccattcttccacacaagattggctatatgggcatcgagaaatgtaagtattaatgaatcgcttgtttacgaggaatggctagtagcatgtttaaatagatgataagtagaattacttatctttggtctgtgtgcctccctctctccctatctccggtatacagtagtagtaactgtaaatttgctcacgacgcacggcccctatcagggtttcctaaaccattgggaccggggttatcgcgcagtaactatgaaaaaccgtacaaaatttatcaaaaacttaaattattttttaaatttatttgaatttaaagaagttatcgcggtatttatattaccgtacctcgcaataaatccagtaaccacggtaaccgcgcggttaccggcggtaagggaaactctgcccctactacgtctacacccgcgcccaggctgagataaacaaaaagaaagtcgcatgttcgcaggcacgacacgtgggcttgccggcgatcctccttttgctgggccccacatgtcaggacgacgtgacaccaccaggccgggacccgcgccctgacacccccacaccccaagtcaactcgctgtctcacaggcagactcccctcctctcgtgcgctgtctccaccaccaagagctagtgtcactcacactgacagcactgcgcctcgctggctttgagattttgatttgcatctcctcctatcctcggtttgtttgttgggtttaagtacgggagctcatgccccacatgcttcatctgctgatcctttcggctgagttcgggagccgcctgaaaacaatgttacctattaatacgtgattaattaaatattgatttaaaaacttaaaatatgaattgatataattttttaaaacaactttcttatgaaaaaaattgtaaaaagacgtgctgttatttactccatacgtcccagaaaaactcaacttctagagtttgaattttgtccaaaaaaacaaatttctacactcctatctaccctcaacacgtaaaacgagaaattttattccttcaataccctttaccaacctatcactcttactacttttttttaataattaagaacattttagttattcttgattcctactaattttatctaggaatgctaggaattgactctctgtgggacggagaaagtaatagttaaaaaatgtgagaaaagggaagaacacaccgtcttggtcccgcctctactctacccaaacccaaatggagtattcctacacagcacagtgtagtacacaccttgttttgattgatggagtactactagctaagctaggacactagtactactccgataccgttatcacgtaggcctagtgcgcctaattaactttgattttagtactagcatgaagatagtgctagcgctgttttttgttttgtttttttgcctttgggaaaacatggttgcagtggatcctatgtgaactgaagctagaggtagcagtggttcagggctcatgacttgttccggcagaaggtgggcccagttagctgggcctgggacaccacatacatatgagatcatgatgccattgttatcaccagctcgatagtactatggcccatcagactatcatggattcatttcatggtgcagccaaggacatcaaccatgatgcacgagagaacacctctactctgctcttcaccaggaaaaagggcagcgagcgaaccctcgtgctaacccaaacttaacactccattaccatctgcttattctcataattcctaaagtaatacttactgactccccggtcccaaaatataagagattttaaagaaatgtgatatattctactactatggatttggacaggctctatgcattcataatacagtcaaaaccccttatattataggaggaagggagtaattaagagtaaaactgacgaaatgttcagtccaattggaaccatgtgaaaattaatatagattatcttattcaattccagagcctacaagtaaaatcaacataacatataataatccaaacttgttccccgtaaaagttactcgtaatttagcacatcaagtaacaaacaaaatttgaacaggtacatccctgtgacggtatgacggtcaggctcattagccctggactttcctcacttgaatgtggtgagtagactcctctctccagatcgacttcactccactctgaacaagggtcacgtagtccccttctttcacgaattgggcgttctgtcaaacattcaaaaccacggttcataagagaaacacaggagtactttgtaaaaggactgaaaaatgatgtcaataatatcaactgtgtcggcagcgtgaagtacatacgcttaccagcaagctactaattgctctagagaaagttccctctgcatcatcagaaaacttcatgtaaatgggaaccacaccctggtagagtgccagacgttgcttcactcgttccctgcaacaacagtttcctcataatggtcagtcctccagagcatctttttcaacttttatcatttatttatttagaatgtttacaaaattgatttactaaaatgaaaacactagggaaaaaagatttggcattgcatgtaggtagaaatccaaaaaaaacttactcatttgtaaatgcaaaaattgtagacgagggccggtagtggctgagaaggactgccatggagccggttcgtgtaaacacaataattggggtgcaaagggtgttcgccatcattgtagcatgagatccaaacattttgcttagttggctttgcgaaaattcctcgttgagcagagcctaccaaaagaatcatgagaaaataaggtgctaaaattcaggtaacaaacttaagaaaggaacttgatgtctaagagcaggtgcaatagcatactacaagccagctataaacatatttcgaggagataaaagaggagagagaagagcaccgggctacaaatttgtagccagctgcagcacggactccaaaatacatatatgtatgacaggtaggaccaaatattaattgtgtagtatatgtttataggtaactattgtatggattgctattaagttgactataaatgatttggagccagcagttggctatactattaaacttgctctaagcaatgaacatcgaacaatgcaaaagctaccatatggtaaatttaaagttgtgggaataagagatatacctgaggatgtgcaacaagactaggagatgtagttgggttatacaggctggattctgttctctgtgccactgtgtgcatcaccttgactgccttcagtgggaacctaaacacagtaagatgcacaatcaaggtaagtctaattggaaagcagaattctatgcacccacagcaagagcttaaagaaataaatttcttggatgcacatggaggaacataaacaaaaagtaacctgtgtcaggttgaaatcttactttccatgggcagtttcaccagacagcatgatggcatcagaaccttcacgaactgcaattgctatatcagaaacttctgctcttgttggagtgggatggtctatcatgctctctaacatattcgtggcaacaataactggtttctgcatgcttcggcatgttctgacaatctcctcctggagaagtaaaacacatgtgatttaaatgttgttagtgctttattcatttgttgcattttaggcgtgctaataaacaaataaaagggatgtagagagtgaggggggaacaaacacatgttttcttgcactagtaaaattatctacaaatttaaactaacctgcagcaaaggaacttcctcaattggaagttcagcaccaagatcccctcttgccaccatcgcctacaaacattttcagagattcagtatctagcactaagcagttacgaaattgtaaaacattcaaggacaaacgaaaccagaaatagaacaaaagaaaacaaggtaacaacgaattaagtgtttgaatttccacgaaagcttaccaaacacacattgcttggctcccattatcatgataactatctaaaggcaaatatatgctgaaaagagatgccacttgccaagatgtttttaatacaaactggttgaaacaaccaatgtccatggtcttacttaccccatctgaagcagcaataatggactggaggtttggtattgaatctgcactttcaatctttggaatgacatgtatatctgcattagcacctggatttggaaaagaacacagaacacaggagattaatcaagttccggatatagatattagaaattccatgtgtgccagagaaaatggttacttttaaggtagtccttcagttcatgaataacttttgcatccttcacaaaggaaacggcatagaaatcaacaccattttcaacaccaaactttatgtcctcccaatctttttctgttaaagcagaaggatgtcagcatcttgtgcataactatctagaggttgaacatgttatggagaaatcaaccgacctgtaatagatggcaaagtcgcactctttccacggacatttaggtggcgccttcctgttcagttccccaccatcaactacttcacacttaaccgtatcagctgttttagacttgacagcgagggggtgcag

SEQ ID NO: 55221 - DNA, 4290 bp, Oryza sativa
  unsure (1)..(4290): unsure at all n locations
ccaatgataagtagatgccatactctgaactgtctacctgtaagcaatctaactcaacataaagaaagacaatcaaagcaggatatgaagattgatagatcagtcctcaccatccaccaacagtatgtccccaacttcaacatcgtttatgaagtcatcgtaattcacactgacggtgtctttggtgctcacccctcttttaatagtaaaattgaactcttgaccttcctcgagcatgattggttctggaacatccccacttctcacttctggaccctgcatcactgaagttcgatcatcacagctcatttgctgcagcattcaaaatttcatgtgttcaacggcagtataccttggtatccagcataatagcaatgacattgccatcagtattcttcgcattgtactccttcaccaaatcaatcaccttctggtgcgactggtggtcaccatgggacatattcatgcgtgcgacgttcattccagtctcagcaagtttccatatcatctcgcgtgtgttggttgaggggcctatggtgcaaacaatctttgtcttcctacgggaattcgcagagaccacttgcgaagtagcgtcagcggtattctcagcaatgttctgcatgcaaagaaaggaatgagctaaccactttattgtatcggaagacaatctgaattaaaatgatggaaaatgtaaaaattcaagaataaggagaggtaaatcttgcgccgaaatactgaaccaactgtatggcatcacctgggttccacaaccatctatacatttctaagtaagcacatagcaaagcatttttgaagtttttagctggtgattcaggctagccttacaccgatcagaataaaaggaagaacagccgcaatttcccaaacacggagggttggaaatgacatgtatattttttttcctagcgaaaacttgcacccccacagtttccctccatttgagtgtgccagctctggatcaaaaggcctcttactacatagtagcaagcatgcagcaactactccagtactctacaatgtcattcacccaagcaggcaaatctaagcacgaggaaacgacgaattaatcctagcgcttgggatccaatcgcctcaacgtggtacgatacagtgacgaatccgccaaaaaaacaaccgctagtcaccaagcgcgcaaggggagaaagagagagagagacctgagcggagagggagccgttgctcccgagcgcgagatccgccgccaccctgtcggaggtggaggtcctgagggagcgcgccgccacggccctcctcggctgcgggggcgccgccgccgccgccgccgcgggcggagccggcctcactgccggcgccgccatgcgcgccgccgcggaccccacgatctcagccgccgccgccgccattggagggagagggcgcgtgtggaggcgagggtttctcgtctcttctcttctctctcttctctccttggtgtttgggggcgcgggcgaggcgacgccgcgtgcgcccggtgtttatacgccgggatgaggggagggagaccctgcaggtggggcccaccgcctgccacgtacgcgatgcgtttcctcggttccaccgcccgcctcatgggaggcggagacggtagtagtagtggcacaaagcccacgcctgcctggcactggcaggaaccagttgtgggtgggcccacctgtcagtgggcgtcgggcgctgaccgggcgggcccacggcgcggtacggaggagaaaaaatcgcgccggcggagaggaatataccacgagatgatcgacgagaggagacggagacggagggggacgtggggagttggaagttggcgagggaggctgtgggcggacggaggcagcgatgggtcggcgtcagcaatggcgccccaggcccagcccaccgtgggcgagcgcgaccagacgttcgcgtggaggcaggaggcgacaacgatgcgttttcgccatgagagctgcgtgcctcacgtgtaccttgtcgcccatgtgtgatgcgtctatctcattctcatcgctttgcagactgaaatggcctctgcttcatgctgccggccactataacaaggagaaagccgagcttctcaggcccatgcaaacatgctgaaacctggcaaaatctgcaatggcggctgtccaaaattcagcaaaccgcacctccaccaacgacgcacaaggcggaatgcagtattaccacatgcgggagaaagacttgctggcagaaacaactggagatgctaggtcagacccaaatgccaacatgactgacaacactgagtagtgtggagtagtagtaaaaaaccgagtgtgatgttatagaagacaatcaacttgtttcagactcgttattctgatgtatactactaggtcaaaaaccttgtcctcccgcgattacaagagaagaacccacaaaaccaaaggtgtgatctctcctagggggttgggttcttgggtggggaaaaggaaaaggacagggcaacggcacttgttaatgttacagattttcagtgttcccatgcgacaatatgcttcatttcaactctatcgagtatcgactggaaggagaagacgctcaccaccacaaaggtaacactcgtgtttcaagaagtgactccgcaaggaagaagtgcagccgcgactggcctcccctcttcattcagaatgttatatgttgaagccgcattcctctgccatacaacagaaggattagacatgtgcaaaagactaaacattgtaggtagagaacaaactacaaatatctgctacattgaagtttacaaacacaagtgatgatgttgtaaataaggaacatttggtcttttaccgaatcaactgcttccagcttcatcccagttgaccgaatgaatttgcggagctcaggactgattggttggatgtgtctaccacaaccaagaatcagaatctctggagaagcatggcacacaaaatgatgtcaacccacaaacggtgcttttgaatcagaaatacaaaaaactactcaaccatgagggtgcaatatcctggaacacatcttgagccccagtaggagaaagatgcttggacaattaaactattcagttaattcaaggaaggtttgcattgactgtgttctaccctgaaattcttaaaaatatttgtgcaccaattcagtgcacagctttgtagattgataaacagccaatgcctgttttagcttcctaatgaagctgcaccatgagattgatttttaaaagaaaaacagccatatggacatttcaaacatgggtgacagaatggctaagtccaatcaagataaagggagcgtatcctatgcacacaggccctcgcgtgtacacaccgtgtacaccaactaaaaattatcacaaaaaattctaggaaaattcatacatgtactttcaatagtattacatctacgtgcaaagtcgcatattcaaattcattctacatagagaataacaaaaaagataaaattctgacaaaattgcaaccttaaaactgtcagattttttgttttttttgttacggctaaaatataatgaatttgacgttaagattttaaccctaggtgtaatacaattgaaagtatgtgtatgattttttctagattttttggtgacattttttagttggtgtgcacgtgtgtacacgtgagggcctatgtgcataggatatgttgcctaagataaaatgcctaaaaatgttgaccaatagcagaattacctgggatagggtgcactactttgaagattgataaactgcattattgaatgaagatgcattgttagtcaaaaaaggataaattggaagcaatgcaaattcaatacttccagaaacctgattcaagcatgaatcctacctttcagctgttatctctgcaaatgatttgggtgcccatgtcattatcttgttttctactatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaat

SEQ ID NO: 55222 - DNA, 2021 bp, Oryza sativa
  unsure (1)..(2021): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgccagggctttgatatgccacattgtagattgcatgtgctccacttaggtgcaaaccaaaaaagcctggtttgtagtcctgtttgctcagtctgttggcaattagttgttgccctattcaatttttctgtttcctgttgatatttgtttaaaacaatgatgtgctaactggtaaatgcatactgtacgcgttttcactcatgaggtcaggttgctcttcaatggattatgccagaatactagtgtaaccataacttatccctaatgtccatggcctaatgtacttgaatacattcttcttcaattgggatcatcaactcatggacacatgaatacttttcaggtacaaaggtggaccagaactctcaagaagagtaatttgtagtagtccaacttccagaagttacattgtggatgtctatcccctccgtctgaaattatttgatggaagagacagcttggagagaattatcagaattagtagaaaggtatggtatatttgatttatattgtgacattgtgcttcatatgtaattaaccgtcaataatgcgactgatgctccttgaaacttccctggtttcataatgtttggcatttcttttgggatgtagtccctccatagttatccattgatgatgaaatcaatagtgtagttattacaatgatgattccactatccagccctaatttattgcttcaaagaggttgtgtggttaacatttggttgtatttcacattagcttatcttagccatcatgcctccttgatctgtgcttattgtgtgggacaaatcggagcatttcttatatttgataggttagatgatcagtttaggcattctttataccttgatcacattgttggagagtcacatttgtcaaataaaaaccagtgcttacacatttgcattatatgaaataaagcaatgaggattccctctttgtgatgaagtgtcaaagaaatcgcatctgttcatcacctgcttgttgcgatcttctactttggtatgctgagcccttgaatttcagaatttgatctgatatttttggttgactattaccagaaggaaaaaaatgttacaaatttgatgcgcaatggcaaatactttgaatgctggttttactaactgcttgaactaatagcacttttactaaaaaagtagaaagatgaactttctactatcttctttcttagatactcttttgttgaacagtaaatttgttaactttctattatcttctttcttggatactctagtttcttgtgcaattgacttgacttattttttgacgtttgtatttggtgctttcaggccaaagttagtgagctctatagcttggtttgctcacttttgtccgtcgaacagtctaaggtacaagcatcatcatttattcatctaatatctctatctgtagtgtcagttatggttatgtatatgattctttgctccatctactttaatgcttcagatcgacatctgggatttttaccaaaagacaaagggaaaaaaactgataaatcttaatgagacggttgaggaagctcaactgatgatggaccaggaggtattatgcactatgcaattcccattcacatatctattgttttatctgctgaaacctatgattgtttcctttattctggcagcgagatggtcgctggctttttgttgttattgttgctatgcgcccttttcatctatggtctgctgtctgccttaggatgtcaccttgcacatggataatgactttgtcataaattgt

SEQ ID NO: 55223 - DNA, 5077 bp, Oryza sativa
aattcctgcagccctagaggcaaaggcagatgatgcttggtgttcggatcttggtacaagatcaaataatgaactagcattaattccgttggaaccctcaacatcatcgttttcaattgctggaggtcctgcattttcaaatggtttttcatctggatttggttccagtttttcccaagataatagctttagtcctttattaagggacgcagaagatggttatagtttctccaatggcacaaaggatgatatccatggactgagtggtttacataacttgggaaatacatgtttcatgaacagtgctatacaatccttggtgcatacacctccattggtggagtactttttacaggattacagtcgggagataaatacagaaaatccacttgggctacaggtaatgcatgttgtcctattatgtagattgcgaacttatgatcttattggtgatttctgagaacatctccattgagcagggtgaacttgcaacagcatttggagaattactgagaaaactttggtcagctggtcgaacttctatagctccacgtccattcaagacaaaactttctcgttttgctccacagttcagtggatacaatcaacatgattctcaggttgctccgaatgtttctcctaaacacttcttataaatgtctgttaaatggtgctgacactgagttttgcacctttgttctgttttgtaacttccattaattagtcgtacattataaacgtatttcttactttaagataacatgctgttgtgtcccagaactatgaagttaattttcatttcaacacaccggtgcactgttagtgttaaggcacatttcagttccgaagtacatatgcattaatttcttgtgagattttattacaaaaccctaggttttgggtaataaaactcccaggtctaattcttacatgtactaaaaacaataccgcatactattttattgtacaagtgttatgcataaatagtggtataagagtgtggccaaaaatttggggttcttcgaaacaaattataaaagctgggattttgcgttacaatcgttccaaacctgaggttttgtgaaatttgttttttaaccatagtgttggttgtttatttaaattgtgtcaaactatgattatatctatgtttctcaaacttttgttataagtcgttttgacttttttcctagtcaaacttttttaagttagaccaagtttatagaaaaatgtagacacattttcaacataaaacaaacatattatcaaaatatattaaatgttagttttaatgaaactaatttggtgttgtagatgttactaaatttttatataaacttggtcaaacttaaagaagtttgactagaaaaaaagtcaacgacttgtagcataaatcaacatgtcctgtcaaagagataaattgtctctgctttttggcttgttcgctgttctgataaatggtgcatcctttttggccacacattgacacaagttttcagctcttttcctgaatatgttttccatctttagaatctgttttaattgcgtccctgttatcttccttgctgtaatcttctcttttataaccgtcatcgtcttgtatacagtttgttgtcattttgtgaactgatgcatcctatttatcactacttatgcatccctgctttgcttgttttcagaacttgatgtatttctccatacatttttttttcattgtgtaatattacctgttgcaacctttaataaatgtgtctttcggaataagggattgtttattatgctttttgatatattagtgcctccctcatcttgtcgtttagttcttgtttggataagctatatttatttgacaaaatttggcaatttagattgttcacattttgttaaagaagattgatctgttacttattgcccctcttttatgcaggagttacttgcatttctattggatggtctgcatgaagatctcaaccgtgtgaaaaagaaaccatatattgaagcaaaggatgccgatggccgtcctgatgaagaacttgctgaggaatgctggaattaccataaagctcgaaatgattctataattgttgataaattccaggtaatgaaatctttgctacgtgtatatgtttaccatgtggagcaaatattgtttggatctggaattattttaaagatatttctgcatttttttgaataagggttccctatctctggttgttctttaggcatcttcgtattatggaaatgaacttggtaatgctgaaactatttgtaatcagacaacaggtttttattttcttttttaaagaaacaggttattttttgaggcagggatcaggtgaaatttcaacagtggttatatcacaaaaatttaaccgtttttgggatgagaacgggtactattttctgtagagccctcataagtagtggggatattcagtttttggttaattttgttggatgttttctattttttgacaaccggttttgaaatagtggtaaccagaatgattgctgcacaaaaaagagctcctgaaccgaataattcagtttggttcagttagaaaacagtatctgtttctcctcggaacatgccaatgctgacctgtgccgcttgacgttgctcctttgctggcctgctgtgccactgccgctctgtgactgcctgccatgccttgcgctgctctgtcgttgaattgatttggtgaaactgtggaaccgagggaggaaagagatgtaatagaaaatctagtcgggaatgtagggttgtggtttggtaggggcgtgagatgtgcttgagccgttggcatgatgattggttgctggttggcatattttgtaccttaacatggcataatgatctaaagccatttaccgaacaaagagaattaaaatcaaactggaaatgaaaatacaaaaatcctgaatgtggcatggctcattttggtattaggtttatgtatgctcacaactattcaccactcatcagtataccttttccattgcttgctgcttttgcaatgattatcttcttgagactaggcctgaaagattaggccaggtctgtctgcaagcagatgtagcgtaccaagatttacctcacaaactgctcagccttttacttgctgctgagtgcaagatactagctagttctggtgcttggtattattagttagcactgtagaatttgttggatatttctgatcggttagtatatatgttgggacaagtgggtcgacctgtgaacccacttatgtggttggcaccgttgtatcaagctatgtcttgagttgaatctggcttgaaccaattgttggttattacttggtcgatttatgaagcagtgatgggtattttcaatagaagaaaatactaaagaacaatgttatagcgttgattaatgattgctctctgatggtgaaacatgattgatgtttcttgaagctattttaggaagtgggagagatagtatagttattttgctttcattctgtaatatttcctccatacaaaaatagaaggcatatgttatttttggattaggctttaaccaacaattattatgttagaatataatttttgtgatgcaaaatcaatgttaatagattcacattcaaaggaactttcttatgatatgcttttgagtcacataaatgatatgtatgttagtaataaagaaattgttggtcaaagtcttgacgttaataacagtgaatacaccttatatttttataaggagggagtatatacatgttcaaatttcagtagcattttcccctttggcgtattttgtggtgtacgataattgttaattgtcacatctctgcagtaacatcaattcatttggttgatgtttcagggtcagtacaagtccactttggtttgcccagattgtaagaaaatctcagttacatttgacccattcatgtacttgtcactgccattgccctcaacagttactcgcatgattaatgtaactgtatttagtggtactggagatgcccttcccatgccttacactgtgaaggtacaaaagaatggagtttgtggagatcttataaaatctctgagtgttatgtgttgcttacaaagttgcgaaacactgttacttgcagaggtaaaaaatccagtttgttcttatgtagcaatggtgttatttgaagcataactctttttcagtaaatagctaataaacatcatattctttaggtatatgatcatcggatttaccgctattggaacccatcagaaccactttgtcatgtaaaagatgaagacaaacttgttgcttacaggctaccggttggctctgaaaatctcttgagggtagagatcctgcatcgggtggttgataggtgagtctgtaattatgttagcaaggaccacatatgtgtttccatgatgtccgttcatctattgttgctccttagaataggtgaaccctgcccttatttgaattttggttctagtgagaattttgtgcttatgattcgtgagaatagtttagtgtagctgacaaaaaaaatgctacagacattgagatttcttacctcagatacatgccatgtatttgatggtagtgattttcttttttctactattctattccttggaactggtttccatttttgtgcttacacattgatttgttttgttaatttatgcagatatacttcagagtccatgtttaatcttagtcggaagctaattggaagccctcttgtgacttgtattccaagtgactctacaagaaaagctgatatttatgcaactgtctcttcacttctggctccatttgtgcgggcaaaagtacatactctggatgaatctgcaaccaagttaaatagcaatggacctagcctggatggtattgtactgacagacaatggtgtcacctgtgaggaagatgtatctacatcaaatgtggatgaggaagcagctgatgaagaggttttgccatttcagctttggttgactgatgataaagctaataagagagagcatattgatgcagattctaacggtgttcctgggtcgaccatgaggttattaatggactggtctgatagagaacggg

SEQ ID NO: 55224 - DNA, 8089 bp, Oryza sativa
ctgagatattggtagttcacttaaaaaggttctcatacagccggtttatgaagaacaagcttgatacctttgtcaactttccaatccatgatcttgatatgagtagatatgcaaatcactcaagaggtgatcagccccccatttatgaactctatgcagtgatcaatcattacggcggaatgggtggtggtcactactctgcgtatgcaaaggtactttttgggctaagttttcctaggccttgcatatccttttaacttagtaggtgtttcctgttggttgctgaattccttttgctgtacattttgtatctgcagttagtagaagaggacagttggtatcattttgatgatagccacgtttcatctgttggcgaagaggacatcaggacatcctcagcttatctcctgttctatcggcgagttggtagcagctcctgcagtgtgtctaaaaatgttgcagtggacactgatatggttgattcgctggacacatagatttgaaggcgagaattcagtatggcatagttttctgggcaatacatatgctgctgagaagattgctaggactcttatttgctggttttgggcactgagtattggtttatggtaggtccatccaaccgtggaggttttgagggtgcagcatctcgttagcatcatcttccaatatgttacaaccattctcatgcagattagggcttccaatatctcctgtcttgcccttttagcgaatcgttgaaatgttgccggctatatgtttactaaaacttcctttgccgatatgctgatgtacagcagcaggtcttgttaatttacgtgatcttattgttgtggttggatgggtggtggaaaattggtactgcaactagctgcgtcagaaccagagaaaaagccaatgtactgcatttttgcttgctgagctacatctactcatgttcttattttactggaatcatatctgctacatactataggtcttgacgatatattgattttctaatacactattcgattcataaccaatatactatgctgtggccatgtatcgtgttgtgagcaaatcaatcccttgaattgcctacttggctatctaaaatgatcacatatattagaaatctgacttgttttaattggttaattaatgtctgcaattgtttccatttgtccaactttgatttgggataaccacgatcttatcctggtgacgtacgtttttttggctattgctattctccccctgtaatatccattgtttatgctgtatctatcagctatcaattgggattggctatcaaataccaatgctaaacggaacaagtcagaaactataattcttgttgcgtcggcaaatgtagtttggttttttttcgaaccaagcttcaacatgaattggatcattattcgctaactggtgaaatgcatattgcagcaaatgcagtttttttatataagaaacgaaaattaatttaaatcctacaagagccacttggacatactttgagccaagtatctgagattcaactatgtaggatcacacacaatgtcaatgtcaaattggatgaagggccatagtcaatagtgactgcgaagttcaacgacatacttgtcctctgtttaaaaatacagaattataagatgcagccaaatttgtcttgcatggtgtggttaattgtttagaaactatctggttctacttctacctctgtttgaagttatatgatactgttaactttttgcataacgtttgatcattagtcctagtcaaaatatatatataaatattactttttagttgacttgttttatcatcaaagaaaccacaatcttaactcatacctttacatattaatactaaatttttaatttttaaataagatggataatcaaacgttttgcaaaaagtcaacagtatcatacattttgggaggggagctagtaagacgtaatcttgtcctccttcattggaatatatttacaaccttttgaatgcgttatccgtgtgacatttactgaattatttataaattcttcggtttgcttctgaccaaaacaccattagctgtgagaatgggatagtttcattcctttctagagtttttgcagtcattttcattctcccatggaaatagtaaaatatgttattgatatcgtaagtacaatccaccgtttaaaatatatatcattggatctttccatgattgtcattctaaaagataatattgtttttcaacggttcctcaaggtctgctcatagccgcctagcctcatagcttgaattagataaagactattggcacttttatactaaagcaaaaataatggaagatgaattttatatcctggcatcaggagactttatattcgttccataaaaaactacaatttacaagacgggtagactaataaacaatagtagaatctgacaagaaaatagtctagtatgatcagatccgaacgaagaaaagaaattcagaatgtataaaatatattgagggtacatcttacacgtttgaatcttcctgttgccggatttaatatttagtacttgcaagcaactaataaaagttggctattagaaaaaaaaaagctgcaaactgcaattgccgattaatttgatatattaatactgttgttgcaccagcattgtcaagcaagctttgcctggccatgcattaatttgacaaacaccataaattgatttgagtgactagcttttggaaaagtgatgctgtcattcagaaagaaattaaatccaggttggagtttctctgcttctattgcaagtcaccgctcatgcaaaacagagtgcggcttcttgggattctccgggttaagcaaccgaaatgtgtttgatatgtgtctatactgctgtgcttcgaaaaagaaatatgttgtttctggaaaccggcaatacaagttccatcatctattcctattgcagtatcataaaactcgatttaataagtcaaagctgatttaaaaaataataattttaggtagaagtctttgcttgtctcctcagcaatcatgaaacatagttggcacacatggcatctaaattttagacagacattgacattcaaaatttcgatcatacatttagaaatttggatcataattttagagatagtggcccatgtgaaatcgaaaatttagaaataaaagacaattatttgactagttgtatatacgcttatcctatgcattctagagagggacaaagagagaaaaaaagtctcgctttttccacgcgcatatatacttcccgaatagctaattgatacttttcttttaaatttttttatacaaaagttactttaaaaaatcacattaatccatattttaagcttaaaataattaatactaaactaatcatgatatgctaatggctcatctcgttttgcatgtcttgttaattttctccaaccccctcctttcaaacactctataacatgtgttccgagaaggccaggccatcaatttgctaatatgatcacttaatgaaggacggcagacgcacacggttgtggcgagaagaggaacttcttggacgcctcagaagccacacaagactaagctgtccacgtcattgtcatgtaaagctcaggatctagctaggtgtttctgtgacctgttctgttgtgtggccacaaggccaaacatgccatcaattcatgcgtcacaattgaagatgtgtgattgatcatgggtgaaatggtacacggggcggcaacgagaggaaaggactgaagttgaccttgttggaattggccgccatgagacctgatgcaaattcgttagaccaagaggtaagatttgaatttgcacacatgagacttgatgcaatgggttccatgaaaatggaaagtgagcatgtgcgaagattcgatccaagtattcatcaacccgtagatcgatctgcatcggtagtattctttgtatccattttgcatatctgtgttggagtttattcaacttaatataatcttaagttcttagcctaaacatgatcacctcttactcatgcggaattcaatcgatctactaacctttgatgtgaagccattgaagccagtcgtcaattccctttcttactgttcttccttatctatttcttcttttccgtaaaaaactatgggttaggaactggaaatagttgtatccgtccttatgtcccatattataaaatatatgtcaattatattataatttcacctataaacatgataaaagattagttaatcactatttttatgagctcacatgtaatattatataatttgttccttgatgtatctcttttagcactttaattatcttcttaattagtattaaatatctatgagttagagatacaaataaatatccgttccctaatccgattcaaagaaaataatatgagagataggatacgagatgagtgacatgttatccgatactaccagtatccggttccgaatttaaaggaagagatgggttaggatatgagaatgttgtgatctgacactaccggtactcgggccgatttcacctctagccctggcctactacttgccatggggcagaaatatccattccaaatttttatctctccaatgaatatctgttggatattctagtaggttagattgttagtatattccttttccttgttaatttgagtatttcagaaatttcttattcatgcagatatttctagccccttttgtcagtctataattaacgtgaaggcctacataataaaaaaacgtttggtatagagatgactaaagatgatgtttaattacgttagcaaatacacttttctattaatttgcaacatctgatttatgacaatcggttatgctttcaaataaaaataaaaataaatacatgacatgtgggtcaggatagcatatctcaaactttgcaaaattataatggcatggttccaaattacccttcaaataaagccataggtgcctgcgcttcagctttattaattgagcttttccactgttattagagaggaactgcgagccatgcctcttaaaattaagttgtgcccatagacaagactgaattcttatgccttgtacagagccataacatttaaattattgtgttaagttcaatggtaaaattttgtttgttgagcacttcgatattgaaataaatatttttaagacagtgaataacatggactctgctttgacagattgaagttatagtcacttattataaagtttttggctcaatcatttgaccaattgtaaatgacagaatcaaaggatgacgagaagacacaagtttaaaacacatctacacaaaaagagagatacatcttatttgagtagctaacctatttagtaaatgttcatataaagttggcgcagatctgcatgagcattatactacagattcttatatgcaatgtgtatgacttctttgtacttatcacacctttatagtttgcctaaaaactatgtcaatatattaccctaaaaggtaaatctatattacttaaaatgttagtagtggtagtgtccattttcacacccaccctgtcactgacatgtgggtctcataatttatactattacgtacatcaccatttaatgagtcatctcctgttttataattgactcttcccaaatttcaaaaccacctatatgttcaataaggaaaatcataatatttcttgaactaagtgcttaataattgatttaataaggtagaaacactacttaaaaaaagcccatagagatcggcactataggtgccagaattaactaaaaccggcacctataatgccttttcctcctccgtgggttgaaaacatataaaaccgatgcctttaagcaattataggtgccggttttactttaaaaccggcacctattataggtgtcggttaattaaaaaccagcaccaataataaattataggtgtcgttttttttttaaaaaatggcacctatccaaaccgagccgagctgccgagccgatccaggccgatgcattggccttatcctataagtcaaccttatcatctctatctctctctcgcctctctcgtcttctttcgcgcacacggcggaggcagtagcagtggcggtcgtgccctcccctccgctggatccggctggaggggaggcggcgggcaatgggtggcggtggtgcccgaggaggtaggcggcggcgcaagaggggaggcggcgggcgacgggaggcggcgacgccctcccctccgccggatccggcaggaggggaggcaggaggtggcgggcgacgggttgcggcagcgccctccgctccctcagatctggccagccgtcgtcgccacttgccgctgccgtccgccaccctccagcgctaccgtccgctgccaccgcccaccgcccaccgctaccgtctgcttggagcgccatcgcctggatctgcgtcgccgctccctccgtcctccttcaccgccgccgctccctccagcgcccgctcgcccgccagccaacgccgacgccgttgggcccgttgccaagaggttctcctctcctctcccctcccctacaagctttgagaaaatatttgattgccccaagattttgagcattgtaatgtctgtgttgtgaaatggtggattcttataaattagcatttggtcatttaggatgaaatgctgatgcaatttaagaataattttgcaaatctagctcacgaattgtaggtagcagctgttgtaggataattgacctctctttgcattttttttttgattggcctctcttctgcatcgacacagtcctccaccgccgttgccctccgacgccgtcctcctcccactgtccaccctccctcctggtcaccaacaccgtcgtgttcttctgcgtcgactccggtcaccaacacaaggtgatcgatcttgcctgatgctgtaattatgtattataacatatgcttgcctggctgatcgatctttgtggtccagattaattggggagccgctctttgatcatttgatatgtgtgtgttttgaaatggggaaattttggtaaattcttgttctgaaatgtatgctgaacttgatcttttcaggaaagattaattgtaaattatgagttgttgtgttgatggataggagtagcagaagatgagttgtgaatatcctattagtattaatagaaatgagtcactggagaggaggggttaaaatgcttttgtgtagctttgggaaagttaatatagaacttgatgcaatctgaaatctgaacttgatggtgcagttttgtatatgccatgaacctgtgtattccatgaatttgaaacaatatgaggatgctagaatgcagtaaacctggaaattttcttttcatgacgtagacctgttacaaatatcaatattacttgattgcaatttttagaatcatagaatagggtatgtttttgctgaatgacagttggacagctgccccatatttattttgtgatgtaatctgaaatctgaaaaatgtgaaggatgtggatgtgcaagatgtgaatgtaatattctgtgacttgtgtggaggatgtggatgtggaggatgcgaatataatattgtgtcatttttgtgtttcaggatatatttctgttgcgctatttattttttttggcttttattagtataggtgccggttctttattgacacctatgtggtgagtacaaagtgttggcctttaccccttgtaggttccgattatttgcaggaaccggcacttatagtaccatataggtgtcggttctgatggtataaccgacacttataatattataggtgcccaatgattttgatcattggtgccgaccaaaaggtgtcggatccaaaaccgacacctattaggccttaagaaccggcactaatgggtatttttgtaacgcacaggctattggctagtgcatataaaatttagttgggactttataaaaagcctctacaatttctacttagccatacaaactaacataaagagaatgctcgtactataatactacctccgttttttaataaatgacgccgttgactttttctcacatgtttgaccattcgtcttattcaaaaaatttacgtaattat

SEQ ID NO: 55225 - DNA, 1778 bp, Oryza sativa
atttattaaaaatacccacaagccaatttgacataaatcttggtgaattttagttgttggaggctcttttaggcttttaaaatttctagaaatgcattacagcacgatttaaatttagggcaatttttagggcgttacaatatccgtgtgcttgtagattttatctgtgatcgtaaaaaataccaacacccacctctcatccgccgcatataaccccaaataatgatatcccgtaatctagacaccacgcctaaactatcagatactactctaatatcatcgtcctgacatagagtaattgcatatgcaaacattatacccgcaccgaagcatctcccagataagctagcagtataatcagtataacatgaacataatgtaaagttggcattcatatactcggaaagtatttcaataccataaatgtataaagaagagtattctaaataaagtacatagcttacaaaagagaagagaagagttactatagccatacccgaactcttccgaaggcttccggactcctgatttctactctattcctattccactagcttaagaacattaaactaacttgagagaatataagagagctcttgcttgaggtgtgtgttgaagtgaagagagtgaagtccttatatagaggtagttatgacggttgtggaagcagaattatccgaagtgccctccaaccgtcattgggatgcaatcctggacgtccacgccgaaccctgcatccaacagcatcaggatgggttcggccaaaccatgggctgggccatcccggcccatcttcggctggtggcctcctctattgctcctttatgcagacttgtgaattttggcccaattcatcgtgtcaattctgagttcttagcccattcatgcataagtctgattctcgacatcgtccgaatgatttatcgtcttagttgatgccgattctcctccatttaatgatcattctctgcaaaaggttagtgaacctaatactggcggaatattattattctaacatgtatatgcattgatgcattgcaagcataattagttctcctctattttggtaatattgatggtcgaaactgatcgataacgaccgtcaaaaaacccccccaagcttgaacctttgctcatcccgagtgaaggacgaaaggaaacaaaaacttgattgttgatcaggagttgctactatgctgtatatcttaaaggtacaagtgcaaggtatatgtactctctctcagattaaaaaatctttggcacagtggcttatccttatctctgattcccacgagacaccggttctccttgccttgggcggttgaaagacaacatcaattatagcaccaatcacccaatctttattcgactcttatttcggaggttttcaaatgattttgcaaaagaaagccaagttcctcaaatgattcacttagtctctctaagtgtatcaatatgaatttcttaccatttttgcctttttgattcctactctaaggtttgatatgtttagctcggtagggatcaaacatggcatacttgcattcagatttattactaagttaaaaacgtagactaaaatagataactaaacatactcaatatcaagatcgtgcaaagtgtgtgatatattgtggaaatggtatataaagaaaaataaagaaaatgcttctcctttgtgcttactttcttctcccataaatcattcttttattaattaggagagggcatagctacacatttctcttttttttttctttttttttcatgctcatgct

SEQ ID NO: 55226 - DNA, 20196 bp, Oryza sativa
cctcatcttccagaagtggctcgggagattcgtgagggggaactgctgtaactgtaacacccaagaaaaccacataagcctgggatgccactaaacaaccacacataagtgccaaaacaagaaaattttggcaacaactaccttagacaagaaaacatcgcggaagcatcaacatatagattaaggttatgatacaacaatggactgacatgtagggataggcttgaaaaggtagctcattaatggtcaacacttctagtgtttaattaacccattatgtctaaacacaagtaatcctatcagcatattacaataatcatgactaagtgagatcatgtcgtgcaacagtgtagctaatcccatcccttcacgcaaacatatcaacagcaagtacctgaaaagactataaggggatgagaataaatctcagcaagcaaacggctttaacaagctacttaaaccacaggtggattatatagttaattaaatactaagttatgattcacataaagacaagttgaatatccatagactaaaaatatcatgacgtcaccaatcaaatccatatactcacaaatcccagagaagaaaacacttctcaaagatatcttcgatcgatatttcacgtaacatcctgcaatatgtacatatgcaatgcaatgatatgtactcctgctttcacacccaacagggtgaataaatgcatatgcaatgcaatgatatgtactcctgccttcacacccaacaaggtgtgaagctgcatcgtattacggcaatatacgatgttgtaccggtacggtcgcaaccataggttcacgacataacttcaaatgcaatgcaagtgatgcaaatgcagtatgaaatccagagtataacatcggaaccaaattccttcgatggagatcagtataagggtattataaccaagagcataaagtataaccatatacagtgtaaaatcaataagtgtgattcagataggtaaatcctctgggcaacaaataataatatatcggttgatgatatataattttcaaagtgaaggtagaataaaataacaggttaaagctgtagcaaaccaccgctacgttcacttgccttcactgatgatgagatgaactctagttgcattccgaagtggcatcacctgaataaacaccggctcagactcaaataacatgcataatcattcaagaatcacacatacgcttcctacgctgggatcccaccccaaacaacattaaacaaatcaccgataatcttcctataaaagcagcatagattaacaattcgatacctccaattctacatcacataacacagcaaaatatatcatttctgacatctacagaacaagagttacaactttcatttagataacaaaattgaattcttccatttagctggcctaaaacatggcacaaaacagagaagtgcatctgcccagaaaactgtgcaacaaccattcaaaagagcactgacaacaaactacaagataaaatctaacaatttttatgtaggaggtagatcacaacatatgctacaacttttgtaaaaacaagtttctctgattccatctttaaaatcctctaaaatccctctgaacctcgactacagaaaaatgcatcgatatttagacagccaacttcagaaattgatacctcctaaaccacttgatataaactcatgccatttggtcagaagatagatctacacgtttctacaacttttgtatagagacttttcgcaggaaatcccattatgttggccgaaaaggcagccaaggtagaactgtgcagggtggcagatcagaaaaaaaacccggttgaggaataaatcggtggatccccaaacttactcgcttccaacacttgatctaaaccctaatagaaaaccaaaacagagggacgaaatcatgcattgatacctaagcctccatgggcagcgggtaatcaaaccccacatttccatcttcacctcgatttcctccgcttccttctttccctttcttctccttcccttcttcttcccagatctgcagcagggcaggcatgggggaggtcgaccagaaggggaggtgggcgccccaaggtaccaaatgacggctagggggaggtggggagggggacctcctagggttttggggtgtggaggggcagctgggccttgggctggctgaaagctagcccagctagcgaataactattgtttttcttctaatttcaaacaccaaaaccttacggacttccaatatatcctctacggtattctatttttttctagggcattacagtaacctcctccgctaactcaatctctgagagagagtcggtcaaggcgaaccttgcccgcgagaatggaactgagaattcattccctcccaaagttatcttgaggctatctaatcggagcgtgtttatgaggagttgctcaatggaaagcccgattagaatgacaatatctcggatttcaaagacgtggaaatccaagaccgcctccctgtcttcaaagtagacaggcacatcttgcacaatcccaaatccttcgatgatatttccgttcgggtgtttgaagaatttgtttgtcagggttactggcttatcgctcagataagcgaatgcaaatgactcaaagatgagattaacctcgatagttggactgtaaagaataccaatgtcgttcccctccagatgacaaggaatgattcagggagcggtatttatccgaattacttcgtatgaaagctctgcctcccttagccattcgtcgctcattatggatgttagctcccgaacagtttcccgtaggaacccaagttccataagatcaggaggcggcaaagggacgagtggtttctttttactaaaatagtttagggtgttgccatagtcttcgtcaaaaccgtcccttaacagaattgcggcatggtccgaagtctgaatttcttcattcgcaacggatggctgcaaaggaactttctcatcaatcgagccagtggaagtggaaggttcagattgtgactcgattgttgaaggttcctctatcttggacacggatacctccggagggggttcatcagactgtgccatgaaggaggtactttctagaatgcggtctagaattatttttccttccaacggcgttttgtgcatgaatgatcctccggcggttatgttcagatagaatgtagattccttatccaaacccatatggaaatgttgcaagagcatatattcgggtaaggacaaggttggtccggactgcagtaaattagtgaatctagaccaagctgcaccgattgattcgtttttgatctgctggaaactgatgatctctactcgaagggtagtaatacgagtatctgggaagaaggaaagacataatctgtctcgcaactttttcccaactaacatttacacatccaacggtagaggtgtaccattgcttcgctctctcttgaagagagaacggaaacaattttcaccatatggtttcttatctcatgccacgaatattaaggcatgagcagacatgctcaaagtctcgtagatgatggtagggattttctagatcaaagccagaaaaagtattttccctaaccatgttgattagtttggagcgaatttcatagccagttgtataagttgggtccaatgaaggaggtggctcatagaattcgcccctaggagcagacagctcgaaaagaggttgctccatagttgagaagagtttgacaggaatacttctctgggtagcaggggtaaaggtagaataaaaagtgaaaaagagatacgatgatgaactgggttcggaaatgattagcaaccgttccccggcaacggcgccaaaaatgcttgttggtaattcttatggtcacagatagaaatccgcaagcgcacggatataccgatgtagcacttcccctatggagtattctaagggtatcgaatccaagggaacttgtggtttcagatcttcattcggttcatccaaggacaccaacaaaggatatgccaggatagacatgattttctgttgataaacagtgtctagggaaagcttaagttcaatcctaacgcaatacttcaggcactagcaacccgctgttcccagatgtcgctctactacatacctggatagggaggacttaagtaatcttgagggctgtcaccacctctacacctacctcaaacgtactgtgggatacgcagcaattactggataacaatcacctaaaaaccacgtctaagcaattaatatctactttagtgtttataactcaccaaagcaatcactatattttagttaattatagtgagcaataatcccgtatgctatttaggaactaaccaggagacaattctcataagataaatctaaattactcaagaaaaatattgtattgaaatcagagtaataaacagaataaaagaaataagagaagattactgacaactccggaattcttccgatttcttctactctactctcttcgtattctagtatacaatatagtgcaatagaacctcttataattcagctcaagcttggaagtgtgtgtgaagtgaaggagtgaagctacttttatagggcagttatgacggttgtgagaaggggaaatgtctgaactgccccgcaaccgtcattaggagagcatctggagcatccacgccaaaccccaggatcaatggcgatcagaggggttcggccgaactagggggttcagccgaacttgggctgggccctcccggcctggccttcggcctgtggactcccctgactctcctctgtccatttctcggagttttgggctgagtctttgatatttttatgactagtgagcgtgcacgtgcaaggcatgtcagtatactgaatagagaaaataaaagaaaaatacatccatcactgatgcacatcgacatatatcgatacattaaaacttacattcaccgaatgaaatagcataaagcatgtacgtcagaaaccggaataacctggtttagagtcatggatgctgatgttagcccaaatgaaatagcatcattgcgctctactgtattaagattttccattgaatcctggattttctaatttgttttgcttccctcaaacaaatgtttctgatatatcatagtttgaacgtgatacacagctatagataagatgcagtgccaaatttggacatcttcagctatatagttgggtgttctaagtagacaggtgtatcaatcaaagagctgcagtatgctccccatgtgatctcaaaagaaaaaataattggctacagtgtgaggtaccttgcaatgctacagaaataattaagaaacaaaatcaacctttagatgccacgaggagaaataatgtaatttcagtgttcaacaaaccaaatgctaagaatggcatcaaatcctggagacagagctgctcccccttggccacgcaagtatgtcgatgatatatgccactaactcctagggtccaaccattgctatagcattactgcattaggtttagaaaataaaattttcagaaaaagttcagtgcttgtatgaaaagtaggaagtggtatatttgaccaaaattcttcagaatttgaatgagatgcagagctcaacgatccattgatcgaaccacatgcagagttagtaactgaggcgaaacacaaaaacctcttcacatcaggtcagccttacgctaccatggtctgttgctttagagaacacatatagtaaatctacacgaatttcgtaagagagaacatataaagaaagcgctaaacgtttaaaagcatgacagttttcacagtgagaattagcatggctcttagactcttacaataagaaccattgtacctgagacttcggttgtaagaagattgtcacaagaggaaaacaatgcatcttagtaactatgtttctggcaaaaattcatcttgtgatagccaaagcagaaactgacagcaactcttagctctgagttgaatcaataaactactaataaaccattgctcagcagtttttttttcgccgggccggcgaatagccggccgatgtatattaagagaaagaaaaggaatgtacaaggttgcgcggtgcgtcagagcaccaccattaccgacacaaaagaaaagaaaaggctaaaatctcacagcaaaatttgctacagggtggcaaaaggggctaacaagacctgcagccatccaggtctcccattcatcccccatggccgagcagagctcgggaaccgttgccgcgattctatcgaacaccctcgcgtttcgctctttccaaatcaaccaagttacaagtataacccccgcatcgaatgttttgcagtcaaccttagcaacagatttctgtgctgtaagccaccaatcaatgaaatccgccaatggcgaagagcacgaaaggcccagacgcgtgtgcacccgaccccaaatctgctgggtgtaagcgcagtccatgaagatgtgctaacaggtttccccatcgttggagcacaaatggcacacccgggcaaggctcaatccgcggcgttgtagattgtcggcggtgaggcaagcgttgcgcattgcgagaaacataaagaacttgcatctcgccggtgcacgggatttccaaataatcttgccaagtgggcacttcatcctgcctgccgaaaacagggaataggttgagcgcacagagaacacaccatccggagctgccttccatatcatctcatcccgactagcagggtcaagagagattccagcgatcacatcccacagatctagatattcgcccaatgcttgaaccgagaggccgtctctgatatctgagacccaggaattattacggagagcagccgccacagtcattccactattcttaacgaaagataaagaggataggtcctctgttttccactgaaccaccatccggcaaccaattatctttccaaaatagagcatcttatccattccccaggaccaccttgcagccgataggaaaacaatgcagtctcttcttatccgccggcggcgcgaaacgcgcccacggtcgctccggctgcgttcggtggaactagatccacctagcacggagagcaatgcccatcagacgaagatttctgatcctcagtccaccatactcgaacggacgacggagtttatcccagactacaaggctacacgacccagccgcctcttcatcacctttccaaaggaatccccggcatttcttctctatttcgttgatcgccaagacagggacttccaaaactgacatgaagtaaagagagttccaaaactgacatgaagtaaagaggtagggccattaggacatgtttgatcagcgttaggcgggcatcaggggataaaagcttgggtttccagccagccaagctttttgcaagcctatccatcattggttgaatctgctcctttgttggttttctgacggagagtggcaacccaaggtaaacaattggcagcaacttgactgggcaggacaacacatctgttacttcatcaacttgcgcatcagagcagtgaattggtgttaacgaacttttaagcagattagagaccaaacccgatgcttcacccatcagcttgagcacaaaattgattgtcagcgcatcgtgtctggaggggtggaagaagatcaccgcgtcgttgtcacatcccaatttttattaattttaaaatttacctatttccaaaatttaaataaatatcgcctttcgcttttgttcctaaaacaagcttaattacttttattaaattaattaatgatgatgttaatttttattgtgtgtttattctaattggagttatttggatttaattagattttggtttgcgagctcaaattattctaactccctttatttcctaaaataaccactcaaaaaaaatatcatttgtgcagaaagccttccttttccttcctttttcgcttcctattgtttcttttcatttctccctctcttttttcacgtacggactgaaacaatattttctgtttcttcctctccaacacctggatccagctcctatcccaaatattgttgctttaatcccatgaaccagcagttataaaaaaagaagagatgaagagcaaatcaaccacccagactttacatcttcctatcaatgcaaacatttgacatttaatcctctgttgattgctctctccatccactatgagtttaatcacctatgggtcatcaatcaggatacgttagcaagccaagagccaaataattcccctgcattatcttcaattgaatcaccagataactcctccactcaacattgattccttctctcactgtataaacagacttccaccatttttctgcgttctcaaactctcaaaggctcatagagccaattcccacacttggtctgcaccgcttgctcacctagggccggcgtcgttgtggtaagacactctccttcctcctatctcagcgatggcgctgcatctccctcctcaacaacgttgacaatcggaggtcatgttcaccggcgacgatcaccggaggcattcgccagtgtcaccacattcttgtgtcggcaagtgctgttagcgaagctgctgtcttgctggtcaccatcattagttcatttgtgcctctgcacaagcacgtgatgtgtcctgtgaaatcacaggagctttttgttcttttctccttgccactaactggtagttctccttcaaaatgtcagaaaccacaaccaaatataaatccctgctttaattcctatactgatcgtccagtcccaaaataatcccagatcttttttttttgaccaagggcattaagcccccatttccattactagaaatgagaagactacaaaagttcaggttcagatacagagcaatcccagacaagctatcaagatagctggttttgtagatgacaccaaacataacagaatagcagcacatagctctaaaatttaaagccctgaaacataaccaactggtgattcagaaatacagcaatcaccacccaaaaccctaaattttgtagttgcagctgacatccagaccaatagagagagaacaatcttcagcatccaatccttcttgtagcggccctccatccatccttggagttgaaaatttcacttgccacctgtcttatgagtttggctcctaagagcaactttctttgatcttcctccagtctctgcaatggaatccaagattccaaccaatgacaaaccgaaaaaatcacatcagttgggtcattagggagtttattctcaaaacaggctttgtttctagatttccaaatggcccaaagcacagcagccacaccagtgacaacaagttttttaagtttctttccaaaagcagaaatccaggagctaaacagttgattgctatcaaaaacaggtttcaaatccaaagcacaggagataatgttctagatcagccttgccatagcacaatcaaaaaagagaagctgaatggattcttgttgatcacagaattgacacttagtgtcacctttcctccaccccctcttaaacaagttgtctttagtcaagattttaccctttagcatgagccagataaagattttgatcttcaggggtattttaaacttccaaattttcttgaaaggagtaggtgtctgttgaatacagagagcattgtaaaaagatttgacagaaaatgtcccttgcttattcagattccagctgagcctatccttacagcctagctgaaagtgtagatttgcaaagttttgtttaataagattccaatctgtcagtttttcatcaaccaaggtccttctaaatttgatcacactccaacctttttcttttatcttagctaaggaaataagttttgtcaaagtgatattataaagagcagggaactgagggacaagtgggcggccacccatccagctatcctcccaaaacattatagatctcccatctcccactttttttgaacatagactataaaattgttcttttacttccagcagcccctgccaaaagtaagagtctccaggttttgctttcagtacagacaagggtttcttcgtcaagtatttattcctaagaaaatcttgccaccatccctcttcattttcaagttgccaaatccatttccctagtagagccttgttcataagatcaagatctaacactcccaaccccccctgttccttaggagtgcagataactggccattgaacaaggtggtgcttcctaatgccctgatcctcttgccagaggagccttcttctaaagaaatccattctctccctcacccctttaggaattctataaaaggacggcatgtagagagggacattacttaaactggaattgatcaaaatcaaccttccaccaattgattgaaatctcccttgccaacaccccagcttgtgctccattttattttcagctgttttccaatcctttttcagaattctttttttatcaatagggaccccagatatctcataggcaaatcacctatgttacaagtaaagagttggctatataaattttgtctatcctctatcagccctatgcagaaaatttcacttttattgaagttaattttgaggcctgataattgttcaaacaaacacagaatatatttcaagtttctggcataatctagattgtcaggaatcagaagaatagtgtcatcagcatattgcaacacagcaactttgttttcatcattgacacctaatccttctagcagggaattgttttatgctctatgaatcaacaaagtaagggcttcagcagctaaattaaaaagcaaagttgacaggggatcaccctgtttgagacctttgtgggtttggaaataaggaccaacttcatcatttactttgacagctaccttccctcctctgatgactttcatcatccaatcacaccattgagttgagaaattctttgcaattagcattctataaataaaaaacccaatctattttaacataagctttttcgaaatcaatcttaaaaagaatgccactttgtttcttttggtgaatagaattcagaatttcatgaaggattaccaccccctccaggataaacctatttttgagaaaagctgtttggtttctggagataatgtaagacatcacacaatcaatcctgttcatcaacacttttgttagtattttgaaactcacattcaggagacaaataggtctaaacttttgaatttgagcagcatccttagttttaggaaccagagtgataatgccaaagttaagtctctctacatccacatccagagttcctttatgaaattcattcaaaagctttaagagatcaaactttatcaggtcccagaatttggcataaaactccccagggaacccatctggaaaataatcccagatctaatccacccattttattttctataaatctatttaatttgagctctctatttttctgttctgtttattacttgtttgcccatcgtttatttgcttctgttttttttatcgtgcacgagtagacgtcgctgccgaggaaggagcaggtgcagaagaagtttgggttggagattctactggtgaaggcaagtgtactcctttgatcaagttgatcccagtgtgtaaatattattgtcttcaaattatatgcatgttttatttaaaaattagcgctttgggtaattactgtcctaattgctataaataaattcctgccatgttatacattgctacctgtaaattctttgtcgccacgtattttgggaagtgagctactggaatgaaaagctctgataggtagttgagcttagccatgcgcataatggtttttaagcaaaaataatattaaacttgactaatcatatactcaacattgtttttataacgaccatgtggctgtgtgccgtcttttggtggcatgtgatgcatcgtatgataaacatatggtggaaaaattgttttagactggggtgatggtggatctgtctgaacctaggggggaagccttctgtgtgcgtgcttcccatcgacctgtgtggtccttgagctgtgtgctccttttgctgtgtgcttgaggtctttagtttaggcaagtcgccccggtcaattgaggactttacttcgtgcgccattgatctaagccctatcgtgcaaccacacgttctcgtgggaaggatctagcttagtacgcttcctagtccggacactggcgtcccaggtggttagatgctaggattttggatcgtatcgtgggacctttcacctgtgtggcaaagggaggactgcccatgagggaggccggtgttagggcgaggtaggggaaacgctttgttactctttagagtttggccgcaccgaagggtatcgtgtgagtaaagttgtacaacctctgcagagtgtaaatctattcgaatagccgtgtcctcggttatggacatgctcggtgatttcacatgaggggtagattttcgaaaattttactttggagcgagctgtgtgcaagataaattaatatgtttagttttgtgggattatatttgcatttcagcatttacattctgtacttattttcttttccggtatttaaattctgtttttactgccccctgtatacttttgtactaataaaatgccatttaagcaaaataacccctaacctttctttgttagccttgtaacatataatgcatgtttccgtacacttgttgagtacttgttgagtgctttatgtgctcacccctggtgctatctcaccagttgcagaggaggcttatcctttgtttccagaggaggttgtggcagtggatgatgactaggctcgcgtctcggtcgattgcctgtggcagtttgatgaatttcacttcgctgtttatcttttccgctgtgtttcccttcgcttttggggccctgcgcggccgaataaatatgtaaaccatgttacttatgcactggttatatattatatgcgtgatgcggttgtgatgttatttctgtatcctgtatatgctagcatgatcctggtctagcattttatacagagagatcctattcggggtctcgacagtcattggtgtagagcgaggcacgcagcggtagatgtacattggcaagaggagaaagctctcctcgctgcacagccgttgcgcatagggccgccagagcttccgtgacgatgacgaacaacagtggagagaggggatccctttgacgcaacccacgagcaagcctgatccgttgcgtatctctaccgttgatgatgacagaagtagaggcggtgaagagcaaggccgcgatgcaatccctccatcggaccccaaaacccaggtgccggagcagatccagaaggaattcccaggaaacagtatcaaacgcctttgcaatatcaatcttcaagagcatggctggcgttttagaacgatggaggtttttgaccaccccctgcacatacagaaaattctcctatatccttcggcgcctgatgaaagcagactgtgccggcccaattagctcatccatcctcgacgcaagtcgcaaagccaaaatcttgttgagaatcttggcgaagctgtgaatcaaactaatcggccgaaaatctgacagttgattcggttcctccttctttggcagcaggacaattgaggctgtgttaacaaggtgaagatgctgggcattggatctccatgctaagttaagagctgccaccagatcattcttgataatttcccaacatttcttgtagaaggtggcactaaagccatccggcccggtgccttgtcgctcgacatttccaagatcgccttcttcgcctcgtcttcagtaatgtcgcgctccaaatcagagaaatcatgcaccgccaagccgatcgcatcgaaggcaagggatgccgacggggggcaaggcatgccaagaattttgagaaaataatcatacgcagcctgaagcttgtcctcttcagttgttgcaatgatgctgtcctaacaaatagaggaaattgtcttcttccttcgacgagcattgattttgaggcagaagaattgagccgtggtgcctctatgtttcaggaaaagcaagcgggcatgctgtttgagccgaatgcgctccagggaggcgagcgcgaggcagcgacctttcagagatgcccgcaatgatctttcaccagccgacagaagacgatcatcctgggtctttgtccaattggaaaactacttcatgggcgatcgcgagttgctgacggagctcactgatacgcctggctccccaggaccgtaaggcagcagcagttgcacgcagcttgaaatgaaggctgctgagtgcattggagccagccggcgctgcctcccacgcctgacagaccacatcctcgaaatcctccaatttggcccaataggattcgaacttgaacttcctcggcctatgcatcatctgatcgcaggccagcaacaggggacagtgatcagaggcagaggagctgagcgcttgcaggtgagcatcacggaaaatttcctcccaatccccatttactagcaccttgtcgatttttgttagagtcggtcgttcttgctcattgctccatgtatagcgacgcccaaacagatacacctcgcgcagctcaagggcatcaatggtgtgcctaaacttgctgatcaaccgtcgatttacattcccattgtttttatcaccgtccgtggccaagaggttgaaatctccgaccacgcaccaggccccgaccactagctgcctaaccagcagcaattcctccaggaacaacaatttgtcgctgtccaattgggggccataaacattggtgagagtccaacttgccccaccttccaggttggagaaacaaagagaaagcgaccaccgtcccttgtgaagacaggaaacagagaagcgatcatgccgccaagccgtaaacagcccccccttgttccatcagcaggaatgaaatcaacaccatccagggcatgtccacacgactgaatcgacagggaccgatctagaacatctaatttagactcctaacaacaaaaaatagaagcactagaggttctaacaacttccgctacaagggacctcttgccagggtggtttagaccccttacattccagaccaaaagagtacaagacatgagaaacgaccagcttcaacattgcagcacatgcggcagttttaggctgccgctgacaccgccacactgcagagcgccgccagcgcctgtacatgagatggcgctaggggagccttgaacagctcgaggtaccggaggatatcccgctcgtccgccttgttctcatcctcgatgatgccgagtctcttcatcaccacccgctgtgctctggtgatcatgtggatatgtttcccactattctgggcggcaaggcgctcgctcctccttggagtgtacgaggacgggcggtgtcggtgccgaggctggtggggacgcttcccgaaaagtgacaaaggcggtggtcccaccagatcagccaaggcagggagcgatcgtgggtcagcccactcctctagccccggcctataaagaggaaaggcccgcgggccagtgagctccctgcggcggcggtagacagccaatgggccagggacgagcaaagccagcccaaaagagggagcgaggcgtggtcccggcaagttgaaaaaatctccatcccgctcagcgggcaccaggaccgacgaagcatcaacgtcagggcgcaccggtgatgacgaagtaggtgtcaacattaatggctcctcaggaaaaagctctctttggagacccatctccctggtagacggggccacaaccatgcatgccggggctgacgaggggtgagtaatgacgcgtggagacggtgggcccagagccgccaagcctagggaagaaagctgaggcagagccggtgacaacgggcagcgcaccggcgaaggcgttgaaggcgaggcatcccaggaggtgggggctgccagcactggagaagcaccccccggactcgacatccgcggcaggaaaggcgcagctgggggcggtggcgtcgtagccggaggcgatgccgtcgcagctaggagcggagtcgtcgacttagctggggatgaagcctcaagcgctagcacagagactccctccagaatgcaccgaggcatgctagctggcatcaccgccgcccgagcggggagctgcagatgggacgcaggcaaaacgggtacgcgctacaactgccgttgaaaaccccccgccgaaccagaacccatgtctgccaccaagcgccggccccagccccgttgcatcgatgcgaccgaggaaggtgttatgggtgcggcggtgaggaggtacgaagtcatcgtctgaagaagagccttcccgaggctcctggagcgggtcgaccacctccatgatgtgaaggagtaggtcgaacttgagacaatgcttctcagacggtggagccggcggcccttcggctaagagcacctcgaaatatccggatcgtcggtctctggctcgttccaccattcttgcgtcggctcaggaatgtcgagggcaaattccttgggaatggcggaagggttcaccgcccaaggcagcacttccgtcatgcaggcatcattcggcgggaatgattcgatgaactggcagtccaccttgttcaatagctgcttgagctcttctggctcggccgcatggggagggaggccctcaattgccagccgaacgatgtgtctcattttggtgcttcgggcatgaatggcacggtgccagcgacgaaaggtgatcctcgcgccagcaactgccaaacggcctgagagatcaagaaccgccatgcagtcttcctcgcgcgtgaaggatatgagaaaatcggagggtctagtcacttcgacgcgcacattgtcatagagcacaccacaggaacgacggagctcttccaccaccatggccggcgagacctcctgccgcccagaaagaacgacaacgagagcacggcccctcagattctgctccctcagattctgctcgatggccgacatccgctgggtctaggagaggaccccccctccccacgcccgggcggagaagagggtcgccagcgcctagctcatccatgacttttgccgacgaagcagaatcgggcgccgacactgtgacggggagcgcctgacgagggggaggggcaccgggacaggaaccgccgagagcgtaggcgcctggacgacggacgcagttgacggagcggtcacgtggataggagcagcagctgatgcttctttcacggtcggggtacgtgccgcatgggcggtgtgcgcaggagcggttgggcgccgcggacgagcgacggctggcggcgcctggataggtggctcgtcttcgtcttcttggtggaaggtatagtggcgctcaaggtggctcggataccagcagtggtagcaccttggcgtagccgtgcagccgtctttaaggtggcccagacctaggcagcggaagcacctcccatggagccaccgagggatggggcgagcagggcgagtaaagatggtggttggacggccggcggatggccctcctttactcctcctctggaccacacaccaacctgcatcaaatgtcttgctgcgatagggtagggggagcacgggagtcaacccgtggggcccggacgacgtcagcccaggaagcggcggaggacgagggcgtagaggcgacggctttgtctggacggtgaccgtcggagcggccagtcgccggaaggggtgggtgggaggacgacaacacggctctcactctctctctctcatggcgctggtcttcctcagcaggttaccaaatatatatatgatcaattaccaaatatatatatgatcaaatatagtgtatcaatagttagctgaacaagggcgtgtacctgtgcttcttctgaaactgaacgaatggatggctgcttccactgcttggagtggcggcggcgggctcgcacgaggcgagcggctccctcgtcgacgacgatggctccggcgggatgtccactacttggagtggcggcggcgggctcgcacctggcgagcggctccggcggaggcggtggtggcgggaagcagcgggcgcgtaggaggcggcggcggcgatactgcccgctccctcggcgacgacgacggctccggcgggaggcggtggccataggcaatccgaggcagcggcggggtaggggaatcgggagcgcagcccagcgagcggagtgaaggcggcgggctcgcacgagaggcggtggtaggggacgacgccggcgacgaatatggctccgacgggaggtccactgcttggagtggcggcggcgggctcgcacgaggcaagcggctctggcagaggcggggagcgacgggcgcgtaggaggcggcggcggcgatgtggcccgctccccggtgaggcggtgagtggagtggcggcggcggcgcccaggggggcgacgcgtgagggatttttttttctttttcttttgtcttgaccgatcgctaatttctgtaaccgctgctttcctcctcgaggtgggatcactaattgcaggggtgatccaacttttgatataagccgttggatgaatagatataagccgttggtcaggaaaaataggtgtttgatgaaatcgtgctttttatagtagtatagatgtttacgacccatccttgtatggatacttgtttctcctgactttattctagatttcctcccaacttcggggtttaacacctatacaccaacacttgtggaataagtgagattaaacacctatcactatgttggatgttttattatctgaacttttatgcagatgttggcggtatagaatcggcatttaataaccgccaacacctaccacctgggtaaaaccttaagcaacaagtctagctttatttctcacaatcaaaccatcctcattttgtttattttagaaaacccacttggttccaatagtattatgtccaaaaggtggttcaactaaagtccaaactttgtttctctcaaaattttcaagttcttcatgcatggcgttaaaccacgattcatcagttaatgcatgagtaacatctttgggttcaaaagaagcaacaaatgtagaatttgcacaaacatcatgagtcgttaccttagaccttgtagtctgctcacgtatattaccaataatttgttctggcagatgtcgtcgttgaatatgcaaaggagcaacgacttctgaagttgtttcacgttctgtaccctcactggtcgaagttgtagcctttggaggaccatctcgatcagcatcaacagaatcggaacccgacgaccatggccggtctgactgcacctcctgtgccagtctgaccggaggcgttccggcgatctgaccggcctggcgcccggtctgatcggccgagccgacctcatcatcgtcgttgtcgctgttgtcttcaaaaaatacgaccatcctccccctgaacctgtgacaaagtacctgcaatttcggatctagtacctggactagcctcatcaaaagaaacttcgcaagtctcaacaattttgttagtttccaaaacaagtacatgatagccacgtgaatgtgcggggtaaccaaaaaacattccatcggtaaagcgtgcctcaaacttatccaaatttccagatttcaagacaaagcatttgcaaccaaaaacacgcaaacgtgaaactttgggttgatgtccaaatcgaagctcataagaagtttttccaagttttgaccttaagaaaacataccactttcctccaacagattgcactctagctggaccaacagtgtccatgtgtaatagctatcccggtgcatccgtcatcacagaaacaataggggcatgtgaagaagaaaccatcttagcatgacgacacggtgtacaaaccaaatcaagatctttcttaagtttaggcaaaccacgaacaagatccaaaccacttaatctagtgagatgatcaaaaccaacatgtccaagtctacggtgccaaaacatcacatccttattaaacttagcaaccaaatatgttatcacatgtgaaaccggattttcaaaatcagctttaaacactcttccatagcgagaaatattcaacatagaatcaccacaagaatcaaatactttacttccagttttcttaaagtgaacctcaaaattttcatcaacaatttgtgaaactgaaagcaaacttatactgg

SEQ ID NO: 55227 - DNA, 8038 bp, Oryza sativa
tgtaccccttcaggttgataatccttatcgttttggacgagggcacattcttaaaaaaaaacgacagtgaccattatttttcattataatatgtataaaatgttaacaaatatatgatttttattaaattattttttaagactaatatatacatgtagtcaccatatttgaaagataaatattttaaaaatgattcataatcaaagattctaaagtttgacatcactcttgtctaaaacgataaatattatcagtccggggaagtatttaaagagtgacaacaataatattattttctagatctgctactgaaagtctcccgatcgaaggagtctggagtgtgatcggtccataaaggttggtctcatatatacattgcacaggaacttaagatcgtcctcaagatagaagctgctcataggcttatggtccggtcaaagaaaataacacaataaccaaatgaatctatacgtctgattacgatgctttgtacgtttatggataactcagttgcaagaacaggtcttagatgatctgtctagcactctcatgttttttttttctttttggaagtggcattgtgtgacttgtgtctcagtttactcgggttaatctaccactaacttgaaattgactagcaaaatactcactaggatattggataacaaatgtacctttgagcaattaacaactcataccacgtggaaagttcaagagttcttttgctctggatgcatcacttggaaagtgacatgatggtcatcagttgtcaaaattactattgcatttataatttcgtgattatgcaaatttttctatctcaatcaactgatcctgatcgggaaaatggggccagaaattagttcggtcacatcatattctaacgagaccaatgtattaattaaattcacgctggcacaaattgaacgacaattttttttctgcggtgcatgacaaagacgtaaaaattggccaactaaaggaaaaaaaaagtaaaaaaaggaacagcggaaatatatacgtggctaaaatacgcacctttggagaatttttcagggtttatgtcaactccgatgattcgagatgctcctctcaatctggcaccttcggcaacctaaaagaattttaaaataatcaaaatttattttcttttgtttgccttttcgcatcctaattattacaaacatatattttgttgccaaatgaaatgtacgttataaaaacgctagaaaacacatatttgtagaaaaaatattttattgcctgagtatttctcagtaactaatttacttaccgcaagaccaatggcaccaagcccaaatattgccactgtggaccccttggagacgtttgcagtgttccatgcagctcccactcctaattaacagcaaaatcataaacaatttttaattcattatctaaatgaacgattgctaattaaattcaaaacattaaactctcacattaaactttcaagaaatctacacttccatatatatgcagtatcaatcaaactttaaggctttcattttcacacatcgatatcacaatgatagaagcaaatgcccaccattatcatctaaattaataaacagggataagtacccaaaaaaatcaaatggagggccatgctgcagagaccaatctctgtagcattgtgggctggacatggagcttggttttgttcagtttcagagttggacagagtaaccaatctactggcatccgtatccaaggtgtcccatgctggactgttggatttcaaataaaatcaaaggaaacatcgatatctagtcggcacttgacaagtccatgagtgtccagatgcatgctagccagtttgtccatgtgtcatgttaatccagctagctgaatttccatgtattgacagacagcatctcaacaaattttctgttcaagatcatgggtgcccctgcctgtttctcctttatggtttatatatacttttatgttggcttgttaactactacctccgtcccaaaatatagcaatttttagctatgaatctagacacacatgtgtccgtagctaaaatggttacattttgggacgaagggagtagtgtatagtttataaaacagtggttgtaacttctaggttataagttcaaggagatatagtcgtaactcctgtctcaaaaaattaacttggctcatcagtgtaagagcaattcatgtcattttaaaaaaaaaatcctaatacaaaactaaaatgcctattattgagtatatactatctccatcctagaataattacatttttagagaaataaagacatattagcaaccaacacaatttaccactattaataatcacactatatgtacacattccatacatacacttgattaaaaagaaagttaaaaaccatttttaaatttgattaaaaggaaggttgatcagtcccaccacagcataaatacatttttttaacaaaatttgaatggtagaaatacaattattctggaacggagataggacaatattttcttcactatataggaccaagtcacggttgcttacctgtggagaccccacagctgaggagactcatcttctccaagggagccttagggttgatcttgacagcgcaagcggagtcaatcacagtgtactcagcaaaggtggaagtgttgagaaaatggtagaccgggttgcgtgcaccggaggagcggtcgatcatggtgaacctcgtgccaccatcggtgaccatggtgctcttgaatgggttgacacggtaggttttgcataggttgctcttgctggactcgcagtaggtgcacgcaccacactcgccggtgaagatggggacaacatgatctccaggggcaagatcctccacaccctctcccacgctctccaccaccctgtttttttagttgcatattgctatcaggtgttgtataaaaatggtaacgtctttaatgtgccaaaaatatactctttaggatgagtgcttttactatgacaagatgtattcagttttgtgaaaacatgcaaatattcattccattaaacatgagaaatggagagtaaagttgattctagcgcaaccatgtaaaaacattgttaaaattaatgatgagctcatttgcgctaaataaaaaaaaggataaaggttttacatttcccataaacatcacttgtatgtagactagatttatatgccaaagtgatccgaaattttttattaaaatgaaatggaacacaattgatgaaaatatgtgaggctggtacaaagaataatcaagcatatgaggtatcgtctaatcccatgtgagctaagctggattgttggacctatgcttttggggagccggcgttctatatatcgtcttcatctgccaactaacaataattaattgtatttgtatttattaacaactggttatctgtcacatgatcgatctaatcgccatacatcgatcctactttatgtcagacaaaaaagatatctctagcttgttggcatgcaccaattgtaattaagatcgaaagcacgaccagtttctgatcaagcaactctaataaatccacttattagcacgtgtctggtgtaaccctggttatgtagacatcatatcggatttttttttatttgcttaataattcttggtttcttaaaaaccatcttttggagtatcttgacggtgatctctaatgtagtaccattaggacgtccaagatgacttttcttaagatgaagttgaccatcatttcaccattagcttttttgcaagcaaagtcaaaaatgcaacatcactttatacaaaagaaaaaaattcaattgcaacagaaatttcagactagccttttggtctttcctatatatattaattctctactgaactaaagctaaaaatcctatttcaaccacttttatctttcagccagtttaattaattgttacatatatacttacatagtacctaattaattttcctcaagaaccttttttttgcatttgcttgttcaaaacgaacatgcatgtaaattaaagcaacagatgaattttcaagagcttagttattataaagagaggaaaaaacacagagaaaaataacttttaactagagaaaaaaggaggataaaaattaaaagagggtgaaagatcaaaggtgtagtactcaccctgctgcctcatgacccaatatgcgaggaaactttcgctgaagctcgttctatcatcatcatcatcatcacgccagccaaaacagcagcatcacatgaacagacagattgaaggacaaggcaagaatcaatcaattaacaatgctcgagaaataattcaattgtgtacatctttgatatagaagacagaattgtgtatgctttccttcatacaaaagaagttaagtaacttaattagcaaaatttcatgaacacgattactgcatattcgtctatctttttatatacatctctctatatatgtatttgtatgtgtatatatatgtgtagaaagatatatacctctcctttccaggcgctgaggtcggtatggcagatagaggtgaagagcaccttgaggcgcacctccatcctcgccggcggcgccacctccacctcctccatcaccagcgcctcgccggggccgtgcgccaccgccgctgcacacgcatgatcgtcgtcgtcgatcgtcatctcatcatcatcgatcacaccggccggccggcaagaaaagcttgccggccgacgatggccggagaggaggacgaagctagatatagaaggcgatcgatgtcgttttaattctcacctttgcatttgatcggcttccctttggtgtcggcgccggcgccattggagtgcagggcgccgttgccgatggcagtggcatccatggtgtttcttgcctttgactttccgaggagaaatgtggatttcttgattgtagcttcaagtgaggcaagttgatgggtttatatagagatggcatgaggagagagattagctggatatatatatatatatatatatatatatatatatatatatatatatatatatatatatatatatatatatatatatatatatatatatatatatatatatatatatatcttgtagatatgatagggaggagaccaacaagggattaaatattttgttttcttgaagctataggttgagattttaatttggtttctcttttattttctcaaaagaggtgcatcaatccaaccagccaccgctttaactcctggcacacacaattatgcatagctggaagtatatctgtttcaaattacttgtggttctagcaaatctcatacaaatcaaaaggatatcgaagattacatagttgccccattaaatacatctcaattttttttgttttcaaagcatataaaccaatgggagttattgggagtttatgactgtattaatgcatgactatattgatgaaaaggtggagataagatcacctctaaaaaggctttgaattgtgagaaccatataagtaatttgataaaaaaaatgaaatgctagaatggtaagtaatatatatgaaactgagggagtactgatttttttgaagaagttaggatttatacttagctaacgactattaagcgtgttcaaacacggtgtactagagagtttgtgattaaggtgatgtgtttgtcggtatatcttgctgtgaaaaaacaaggtatggttcatgttcgccaaacacaattttactataaaaattaatttctaattgtataaaggtaaagctccaagtaactccatttttcactcaaacaattaaacaacgcccgcacccaactaaaatcagcttttttaaaaaaaaaaaccatatccaacaagataacctatgtaaaagaaaatttattttttcatggtaatttgtatatgattttaaatattggtgttctaaaccaatcttacgtcctatgcaaataataattaaattaaacatcctgaaaaactcgaagtataatgttactatcattcactccacaaatttcaccttaaaaaaacgccttttcactaaaaaaaattcaccttaaaataagactcgtgtaatgcgaagcgagaaaattattgaaaaataatattatacagaaaagcgaacaatttcatgcatggtgttgatataataattagtactgtggcaaaatagtttaaactaggaaagtggtatttttccaataaatcctaccatttaacctacataaagttggattaattgacaggggttaagcatgctattataccgatcgacacatacacgctccaccattgacttttgaaagaaaaaaatggaaaaattaggccaagaccactaacattaattaggtgtaaagaagaggtatgaacacccgaagctcatgagtggaggatgctgtaaattatatatactcacagagttgtaaatttacaggtttgatcttttgattacgacatgaactgtagtttaattgcaattgatggcatcgtattaaagagacagcaaactcttctatttgtattgagtgttttagcaggagactaaatcgatctacttattatcagtccatttgtgaatagcaagtaagcacatgaacaagcactgcaatcaatgatcaatttaacatgtggcgtaagaaataaatgtgaaaataaatcgtgggtagatactagggatgaaaactgaacggatagttttcatctgctccagagaaattaaaacgaatatagatacctttcgaaacggataatatagatacctttcgaaacagatagttcggatacgaatacggatatagtatcggggtttccgatatatatggataataatacggatatccggtgaacaccctatttcttaataactctataaccttcaatctacctttttagattttaatagtaacacatatcttaacactagtccacattattattattagacttttacataatttttataaattatactatattttatataaaatgagctaattatgtacgatgatatttgtttctattagaaattgaggtggtttccgtgttccgagaaaaaaatgtttccatattcatgtccgatcatatttgatccttattcatattcaagataatttgtatttgtttccatatccgtgctattcgtatttgttttcgtatccggcaaaaaaatatgaaaacggatatcgtatgagcattacacattcgtatccgctccgttttcatcccaatagatacatcttgccactggaccagtttctctttaaaaaatttaatgatatatatgtatgtatgtatgtatgtatgtatgtatgtatgtatgtatgtatgtatgtatgtatgtatgtatgtatgtgtgtgtgtgtatatatatatatagtgaatctattctacacccctcccctagaataactattctacacccccccctcccatgggtcaaacccacctcccccaccctccctagggcccaaaacccctcctcctacctcggtcaaagcgtcctcccaccggtcaaacccgcccaccactttgctgctctcgtattgtaggaatcgtgcagtaacaggacggtcatcctgcagtaacaagacagcattatcgcagtaacaacgtcaaaaagtagccatgatggatctagtttcgttaagtgtttttttatgaactttatggtgcaaacggattggaaatacaagatatgatgtgagagatattgctctctaaagattgtgatttacctcttttttagttctcgtctcactggaacagcgtagtaacacgatggccaatatgcagtaacacgtttgcttttcgcagtaacaacgttaaaaaatagttatgatggtttcagtttcgttaagcacttttttttttacgaacaccatgatgcaaatgggttagaaaaataagacatgatgtgtacgttagtactctctaaagattgagatttaaaatactctagatctaaaaaaacattactactatagggccactgttacgatgcatgttctctgttactgcaaatttcgtcatattgttactgccaaaagtgcagtaa

SEQ ID NO: 55228 - DNA, 10800 bp, Oryza sativa
atccatttttatgtcattgttgttaaattaatttgattattgattgttgagagcctcaccaggtaaaaaggagccataaaaagatgcttgcttcacttaaatttatggatagaaataaatccaaggtcccatagacaatacaagattttatggaccaaaagcaacttttcttagcagtatgttccattaacaatggggcatgtagagtcagactcttcggggcttgatagcatcatattgaactatgacataatatctatgatataatatctgttatatgtaaacggattggatagcctactaaaattatatatttatttcttatgtttgatctatgaattgtgttcagtttcaggaagaattcaatgcaaagtttaaactgaaggccccaaattgtataataaatttaaggtggtcttgatgaaggatcaacttcattttcgagatatatggaatgcatgcagatttataatacattctcattagttcgaaactcagtactatcagattttgtatttcttcgatatttcaaaatcccctgtgctttggttgcactatgagaatttctaatttctttcattgtcatttgtatagatattcaaatgatgatagatttcttccatttttccaatgatttatttctttcttacatggatccttgtgcaatgtactctgttcgcatacagtatagttttgttttcccccttttcagcctgaatataattttcaggaagttttgattcttcattcttctatggatcgaaatgaatcggtttggctatatattgagtctgcaaaatattagattgatggaatatatattgtgaaaaacgtgcattgcacgtgcacgattactagtatatatatgtgtgtgtatgtatatatacatgtatatatgtatatgtgtgtatatatatacatgtatacatgtatatatatgtgtgtgtgtaaatttttagtgtaaatttcgatatctctcaaaaccattttacactttaaaaatatgttaattgggaagctactttaaaaaataaacatggaagcactagggatgcaagtgggtagttccgctatcttcataaaaatccgcttgctagtttattttctatatggtagtataaaatttagaagaaaaaataaatcagaagtgagataagcgggcaatcgttcttccgttttagcagataaattgcgccacgatgcattttggacatgtcgatgtccataccgctcaatgttctagaggacgacaaacatagtatttttcaaggtacagttgcacgggagcttcaccagatgaattacgacactgaacaatttgcactggtttcacgcgatcttggggggacagatcagttaattacgcctcttaataatgatttaatcaagaccacttgcattaaacataagaaagagaaaaaaaatgtatcgaacggtccaatcgagttgtagcacgtcacaccctgtttgacccgccaaaccactcttacgcatgcacacgttctgtttacggtccaatctattggttattggttattgatgattcacgttgtattccatccatactcataaaaaaagtcattaaagacaatgtgtaagttaaaccttatgaatataaattataaataattctcaagttgttgagtttgaaaatgtaaaaaatatatgtatagatttatcttgaaaaatacttttataaaagtatacatatatcacttttcaataaatatttttatagaaataagaaatcaaagttgtgttttagagaccgtgttgctattctaaacgattagtatgagtatggagggagtaattaagaaccgtttactgtatattgaactgctagtaatcaggctttgggtagcaatggactggtttcggacgtcccacggtgacattcttgatattgtgacacatgtcgcattggaggttttctgttggttgcagtgtccttgtaataatgtcttcgtcggatcggattctctgcagagtgatgacatgatatgaccaaatgacttattatatatcaattgctctccgacaatatctttcattttggttcgacgttagtcgccagatgtaataggagcgaaatttgatcgatacaggaatgagccgttgattttgaagatttttttttctggtttgagaaagattaggattgtaaaatcgtttgattcttattctgtgatgaataattggcatctgagtttattggttttaatatttggagattattagtgaagtggttttggagatgattggagttacaggtgttaaacaaggagtgctggagatttggtccagtcagaccgggcatgggttgctggtcagaccggtgtgtatctagtagccagaccgggcagcccgcggtctgaccggccgactctgtgtcggttgcggtttcgggttgtttcattggatatcattagataatttgtgtttatggcttctagatggatactatgaatatgtaatactgttgtttgctaataataagtcaagttggaaatagcttggtgtcggaatatggtttctttgtttgattcatgtgtaggtgtcttagtgcctcaggagagtattgtcgatgatggatcgggagtcaatttggagataaggtgatatccggacggtcagatatcatacgagatacttaggctaaagatcaatgcgcgtggttggtgaagattccatatggcatatgatggagatattgtgtgcgtatgggatacagagtcgaatttggtacaattggaatttgtaaagttggtttactgtataggaagatttcctaaagggattaggacttcttgtatgagtttggttcgctacctacctcatatataaatagtgagggagggtggcctcccggtatcgctttagatagcattgagttgacagaatagttagggtttcgagtttagtcgagatttttgtgaggagtgatgttgttgcactttctaaacacagagagaagtaataaagttgtcatttactttgacagatcttcaatttttgtttgctcgggttcggcggtcgtacctgcgatcagatcagcggtggtgcggcggtcagaccggtgggtcagtggcggttagaccggcgacggcgacaggaggcagaagcaattttcgggtggttagaccgggcaatctacatcggtcagaccgacggctttggcttggtcagaccggctaatctacttcggtcagaccgtaattcatcgatttgagggtaacttttagttccactaaaagttttggttttggggtactacaaccattcacccatctatggttggcttagttatcgtcgttcgatcctacaaggattacatataactattaaaactgttgtaaaaaacaacagctatgcatactctagcccaaccacttatagaaatatgtctttaagtgatattttttgtttttaattaagctgtaatttttaatttttaattcagagatatttgcccttcaaattttataataatatgccaaaataaatttcatgatgtaaaatactcgtccagattcgtaatcatcctagttacaatatttagagccggagggagtaaaagagtttggagtaagaagagaacatataattacatttgaccaatcatcatattaaaaatacaactaattattttattgtgacttatttttatatatttttaaaaaataactaattattttttatatatttttaaaagttattaaggcgtgatcgtaaacgtaaaattaaagtcaactgcgttattggaaaaccgcaagaagtattgggcaaaagtataagatcgtacattaatactgcaaattaaattaataagtacccatccatatgttagttaatatatggggccgtgcagacgtggacgaatttcgcacgctactttcttttcttgcccccaatcacacgtggtaactacaatacgtgtagatacagacaaacagtcatagagagtgatgcaatcaggcaagcgacttctccatgtgtccgaacgtcgtcacggcagatatttccatgtgttacagtagcccacctgacaatgaccagaccatagagacatgacagcatgtagtacaagagagactttctttttatatgttgaatatatttttaagataaaaacagtataactcatcgaaaactattttccaaaagtaaacctattggtcatgttacaccaccgtaataattttcggcgaacaatatgttgcctggctacaatagtcgcgtggcagccaaaagatttaattttaagtcaacatagtaccacagattacaagcctaaacaaaagcttagccaaacagttttagctttaccctaaaataggagtggagctgggtagaacgctattgcaaaataaactagagaggtggagctaagtttaggctgctacacaactccactccagatccaactcctaaaactaaatttagaagttggaactctaccaaatagcccatatgtatctaaagttttctttaaacaaagttttggaaaacaaagaaattaaacctacaggagacagattgcaattaagatacatatataacatagcagacatgtgcaattctttttatccacttggttttgtcaaggaactacgtacatgttgactggagcaagtgtactggttggagttggcgtcggctttttttttttaacatagtgggaaatgttgtctgctaattagttcactttagcttaattttgcccaataatttggggctactccatgtgggagttgctcagatgtgtgctggatttcactatatttataagaaattcattcaattggactcgatccgggtcaagtcggcatgtgactacttgtacatatacaaatggcgcgtgcacgaaacacctttgtttaatgatatcattaatttcaatttgttatttatcagtgtctggcattttccgtgctacttaattaagtagaataaattactggaccacagcatgactcaaattttaactaatcacatctgcatttttttcgcgtatattgaaaatagccagtactcttttctagaaaagagaatgatatactgtcgttagaaaaatatagaatggagttccctttgaacgatttacctctcccaagattcttgctggatcgtcacgaagaccaaggtagacttgaaaaatgtagtcgcagttttagtcaatctaaaaacaatgactagatcacgacctggaatgcagtgcagaaaatacatgaattacccatactttttcttgactttttttgttttttttcctcttatcacatgcccccatgcctcacaaatggagttacctaagagcatctttagcagaagccctcattttaaagccccaaaaaaccaaatgagggctgcccccaatttcctaggaccctacaaatgccttcaactccaccagcagcccccattttttagaccatatttattattctcttttatattaatatagactataggtttacgtctaatttaacatctcaataattaaaagataaatattttacaagatcatctcgatgtaaaagttaattatcaggtgcattatacacgaacagcacaaactatagagtatatatttaaccaaactactgaaatattatcctatatgctgtttcaaagaaaaaaattgaatatataccactgtctctctccttaatcctgtatgtctcgacccaaagaaaaaaatattgtctttccactggaatcctctatgcctctgtaaaaaaaatgcaaagaaaaatctactccctgcattctgcgtgcagggacattgcaggggcaagcagacaggcagaagagggacaggcggatgaaaaagcaaggggatgggctggtgggcaggcgctagccctccggccggcagcgccgccagcgcgagcaggaggtgcgcgcgggttggcaggcaaaagagctaaaatcagtgcggtgattcaccggcgtgcgagcggatggcggacctatctggggtgatcttgccagcggtgaggggtcaacgactgaaatttttacaatttggtcctttttaaaaacttattttacaaatagactcctaggaaaacttaaaccagaaatggtcctttttgggacgccagagtggctggtacagtaccctaacatgcgggcgccagccacactggcgccgtgcccgtgccaccgtggcactagggctgtcgtggaggtgctgactaggcagaatgggggcgccagccacactggcgccgcccctcataccacggcgccagcatggctggcgcgccctcctctgtgggccgacccttaaaccccgtgggccccaccacctttctcctccccactcccattttcgccaagtcccagcccgagcagcagcgcaggagttcttcccctctctctccccctcacctctccacctcaaatccaatcaatttgaagccgtttttcacgggattttttgtggaaatcgaagagaaaggtagactccttcattcccccttttttttcgtttttattggttgaatttgtagatcggtgggtaaccctagaaccccttttttacccaaatttatgatttttagcatttgttcttaggattggcttgttgtagtgctatatgtttgcaatgtactcattggtgtcatgatttttttaaccatatatgtggtaatgttaatttttggatggtttggttggatggatggatgaaaaattatggttgaggcatgacggaggtttgggttgtatgacggagtatttgtaatatttcgatgtgtaatgcactagtaaacttgttgatagttgtaggtggattaaatatttttttggagtagtagctttgggacaatttaagttatgcattggttataatatgtcggtttggactacgtttaggaatgaagatttaatttttgttgcaaagttacatttgattttttggtgtagatggatagacttgttcgtgtttactacggtggtagagtggtggaaccttatgttggtgcacatgttgagtttgaggatatgtcattgaagaccattttgtttcccacccacccaactctagatgaactaaggtcacgagtgaaagaagttcttggatggaccgaggataatgtggagattcgtttttatgggagatacgatgttggtcaagggcataagtatatattaaatgtgataggtcagttggaatgggaagtttactttgatttggtaaaagagtctcagtttagatctctagaggtgtttgcatcaaagttagttcgtaccgtagaaaatttggatctaaacaaatctccttcttatcattacgtttagaagaattttgtgacatattattctcgtcgtggagggggtgcaagtaagagtgagttggtacgagaagacttggagggtgaaggagagaagaagagacctttgcttggaaatgatttatgggaggcaggaccatcaaagagatattgcggtactgatgatgtggatgcagcgagggtgatgaaaagggagttagtacaagaggggcttgatctaagtgaacatttgtcggcgagtgttcattggtcgtcgtacggagtcaaccctgaatacccgacagaagtagcaggccaatatgtgaatccagatgattacttttatgtcgaattgagtggtggtcacgattctgtctctgtagaagtcaatagagatgatgttgacgaggaggcaagtgttgagcaatatgatgttgaacttgctgaagactctgatgatgaccgtccattccctccacttactaataatgacaagttagcattagaggaatgtcgtgcgtttgagaaggtgtttgggaggaagccggacattcctgagtttagggacctaacacatgcccatggtgcactactagatggcggcatcaacctagatcagttgctagaaccattccaggtggatggtctcagaaagggtttagagttcccatccatggtcgcattgaagctatggctccaggagtacgccatcgtgcaccatcgtccataccgtgttgtcaattctgccgcaaataggaggtacactattaaatgtgaaaacccacggtgcaaatggaaggtccatgcaactaagaggtctagtggcacgtggaggatatcacgggtaggtaagaaacatagttgtgctactgccgaaggttcagggagccaccggcagctgacatcaaagttcatagcaaataggttattcaatgccataaaactgcaacctacactctctgcttctgcgttagctttgtatatatttgaggttttccagtatagggtgaagtatggcaaggcttggagggcacgagaggaggctatgaagctcatttacggtgaatggggtgaagcgtatgttcgtttgcccactttgctgcaagccattaagcagaggaatcccagtatgatctaccacatcgatactcatcctgacagggttgtcaacgttgatgttgtgaccaagaaaatttttatgcgtgcattctggtgctttggtccttccattgaggcttttaagcattgtaggccagtactagctatagatgcaaccttcctaactgggaaatacggtggtgccttgatgactgcattatcagctgatgcggaggaccaacttgtacctttagcttttgccttggtggaaaaagagaattcacgagactggtgctagtttatcgatcttgtccgacgggttgtggttgggccgcatagggaggtttgtattatctcagatcgacatgctggtataatgaatgccatgacgactcctattccaggattgccaccggttcaccaccggtggtgcatgaggcacttcagtgctaatttccacaaggccggtgcggacaagtatcagacaaaagagctcctaaggatatgtcagattgacgagaagtggatatttgagagggatgttgaggcactaaggcagcgtattcccgaaggtcctcgtaaatggcttgaagatgagttgttggataaagataagtggtctcgtgcatacgatagaaatggccgccggtggggttacatgacaaccaacatggccgaacagttcaatagcgtgctagttggtgttcataagcttccagtgacggccatagtatcatttacgttcatgaagtgcaatgactactttgtgaacagacatgatgaagctttgaagcgagtccagttagggcagcgttggtccaccaaggttgatagtaagatgaaggtgcaaaaaagtaaggcgaacaaacacactgcaaggtgttttgataagcagaaaaagacatacgaggtcacagagaggggtggtataacgcgtggcggtgttagattcggcgcaagagccttcaaagttgaaggtgaggggaactcatgttcttgccaaaggccattgctctaccatatgccttgctcacatcttatacacgtttatatgattcatgcaattgatgaggaatctcccaaccgaatgccgtatcagttctcttcaagagccgttgtgaacacatgggcaagtcgctttgagccatacctcgaccccacacagtggccaccgtacgatggtgaagaatttgttgctgacccaaatttgaagattaaaacaagagggaagaggagatcgaaacgattcaagaacgaaatggactcgggtctgggtggttctggaaggaaaccaccttcatgcgttcaacttgatgctgcgccggtgcaaaatgatgctcgttgtgtcaccaggagggtcacaagaaaactaagtgtcctacgcgtccaaaaaagaagaagtccaaaaaaaatataagtgttagggaggtaaatattttgttttcctactcatgctctcgcattcattttcttttaatatatgtcacattggtaactaacggtgaatttattactttttcatgtaggatggccaaggagggacaaccgccgacttacccagccttggaggcgtactacgaggcccgtcatcgcggggctgtgatcgaggcggggagggtatgaatcggcattgattcacttgtgcataagtatcggtagcgtgtatttgacattatattaactaattgatttacaattgctaatgcaggtacttcaaccgctccgagtcagagctcatgcccccccagtgttcgacgataggtagatcccgtacctaagggctgccgggttgctcggggtggccttggtcgtgagcagaggaatgccagtgttcaacgctcctgcgttgacagcacttgtggacagatggaggcctgagacacacagcttccacctccccagtggtgagatgaccatcactctacaggatgtggctatgatcttggccctcccattacaggggcatgccgtgacgggcaggacagagactcctggatggcatgcacaagtgcagcagctgtttggcattccactgaacattgagcaggggcaaggggggaagaagaagcagaatggaatacccttgtcttggctgagtcagaacttctcacatcttgacgacgatgctgagccatagcgtgttgagtgttatgcccgtgcatacatcttgcacttgttgggaggggttctgtttcctgatgctgggggtgacattgcttcggcgatatggattcctttggttgccaaccttggtgatctgggccgtttcagttggggctcagcagtgttggcgtggacatatagacagctctgtgaggcctgttgtcgtcaggcaccatcatccaacatgagtggttgtgtgctattgactcagatgtggatgtggttaagactaccggttggaaggcctaagtggagg

SEQ ID NO: 55229 - DNA, 1586 bp, Oryza sativa
acaaatgaggcttcaagcctgaccctgaactcgatgtgcaatcgagactctgactatttcatgtactagtgcccattgatttgtttctgggcagttgagtaccaccttccgcaccgtgtcatgcgacagttcgggaagaaacaagattggccggttgaggacatctcaactggagttgaattacacaagtaaatatttcttatctttgtttgctttcattgtcaatgttcaattttgtaccatttaacccttgtcgatgctcactattgtttcatcaccttctacttgtctaggtatgacagggtgagaacaaagaaggtgaaagactgggggctagagcataatagatacattgatgaatggaggacagccggaaggaacgacaggtacatcgagactatacaccaaaatcatcttttctcagagtaccttcgttggctgcataggacatatagactgttcctccgccctacttggacggaagccgacatagaggatgaccgcgactccgatgaggggcggaatccctatgatgtccgaactagagttggatatcaaatggagcacgccccacttagagacagagtcgtaagttttcttgcatttgtcaaaattatttccatttgcaccctagaccctaacatatatcttctcacgctttcagtcgagagagctcctcaggagtgtgaatgaaatggggcataccctccaagctccgaggggtggtgaggacacggagaacacactccgcaatgttttagaggtaaaatttatttagcactttgtattacttgagttatgcctaacaaacttctttttttttgaaatgcagaaagttcgtcaaaggtgccggaaacttgcagcaagattaggttgcaggtcggttggattggacgacgtgtaccaaccggggagactaccaccaccactacctcaatccgcgcgtccaagtatcgctcgacactccatcaggatagaagagcgtgaaggagttggtggctcgtcgtcgtcacgcattaagcaagggaggggaaaggggaaggcgccggctccacctagcgacgacgatgacgacgaggacgaggaggatgaggactacgtcgcaccagacgccgaggagatagacatgtcacagcttcccgacgcgcctcaggggacgcaacccacgcaatacaacttgcgatccactcgggcagcgaaaaagaggtaaaatgagcttaccattctcaaatgttatttgatttcccttattttgtttttaaaatgttttaaacattggattttcaaatgtaggtacactccggtctcgcaagcaattcggcgccaacggaagaagtaatttgtatgaagttaatctattggttggtagtatgacatatgtggtgcactatgtgatataaaatgtgatggactatgtgaggactatgtaatggacttttgacattgtttcatgtgtggaatataggatggacttttggcattgtttgatgtgtgggatatgtgatggactttttgcattgtttgatgtgtggaatatgtgatggcctatgtgaggactatgtgatggacttttggcattgtgattt

SEQ ID NO: 55230 - DNA, 20236 bp, Oryza sativa
cttagatctcatagttattgctgacgttgcatataataaataattctgaatttctaatgtcaatggttgataatcgtaatatggatgacatcgtgaatgagaaaaatcttgtcagtctgatatttcgcatgctccagaagatgctaaataatccaacttttcatgaaaacgccacgagttgaaaattattttaggcgtgcacgccttccttttgttcactgtcagaagcaacaagtgacaaataagttcatacaagatctgtccatttttcttgttgaaaataggagaaaggacgtaccatgtctcgttcattgctgcggaatttggcgtgttcgttttccaatagtttttcagtcaaagtatgtcccatggaggcattatttatctttgacaaaattcaagttcatttctctatcaaccgaaaggacagaaaaaaagttgctccagctgggagttctctgtttacaaggtcttcacaaatcttcaacaaaattctctgcttaaatttatcaacaaaatagcaatctctgttttgaaaaagttgcactagatgcaatagtaggagttagaagtcccattttgcagtaaaaaaaatcatgaatttcttaggttgcatctaagcatgggcggcctgaaatgtttgtgcaggcaaagagatgggcatcactgacttcatcaactcgaaggcatctggcaagcctgtccacgaggtacaaataatttggccgcttacataaccacactgaacttcgttttcctatgttggcaatttaaacatttttcaaaacattgtcctgatattttatatttaggttatcatggagatgacagatggcggtgtcgactacagcttcgagtgcaccggcatcaccgatgttctacgggaggccttcgtttccacacatgatgtaagcggtgaaaatatccggtgtttttaccgctctttgaaaaactatacaaatagttatgaaaaaatttgcgttgtttcattaaaactaaacctgtattctgaatgaaatggaattcagggatggggcctgaccgttgtgctggggatccatgcaacgcccaggatgctgccgctgcatccaatggagttatttgacggccgtcggatcactggctgcgtttttggtgacttcaagggaaagtcccagctgcctgaaatcgtggagaagtgcatgcagggtgtaagtaccgaaattgttttgaccaatttcattgagtcagattaatgcaaatgtttaatggatggtaattttgattctgtaacaggagattaacataaattttgatgggttcataacacaagagttgcccttcgccgacatcaacaaagctttccagctgctggaagaggggaagtcactcagatgtctgctccatgtctgatgaaacttgtggattgtaaatttgaatacacaataaatgaatcataaatgttttcgcggtttcaaggtgtataattttcatatgcatgtatgttttgtacataaaatgggttgaacttcgttaaagaaaagacaaattgttaattagtagaatgcagtattaatatttgtaacaggtgagtgtgggtgtgcagtcgcgagaattgagcacacgattggttacatacatgctcgagttgctagtcagtagggccacacaccatttttatctattacatacgagttacagtctaattttattatagttacatataaatgttctctaccaaaaaaactgtctgaatgttgatatttgtaatagagttagcacaggtttcttctgtatactattatcatggtttcctacacaataattgtaaaatgttcttttgaatttagggatctccattgcttgtgtccgttttacatttgcaaagatctcaaatatggatgagaactttcaaaccgaacaacaatttcagtttgaaagaaataaaacatgtagtagtagaaattacaatacagcgtccaattgcagaaacgattccaaagtgcacagagcgtctgtgcacataggccggtttaggccgctagcgctacactgtcaactgcagcttgggcctcctagggctgggccttcgtacttttctgatcttagactgttggaagaagtccactttaagtccctcaaataagggtatggtttaaatctcatcctccaaccgtaaaatcaaatatatttcataccttcaatttttaaaactagtataaataaattgagtcattattcgatagttttgaatggcagtattgatcgacatggtgcttacatgatgtattgatccgaacatcattgtaagtggcacttattttgggatgagtctataggtcgggcgtccgatcggtttggagaaaaatcggacactgacgtcagcataacgtcaacgcccgatttatatgcaaaactattttaaactgatttttctcttaaattacttatccaaatcatgatccgattgcaccattaaattcgttgcaattaaatcttcaaaacaggaccacatatggatatattccgatgaaatttttttagcttattattgagttatttttaaatattgcatgatgttccaccaggtatatcggaattgtttcactaagtagatcgaaaatgtttcacttgtttaaatcgggtgttgtttcaccttatataaaaacaatgttttagcaaataggaaaaaaatgtttcagttcaatgcaacatttgatccatacatagtgaaatattttttggtggaacaaaaaataaaacgaattcccttaatagggggtttccaaaatatgtgggttttttttgttgcaatggaatatttcagttcattgcaacattagatctatacatagtgaaacattatgagtacactaggtgaaacatttttagtggaacaaaaaataaaccaaattatcttaatagagggtttctaaaatatgtgggttatttgttgcaatggaatatctggtggagacacgtggcaggtgggaacagagatcttggtggggcctaggatactgcatgcacgtgcgtgggaggcggggccatggggggagcgcccaattttttgcaacccccgtcggtcgaccgacgaagagcattatcgcttattttgtgcaaaaataaaattgagaccgacgtgtcattagtatttccttctttgtcccccataagtggtgaagcaggatctagacatgggggactaacttatgaggtactacctccatatgttaatgtatgacgctgttgttttttttttaacgtttgaccattcgttttattcaaaaaaaattatatgattgttagttattttattgtgacttgattcattatcaaatgttctttaaacttgacataaatatttttatatttatataaattttttaaataaaacgaatggtcaaacgttggtcacaaagtcaactgcgtcatgcattaaaatacgaagggagtattacttaaataaatatatcaagacaatccacaaaaatttaggactgattgtgtattagagtaatttttttcttgtgcaactttcacgatgttggcatgatatttttagaataaggtagcaatatttctatacgtatctcttctttcttctttctatatatagttggtacccactagctataaagctgctctgaggatgagccacgtcaccctaattagctgagaccgttagatcttaaatcaacgcttcaagactgcacatggcaccaccatctacaccaattaggcccatgtaagcaggttcacctaaacagccttccactttcccgtcgttggcccactgttattaaaatccagcacgtttgaatctctactttgcatcatcaaaaccacttgaaagagcaattacaacaaaaaaaaacccgtcatcactgacatgaagatcaaaggtcgtccttaattccatttattgatccccaatctcctcctaagcttctctcaattcatcattaccgtccacctcgacggatgcaatacgtagattaccaatctattaagtctgtcctaaaataattttagtgggcctcatactaactcctatgataattatgttcatgcacatatcgttgctttaatttgccttcctaacattcgtcttaatcaagtttatgccttaattagcactaccaataaaatgaaccgttacacatattcatcgattgaaattttttccgtgacttctcctttcatcttcccttttgatgtccccatttatatttctgtccataacatataaaatgtcttagccatcccagaacaattcatcgtgaaaccttttgctagccagcaatgcaatagctggtgaccttttctactttgttttcgcgatgtattgttctttctactaaattaagttaccatcacaggcttcaaatgtattgttctttctactaaagttaccatcacaggcttcaaatcactgatggttttgttgatatcattcgctcactgccaattaatgccaggctaccgtgtttgctcctcatatggtgcgtaaattatggttacaactccattcaaatactcatgctactgttttgtcccctcctcatgtgttctttgtttctttcctctcaccatgatatgacacacttaaatttttctaatgcattactctttctagcattcttcatatgcttattcactactaccaataaaatgaattttttagttatttatcgagtattaattataattcctattttttctaaaaggcttgaaaggcctaagtttataagcattgaagtgatgaatttcatcaatcttcctttctaatgatctggcccaaaccaacagcacttggaaacatgaatttttctaagttttttgaaaaagttgaaagatgtatttaaatcaagttgcatctaacgctgaagtgatgcacaaattttagaacaatatatatttacgtatatatataagcagtcaaatgcatcttgcacctaacattttctatttatcatagagaaagtcccgcagcaacgcgcgcggagtctctcactagtatagcagatgagctaggcataaaacaacaatccgttttcccctcttcatcatagtctattatattggcaggcaaaagttctagaatttccatggtttttctttcacacatttaatttagaaattcgtaaaaaacgtagtaactactacctccgtttaggttataagactttgcccacattcatatagatgttaatgaatctagatacacatatatatatttctagattcattgacatatatataaataaatatgggtaatgctagaaattaagtcctataatataaaatataaaatagaggaagtatatacgtctcaatctcatcatcactaacgctgcatgataatcatcgttggagggggccgggccgcttcgcccctgctgtctcccatctcctatctctgtcggtgacggtggcagaggttgcggaggagaagcgcgcggacatgctgaggcagatgaccaccccgggcagaatctcctcgttgctcgatcgcctccggccgctgcatcagccagcccccgcacccgtatctttaccgaggccatcaagtgctctctaacatcatgctcttcatcaattatacagtatatatcgctgcatcacctgaagctagaaaacgaagctgaagcagcagtcagcagagatgaagtactcgctcacctgaagctgaggctgagcccgtaggacagagagcgaattgaagaagcgagcacgagaatggaggaaaggaaaagaaaggaaaggaagaagtaggaattgcacgagaagcccaagcaacaagaattgaaattgaagtgcctagtaaataggaattgcatttgctcaaaaggaatgcatatttatgcatttagattgaaccaatccatttccatataagacagcctagtgctatgctaaagtagtacaaataaataaataaagggaatatatccatacatacacaaaaaaaagggattaagtgctgacctagttgtgttgcttaactaaacacaataaatttgaatctttaaaatctggcctccttatttgttcgacctacacaaaggggaccaaccgattagctcaccaacatactatcacaaaaatgttcaggataagtaagaacttaactgggtttgcaagataaacactggtcattgattcatggcgtaagtcaagaagtaattaacatattttttatttagaacccacaatcgataaactgtgaaatggaagagaaaaaattatgcattccctgtaaaatcaaaggtgtttttgattattattctgtgatgaactaaaatcaaatgtgtttttgattattattctgtgatgaacaattggtgtcggagattattggttttgttatttggaatttattcacgaagtggtttcggagatgattggatttacaagtgaattacaggtactgttattttatgtgaccggtcagaccgggcatgtgctgccggtcagaccggcgtgtattgcgcggtcagaccggtgcaacctgtggtctgaccggccgactctgtgtcggtttcggtttcgggttgtttgtttggatgtccgtaattatttcatgattatggcttctagatggatactatacgtatgtaatactgttgtttgctactaatgagtcaagttggagataggttggtctcggaatatggtttctttgtttatttcatgtgtaggtgactcaatgcctcgggagagtatttgcggtgatggaccgggagtcagcttggggataagacgacgtccgtggtggtcagagatcatgtgggatacttaggctagagttgatgcacgtggttgatggagattccatatggcacacgatggaggtattgtgtgcgtatgggatgcggagtcgaatttggaaggagtccaaatttggtatgattggttatgcaaagtttgtgtcttgtactagagagtttcctaaggtgtttaggactcctagtatgagtttggttcgtggctttaagctgcctacctttgtataaatagagggggagcgtgaggcttcccggtatcgctttagagagcaattgagttgagttttgagtttagtcgaaattttttgtaaggagtgctgttggtgcactttgtaaacatagagagaatcaataaagtcgtcatctactttaagagttcttcgatttgtgtttaccgggtttcggcggtctaaccggcgatctaccggcggtcagaccggcgggaacacggcagtcagacctgcggcggcgacaggcgcggcaggtgacatcgatggtcagaccggagattcaacaccggtcagaccggcggctacgcttcggtcagaccggctaatctactccggtcagactgatctccatcgatttcgagggtaacttttatttccgctaaaagtttttggtttttgggtataccaaccattcatcctccttctggttggcttagttcttgtgtttcgattctacgctccccatactcttggcctcttcggatcaaatggcgttggctctgttcagctacatgcatatgattagtgaaaaatctggaagaattaagagagattttggaggagaataaatggcattaaccatggcccatggcctctcatctccttattcttagcgacggtttcttaggctgctaccatcgtatatttctacagagggaggtttttgcactgttcgatatctcacccggagatcttctcatccaatgttcatatgcgatctcatccactgatcaaacagctgataattaatgatgacgtggaacactgaggtttcagctttgggtcccaactttacagaaagaagggattggcatattacaaacttcatgtctaaatacttggactgcacactaagaatatgaactgtgcataaagcagtggtgataactaatacggctgaattatgcattctttgtcctcatgtttcctgatgctgcatgcacttcgtgatcaccgatcaactgctttcctgagcaattgaaccccagattctagactgaccaaatgggggtagtactataaacatgtgtacatcgcctggtcttattccttcccctgccttgcagcaacaagattggaataatcttaaccagctgctgctgcaaattcctttacaaaagcaactaactcacaaacctctttaattattccaagtggtgcatggcccaagcaaaggtgatcacctcctcctcacacagtttaacattctgcagtccgtaagacctataaaaaggccccttctataacacagctaagcccacacaagatcaagagctggtagtagtactcttaccctcttgcattagccttttccttcatcatacaatttatcttgagaaatcaagctgtacctccacaagttgacatgtcgacggtgacctcgtgcaccttcctgagcatccgccccacggtgagctctgctggcagtctcttatccaagaaaccggcagcgtttgtttcccttgcgtcggagaggaaatctaggcctctttcgccgtgcttcgcaattagctccaacaaaccaggggacccaaaaatagatgtgtcgccattcagcatttcacccgttggtgagttatttgtcacattgtcattgcaccatgaatggcacacttttatttatttatgcctttcgaaagaattacgtttacacactatataccattacttcctatgtctgcaaatataatatatgtttagtttttgtgttatgaggtttataaagttattggaatgcatggtattttctcaccctgaaaaaacttaatgccgttatgacatggaatgatcttcaaggacaatattcaaatagttatttctgataaatcggcagaaaacatttagtaagaattatcactagtttatttatttgaagtgatatctgtagtcttattacaacaaaaaaaatgtgttataagtttccctcaatagtttaccttgttgggttgaatatgattttttaaattaaagaaaatatgtattttagactatgttttaagatacttaaaacaaaaaaagctaagatatggaggcataaaaatacaaatatctaataagaactgcaactaagaacccataaaaattggaactgctgttttaggctaggatgcatggcactattgtgtaagtttggattcatggccaactcatagatgtattaattagaaagtccattaaccagttcacaaatcaattaatgacaaaactatatatatttgctgtaaacaacacatacgcaacacatgaagggaaaaaagggaatgaattatccattaatttggttatttgatttccaaatgcatgtgaagttctggtgaacccggtgccggtggacggcgagcggtggcaggtggcggagaacaaagatgaagtgagcctgtggttcgacgtgccggggctttctccggcagatctgatcgtcgagatcgacgaggacgtgctcgtcatcaagaagaagaagaaggcgagcccaaagagcaactacaatactcctacttccggtgccattgcagatcatcaggaggccaccgccgacgagttcagcggcggcgggatctacgcgcggctgctcctcccggcggggtacagtagagagggtgtccaggcaaagctcacctccggcgagctgaagctcaccattggcaaggtcaaggagagtgtccgcaggaagatcaatgtcgatatctctgtcaagtagaattcagtgagcttccatggaattcatatatggtcatctgtgatgaaggatcggagcaacggtgcaagttatatcttgcctaagattctagctcatatatatcaataactggtccatgatctgatctctctctctctatgtatacatcctttgctgttttcctaaggttgagtatgcttatgtatgcaagctttattccggctgcatccaaataaataaaatgatcatctttgttgtgctttcacttgtgcctgcatgcatgtgtgatgtattccctggtagatattctaaaaaaaaaattctatgaacatctctggtatacatctccttagaataactactctacacccccctctcccataggtcaatcccatcgcccccacccttcctagggtccaaatccccccttccacctcagtcaaagaatagtcaaagcctcctcccgctggtcaaacccgagacaaacccgcccattgactccctcccccgcctaccactttgtgttacgtctcgcaggaattccgcagtaacataacggtcatcgtttagtaacaggacaactttctcgtagtaacaacatcgaaaaatagtcatgatagatctagttttgttaagcactttttttcaaacatcatggtgcagatggattagaaaaattatatataacatgagagatattgctctctaaagattgaggtttactttttttaagttctcgtctcgctggaacggcgtagtaacgcgacggccaatgtgtagtaacacgactactttctacagtaacagcgttataaaatagtcatggtggatctagtttcgttaagtattttttgtctcaatcattgtgtagtaacaggactattgtctcgttgtaatgtcgttttaaagcattatggtgaaagcgattctaaaaataatatgcgatgtgagagatattattggttaaagattagaattccaaaagtatacttatactaagcttgctattatgtatctttgtatggacaaagagaagtactttttaacacttgtatttttcataagattgagatttaaaaatttagctatacacaagtagtggtactatagtattaccgttaatatcatatgttctctgttactacaatttcatctcaatgctactgcaaaacgtacagtaacgacctataaatttcacagtaatgacctatacatttcacagtaacatatcgtgttactgcacttctgcgataatgttactaccgaatcatagtaaaaaagtatgattcctacagtaacataacgggtttgtgttcacaaaatttgaacaaatatataaagaaagcaaacaatgatctcaaatcacatagtgtcatagaggtgaataggttagtagagtttgttatgaaccatgagatcatgggttctagtcttgaattcatcaatttatttttaatttttctataaaatagaagggaaaatggttctagtcttgaattcatcaatttatttttaatttttctataaaatagaaggaaaaatggcagatgggagagaaaaaacgaataaaagaaaaaagaaagtagaggagtgcgctaggagaagaaaaagcgaataaaagaaaaaaaagtagaggagtgcgccaggagaagaaaaggcgaaaaaaaaagagggaggaggggggcaatggagagagagagatcggggaggaggaggaggagtaggggaaggcggggccgtgcccgggagggcgggatgggcttagtagttgggctgggaaggaggggtgggggtgtagaatatatatatccgtggagccccccccccccccccgcgccccagctccatgcccttttgctgcggccgccgcaggtaacgccatccaacgagctccatgcctctcccctacagcccagtcaggtgcttgagactgatccctcataccataagcttcatgaggagagctgcggtggagctccgctgtctaagctcgagctccactggcctccgcatttgcctcagcctaattctagactggaaaaggcagcagacaatggcaaccaagcggtgaagatggtgcagctttgagcaagctcgagttggatgcggagatgacacggacaatgacaaactcgaagtggtggaggcccagcggcctcggctcttccatcgagcttgtcgtgggctcgaggcctcgccaccggcactcatcttcttcgaccttggcaagggggcggcaggtgctgggtctagggtggtggcggagctagggacagtagaggccttgtggaggagagaatcgaagagccgcaccttggtctcgtactctcgtagatgttggggaggagagactcccaaatttcaaccagccgccactagacccagatgcagtggggtttgtccacgtccatcaatccttgatagagcttgttggtgaaccttcttttctgtgctcgatgacccctcttctctaacctcgccactcatcgctagtccccctcttctctgacctcagccaatggggcaggctctgcgtcgagctagccgccaacctcgtgcttctcccgagcacgacaaagggggtgagctccgcatcaatctcgacgccgaccttgtcatggccgccgccccctcttctctcaagcatgcgagatctccatggccgcctcaagctcggcgagggtgaaggaggaagaaaacaccatgacaggcagggaccgctgacatggcatcctggggtgtaccaaaaccagggtaaaaaccactctggggtgtaaagtgaatgttattgaaagtcatagtatgtgaaatatccaattttagagttttgggtgtattttagacaaaacgaagaattgaagggtgtaaaatggacttatccctatttataacaaggtgcaatttctttcgcacttattgtggcacattgcatatatggacattacattgatgagtttacgagttagcctaatatcaaaagattattccaagtcatctaaggacaatcatattttggtttattgtgaactactaaatgccttttcttttgttcgccctttctttttcagcatatcatttcaaaaccgtaatctgtgtaataccatcctgcagtaagacgtgggaccggcatcatctagttagatacatataacacttccacctagacattactcaggtatctaaatagaaattctagtgttggctactttagatatgttgaaacttgatttatttttgcacaacttaatttcaactatatataaagatagaacttaattaattaacttggtcaagacaacttcgtgctagttaattaagttaacttggtcaagacaacttcgtggcaactataattaaggaataagccaaacggacatatttgctaacgaaaaataatttgtgaataaaacttttatatacgtatttttagagatctaaaagaaaatgctggaaaataaacttcaatgaaaaaaccccaaaatcaacttgaaatttaagattgaaaatttaaattttagctggtaagcataagcatatgtgaagagatgaggctagtagtttctctgtggggccgattgcattatattgccattagggcgcttgtgttatttgtcagtttaccatctcagttttcttattttcacagattccactggttttcttctagtgttgtcagttgtcaaaatgccactacgattccagtttcaacgccattaacaagggaacaatcttcgactgtatccgtgaccaaaaatacccctcaacaaaatattataaaagttttaaaaaaacattatcctatttgagttgtgaaacttgaagccggataagaggaaaacaaacagaaataagtattttgggagcccatgaattgtggaatcatcgagatgcactctcgagatctgataaacattaatttggttttggattaattggttcatcatgaccattacgacaattagtacctcagttttttaatcgagttacaatttcgactactaacgcagcatgatgatgagtagcatctcctcctcgtgaagaaaggaaaaagagtaaaagaaaaaaggagaaaaaaagaaacactcatggccgacactgatagaacacgtcaaactgttgctcgtacgtactacaaggcacagataatgcagcatccactgatccaccggagaataatgctttacgtaccaaagcagcttcccggcctggtatctacagcccttcgatctgaatttttcctctctttaattataccctgctaacccgaccaagcaaagtgcccaaaatgaccaacacttcagtcctagctgcttttcctttctctctatatataaactctcgcttattagcttccctgtactcagtattaatcagcaacaaatggcttcagatcactagaccagagtgaagagagaaggcatgtactacagctaacccattatacatttcgatctcctcctatacatatgatgatatatatatttgattcttgacttgttaattacttttctttctatgctatagcgcgtgtgtgttgattgtcgtaatgtcgatggttgtggcctcttacgctccggcgagccggtcgccggtgacgcgggcgtcctccggcgcacggcgggttagccatacacagtcatggaggccgccgccgccgccgttcttcccggcttccgccgccgtcaagtgcaggcggcctactcttccggtggcacgttctgttggcccgccggagaaacatcgccctgtgctcaacattcctcccaccggtagtgactctccttcaattcacttctctgtttttttttgttcttctcagctttgattttctcttttctaactgtggctaatatacctagaaatcaaaatgaattcaacaaattaattgcaataaaacttaaggcccctttgattcaaagaaaatttataggaattttagaggattttatttctataagaacttttcctacatagccctttagccctttgaatcaaagaaattgatcctatggaatcctatgaaattcctatgtaatgtgtcttcttattcaaattttggagaaaatttaacatgaggtagaacctcatggaaaaaaatatttgagtctttatctctcctcaagttctcatattttcatgcagttcaatcaaacggttattcctaattaagtttttcgtgtgttttgtatttctctgttttacactattcctgtcagaattctatatttttcctattacttcgtttttttcattccagtgattcaaaggggtttttaatgtgataatatgtgatccaattcagctctactgtaccaagtcccgccaccggaggggaaagaacggtgggaaatcaaggatgacgagggcaacgtccagctgtggttgcaggtgcccggcctgacggaggacgacctggagatcaccaccaccgacgaattgctcgagatcaagcgtaaggccggtcgcggcgacccgcggcggctcgacgacgtccaaggcgttggctccttccatctccggttgctcctgaccaaggagtttgtcagcagccaggtgacagccgagctgaaggccggcatgctggaggtgaccatccccaagaacacaaacctgcgtcgcaccgtagtcaggatagggcagcaatcacagtctccagctgcagttagaactgcgcagccgaaggtcgtcgatcctcctcctgccaattcgccaccgaagaataataatcttgtgagaaacacaagtgtgcagtcgaggattgatcctcctgcgagagagtcgccgaagaatgatcttggagtaggtatcagtgttcaaccgaatgattctcctgcgagagagccacccaagaacaatcttgccggaggtagaaatgtgccaacgaaggatgatcctcctgcaagggagctaccgaagaataatttggccggaggtagaaatgtgccaccgaaggatgatcctcctgcgagagaaccaccaaagaataatcttgccggaggtagaaatgtggcacccaaggatgatcctcctgccaatgaggcaccaaggaataatcttgcaggaggtacaggtgtgccgacgaaggatcctcctagaaatgccaatgagccgccaaagaatcctcctggtacccgtgaagccaacctaggatgagcaaattaaccgtggtgggcatgtgagaataaagattagaatagattaaaccccatgagaggagagaagatatgtttatgtacatggttgtcatgctcagaggggcaattttcactgcacgcagttggttcactttaatttttatgaaataaagttatttgatcgatatgatttgctatggtcgaccatttaccgtttcagtgatggtgtaatgtcccagatatccacataataaccgttagagtgcgcaacctggcccaccaccgtgggccacccaagtcacattgggtctgctgctccactatatgcccaaccggagccataactttaggtcctgggcctacacaacccaaaagactagtctgataggtgagaaccgcccccaccttttaagtcgtgctcctccatcatcaattaccgatgtgggactaaacccaacaataactatagtgcaagaatatcaaaattcaaacatgaaaaccctgctaagatgaagaagagaaaatgacatagggcaaatgagtaggggtcccggagacaatccagatttacggaatcgaagagtggctcattgagtcatacgatctccatcgtgtaaaatcaaagtgtttttcattctttattttgtgatgaacaattggcatctgtgattattggttttgatattggagattattggcgaagtggttttggagatgattgatttttcaggtgatgaacagggttactgtttttgttgggtccggttaaactgggcaggtgctgccagtcagaccggcatgtatcgcgcggtcagaccggctcagcccgcggtctgactggccgactctgtgtcggtttcggtttcgggttgtttgtttggatatccgtgattgtttcatgtttatggcttctagatggatactatgcatatgtaatactgttctttgctagtaatgagtcaagttggagatagcttggcctcggaatatggtttctttgtttgattcatgtgtaggtgacttagatgcctcgggagagtattgtcggtgatggatcgggagttgacttggggataaggcaatgttcgtgacagtcagatatcatgtaagatacttaggctagaggtcaatgcatgtggttggtgaagattccatatggcatacgatggaggtattgtgtgcgtatgggatgcggagtcgaatttacaaggagtccaaatttggtatgattggagtttgtaaagtttgtttcttgtacgggaaggtttcctaggtggattaggacttctagtatgagtttggttcgtggcattaggctgcctacatcatgtataaatagagagagagcatgaggtttcccggtatcgcttttgagagcattgagttgaaagtttagttagggtttcgagtttaatcgagattttcatgaggagtgctgttgttacactttgtaaacataaagagaagtaataaagttgtcatctactttgagagttcttcgatttgtgttttctcgggttcggcggtctaaccggcgaaacaccggcggtcagaccggcggcattgtggtggtcagaccggcggcgtacttacggtctgaccgtcgacgacatcaggcgacttcaggaggcagggtttgatctcagcggttcgactgatattactacctcggttagaccgacgatctccaggcggtcagaccagtgcgactacttcggtcagaccgcgatgcgttgaatttgagggtaacatttaattccgcaaaaagtttgggtttttgggtataccaaccatttaaccccctctggttggcttagttcttgtgtttcgatcctacaagtgatatcagagccttgttttcttctttagattttaaccgatctagagtttttgccatggctaataagtttataactaagccccatgttttcgatggaacggattttccttattggtgtagtaagatgcaatcttacattatggctaaggatcttgatatttggaaaaaagtttctaatccttatgtgattcctgatcaaattaatactgctgctttaaaactgaatttgaaaataattgcaaagctcacaatattcttttgagtgggatttctcgttcggattttgatcgtgtttctcatcttcaaaccgccaatgagatttcgattgctttgagaaattttcatcaaggaactaccaatattaaagaacttcatcgagatcttttcaaaaaggagtacataaaatttgagatgaaacatgagaagctttggatgactatctttctaggttcaacaaaattttgagtgatcttagatctgttgattcttcttatgatataaattacacacaatctaaggtttctcgtcattttttgaatggtcttgacatgtctatttgggagatgaaagttacatcaattcaagagtctgttgatatgtctacgttgactttggattcgctttacacaaaactcaaaacacatgagatgaatattctttctcgtaaagttgattctaattctagtgctttggtttcttcttcgaattctttgaatgttggtgcttcttcgttgaattatactattctttctttaattaatgctatgttcgatgagcaactcaaatagttcaaggaggaggacttggctttggtcactaacaagtttgctcgagctatgaacaatgttaggtacaggagaagaggtggtccaaatcgttgctttgaatgtggtgctcttaatgaccttcgctcgcattgtcctaagctttgaataaaggcaagaagaaagacaatgatggtgagaagaccaaggagaacaagccaaagagcacgttcaaaggggagaagactaaggagaatctcaagaagatgtttgagaaagtctatgccgcttttgagcctttaagcaatatagatggagaaagtgaagatgaagataagggaaagaacatctccggtgtttgcttcatggcacgtggtgaatcggattcagagtgtgaagacaatgaggtgagttcttttgaagaagctattcttattttaagtgctaaaaataagaagtgtgagaagatgtataggaaacaggaatttattattaaatctcttaattctgaaattgctagattaaaatctcttattcccaatgatgatgattgtaaaaattgtgaggttttaatgaatgagatttcaaaaattagagatgtcaatgctgcacatgatttgaaaaatagatcttctcttgctcttggatttgccttgcatacacgcactttggatgagttgttttttactaaaaatttgttgaaaaaaatatcaaattgcttttcatgctagtttgatgtttaacatgatttgtgccaaaaagtttaaacaacaacatgatgttttggatagctcaacatgcacattaaataagatgaaactaaaagatgctttaggacgtgttgagtacatggaggatattgtgaaaaacaatgaagtgctttcttgccccaaattttgtaaaagcaaaggtgtcatggtagattgtgaaaattatgctaatttggaaaaggagctttcttatttgaaaagttctttgcaaagattttctgatggtaagaaacaacttaacatgattttggatcaatctaaagtgactagttacaatagaggagttggttttgatgttcatgaatatttcaccaaaaatcaaccaaacgttttgagtgtgactaaatatggtgaaattttgacaaaaccaagtgctaagaaaacagtttttaagtctgctggaatttggccttctctttctacaacactaagagaaacaaaaacaaatctttcaaaaccatcttctaaaaaaaagtgtacttgttctttttgtggtaaagatggacatattgttagattttgtttcagattagctcgtaaacagaaaaaggagagagaaattgcaattgcaaaatcaaagtggcaaaaatctggttttcccttgaggaaatcggttagaccgcagtgggtcccgccgtcataccggcgactggtcagaccggtggctgtgcatcggtcagaccagctactatacttcggtcagaccggccttggagagatttttctaaaaattctcaaactgtttttgcacgtgggtacatgcctattggatctactggtcgtgtgtctcagtactggatttctaaattcttattatctaaccccagtactgaggcttcgacatcttcttgtgtgtaggctttggtggtgaggaaggagaacatgtggatcgtggattccggttgttcgcgacacatgaccggtgataaaaattggttctcctccctcaaacagacatctaagactgaatcgatgatctttggtgatgtttctactagtgccgttctcgctacaggttagttcaaggtaaatgacaagtttgaattgaaaa

SEQ ID NO: 55231 - DNA, 1189 bp, Oryza sativa
ctctaactccaccccctaatacttattacaactccaactccaatcgtaaccaaatagaactagtatattcgacacctattctaacaaactccagattactatgccgatccaccggtcctccagacttgggttgtcttctttgcagcttcaccacgagccacctgacaagcctacaccagactcaccgtcatcaagagacttcattatcactgtaattttcttcctttggactccacccgtaatagtgctccaccttctcacctatcatcccagtagttttgccatcacatcatagactcccgaagaccatgttcacctccatcttctatctttaatttgatttgatctaatacatggctagataatcgatgtcatcaccaaatagataaatcaaactcaccagacatgaagaaaaccctttcttccttgttttttttgaccggaaatactgccagggctttgcccaatagtgtaattttataaggaaagagaaaatttacaaggttacagagttacatgcgggtcacacaggaagactataaggtttgtaaccaattaaaaacagtttgctttaaaggatctttcattctgcacataagcagaagaacttctttgacaaaaaaaagatctccatgcttggaaggagggttgaacattctgaaatattaagcttttcctttgcttccagatgtgccaagctgccaaaaagaaaatttctaggaaacccctctgagcaaacttgagtcttgctagggtgatcatttggaaaaactccaaatcatgattccactcaattcccaggtattgccaacacctgatactgaatggacatgaggagaagggatgtagccttgtctctctgcaattcgcattgcacaaaacacatgtgagatcatcattttctttggcacaatgtcttctatccaacatatctcttgtactgagcctatcacagaacatgagctaggcaaaacctttgatcttcatgacacattttattttccataaccaaatcatgggcctggggtgttgcaatgcagaatagtttagcttataaaatttcttagctgtgtacttatctgaaccccagataaaattccaagcatctcccatccctgactgtaaattcaaactgtccagaacttcctgaagttgcaaatattcagaatatgcctcatctgagaggggt

SEQ ID NO: 55232 - DNA, 4668 bp, Oryza sativa
tcacccaaggtagatcaacaccaatatataacttgaccatatgttttagaaggagggctgtgttttgaactctcagattgatcacttctaagcctcctttctccttagggatgcacaccctatccgaggaggctagagatttccttgtagaagaagggttattccctctctacagacaattcttacaagctgtgtcaatggccttgatgactgtaactggtagctgcaatgaggacatgtagtaggttgggatagaaggcatgactgagttgatcaaagtcaatcttcctccttgaggaagaaaaatagagcttgctgtcagcctcctttctactatgtctaccaacggtgcaaagtctaccactctaggcctggtggtgcccaaaggtagccccaaataagtgaaaggaagagaaccaatcttacaccccaaaatgccagctagcaaatcagctttgtcctgagacatattaagtgggtacagatttgatttattaaagtttaccttgaggcctgtggattgagcaaacatattcaaaatagtcttgaaacagaagacttctttcttagatgcttttagcaagatcaatgtgtcattagcatgctgtatgattgggaaaccctccccactgctttcattaattggatttgacagaaggccttgatggaaagctttgttgattattctttgtaacaactctgcacccaacacaaaaagcagaggtgagagaggatctccttgtctgacctctctcttgcatttaaaagaattccctggcaccccattcaatagcaagcagtagagaaaaccatttgtacccactcaatccattttagaggaaaacccatatgttgcagaacggagagaattgcggaatgctcaatggtatcaaaggctttttcaaagtctaacttcaagaggacaatttctctttttgactgctgacactggtgaatatattcaaaagaccaggcaagacaatcctgtatggtttttcctttgatgaaaccatattgattattactcaccagtttgagaattaccccttgaagtatgtcatctagtaatttggttaagattttcagacttatacccataagggaaataggtctgaaatcattaacagtctctgggaggttttctttggaaccagggttatgaaagagctattaaggatttccaaaacaacatttccagcatgaaaatgagctgccaatctgtaatagtcctgagctataatatgccaacatttttttcatgaaatagccattgaaaccatctggtcctggtgctttgtcagctgaaataatggagatgagactatctatttcctgagtggaaaacatgtcaaccaagctgctcaaatttatatgtctgtcaaaaagagactccaggtcaaaagccatatgtggggaattagaaacacccatcttgttcttaaaactgtgatgaaacagggaaactttctgctcatgaagatgtataatctgtccatcatgatctagcacttgtgagacagtgttgattatgaacctttcagtggctaataactagaagaattttgtattctcctcccccaacatcatccatctattggtgcaccttttttccaatagatcttcctaaattccaataatttcaaaatatgtaccttaactgtttctctgaaattccactcatagactgaaagcattctgttttcttcgactaaatccagaaaatccaccactttgttacagttttttagaagtcccatcaacttagattcttactccaggcaaggagcttttacttgagcactttcaatttgaaagaaatgcacttggcatgatcatcaaaactaggatctaaagaccaaactgcctaaacaatatcaaaaaacccatccatctctacccaataaatttcaaatatgaaaataggggatttggggatttttgtgtcaatcttaactacacatggcacatgatcagagatgtttctggttagaggcagcactaatgtatttggatagtccattgtccatgaggctgatgtgaatgcccagtccaatctctcaagaagtggatatgatgcatattgctctaggtgaattttctgcctttaagagggatttccagaaggccaagagtgctaatgatatcattgaagatgaaaatgtcattcatatctgccccatctttatttctatcttgcacagatatataaaaattgaaaacacccaagaaaagccaattttgctgataagcaatttggacatttctgaatcaagaaacaaaatttgctgttttagggccactacaagggccatagacacatgccagggtccaattctgggcagagtgccttgagatgaagtcaatggtgactgaaaagaggttaacctctaccactgtgcccacaaaaactcgagacgaccaaacaatcaggatacctcctgaagctccattggaaggagcaaaagcaaaactatctagattctttggagcaaatttcctgatatcagataaatcaaagtggtcttttttagtttcctgaatacaacagacctgacaaccactatcctcaatcttctgcctcaaggagagtaacttggattcggcattcatccctcgaatattccaacagagcacattccaaaatttaaaattattcatgataaactggataaaggagactgaaataaatagaactagcacaaccagtctgtaataaaggagcatcccaagtattcaaaatttacataattgaaacatttaactgataagacacaaatgtttttgcctaagtacagaccattacatgatggataaaaatctgattaaggtctgcagaaacacacaaaaggtctaaattcatttttcctccatgtcaggcctgggcatcttcttccttctctggcctcccaggctagactcagctacctcgtcaggagctagcccgcacatgtccactcccatcttttgcaatagagaaattgagcaatcagatggtgaggaatcagaatgaatatcatcataaacatttgcattaaaatcagtttcctttatgctagtataatcaaatatttttgctatacctgccaattctttgagctttcttgcagactttccccttgacttaccaatgcccattctgggatccacctttagttcagaatcccctttgatatgctgaagtcttgcactctgcctcctgtagggattatatagaagagttctgccttcccttttcttaccaggggcttttggtagcatcaaaggagcagctgcttggcagactagactggagggtgggtgaaccacccaaggcaagacttcaagaatttccatgttttcatgggcctgtgactgaggaggactattagacttatgaaagtccaaagcccaggtagcatccagcttactcacttggggggagaaatcaaacatagtcttctttggtaggactagagctttaaaggggcttggctcataaagagtagcaggaatagagttactagccaagaactgatgcatagaacccctttctttgcacaggtggtcaatcttcttattgatctctttcatggggtagaaatagggaaccttggggtactcatttttagcaattttctccaatcttgctaaagacctctgcacttgtgcatcctggtcagatccttgcacctttttccccttgtctatagcaggaacaaaggggaccactacattatcatctccagggttagcaacagccaaatcaattattccatcagggtttacttccatgatctggcccatagggtgatcttggccccaagcatcttccacctgctcatttgctgtattctgttgctggactaaatcatcccaatcaccaggacctgcttggggatgacccatttgccagatgtggccaccatcaggatcctcatcatcatcagcagcaggattaggctgtgggccagctaggggaagatcctcatctagcgacatattgatgaaatcaccttccaaaagaaaaacagaaactgtccaggattcgtcaccaccacccattcccactggatcatgtagcacaattttcgtgggcacagagtcattgtctttaaatttagctctaatgagcaccctccccttaatctaatctctttcaagccagtaagagagctgtaacaccctaaaaattcccaataataaaaatcactaaaattttgaactttttaaaacttttgcatcatgctggttgttatgattgctattgcttgccaaaccgtaaataatcacaaagaaagtaaagaaaagatcgacatttaagcaatagatataatttacgagaatatattattgttaaccctaccaatatttatgcacaagatagtaaagtcaaatattaatttctattataaattacaaatcagatattaaatattcgaaccatgattgatagcttgatgtcacaattagctaaagaaatagtaagattaaatctaattcatttgaatccaatctcacatgaaatataagaacacatgaaatgatgatcaccactataatgatcgtgtttataactaagtaattcaccagaatatatagattgatacttagagcatttcgccgagttcctcatgacatgaaaatcactcatataaaataatggtcatataaataaattaagcttgagta

SEQ ID NO: 55233 - DNA, 1851 bp, Oryza sativa
ttctttcaaatcgggacagtatctcagaaatctgtagaaagaggaggaaaaagcggatatgaacaacatccatcatacagtattcccgtaggaaattattagcaggcatatggagacaataaacagtagagtacaatttagtgtttggttgcatgattgaaattggttacatgtcggcctgccactagccaggatgttagtagtagtactggggaccattgatttgacaaacctgagagaagaggagatgagaggagaggaccccaagtgtgcagtgcagagttgaggagcccaattggagaaaagaaatgaaaagagagcagaatgacagatctgccatcacatctcaaagtttgtctcatgtgaatgtgattactactcagtattattagtcatatgtagaactgagatgagatggtactatgcattatatagttgttactagtggtatatcgaagtatatgtactccagtatgttagtaatagagatgtactagtaatcggaggaagtacatggtaccaacatgagcatgtaatgggattccgtaattttatatcgtagtatgatgtatgcactagtaatttgctggtgttaatgctacggtgatacttaatagaacccatgttagtattattaaattaaaaaaaatcatgttggtgatgcaatacaagtagtagttaccaggcccctttggacgccgtcaggcttgatgacagggacctgtaagttgacatgtactgcaccatcaacatactacatgcttgtagtcgtagatgtacccaaaaaaaaacaaaaaaacaagagagaggcatagcactacttgcaaatgcatccatatatactcacttttaattacttgccagccacactccacacacacactttgttattgcctcgcgcactgcttcctctcttctgcaatcttcccctcccctccccattgagagaggctacacttttctctactcaaattccctaggagtactttttttttctcgtcactctccttgccttaatttggagggaaaagaatatctacttactgctgtcgactcatgtagacaaaacaaaacaaagcacagtcattaatctgaccttaatatcttttggccttctctactttttttcccatagtaaaaataaattatgttttcactcctgaaacaaaaagtaaaatctactgaccagaaaatagaatgcttgttagtaacatgtttgcaattaagaacgttacatttcagtacttcattcattttaaaatgaattaactaagtggactgaaataacctctttgtcatctgtcgatcctacagggaaacatggcacaaccatcctttctatcagagtatgaccttggaggggaaggggacctgttcaaagctcctgaacccatcattgaagaaccagtgcttagccttgatccagttgcagcagccatttcgatgatgtctggcagtgagaacgtaatggatgaaactatagaggttgcagatatcagcgacattcagaatgactctcttttaagcgaagtattatatgagtgcgagaaggaactcatggagaagtccgcaattgaagagagtatttctgaactggtggatgtcaagattcttatgctgcaagtggaagagttccttagggaaacccaagtacaactaccggccatggagaaggagaaaccatcagttcatgaatgttgttcactccagaaaagtgtcagttctgggtgcctcaactcagctgattggatcaatggaccagccaggccaaacttcctggacttccaaggattggactttgagacagcgtttgggttgaggagggcatacagcgaaggagacagtcaggtt

SEQ ID NO: 55234 - DNA, 1214 bp, Oryza sativa
gcttattaatatgcattttacccatgagacttgttgcataactgttgtacacatggcacgatacttgttcgaagtttcggagagcatatgcatgcgacgtccaaatttaggaagtagaaccagagaatgtgcctacttttttgcaaataatcaagggggctgacttaatttgtaccacccatttttgggcggtggctaggtccatgtatgccaatatataaatcgatcagagaagaggatcgacgaggagacaagctagatagcttattggagagaaaaaagggtcgaagcgcaagcaaatcgatcagcaacacaagatgaagaagatgcggatggcaatggtgagcctggccctggtgctggtggggcttctcctcgtcgccaccactgctaacgccaagaacgcccatgccggtggcttgaagaagggcggctctgaagctgaaggccgcgtcgtctacgccgacatgagattggtcgttccctccgactccgactccgcccccgcccccgcccctgcctccgcctctgatgggccagcacctgcgccatcccccaacaattaattcaacatcgacctagcatatatatatacgtatatatttgttattttcatgtgttgttttcgcattttatataaccatgcgcgctctagttgtacatgcagccgattgatgtgcatttgatttatgcctgctcatttttatttctttctttttatttacgttaaatgaaacactttctccatgcatacatggttgttcttattttatttattataaggatatatatatatatatatatgcgcattcagtaagaccaacaagttcatgttatgtctcatctatatacctctctattattaggccacctctcatctcccatgatctctacatgtcggtctatttatccatagattttgaacaaattaattactgaatacaaattgcgatcaaaggctatagcaattgaaatagcaagcccatgtttctgtacatcttgtgaattacagccgtgtaaattcatgagcatgcatgcatttgatgataacaattaatatagctaatactagccccgtttgagatatagctgaaactgatggattgatggatagtttttttatatatagttattttgagggtatacatttacttctttatgtatgtataaacttaaaaacttgctttacaaaattattcgttaaaatgtaatat

SEQ ID NO: 55235 - DNA, 2602 bp, Oryza sativa
tccgcctaagggacttgttcgtgttttagagttgtaatagaagtagagtcgtgtccgacaaggacataatatgtgttttgggtataaatatgacccgagaccttataaacaaagagaccagctcaatatactctcggcgcatcgccaccctttttacttttcattgttgtcaacgagttcttactttcgagttgggctgcatcagtttcgatctccgacaagaggtaaagcttgttatggcggcttgcattctcgggattagtgcttacatctttatgacactctaatcctgtccatgtaaatcgtcgagttatcatatatgctatataatctagatcgaccttactatctgatctcgtcggctagcctctatcatcaaaaacagccgataggatccgatattatcgtcaaattagattatatagcatatccaccatcccgaaaaggcttccattggcttttttagatcttatgtttctctttatgcttaatgctgcatcaattgtgtttgatctactaagcaatatccagagccataatatctagcttgcttcaatctgtgatcactgaacttattcatgaaaatcaatatggtttcataaagcaaaggacaattcacgactgtttggtgtggacttttgaattccttcaccaatgtcatcagagcaaaaaagaaatcctcattctcaaaattgattttgaaaaggcttttgatactgtagagcatgcttgtatcctggaaattcttaaggcaaagggctttgacaatacatggatcaattgggtaaaagatattttaactacagcctcctcctcaattttacacaatggtgtcccaggaaaaaaaacttcaattgtctcagaggtgtaaaacagggagaccctatctctgctcttctgtttgtccttgctgctgatcttcttcaatctatgatcaacaaagctctcaacctgggagtcctctcccttcctattcctcaagttgacaccaagttccttataatccaatatgctgatgacacccttatcattatgaaggcgtgtcaaagagaagttttctgtctaaaaggcatcctgcaatcttttgccatgtccactgggttaaaaatcaattttcacaaatattctatgatcccaatcaatgttaatcaggatagaattgaaatcctggcagagacttttggatgcccaattggatctctcccctttacgtaccttggtctaccggttggaacaacaaaacccaaaatctgtgattttgcacctctcattgatagagtggaaagaaactcctggctataacaatgttttagaatcaaggacagagactaaccatggtcaactcagttatgtcatccctgccaacaaattacatgtgcacacttaaaatccctaaaaagattttgttgcacatcgatagagcaagaaggcattgtctttggagaaaatctcacgaaattgatgcaaaagctcattctttttggcagcatgggacaagatttgtagaccaaaaaaaagagggggactgggtgtcattaatttagaattccaaaactatgcccttttgatgaatcatctcgacaaatttttcaacaagaaaaatctcccatgggtaaaacttctttggacatcattttataataatagatccatgccaccgcatgcattaccagactttggatccttttggtggaaagacatcactcaactaatacctcactttagaggtttcagctctattcagatcaacacaggggacatagctcttttctagaaagatctctggtcagacactttacttcaaaactccttttccaccattttctcttttgtgaaagtgaaggcattcctctggctcctgtttatggatagattaaacgagacatgctacaaagaagacacctctctattcaggatggaccctcttgccaaatctgcagcttagatattttggaggatatgtctcatctttttttcacgtgcccatttgcccaaaactgctggaattctcttgcaatctatttggatgtgaatcttgatctctttgacatgattcaaactgcattcagaaattttggtcaaaacttctttgtggaagtggtgggtacagcatgctggcaaatttggttgaaaagaaatgctctcatttttgacaatgtccaaccatctttcaatatttggaaagctgatttcaaggaggatttcactcttcttttgcatagagtgaaggaggaagacatgcctaaatatcaatcatggattgacaacttattttatttttttcctctttagtacatattttgtaattttgatgtaactcatgttcatatattaatataattaccacagtaggagcctctcctattgtttaaagtcaaaaaacagggatagtatcggggtttcagctgatcttacctggttcagttatcttgttttcttatatgtttacttggtatactgaatctgccctttatattaagatctcgtttggttgaaatacgttaagctcactatcggtctgttagggtatactgacattgattcgattcttatttagtatatttaatccatactagtatcttagtataaagtagtaccgagt

SEQ ID NO: 55236 - DNA, 7575 bp, Oryza sativa
tcttgttggttgcaggatcaaaccaactggcatgccccgaacccaaaagcaagattttaggacatgcactagactaaagcaaatctctcaggccagtgtgtgtttttcacattaacagtagcttaactggttacgagctacgtctcttgtggtagaaccagcacaaccaggttcaaattctatatttggcacggatgctcatatttacgattaattattgttttagtggtaggtgctcgtcaacagcgaggcgcccatggttacttcatcaatatcaaaatatgttggctcaatctttcggatgtgctcataggagtaggatgtatgtggtaaggtgcaacagtgaaagtaaagaaaagacatgtgttacgtgagctcgaaaatgcatgcatcaccgcttagttgttagtactacttgtttacctaccaatgcacatcgtcatgcaaccgcagatgcaccttgcctcaagtcaagaagtaaatatggaattcctatttgaaatattgttaacaaaagtttttctttcagtttgtatggaaggtgttcacaccttacccctaagaagttatggttttgctatttcacacgcgtcagatttttgggcttctatctttattttttcgtccgcaagatcttgcattaagatttctgttcttgtatatccaacttgcagttacactcgattacatagcacttacactcagttatagtgcacttgcacttaattacatagcacttatactcagttctagtgcatcaaaattatattttagatcagttttttctagatttttgattgtttatatgcttgtcttttttgtttattatttcatttaaaatgggctatagccattggttgaaatttctgcaagattcgaagttataaatctatcgcaatatcaaaaggtagtcctattaagctatttcttcggtgtctaggaccctaaatacctttctttcttctcccgcacttcatgaacgctctccatcttttccatttttttctccctctgtgctagggaaggcaccgcggagcacctggccgtgagatttcaatggcggcaccatgaatacaatgagataatagaggaaagatctctcatatggtctattaatgtgaccaaacatgggacatatataatcattccattcacttagcacggatggcacacctcttctcatcgatcccaggaatgctaattcacgcatacgcgctagctggcaaacttccgcacgtggccccaactctatctcacgacaagcgccaggttggagttagggtttctagagtgggtaggggaaggttaacactggagagggaaagttaggggattggccttagagcgtttgtcttgaacaaacaaaggctggtttccatcaagaaatcgggttaatgaaggaaggggggaagaaaagcgtgtcaaagtggaggcgaggactttggaggtgattactatcaaagtggggtctcatgatatgccaataccttctaaagatggagccaaggcgattccaagcgacgaaccgaagccgggaccatctctgccggtctaaccaccggccacacgctagtctgaccgggccgactggccagtctgaccggtggtttacaaccggtcctgactggtctccagcgccgatttgacagtagatttgctagaggtggttcgggtgcttcatcgtcttcaagcaaaatcaatagggggcataatattcctcatggaacatagccgaaatcaaggcggatgcctaggaatttaacggctactcaaaagaggaggttgcaacatcttcggactcaagagttaaaagagagagaagccgaagagtggagggatagaagatttaatgagttgtgactgccgccaatgaaggagtggaggcctaaatccatagagattagagattgatgagccggttgttgagcaagtaggaaaagatgaccaactggttgttaaagatgaattgccgccaaaggaagacatggacataaacatggtgtgtatgtttcctatggagttttgtgctatggatgaggttgaagtttttcaactttcactaggtccaagagatgcggtttttgggaagcccgatgagtctaaccgtcatatgaagcatcttaatcttaagggtcatattgatgggaatctctaggatgttggtggatggaggtgccgccatgaacttgattccatactcatttgtcggagatatgggcccgggggtatgtgaagtaaagggaagttaccttcccgtccagccaagtggccctgcaagctggccccactcacacacctcgtgagtcgcgagagcggcggggggggcctcggggcgtgacgtcgccccctcgggctctcccgctgctcccctcgaggccctcgcccggctgtcacgtggcagggggagagagtgagagggggacccaggctggacagccataaaaatgcggcaccccaactatccctcactgcatttaacgcgataagggcaggcatgcggtgcgcctagctgacccctgtcaatcggaggtgaccaatctgtgaccggcctgttgccggtcacgtccgattgaacgggcggccgtgcccccacgtcgcctctgtctctggcggagtgggggtaggtatgacctgtcacattggagcgtcactcgaaggagggctgtcacgcccagaaatttaacccaaatttccagactattttgcgtattaaatccctgtcccgagattctgggatggctagaaagaaagctggagctggcgggcggtctgactgatttgcacactgcactgttcctttctaattcaactgaccgattcctcaatggtccaaacctacacgactgaactgaccggcattgaccattctgttcttttgctccaaacaactgaactgactggcctcattggattcgaccttggagttctggcgccccacaagactgaactcagtacgagtgatctggctggtttcagctctgcggtcctgttgctcccaaaactgaacagattggttctgcttgaactgacccagactaggactgcgaatgctcgtgaaactttcttatcttgggatgaactgttgatgctagcaacttgataacctgacagttcaccaagttggctagagaaggatggagttgttcctgaatcttgcatctggcatttgtaactcattgatcctacgtccgcttgaactggtcctggctcgaatgacaattccaggaaacctgcttgacatgtcttttgtctgaactgcaaccgtctgcttgacctgtctaagctaagcggttgaactggcctcatgggtgtaccttagaattcaatcggttgcccggggattggcttaattcttctgataccttgcaacatgtttcttcaagtgctaccctgattgcggcactggttgaaccttcaactaaaacagcgacgaagtgaggcaaaactcttctccgagacctaccccccttacagggagtagtcttactttcgcgtggctgggatcggttgaactgttgtccttcaaatataaccaacacttctctgttttgcgaagagccctgactttgaaaactaaaaacttcgccgatcgatcaaaatagagtaacaacgatgcactttcatcccattaagatttggaacttaaccctcagttgctgataggaaattccacataaggaaattctcatttagcatatgatctttctaactcttgactacttccccatcagttctacggctggcataactagcatgcttctggactgacgtcggtgtcgtatgcttggacatattgcatagtcgacattctttgaagcacacattgaccacttaacggatcaaaatcaagagtccttctcacgacataaccccacacgtcgatttttttttactcttcctggattgatgaactgtaaaccctgcaactgctttcgcaaaaatactgtagtctgcacgactgccggaaattgactttgatgctgccgagagttcctgttctttgatcataacaacttcgctttcatatgttcggtaaagatgatttgttgaaaagagattctatgccatataccttgttggctacacatttctatttctggaccaaactctcgtatcttcctgactcatgtatggaacaatttctttttttttcaacttctgagaaacattgagatgattcctggaacttatactggttgccttgaactaagcaaacaccttctgaattcatggtcaccacactagggcgtaatcgccgattaccatcctgtaacagcttccaaggttagagagtttccaagagtttctatatgatgtcactttcaaatattccatccctcttttcatttgagtaccactgatgttgcctttagagagatctcatcatgtcgagtgttgagggtctaaccattttcactccgttggttaaccattcctctattggcttgcaaacaggttttggagctcaatagaattgcgatgagttagaagagaaacccttggtttcttgagacactgacagatacccattttgatttgcttttgcatgctgaagatgaatcataaaaggagaggaactggctgactcatattttattcaatatttccttttcattacatggctaccataaacatatatgtacaatgagaagtactacaaaatcaaacaattgtagactgctgctgattagaactgcccttttcacgactgaacttgaaaagtagaagtcttgtctagaactgctattgcttccattattcaaacctgactgacttgtttctttagttcctactaccagaagtctcaccgggaacgttgctctgcttgttgatcttcgatggtggaggggcaactgtcttgtcagctgtaacgggtaggatcttcttgcccgtggggttaccgaacggtgatttgtcgatgggcctccagattggagcaatacgaggtgcattgctagaactgacaacagttgggcgacctggtgctgacaacacttgccgcgggtgctgacgaaggggcgtaccgcctctttgtagctgtagcgagctgttgttctcctggcattgcttacgctgctggcgttggtgctgtaggcttgaaacgattgctggtggaacaatgtgacctttgacggtgcccttgacgataatccgttggggcggaggttgcacattcaggtgtcgattggtgtcatgggcagtgctggtaacttgtgaatcacgacgaactgcctttgctgctcttggaagaggacaatcactgaaacgatgtcctggcttacgacagttgtgacagaatcgacttgcttggtctcggggtgcaggcttctgattatgcactttggcagctgaaacgggaacaagcagagacttatgaacatccttggtgacgttgcttcttccatggttggcttccactggaactagagttggaggaagagcagaaggattgtgaccgctgttgtcgattgtcattggttgacgaatgggttgcacggttgtcccttgttctttcttggtcttagctatgaccgcgtttaactgacagtccttaggcacatgatctgttccttcacacaagaaacatgtgaccttccttaaagggaatgcatctgagtaatgggtatattcaccacagcagcatgtggggaggcataaactagcagtgtgtccgactatcccacatctagtacatgctttgaactccaatcctctttccatgaaactgttaagggtcgtatcatcatcgtcatcagtatcatcatcatcgtcatcagcagaaaactgctctcctgattcatcatcttcgggtctgggcgaaccgtactttatgagatgtcgggttagctggcgtgctccacggaaggtatttcttcctctctgacgcttgggtatccttgctgcgtcttcaggagtaaattctgaacttgtgatgatcatggtcctgccattatccatcttccatgtcaccttcctgttcgctccagagttgggctgcaaagtaccatccttcttgtcggtagactgacttggagcttggttactccctgggcactgcttctcgtctttttcaggtgacctggcgaacaccttccatggacagttccttacataatgaccttgctcaccacagtcataacaggtagcacttactttcctttggtctgacgatgacttggctgtcgttatcttcggggatctggacagcattttgacaggggtcttcggtgccgatattgggaactcctgactctgactctgattcgggttccgggctggcatctgatctggcacctgcggtgggtgacattgacgtgactcctgacattgtcgttgcatctgttgcatctggtatatttggtaccgacgtcgcatctgttgtaacaactcttccactgtctgagtttgattagccatgacttggggttcaggctgatcttcaagaggctgacgtggaatactattagaattgcactgagttgccccatgaaactgacggggtcttgatccgatgaaattgtccctcatgcagaccatctgctgcaggcaccagagagagggggaaatgggaggggttactagagaggaggtactaaaccacttgcctattgatctgttgtgaatggattttatgattcaagttgtttaagcaaacaacctagtatggtcgcatccccaccagtgatgcaaaccatacccctacacacaagcaaacaacacacgatctagaagctaacgaaactaccctcccgggaaggattgggtttaggtcatctccgagaaaacttcacttgatcttcgcggaacgacgactttgaactgatcttctcgctccttgcatgaagcttgaggcttgacttgacttgacttccgaacagacatgaagttgacggtttctcctccatgtttgacaactaaaagagttggagggacagggaggagaattttcaaaatcgtttcacaaagaaatgccaaagggcgagaggagacattttgcaaatagggttttcagaaaacttgtccttagggtttgaccatttggctcaacctacagtcaagttggctctgataccactttgtcacgcccagaaatttaacccaaattttcagactattttgcgtattaaatccctatccaggaccagccagggtacacaaaacgacaagtaatatacagttccaaacgtaaataaagcgtaaaatacttacggaagaggcacttagtcctcacaccgaaacagaacgatagcagcggaaaaaggcgatcctagcggggctcgggaaggcgggatcgaggccggacgtggcggaatcggccggcgaagtggggcgccgacgtggggtggtgaagggattaaccggcgccgattttcgctgggagagtggggagaaaggtggaggatgtggaggggatcgatttcacgcgctcgtgggacggggtggagcgcgggagccgcggcgtcgtggggcgaaaccggcggccatggcggcagttggggcgacgggaggttggggaagaagatgacaggtggggcctcgggtcccacctgtcggggagagagagaggggaaaacg

SEQ ID NO: 55237 - DNA, 1598 bp, Oryza sativa
ttaaattggtttaacttttatttaatttttagaaaatgcattattaaatgatttttaatcccgaacgaaaatcggggcgttacaagggttgccacaagtcttcactcatttatgagggaatgacagggctgtcctccgtgtcaggcgggggatggcattgggacccactcaaggaccggttgctgcttagcttccgggggaaggcacggatcaatgcccggtcaaagtggagtgggtccccccccatggagggttaggtagaggcagtgcatgtggtatccccttgagctataaagggaggaccttgcccaccgagacaggggggacgactctcagaaaacctgaactctaggagaaggaaagtgagaacgctctctggagtaaaggaacctttgtaaaactcatccataatcccaaacacaggagtagggtgttacgctccatagcggcccgaacctgtataatccgactgtgtgcaagctagccgagagtcttaggggcgaatacgtgatttccaagaggcgagcctctgcccccggccgaactcacgaaaggggggtctcacgactccccgctatcgaggatcttccctcgacatcattattcaagaagttgggacgtggagatgatgagttgaagaagaccaacatgactctcaacggcttcaatggtgaaccaacggaggcgaaaggtatcttttcggtggagcttaccgtggttaaaaagacgttgccaaccgctttcttcatcgtcgatgtgcaaggtaactgtagtgttattttggggcgttgttggattcatgccaattgttgtgtgccttctaccttgcatcaatgtttaactcaatgggacggcgatgatattgagattgtttaagcagatacatgcaatggccgatgcttcaattgagtgcgaacatgggaatcctacaacatttctaagaatggtttttgtaacattctgaaaattcgaccaacaaaatcaaagactccaaaaaaattctgatcttcaaaaaaaaaactttttaaataaattgcatcatgccaattttattcgaagattttattggattttgatttcggatttcatcgatcacaaatgggaggaaattaactaggaataaaccctaaaaatcaagtgggctaaataaataattaaaatataaattaaaataaagattaggtgggtttggaaataaataaaatgttatcgcaaccatattaacaacaattaaattttaatacgatggaatgagaattaactttaattaaaaattcaaatgaattatataaacaaaatatgagtgatattaaattaggtgaatctttagttagaataatataaatatggggtaaaacttcatttatgcaaaaattaagaatttcggaatcaaattcatatgagaaacactctaaaatcggtttattggaaaagtgcactgttcattgcccgccacgtgttcgacctggtccccagcctttcccctcccctgccacgcgcgccgctccgcctcccctctgccgcgtcgctcgccgtcgcatcaccgtcgtcgtcgcgtcgagccccgtgccgagccgcgcccgtcccgctgccgcgcc

SEQ ID NO: 55238 - DNA, 5933 bp, Oryza sativa
  unsure (1)..(5933): unsure at all n locations
cgagccccgcgcgccgccccgagccccgcgcagccatcccgtcaccgcagccgcgtcgccgcccctccccctcctctctttcccctcttattcttcccctcttcccctcttccctcttccctcctcctccttcccccttatctctctcccttcccctataaaagcctcactattcccccccttctccccgtctccaccacccactcctccacgccgtcgcgccgccatcgtagtgccgccgcaccgccgccgtcgtgctgccgcgccgaccgtttccgtgcccgcaccgccgttctcgcgccaccgtgcgccgccgtcgctgccgccgtcatcgccgctgccgccgccggtgagtcgccctccgtttccctcgagtccgccgccgccaccgctcgggtgggaaagagagagagccgagagaaagagagggagagccgagaaagagaaggagaggaagggaggaggaagccaggagagaaaagaaaagaaagggagagaaagaaaaagaaaagaaaagagaggagaggaaaaagggaaagaaaaagagaaagaaaaatttagggggaaatttaaaatatttgcaaatattagaatttaattgtaggattaatgaaaatatagttagataaactcttactaattaaatacctaaaatactagcatttaaatataggattaatgaaaatataatgggataaattcctatagattatagataacttttagtactctccataagaaatcaattcgcggtattaatttagatgtaattaataattaaacaaatgtatgaattctcgtaaattattgtggattatttctgggtaatctctataaataatcgatcaacggtagcgattcggatttaattactagagtgttaaccgtgtattatatttaatcatagactaaattaagtcgtataatattataagataattttaggattccgctcgacatttagctcgcgataagaaatttctaacctaatatacggatataatgctagggtagattaaattaaaaacatacgacaacaaaatattgtaaccgcaaaataatttaaaccaaaattggggtttgccatagttcgcggatagtaaaattaataaaaaggaattgactttcgcgttcgacttccatttggatttacttggatttttatttgaattctaaccgaattcaaatcaattttcgcacgtaactatagagaccgagggagccgcggatccaggtgaaggccaagacccgcaagacctcgagcaaggcaagtcatcactattccttgaacatgttgatcccaattgcgaaattgttttgtttataaataaaattgcatgcaattatgaacctcctacttgtgattatgccatgccttgattattgttcacctttaaatctttgtaaccatagatacgtacgagtccctagtcaactatgacacttgcttagaaatgctattttagattcatgcatactcatatttatcaaatgctatatgcttgggcaattacctttgggaaggtaattgagatgcggcatgtggagacatgagcgccacattgccatgatattgatgacataatttgtgaaaggaaaataaagtaaaacaactgttttcgactggggcggctggaggacttgggtggtgtccggaaaaggctagtgccgtccctggtcaattaaggaccgagccatgaagttaagcatgaaacgacccccgtacaaccgcacttctcgtatgggtatagacctagcggagtagatagctgagcggaggcagtatccatgcatagtggtttcttgatgtgtgaggcaggggctctacggtggggcagccattggtaggaccgcgaggagggtgtctacagtggtgtcgccatcggtaggaatgccatgtgagaatctaaaacataattataacttaatgcatgtgtgagtcttcccttcccgggtgccagaactcctctcactgctagaaaccgtgtacgcctagagtgcatgaggatgaaaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaacctattcgaatagccgtgctcgcggttattgagcaccgggacatgtattacacttggctagactctaaattcttaacttgtgtgggatgggatattgcatgatgaattttatgctgttggagccacttcctgagaggcgagaaggtggacgtcctcagaaaaccatgacgaatcaatggcgggaagctatccttgggatcacaatggatggtggacagaaccgtcgttgtttaaatacaaactctggtactaaaaatttgatcagtcaatgctaggtcttaggcttgtgaaaagaattacaaaacttgctttgcgcaaaagaactatggccatcctttgaactccccctttcatatgcattgttgctgtggtggcttgctgagtacggttggtactcatccttgcaaatataaaatttattagaagtgggagatgaagcctcggaggatccctatgcctattatcaggagggagatgaagacgatggcgtccagtaggtcttagcacggtcgttgcctgtggcaatggcatgccgctgcctgaattccgctgccttatctatttctgcttttggatgtattccggacctctcggtccgatgatttaaggctatgcctgcgggcctatgatgtaataattcgtattaaacactcgtgtatgtgcacttgatattccagctatgaattcgtgtgtaccaaactacttgatccagggaaatggtactgtttacacgattgattcctgttataaaaacgggggtccacagtttctgtaaagtcggctagtttaacagggttagatcgttctagctatgatttcattagtgtttctaagaatggttttgtacctatctctataaagccggctagtttagcacggctaggcaatattactttgtatcatgagtaaagatgctaatctagagtggttgcaagggtacaatatcaatctacgaagataacatgttctatgcttttagattcacgatattcatcaaaaagacaggggcatgtgtttacgcccaaatttggcacataggatcgaaatagggaaaattaccaagatttgggacatctgcttttgatagtcatatttcatccgtccctctaagtcctactccctccatctacttttgatagtcatatttcatcttggcacacagaccaaggataagtaattttacttatcatctatttaaacatgctactccctccatctacttttgatagtcatattttatcttgacacacagaccaaggataagtgattctacttatcgtctatttaaacatgctactccctccggttctatattaattgacgttttgaacaaggttgagattaaacttttataactttgaccatcaataactttaaaaatatttagtttaaagaaactagaacaacatatataaatttgtctttcaaattactataataaaagtaaacatgcatttatttattgtatatattataataaaaaatgagatcaaagatatatcttgtagaccgtgtcactgtccaaaacgtcaattaaaataaaactggagggagtactagtcattcctcgtaaacaagcgattcattaatatttacatttcacgatgcccatgtagccaatcttgtgtggaagaatggaaagtcacgcattaaatctaagaaattcattaagatgataagttgttggattgaaatatgcctatcaaaaataaatttttcaaatttggaaatatgactatcaaaagtagatggagggagtactagttattcatcataaacgagcgattcattaatatttacatttctcaatacccatataaccaatcctgtatggaagaatggagagttacgcattagggtttaggaaggaaagccattaagattataggttgttggattgaaatatgcctatcaaaaataaattttttaaatttggaaatataccttttgatagaagacagtatcacagagagaggaaaaaaactgaacagttacgaggtactccccatctgtacattaatttgcatgtccaggaaaagatggacaagtttaattacacacccatatacctcttcacgaaacaaaccactgacggatatgtgtgcacaattatcgtcacataaggacaaaaggaatctacattatctacctctccggctctccctctcatacaattttgcataggactaactaatgatacaaatgggatttccttcaattctggcctgcgtgagcgcgcatgcgtcatcctagctgcatgtacgtagacatccaacaatcgattgatcatttgcagatatcgcattcgacaacatcgtcctgcatatgtaagttgttttgtattattaacaattgaagagccacgtgttcactctggagatttaaaatattactaagtgagtaggagaaaaggagaaattaatgtatatttactgtgtttaatcatgcatggtgggtttagattaaaatacaattgtatttataaaaagaataaatggaatgatatggttgtatacatggatatataagacatatatgtatacagttatataaacgtaaacaacatttaaatttagctccacgtacttaaaaatgagtggaaaaatatgataatagttgcatatcctatcttactataaaagttgatgctaaataacttttaaaacttaacatgcaagtgtgtcacatcatcacctttactagcaattattatctagagtattttaaatcacatacaagtttgacacatcatcatttactagcaattattatctagagtattttaaattacatgcaattgcgccacatcatcacccactagcaattattatctagaatattttaaatatcatgcaaacataatatatcagttacagttgtatttttagagctcaatatgcgagtgatatcaaattgttatcttcacattattctcatatacacacactatttctataacgtataaaatgtattaattcatataacctgcagtaaaacactgtgtatcaaccagtacaagaggcgtgtctgttttacctcgtctttatcgtgtccctccagacggcgcttggtcttgcatggacatgaatagggcgccaacctagaaacgtggagcatatgccgcagccttgcctgcacatggttgtagatgctgcgcgcgcaggcaggagtgccccgcgcatagtgtattcagtaaattattatactaagagcatgtaactattagccaggtaccaacatattttaataagataaaagataagagagaatagcagcgggctacagatctatagccagctacagcaaagactccaagatgcaatatgtgtatgacaggtaggaccatatactaatagtatagtaagcaattattatatgaattagctattagattggctattagatgaattggagctagtagtgggctatactattaaacttgctctaataactagtagttgtacagtacacgagagcaatttgtggaccctaattaattagggaatgtctatagatcatttgacagaaaaccccctcacaaatcttgtaaatttttgaccacccgattgctttaagattcgtgcaggcaacaaaaccttaaaaatcctctctcctctcccgattccttcaaacacgcccgnccnccgggnncccttgctcagcgcttcccacccgcctccgccactgtcgccgctgccccagcgcaccaccgcccgacctcgccggccggccaaaaggtgtcaacggcgccggctaggcccccccgaccggccccct

SEQ ID NO: 55239 - DNA, 4315 bp, Oryza sativa
  unsure (1)..(4315): unsure at all n locations
agagcacgaatcgtgaagcacatccagtgatccaaaatttgcaagatttgaggtatgattttctatcgacatagctttagcaattccgaattaattaagcttgtagtagggttacctgagcctatgcctgttgcaagatgcaaagaagagcagtataccattcagtatgctcctgattgcccggaagatctattaattatacatataaatgggtgtatattatacacagagggatattgtatgaatcgatatagtactagttagctaggagtatagtgtatatgtatatatagtagtgtacctgggagaagagatcgttccagagagacttgagcaaggagacgtcgaaggcgctgtgctgcgcctcggccatgtggttgagctcgaacatgctgctcaccgtctcccagatgtccttgccgaagttgtaggtgttggagagcagcgagcccgcgcaggaagcaagagaggccgcgaaacgcagcggaaggagcagcgcctggaccagcgggttgaggcagtccaggacggcgtccaagggcgcccacagcgcctccgccaggtcgcccagcagctcgcatacctcgccgcaggcggccaggaggggccccgcgatggccgacagcggagccgacagcggacggagcaccgccctggccatgcgcagcagggccaccatcccctgcaggcacttgcgcaggtggttccggaggaagaggatggtgcccaggtactggatccgggtgaccatgtcccacgtctcgatccagccgaagagcggcccacacacgcgcgccgccgcggccttgagcagcggcacgttcttgtacaggtcgtagaagccgatgatgacggtggccagggagaccagcaggtagagcgtccgcgccaggggcctcatccacggcctgtatagcaggcacagcagcgggtacgactgcaggaagatgacccacgacggcaggccagactccagcagcgtcagcagccggatgtccgacatgatatctccctcagctttccaatttcccgggggggcccaaaagggccgggnccgntcctttggttcccctgnngnaccgnngnagnncagganntncaggcgtgtcggtgtaggaagaagacgaagaaggcgcctgatcatcctcatcatcggcgtcctccttcttcttgtccgactccgacgacgacgaacgtcggatctgttgatgaatcagccgccgcatattactagtactagtattaatattattgttgtccttgtcgtcgttatcaacgacgttgtcttgggacagggagtagagggtggtgaggtagccgcgcagcgcctcagcctcgggggcgcggccaaggaaccagagcttggtgcagccggccgcctgctccgcgctgtagaactcccatttcttcatgtacctcgcctccagcgccaacgacgtgtccgtcagcagctcgttcaggtagttgatgccgtgcacgtctctccacgacacctcgaacactaggaacccatgcagcgccagcctcaggtccaccacctcgaaccaccgccgcgccgccatgctgcactcgccgtcggctgctgctgcggcggcggcggtggcgctcgaggtgttccggccggagcaagggagcgccctcgagtttgcgaatggagacatcctgtactgcaattagagagagaagctagctcgtgaccataagctaggcaggaattaattgaaggtagtactagctagtataccttggtcaccatgaactgccagagtcttgccgatcgagattgcttgctcgaccgccatggctggttatccaccagaatgaacaccttcttgctgagaggtgcaaaatacaggaacgcccgtgacacgtaagattgcatgtccctgcagacaacataattataatcgatgtaaatcatcatcatcatggcattcatgtcgatcgattaatatatctacttaattagttacccgatttgcaaccctgtcaatggatagatatctggcaaggcctccatgtgtgcaagatgtatgtatgccgtctgcctactactaaggttgatcgatctgcaaataaataaagagagattgatcgaccaactctgaagaacttttgggtaactttagctagctagctagttcatgaatgaccggaaataaatactctatataatgaaggaacggaattaacagtacatagcgccatgcatgagccgatatatcgacgatgacttattagcttagaatttaaatccggggattgaaagatgatcaaatcaaagccggaggagtaacaaatataccgagacgagacgtacgcgacgtcgtgcggaagcaaattgataaagagatgatggaggccggacgattgcaaggtggtagttcttgctcttatcaatcgctgcttcgttttcctttcagccggacggccggtggcaagagcaagagcaggagcaggacaggaggccgattgcatgttgatgttggcaggtcgatcgatcgagaggtgagcgaatggccgttctttcctttgtttccaaattaaacctccattattggcaactaccattaatagctgttactgatctcggccactaattcatttttatatccaactgagggcgcactccatcgcaattcgactggccattcccaacccaataacggggatggtgtccatagcattaaataaaaacgatgaaaattgatgtaacaagtaaataaatgaggaaagagaaggaaactaggtcttacatgagacatgctttctacacaacattcaagatatcgtgtgagataagtagcattaaatttaagtatggaaaagtggtgtttgtattgaaagagtagtgtctagtactaagttcttgatggtgtagagttttatattatgtcttatattatggttgtgtcttatattatggaatggagggaatagtacataatcgatttttgcggacaaggccccaataggttgcaggtgggctgtaacctatccctcgtgcaaaaatcgccaaagtgttggattgttcattcaccaataagtaatgtgagctgggtttcatttttgtactttgtagaggtctcataaaccaccatgaccttgctgcttcacggattgttagtcgcctttcctctcaatctttattgggattctaaatatcaaacctaaatgtcatcgtaagagaggtttattcatagtttttattgtttcatcaaccgctatcacactacttgctagctcgttaccctatccctcttttagcatttaccatcattgcgttctatattacattatttcccttgaactctcattttttatataattttgaaatttatcttacttttatttcaaattttaatcaatgtcatgttgtgttctgcgtgcatgtttttttaacataattgtcattgcaaacgccaacgctccctcctttcccgcgtgcgccgccgccccctgcctccgtgcgccgctgccgctccctgcctccgcgtgtcgtcgtcgcccagctgcagctcagtaggcgacgaggtgaggatggggatagggttgatttgtaataggggtattttggtcacttcgtgctagcaattttttttctttttcctaaatgaagtgctaacggtgaagtgaaaaaacgaggtcaaatgagtaaggttagggttaaattagtagctaggcttgggcaaatttgtaattgcaattaaccccacgtcagcgatccgcctctaaaccatcacccccgatccggtcgatcgatcccccatccccactgaaaaagaaaagaaaaaaaaagaggaaaagcagcgagcgagagaccgggggacggaaatggtcgtcgccgtcgcctcaccttcgtcggcgccggggccgggcgccgccggccgcccccacccgacctacaaggaggcaagattctctctcagatactcccccccatcccaaaattatactagtatttttgtcggttgaatcgagcatatgcatctggatgcttcttacttctcacttgctccagatctccttgatttggtgcagatgatcctgcgggcgctcaaggagcttccagatccgatcatctccagccgccgtgccatcgccaagtacatctccgacaacttctccggcctcccttctcacacgacgcgctcctcaccgttcacctccgccgcctcaggtcacagggccttctcctcatgtctggacactcgtaccttctctccacctccgccaccgccgctcgaggacggggacgaggacgaccgcccaagaaagcttcctcctccgcgccgcctcaaaagcgcggacccgg

SEQ ID NO: 55240 - DNA, 5271 bp, Oryza sativa
cccgttgagactgggagtgaagcggggacctgggaggccgcgcaagaatgctgctgctaccccgttgagactgggagcgaagcggggacctgggagaccgcgcaagaatgccactgctacgccgttgagcctgggagttaagcggggacctgggaggccgcgcaagaatgctgctgctgctgcctctcccgttgctccgccgcctgcatctccactgaagcggggtgttggacgcccaaggaagaacgccactcctctagtcaagcctggacctgggaggccgtctggattcaaacgtggaccaggccgccctcgcaagaatgccactcctcctgtgctgtcagtgccacccactgctgctgctgtgttgggagtgaagcgtggccgtgggcgccctagaaaggataaaccattgcaatcttggtctgtgctctctggcggtgctgcaatgactaagagagggcctgggaggccaagaaagaagaggccactggaagctggaggtgttgtggcagcacaggtagacactgcagatggaggtgaggctggagccgttcaaaatggaggtgaagttaggtgtctgctctctgatggtgcttcttcaatggggaacagagggcctgggagtcctaggaaggaggtgctattggaaaatgaacctacagtttctacattggtgggaaagagaggccgtggccgtccaaaaaaggagaaaccatcagcagcaaggcctgctgaaactggagatgctaaatcaatggggatcaagagaggtcgcggaagaccaagaaaggacagttcctttcaagctgtgtttgcagaagctgcaggtcaggtgtcaagagatgtcacagcagctcagcccgaaggagatgcagatttactggcaaggaaggaaccagagactgcagctgtagtttcggtggagaacaaagaaactaggcctgcagatgctgggggtgttgtggtttctgaagagaagacatcgattgatccggtggaggctggaagtgtaatgccatgtgttaatgcagaagttgatcgcatgaactctgacctgcgcactgctaatccatagtgtggctggcgtcagcactcagcacagaagggaggacctggatggctggcactacctgcaggtgtgaatgtgtattcactgatttagctggagacatactgtgaaaactgttaaatgttgcaaccaaaattattactgtcatgctgttaagtagtttctcaagatcaacattggagtatgcttttaatgatatccacttctcggataaatttttataatagtccttaggtagcacatatagttcctttaggaatgactggatatatcatatatgttgcttttagtgcacccagtggtgatgagatgcatcaatgtttacttccaatttgaacatccattagtgtttcattcaatcaatatctctgttttttccatgcctatatcttaagtaattttggtgaatttcctttcttattaattattaatagtaaggttaatctagcaagtatttttctattcattgttgtattgtgcaaattcagcctagaatgtgctcttatgatatgaagttttactgccacagcttgtttgtttatggttattagtatttgtggggtttaaataattccagatatcttttgtgacatagtataggttgtggggggagaattgttggtccatgaccatgaggtctggtgctcttgtcattttactgtgaggattaccctagataccctaatcatgctcaatctgcatgtttctctcaatttgcatagaaaatggttggccctattgtgttgctgagttaatttataccgcttgtaggccgagcaacttagcaaggaatttaatcaaaatctttgtttctctcatatcttcccatatcctatatgaggtcctgcatgaatatttgttctgttcatatgagttttggctgacaagtcatactatactactgcacactagctgttctcacgtggcctgctttggttctgcataatacaattatgtgtttatgaaccgccttcaatcaagctcagttggtgggaggtgtagatgcatgggtttgagtcctcttgaacacaagtgccccttcttcctaataatgatactgtaatgaatagggtttatggagttgaatttgcagcaaaattcagtttatagagaaggttttgttttgttttgaacagtttatagagaagttccattcatcatttgttcagtgcatttaatggttccttttttgtgtactttttttgtacattcttgattccttgttattgtgcaatattttttttgttgttaagaaattgttacagtgtaaggatatgtaagggccttatcttttcaattatgcttatgcttatcagccaaaatttgaattttcaaccttaaatttggagttgattttgaggttttttcatcaaaatttatttttcagcctttgcttttagatcgataagaacacgcatataaaagttttattcacaaattcctcttcgtttgtaaatatgccgtttcgcttattctattccgtgaataagtgaaacgatggttcgcttattctattccgcaaataaggcgaataagcgaaacgatggttcagtaagattggtttgcttggctctctgattgctatggtgagaagttggtatgaaaaccataactttgagtaccaaacaaatcccttttttttgtcttggtccattatcactggcattaccatttgtgcacagtacaatctccaaccaaatattatcactgaaatgaatgttttttagatgaatgttctgggttgtgatattgatatagatgagttatctcactttacacacaagggcgggcagagcacaaagtaaaatgatgattacagaggttggttagcagacaatctttcatttcatttgttatggatggcttgattttccctgaagaatgataacagcctcaggaggtggaaggaacagctaggtttgagtgtgggaaaaaaacattgaatgcgattagtagtacctgctaaaggttttctactttcaggcagatgaagtaagggtttagggtttagggttaaatcagctgagaattattttttttaacaaacaagatacaattgtgttctctgttctagtttagggtatatatataaactgaatgatggcaacctcgcaagaattatttccagataattagactgatgcattgttccctgcgtgccttgagaggtcagcatgttgaactagttgtactatactactacctgctgcttgtgacaacattcttgtttagggggtaagttttggcttgtcacactgggtattgtataggatgtcgcatggaatgtttgggcactaataaaaaaactaattatagaatctgttagtaaaccgcaatgaatttattaagcctaattaatccgttattagcacatgtttattggagcaccatattgtcaaatcatggagcaagtgcttcattgttgaatcatggagcaattaggtctaaaagattcagtcttgtaaattagtcgcaatcgtgcaattagttgttttttagcctatatttaatacttcatgcagatgttcaaacgttcgatatgacaaggtgtaaaattctaggagggatctaaacaggccttaggctgtgtttggaaccatgggttcccaacacgcacagtgcgcataaaaaacggagtggtccattagcacatgattaattaagtattagctatattttttttcaaaaatgtatcgatatgattttttaaagcaactttcgtatagaaactttttttaaaaaaaacgcaccgtttatcagtttgaaaagcgtgtgtgtagaaaaagaggcggaggaacacgaaattagcttttttattcgtgtccgaaaacccattccgacgtccagtgaaacatccgatagtaacttagcttcaatgcttcttctttcctttcctgtactagaatagttcttgtgttgactggaaagttggcttgtgtttgcttctcatgtatgaacaagtacgtgtattctaattgtcgtgtagtagtatatgagccaaaaatttgataggatttcttatatagttaccaaaatttggtagcaaactaaatgtagccactttttttatatctttattaaaatttggtaaggttgaaaatggtatcaaagtgaacatgcccgaaaagaaaagagtaaatgaaagaaaagagtgaatggacggcccagcagcatagtcagcccaagcccaatgcgtaccaaccaacggctgtgatgacgtgaagcgccgagcgcggcatcggacggccagggctcgcccggtgcccttttaaaacccgtatcacttctctcgcattcccaatcccctcacagccttaaaccctagctccgcctcccacctcccttttcttttctagggttcttccgccgccgccgccgccgccgccgattccgatggagttctggggtaatctcctcctctacctctctctcttcccctccctctctccatccatctatattgcgcagtttcggtttttgtttgatttgatttggacgcgattcgtttgatacggtgtttggttcgtgcgcttctcttcgttacggattagacgcgattcgtttcaccatcgagtgttttgggttcgcgcggaatcgcggccatggctcttccctgtcttcgttagggattaattagggattttagttttcatgggccgcgactatttccatcatacatgcgtaaccgcattggttgccgcctttatgtttgcgagaatcatcattttgttcattctgtttctgtttcagttaacacattctgattatcttcagtctcatagttgttatcatatattactacagtacttaccttgcttcggccccatcgtttggcatatttacgaacgaaaaataatttgtgaataaaacttagcgatctaaaagaaaaggctgaaaaataaacttctgaaaacctccaaaatcaactccaaatttaagattgaaaattcaaattttggctgataagcataagcggaaagataaggtcgcttgtttctatgggccatcctcgttaatttactatgctagttgcttttcaactttactagctaaaggcaaatatgaactgtagtatactgtttcattcatgccttcttggaagggaaggactactctatacatgtgtctttccctgattagtcaaagttgtgcaggtcttgaagtcaagcctggacagactgtcaaatagagctgaaggg

SEQ ID NO: 55241 - DNA, 2762 bp, Oryza sativa
ctctcagctgacaagttccctcaaatccagtttgatttggcctttgacaaagagtttgagctgtcacacacttcaaagactgctagtgtgttcttttctggctacaaagtttcccagccggctgaggaagatgaatatcctttgtaatgttttaccatgtttggtcaatatatgtaatgcatataatgtcatactctattttattttcattaaggtatgtattacaatattgttttccttgacctgccttttttgttgttccacaatggattttgattctgaagaagttgaaggtatgattgctactagtgcttgtgttctgcctagagagaatttaacgagcctgtttataatttatttcagatgaagaggaggaagaaaagatcattccagctcccagggcaaatggtaccatagtttctcctttctgattatgattggaatcacagaatccttttgcacctctctttaaaactttataaggaagtacttatgactaaaacttttctaaggcaaagttgaagggaaggaaaatgagcagaaaaaacaaggcaagacagattcttcagcttcaaaatcaaaggctgcagtgaatgacgatgatgatgatgatgacacgatgaggatgattatgaggacgaagatctttctcctgaggatgatgatgatgtgagtaatttatgggtactgttgtgtattattgtggaggattgttccatactaacagtggtgcaatggcctgttataggattcttctgaggatgattccagcgaagatgatgaggatgagagtgacgaggaagatactcccaagaaggtatgtgtatgtgtttgaaggatatagtctgcttgtttctgtgcacttatatgtgtttgaaggatacagttagtttgtttgttctgtactcttaccataaacaatgtgatgacttgcagccagagactggaaagaggaaagtagctgaaattgtgttgaagacaccttcgtctgataagaaagcaaagattgctacaccgtcaggccagaagacaggttagtagctgtgaagctgcgcctgcgatgaataaattggcactggaagtagtgatgaatttgtatcatttggtcctcctgagcaggtgacaagaagggtgtccatgtagcaactccacatccggcaaagcaggctagcaagacccccgtgaatgacaagtcaaaggagaagtccccaaaatccggtggtgggtcaatttcttgcaagtcatgcagcaagtaagtttagatgcgctgtcttcttgttttggagtattacgtaaggaaatgattcaaagtttgcatgaatgcattgtttaggacgttcaacagtgaaatggctctgcaatctcactcgaaggccaagcaccccgccaagtgaagaatgagacaacggatgctgagctgagaaatattggtgtcgtttgagttggttatctgaaatgaaatgaaatgctgcaaactatttggtgttatgagtagtgtcgtgacggtttatgtggtgcaaactatttagtctagaaaaaaaaaatctgtggtgcgaactgagctacaattttattcggtcaaggtcagtggagtgattggtttattttggatggaattattgttcttccctgttattcggttaattcccacgagaaaggattgataacaccacactgaattgactagctgaacaaagtcgtaatatctggttttgccctcggccaaatccgaatattagggtgtgtttagttcgtgttttttgggtgttacattggatgttgaccttagaaaggatttttttgatacgaatgaaaaaaattaatttctaacttgcttggaaaccgtgagacgaatttattatgtctaattaaactgttattagcatttatagattactgtagcacttatagttaattatggactaattagacttaaaagatttgtctcgtgatttacatttaaactgtacaattagttttttaatgtatatttaatgctctatactctgcacatgttacatgtgttcaaattttttatatgagtaagaactaaataaggccttagtgagcattttagtagcggctgagcgcttgatcgtttgctgtctgcagccgcaaggcccgcaactacaggaagttttctccgccaaaaggcagcgacaatgcaccagccttaatatcagacaaacagcctctacccaacaattcggctcctagttggaactctttgttcaccaacacgagatggcactgcagctaggcagtagacacgagagtcattccagtttgttcgcatttgtccctgcccatccttttctatttttcgcctacaatataaccataagtatatcatcattgaatatggaatatttcttctcctttctaaaatatataacttttagccttcacaaccaatcacaactttccacctcttaatatctatgccttctccttaaccaatcacaaccatcacatatctaattttacctacttttttaatactcgtgttcaaccaaaactcaggttgtaataaaattttggagttacaacaacgagagtaacaacagcatttgcagttttacttaataattagtcaacagcatttgtgtaacgagttgtgtcgcatgctttattcacagtttttttttaaaattcaagttctttgacttacactcacccgacccaaaataaatcaacttttatatatctatgtcatcctttttaaagtgttagttttgaacatagtaccctgtaaaaaaaat

SEQ ID NO: 55242 - DNA, 2261 bp, Oryza sativa
aggacgaaggagtagaggacggtgtcgtccatggtggtgatgttgagatggagcacctcgagatggaggctctcgagaagggcgatgatcctgacgggaggggcgcgcctagagagcgtgcgaagaagcacgttggcgccggagatcctagcctccacgtcggccatgggggagttgcagcaggcggcgagctctgctaccagctgcagctgctgcttattttcgtccttgggggagatggaggatgagctgccggcgctgctgccggcggcggcagtgggagagcaggaggtgatgagggagcgcgggctgggcgtggggctggggctgccgccgccggaggccgatatcgatgccggcgagattaggtgcgcctgcggctgctgcctgcgcttcttctgggcctccagcgattgcagtagcgtctgtagctccttgatgaagtcgatggcgccgccgatgatcgacgcctggtcgccctgcatgcatgcaccatattattatatatttgtttatcatttccatttccatttccattagaaatattaacaacgtggagtacgtacgtacgtacccgtttgatgtagaatgcgggcgtgagcgagcggagcaccttgaggtggtcgttcatctgccgccgccggttgcgctccacggcgatgtgcgacataacttaattaatttacttacgaccttgtcgatgcgctagctccacggaccacggcttgcttggcttggcttgtcttggcttggctaggttagcacatatcgaatatgtatatatatgccaatctgccatgcatatggcattaattgtcacaacacaaagtagtagtagtagtagtagtagtagtagtagtagtaagttacggcaggtctatctgcgtggatgcatgtatggagtgtgtgagtgtagaagctcacgtacgtacgtacgtgcgtgtgggcccacgtacgcacaaataaacttgtacacggtcgcatacatgtatgcacgtactatatatgtgacgagatttaatggcagcgcgctgggccggcagctagctcgatcatcatgtccccgtgaccgtgaccaagcgcaagcgcccgcgcccatgcacactcaatgcctccataccggcaactctttggaacctcagcaagtaatctcacgttactcaactcgtgcgcatgctcgccttttcttttttcctccgccacattaattctgctagctagctgattctttttttttattttttttatttttttgaagaagaagatgctagctgattctttttaattatttttatttttttattttttgaagaagaagatgctagctgattcgttgcgacagaggtaaatcaaggaggaggcaacgaacagcagctcgatccattggagtaatgcaaccctgctgattttttactcatgtcattgtctcctcttctcttccgctccactccggcttgaacacctgccacaactgggccgatcatcgtttctccccttcgttttgttcgcaactgggccgagccactaagcttccgggccgatccaaggaaaacggcgctccagctttggaaaaagtacaccgaaggtccctcaacttgtcatcgaattataaaatcatcctccaaccgcaaaaccagatataggacatccctcaacttacaaaactgttcactttaggtccttcggtggttttgatcccggtttcgtccgatgtggcggctgagtcagcgtgggacccacgtgggtcccacatgtcagggtgtacagtcagcacctctcccttcccccttctcccccttcctcttctctctctatttctctctctctctcttttcccctctgcaggatgctcggcaggtggggagctcgtcgaggcgaggtgggagaggacatccggctggctggcgatgcggcggcggcggcggcgtcgtcgacgatgcgggagatgggagagcgtcacaggctcaccgcgcatgcgacctcgaggtcgggccatcagagaggcccgggcggtggcggcgaggacgccaaggcgcgagactccgggtggcggcggcggcatacgacgcgctgcgggcgccggtttgggaccaattagaggagcagagaagattagggccaggccgtcatctcccgacgacggcggcgaggcagagaaagggcggcgcggtgaggagggctcgatgaagaagatgaggagcgtggtgctacgggaggccatggcggggctcccggagcacggcgacagctgtgtgaggtac

SEQ ID NO: 55243 - DNA, 8431 bp, Oryza sativa
accttcggtgcactttttcctccagctttctacgtcccagtccctctaacgtagaatccactaacgttggatgatctggttccaaaagcagataggataaatctgaagctacttacattaaacaatagtcacattgcatacaatcacggattaaggctctgttcgttctgggaagatatgggagattgattctcgttttccgcgcgcatgcttttcaaactactaaacggtgcgttttttgtaaaaaatttctataggaaagttgctttaaaaaatcatattaatccatttttaaaatttaaaatagttaatactcaattaatcataagctaatgactcacctcgttttgcgtatctccccaatctcctcaatccccttctcctcaaacacaccctaagagttcatcctagaaaaagaaattaagagtctaaaaaaaatccaatttgtccataagtttgagaaaagaagcatgttttactgcaagggaattaataacttcattacatgcgaatgggaaaaaaatgcattaccttcagatgcatttctatcactctaacagcaaacaggtcaatcaggggtggatcaaaatcaggtgctaaaaaatattttcctcattagataattggtgtttgtgtcctcgtaaaaaaaaggtgtttgtgcttgcagtttgcttcttctagttttgcatacatataatcagtttgcttggttgttttgttgtcgtgcgtggcaaactgtttgccatgactagtgtaatctaccctatatttcagttcaaaacttcaaatggatcggaaaagctgcgcttgctgaggcggctcaaaaatctttgcgttcatctatgtttttcacagtatgtgtcatttcgtcaaatactccactgtttatcaaattgcaatgtatgtgctcatgcatgtggtttttctaatattaccagctcgcagttattcagagaatgtatggcaatacggaaagtactacttagttactcttttgtacttggattgtttctataggttccgtccattcagtccatggggtagaagctgaagatttttggcacctggtataggtaacaggtctgaatatggcgtaaaatagatatccatcttcttttaaagaaaaatgatcagctctatctttaaagcgcatggtagatagaaccttcaagtttttattaagtcagtagtacaaaagtataaaaagaaacattggcagcatcaacacttacaaatccaatgcaaaggagacggccattgtagcaagtgtgacaaatcaatgaatcatgaggtgtagatgttatcaggttctcccatcaggcatttttgagggaaattcaacaggcttagatcgctttctcagataagcagcgtctatcgtcatctttacagttgcatgtcatgtgttgtcagatggttgctagatgcttatccttctgatccaatttgatgatcttgcagactcataaacccttggtaacaaccaactttagaatctcaacaccctcttctatggctgaatcaatctaggttaaaacaaaacatgcaagcattagactctgcccgtcacaacacaccttcagggtctttacatctagaataataatgaaatttgtaacactgaaataattaagtcaaatacggtgtttccggaaatatggtatcactagagtgattcaatgacaaaaattcgccaagagtgtcacagataatgccataataagtcctccaagtaacttcactccagcagttcgatttctagggcatcgtggcatttatctaaaacaattaagattaaagagatctcaacggctgtgagcttcacggaattggattagtacaccatatggaagttgaccacaaggttaagccaatcttctaatcatacacatgttgcaagcctataactcatctctcatttgcgtatagcaccgcagaaattactaagattttaaatgaagtagaataaatctaggtgcggcttacatgcaggatataaccagggttttagactgttggtcatatgaatctatcccagcaaatgagcatgttcatcgagtgagaattatggaagtaataatacaatgattacttcaaaaaacctcaactcagaaaaaaaaaggaatgacacgaaactacaagtatgcctactcccttccatccccaagaaaaaaaggcaacctagtactagaatgtgacacatcctaatacaacgaatctggacatagagtatgtacagattcgttgtactaggatgtgtcacgtcgtagtacgaggttgagttttttttggaatagagggagtagatatttacccgttctagactggtcttattaaacttctggagcacaaaagctttggggtccatttggccaggtggacatccaattcctgaataaaagtatgaatatcacattaaggaaaaaaaactgaatgccacagatgtcaaacctaccaatccttaatattgactaaattctcggttcttatgaaaatggtatatcattctcttcgccctgataagctagaaaggtaaatattttgtgtcaatttaaaaattaaaacacttagttgcagacgtaaaatagtttcacatagctaatggtaaactaaacatgtataaaacaagggagcatgctaccccacactcagataagagtgtgcttatgtctggtaaacttttcaacagaacgttgcctcaggctatctaaagggagcaaaaaagaacatgtggggaaaatggaaaggtgcatgaagaaattaccactacaaataaaaaaatgtaattaagtaaacaaattggaaaggaagaatatgctgtctcttcttaatgaagtcagcatcttgcttatcaggtcaccttttgaatgacaaattacttcattaaaacacatggttacaaaatcaacagacccattatggcgcccgaatcctcctttaggttgtaaacgaagaattccacagggcaggtccgtgccatcaaatgcctgaaattcacaccagaaaagtcagattgctatgtaacttagcactcataaagattagatattacaatacttaccacaaggacacgattaagtggtagtttataataggcagcaagtggcccaacctgcaataggccaaaaaagacttatcaccaagagtcatcagatcagggtcagtatggtataaccatttttttatgtccagttaaaggaatttctacaagctgaattacacacgacctatcaaagaaataagacatagaagtaaccaaaacaaaacagacatattgagatatcaagttcaagtcatagcaactaaaattctgattgttgataggcttttggttgccccaaccaaagtaaagctgcggacataattgaatttagggggaaatggctcttagcaaatcgttctgattcagttagtaacatcaaaaacattgatgtactccattctttgacattccatagcatccaaatatggtatatattctaaattatctcaaaatcaagataataagaagtgccaggattgccctgcagttatatcgacttaaattagctcaattggactgaacctttttggtcacccataacctacccattgcagccacatattcattctccaggcttgtggccaggaaactctgatgagtaatagcaccacttccactagtaaataagcctaatcctcaaaaagtttaatgtatcatcctaaattggtggtactcaagagacccaccaccaatgacgacaacatcagtgtttctgctgaggcaatcacagtttgacctcaaaccattctggcagttgcagaggatcatagagaccaacctgggtctttgcctcccccagctttgcaagatttaaaataaatgtaggcatgaagcacatatttacccatagcaagtgattaaattacaaaatgcccccctctttcttatgtaactctggtaagtgttgttcccctctagaatttagcctaagctccgccactgcattccccggagtgaatgaggggatttaggtgaagaatgtcgaatacatgtaggacgtgaatgaggtgaaccagtgaactggtggcagcagagtttgttagtcttttgttgagtttgatggaagagtaaattacactcacaatacacaaacttaggtggtggatgcaaataagtatagcaacttgcaaatcgctcgtttggtactacttgcttagtagtaccttagtataacttgtatgggccatttagtcttagttcacacggactaagcaagttgtagtatcagagcgagcaatttataagttctatgtactgtaggcgcaatttactcttgatggaacatatttcagtgccaatactagcttctcatgaaactggcaaactcaatcccgaggctgacagaaaaaaaaaaggcacaacagaatatgacaagatatgctcatgatggaaagcatgaaccatcggtcaatgaccaggacaggggcatgcaactgttcgaagattagtagtggcaataaaccacgagccagagtgatttagttttagaattcagggacaaaagttaaaccatgccaagagttaagggacacgaaatagatttattccaagatagtagggcagagtagaaatcagatattaaaacatggaaagagttctaaaagtgatgcttgcagattcaccactgagattcatatacgtttgaggcttagcgagcaaaacaggcacaccttcgaccattcctgcatcaatggaaagacaacggttccaattcagcccttcgaaccaggaaaacagagtttacataactcaaaagatcaaaatacattctctctgggatcacatatatggagccaaaccttccgcaaatagtgccttgaagtgatgcctggtcggagatataccctgagactgtgcaaacatgtctatcatatcaaacccagcctgcagcgaaatggggtgtcacaggatctgaaaataaatcattgaaacaattaaatgaccaagacaagaatgagatgcaaagcttacattgtgtctggtgcaatgatacttctcaccagggttaccaagaccaacaaagagccatggctgtatcgcggatcatgatgagcaggatgaagataatgaggtctgagaggttgaaatatgacgcttggatatgaaaggggcaagtcttgtccacggctttcctcgcatggctaattacaaacatccacagatccaaaaacagatgcagcagtctgcagcagaaaaccagattattcttccagatacacaacaaaaacaatagtacatatagtaataaaaaatatgataagactcgctcatttattgattttaagggcaatgatgtttcagcaataaatttctttgagtctccaatttgtaggcattgacagcttgattgttagatgatatgtacaaaggaatatctaaatgtgcacaacacctttctaccctaacaacatatagagaacagttgatttattatgcactagtataaattccaaacagggcatggaagtcttcactcaagcctgcttcctcttttgaagatgaggtgagtttctaaaaaatgaaatagctcagaaaaattaagttgtttaattaatcaatgacatacctaacaaaagtagcttgatctcacatcaggatcaccgtagcacgtactccgtagtaactataatattgttgaccgaaagtgaaaataaaagttaaggatgtgttgggtatgactttagaacttggatgcaaattgtgtgaagtgaaacttatgcactagtggagggagcacgattatttgaggagaaatgaagaaacggcagcactagctgaatgagcaaaaatccactccatgagaggagaagataataaaaaggggagagtagagttggagggagaagaaatcacgtgtggctggaatgaagggcggaggcggagtgggatccccgggcagggcagcgtaacgaaggaagcaggagaagaggcggctggacctcacctagctatatataggacgacggcagatccacacaggtgcccgctggtggtggaggcgccggcgccggggaaggcgaacgaggtgggatgcgggaggctgcgagcgatggagaatagtagtgggcttccccttcgaggccggcctttttaattaggcctgaatgggtttcaggcccattaacctactgcccggcctaatatgaatcggaaggggattttattttattttgttgccctcagccgcggaggaaaggggtttagcagtagcagtagaagaagaagaaccttgattgaaatccctaaccccaaccaacctactggaggaggagtactggagtagagagcgagcatggcgagctcccgcgccgccaagcgccccaaggtggatccctcttcctcctcctccgcgccgccgccgccgcccccgcccccgcagcgtggggacgacgactacgtgccgggcaacatcgtggagatcgagctctgcaacttcatgacctacgaccacctcacctgccgccccggtccccgcctcaacctcgtcgtcggccccaacggctccggcaagagctccctcgtctgcgccatcgccctcgccctcgccgccgaccccgccgtactctctcttctcctctcctctcctctcctctcctgtacgattgattccatgctactctaatactacataccaatgcactgcagattctcgggagggcatccagcgtcgctgccttcgtcaagaggggagaggactccggccatgtcaagatttccctccgcggcaatacacccgaccacaagctctgcatcactaggaaggtcgataccaacaacaagtctgagtggcagctcgatggtacatgctctccttactcctcattacacaaaccgatgcttatttctttcactatcctttttattcagcaaatggattggatttgaggcgatgattcctgcatcactaacatttgtttcctgcaggcaccactgtccccaaaaaggaagtcattgatctcatcaagaaattcaatattcaagtcaacaacttgacccaggtgcacctccagtccattttagattcagctcttttacatgatccattccttatcattttcctttgcatgccatgatattgtaatccagaggagccactcacttacccttttatcgtgaatctattcctgatttctgttgcttttgtgctcaactctgttcagtttcttcctcaagaccgagtatgtgaatttgcgaagttgacacctatccaattactggaagagactgaaaaggctgttggagatcctaatctacctatccagcaccgtcagcttatagacaggagtaaggaattgaagattcttcaagtggtaaagctgaatcattcactattcactctttccttatgcttgcttggaccagtgaaagctattcccatttccttgcatatcttgtttagatgtcaaccctatggtatcgattcacgataaatttatctcgtttgttaggctgtaaagcaaaaggagcagactttgaataatctaaaggccctcaatgctgaactagaaaaagatgttgaacgtgtccggcagagagacagacttctgaaaaaggtttgcagtttcatttttttggtttggtaaattcccccttttgggttatgacatgaagggcataaaaagtattttagtgataattataacatcttgttggttttgtcttaggctgaattaatgaagaagaagctcccatggctaaaatatgacatgaagaagaaagaatacaaagaagcacaggagaaggagaaaactgagaagaaaaaaatggaggaagtggcaaaaatctgggaagattctaaaggccctgtcgagtatgtttcatgctcaactggcttcaatttttcattcatttataaactcatctctagaggtatctttgaactacgtgggctaggcatttgttctgatgttcttcgttatgaagatttcctttcaaagcccttcaatctgaatggatacattcacgtacagccaagaggacagttctattaacttccaaccttgattcagtagtacttctatgttttgattgacacacacttccctttaatttttcatatcaatttcctttttgtacttgagtaacactaattaaaacaagctagaacttgatttatacagaatatgttatcactatcacggttaatatgtaagcattttgtgaatccgatcacttcatataaaatgacaggattccttggtcatgcttgcaaccacatgctagtataagtttaactttatgttcctcatctccccttaacttttttcatattcaagtaacttgtgtaatcatattgtttggattcaacacaaatcgaatcccctctatttaatcattgtacattatcacattgtcaccttaaatgtaaaagggaaaaaagaagaagga

SEQ ID NO: 55244 - DNA, 4692 bp, Oryza sativa
  unsure (1)..(4692): unsure at all n locations
atcatcacatttgtgcttgcataaattttatttaaattctctcaggatttacttattgaagctgttgctctcaaatggagttgcacacaaaagaacatggcttccattgagctcgatacaaaggtatgctttgtgagaaactagttactttcataacacaaaacttcttgaattgaactgtgcatatttcttgcattttgattaccttgcagtgacccaattaatctccgcttggaaactttgcaattaatcacccaattaatcacagctgttttacaaatgtttggctgcttgcaataagatatataaattactaaaatactagtttggtctaaagcacacataatttgcacatgttacaccagaaaattgccatatttgcttatgtcttatcccgttccttgtaccgaaacaattcgcacatgtaatcatctgtccttcattaatcatctgatagatatgggagatggaaaaggatgtgaagaaacttgaaaagaatgctattgaagctgctaaagaatatgaaaactgtgagttgatgtttcaatccattcttttgttgtttctaaccactcagtttggcaaatattttggaaagtggcttagggtccaaggcaattttttctttgagtttttgcctttgggttgacaaatcttatgctcactttcatgtcatgctcattcctcaggtctgtttggtttgtagaggtgaagactattcaaaatccatcatgcatctcctgagtagatttttttttgaagtatagctatatcagaaccatgtgagttcttnngctgatnnnttttgnanactgggnnattaattaattncctttaaaaaattttaaattttttccctaaacaacgttagactttagtcccaggcaagtcatgggtattctaacatgtcgtaagttaacaactactctactaaaaaagtgtatttttattttctgaggtgttctaagaatctgttaagtattgactgacaaagttgaacagatgctctcttgggcttttgagttttgaataaagacaactatgttttgagactggtactataaatggtcaactgcggttgaatgtgcctggcaagcttataaaggcctttgtaggaaatttcatttctgtaatgattgagagtagtgtagcatatggcaagttggcaatacattactttcgtgattgattccatttgtctcatgctggcactatcacatgacatatgttcctctaatcaggtaaaagaaaaactcaagagcataagcagcagttgtctaatgcaaaacagcatgcagagtcaatagctatgatcaccgaagaccttgcaaaaaagtttcttgaggtactgtttgaatttaattttgtacttttcttgtcttatttgtgaatcagcattcacatattttagttgagttagcataccaactgtaaaatctccctaatctgcaaccactagatccttttataaaattatttttttaatgataaatttatcacaaaaccttagttaccagatttgcagcatagtttgtcaaacccaaaatcagatcacatgatttggggtttaccagcgatctacctgcacgtaccgtgaaagtcaagcaggaactcaatcaggatgagcttaacgatgttgctgggctgagccagtcaactacaagctcctttacctttaccttttctttttaatataaggccacggttcgatattcaatgaaactttgtggcattgtttgggttatgaacctcagattggattcataaataggagaggtacatccctcttgctaaatcctaggtttgtcaagtgatgaattgcgcaggcagggacacgtaccaggaaccaacagatcatgattctggcaactacagtagcaacaacttgatgttcaaacaaccacgaatggctgaattctgtctgaagcacctatgctctagggtgttagtttcttctcataagaattaactcttctgattttagctcatttagttgttggaatgctccataaggccacagtaaaagatcctcactgcttgtttggttgtttaggatttatgatgtccctctaattatctgctgtttacaactggatttcttatgttgttttctctattacttccagttttcctttttattattatgtgaataatttgagatgcattgccatttactttggccaaaaaaaccacatgtattatcagcatatgctggcacttagcacccacgatcctgcttccactgtttctgtttgcagatgcctactaccatagaagaactggattgtgcaattcaagatactgaatccgaagcaaattctatgctttttcttaatcaaaatgttttgttggagtatcaaagccggcagcgtgaggtacaatggattaataagtgtacctcttttttatttcatactttctttacttccagtgttgcaatatgcataagttgttcagcatcagtttgtctcatcaggaatagcacctagccacccagcaggttttgtattttcagaataggactgggtggtgccttcatagcagttagttgagagacccttattttctcctaatactgctgcagagttgcttctaaacaaaacagaaataagctagagtctgaggtttcatgttggtattattaaagggactatttcctgaagagtattaaaaattttgaattccccatagtgatctccttcaggattcccatgtgggaatatttttccttacagacagaatattgcactatatgctgaaattttgacaaaatgacttttagaaaactaatttaaaaaataaacgtggcaaaaactaattgagaaaatgaacctttgactccgcgccagcctcgacggcgctgagctcttgtccaaggtgccccaggtttgctgactcatcagagctcagctccaagcagcctagcatgttggtggaggtcgtcagctataaacagtgtgcagggttcgatttcgattatcccctccctccacaccttttttttgttttctcttactttcctaattttctttttagtatacttctttttgcttgatttgaaatatttgtttacaaaatgtttgctcaaatagacagaggcgtacatccacatccaatagccagtatttccacatgtaaaatggcctcaagagctcgttgctcgcattcaccatgttcctgttactcgctagcctgctatctcccgtgaaaggcattgatctgttgacctcgccggtttatcctgaccctgccaaggattcgaccaaaatcaactccaatggtgatggtcagtagtaagcacatcgccagatatatacacatacacattatgtttttgtgttctttctcagataatagaacaacttatagttctttcatatattttttcaaattcaaaataaataaatttacaaattaaacatgtcatttatgaaaagaatattagatcaaaataaataaatttgcaaataaaacatgccatttcttaaaagaatatgagtattgtggtggaggaatggaggatcgaactcaacaccacctggtaggctggcacacagctgatgtcctcccccaccatgctaggctagctttgctgatgacgttggtgctgaggcaaaggttcatttttgcaattagtttttaccaaggtttattcttcaaataagttttctaaaagggtcattttgtcaaaatttcggccaccatatgagtgcagagaagatacttcattcagtttttcttttcttatatatttgtcattatactatatgttaataaggtagtatagcagataaaggagatcggagcgttggactatttaagaatgctgcttttgcaacacagtatatttctcatgttgctggttttgttacccataaatctacgggaaatactcgatgtttcacatgtgctatgaaaatgtttctattagaacttaatggcatttcatcataatataatcatgtgatatgttgttttagatttaattgcaacagtaatcggatcgtagatttgttaagtaatttaaaagaaagaaaaacatttgaagcttgcaaatagagcttcatgcgtgcatgcaaaagaggttggcctactgtacaaagagagaaatgtagagcgggtacattgcaaaaaatgacttagaggcttgcatatgcagctgcagcacgcagaaagtgtgagagggaggcaacatgcagcagctgccagatggggatagcacctgattttttgtgttttactgggcgcccaatgcctagtcccgtcctaaatctactactacactgattactttgacagtgacaatacctattttaactgtgtagatagaatcaatatccataaagctggaagatgataaaggagaatgtgaaagatgctactctgatatagaggctacaaaggtctggacattttcatattgtcagctatattaccatactttgtccaaatcttttttggcatcctgcctcacttgacttgactttggcaatatcctagggcaaatggcttccaactctgcgcactcttgtttcaaaaataaacagcacgtttagtcgtaactttcaagaaatggctgttgctggagaagtttcacttggtatgtgtggcagttccttctttgcgttatcacactgttatttgtactattttcagatggcataccaatctgtaccaaatttcctgcagatg

SEQ ID NO: 55245 - DNA, 2107 bp, Oryza sativa
atgtcaaactttgactaagtttataaaaaaaacgtagcaacatctacaacagcaaattggtttcattaaatccaccaccgaatatacttttgtaatatatttgttttgtgtcagaaacgtagatacatttttctatgaacttggtcaaactttgacaaacttaaaacatattacaatatggaaccgagggagcatttaacatctactcaagattagaatggcgttaccgattattttatcattaaaggtgctatttggatggtcctgtaacccgtcttttgttgcctgtttctagccatgttcatcccgcagtgtttaattccatagttcagcctgcttctactgtagcctgtagtttaagggtttccacaaggtttctgttggccttattttgtggtttttaatcaaattgtggcattattttcctcaggcaaacaggtcagttgcaggtgttgagcgctcatcaccaatctggaggggtatgaaaaaaactattagatgcattctagaaaaatatgccttatacttactattattttttgctcctttataggagcgatcagtttcaaccatcctgtaccttgtatcacttcaagatcttaccaactgcccctttcgggtcgttgatgagataaatcaaggcaagccaaccctcacaagtttttgttccctatgcactcaatgctgttataaaatgattactagtttgttgaagcattacaaaggtaactgtttccccgaaattgcaggaatggatcccataaacgagaggaagatgttccagcagcttgtgagagcagccagtcagccaaacactccacagtttgtgacagtactcttagcatttcaggaggcattttcagatagcatctaccaactcccatgtttcttaatctggctataggtgcttcctcctgacgcccaagttgctgcctgatttggaatatagtgatgcatgcagcatcctaaatatcatgaatggcccatggattgagaagccagctaaaggtaatatgtgttctgtacttaggccctgtttagatcccacactaaaatttttcaccctgtcacatcgaacgtttgaacacctgcatgaagtattaaatataggctaaaaatatgactaattgcacagattgcgactaatttgcgagacaaatcttttaagcctaattgatccatgatttaacaatgtggtgctacagtaaacatttaccaatgacggattaattaggcttaataaattcgtcttgcggtttactgacggattttgtaattagttttttgtttgtgcccaaacacctcatgcgatatcttatataatacctgatatgacacgtcaaaactttacactcctggatctaaacatccccttagacattttagcatattctcggtctcaatccatatttgatgcatgctttgcagcctggagcaccggtgattgctggagaacagtaatgagcgtgagtgggcactgatggtcaaatacggatttgagtactgcacttcgcaagcgattcttcaaaagtcaatcgttttacgcggaagcttcagggtattcaatgtgatctttgcttgtaccccatgtagataaattaagtccaaaaaccagaagctccaatgtgctggactgctagccagctgccttttgtgctttgtttattgcagtggtggtttaaacagctactggctgacccttcggcatgtcgttaactcagggacttcataggacaaagtggcgctaaaatcgtgacatgttcccaaccaggttttatcgtttgatgaaggccggttccaatcgcaaaatatatctacttgaattgtcgagggggataacaccgactgacattttcattgccctaattcaaccctacatcatgtccatgttagttgtgaacgccttgttctgcactctgaatctcctggtgaacgatcagttgtacaactgagccgatgcgaatgaggcaggtcttctacaaatgacatctcggacactagcgagtatatgtggtcttctacaaatgacaactcgaacactagcgagtatgtacaaacttgagacgggtctggatggttattatgcgattgagattattcgtacact

SEQ ID NO: 55246 - DNA, 1827 bp, Oryza sativa
ctggaccattttctttgacaacatatctcccatacatgggtcccttagcaacaatactatcaacccgtatcacggtgttttcatttactctgagtcctaccttacccaaggcagttcttctctcacttccttaaaaaaacaaacccttttccttcgcacaaaaccaactaccctttcccataaaaaaaataactatctttccttcacttcgagaaaccctacctccccgagaaggtagtctccctcaataaaacactagaaattttgctaccaaaaaaagaatggtatattgttgccttgtatgcgaaggaagccttgactttggtaccgagttgcccccggtccaacaatgagattggggggttactgtcgaagaagtaggaaccgagattcccacccctgactgctcaggacatcaaaggtctgcagaataggccccgtggcgccacatcccgccaagcacaagcaagaccaagacctcagtctcttagttcagcaggccatgccctaagcatgaggggtaaacccaaagcaagcctcgagctcggccttttgctggctgctcggggcccctggcacaccataactacgattcaacctgatgttaacaacggaattttgcatcaaattcggagaagaagaaacaagatcgaagcggatttggtgtggaatcgagttaattaccaattcggactacgcatcggctgagtatcgtatcggctagaaacaagacagaggcttgacttggccgacatagcaagtagccaatacgatacaacttggggcctggtttgggtttgttttcgaataaccatcattgccaattagagatagagctcgaataaggcaattgtatatattaattaggatatttaagttgatttgagagatttggcaagagactgccatgaggtcttatttgtatcttatctttaggaaagtttgagtcatgtccctaatggactaagtttttattcagggtataaatatgaaccccagaccattgtaatcggggagacaatctaatacaacttcagcgcatcgccaccctttttgttcttcttttcgatgagttatctcgacaagaggtaatccgtcttgatggcttgtgctatcggtgctattatgtcggtttagatgttctagtccttttaccataaccatatgctattatatgtcttaattaatctagtcttagtatctcaatttagccctatcggctggttctcgtttcagggttcctgtcggtataagcttaattgccttactatattagattaactaaggcatccaccatcttgaaaagtgattaatttcttgattgtttagactttagatttctttacttactcagagatgcatcatccctagtcttgtctagaaccctagaaactaatatggaattaagcataattagagatagtatcggagtttcagccgatcttacttaatatacatgctattttgctagttttatgtatatttcccccttatatagagagatcaccttatataaatatattaagtctaggtcaatatcagctgagttgccaaatttggtagatgatcgttatttgatatgtttctatagattggtttgtctatataagtttttactagagtactagctagtatattatctttatttatctatcttgctctaaatattgttccatcggctacttctataatatcatctgacgtaaacttgacaaaataattagatgatattacagccgatgaggcatttttatggtttgcacgtaatttatatatcaatgcattaccgatctggtctaactatatcggctgggatcactaacgata

SEQ ID NO: 55247 - DNA, 5712 bp, Oryza sativa
  unsure (1)..(5712): unsure at all n locations
cattacaatgaccccgggtgtacatatttatacccatggggagttactagttcttgtagaacaagaaagaaactttcctaaagataaatggaaaacataaagtccttataggacactaaacacacatccctaaagataaaaggaaactaacaaactattcctaattaatatataactcgtcatgccgcatcctccttgaacttggtcacttctggataagttttctttagtagattaatttccttaaccgaatatagtaagaatccgacaactagagacttgataactctcatcggccgatcccaggactctgaagccgacactgactttagaccgatggtgacttcgggcttaccaaattttaacaggtccctcactattatagctcgagcttcgacatttgcttacaataccggcatggacaatcccccacgcctcccccctaaccccctcttgctgaaaagtcaagtgtcgtgatttcaaaacgagcacttatggcctttccgaattggcgttgatgacgtttttctgtgcaatggtagatattagatttttcttacataaaaagtaaaacttttggcctttttgtcgattaagaatacacataattacatgtatgaacttcaggatttaaatcctgatgggaaaattatgcacccatggattaatccaccacataaacgttctttatcatacacagatattactactgacctataagctacttaatttcatcgatgccaatatattcatgggtgcaagttgatcgatgcaagtataattaaaaagaacacttttgagttttgactaataccctagctaagtagctagcatatgaatggccaagtcagaatcgtcatcgaatctgctagtatttgacatcactaagacactaaccactccgatatgaaagatagtactagtatactagtactagatacatgtacaatcgagttggcaaggccccagtggataaagaattaatgcatgccgcgcagcattttttcttgatgaatggacatatttataattaattagttaaactagatcatgcgcatgttcggttgtggctgctgcctgcttgataaaataagcaaataaatatactagtgctatgaatctacatatatttctatctaaatttatagtagtatatgtctaatccagccatttgattgttatattttaaaacggaagaagtaatggttggtcaatgatccccctctctctctctaattaattcattgggaataaactccgctggggaataaactccccatcaaatatatatatatagagagagagatatactatatgtagtattgtttctttccatctgctggagaaggcttctctcagccagccgagcggtggtagcacgtgtactagctctgtgtgtgcgttctttgtggataacaaagagggagaataatggaaagggttttattttttgaaacgaataataatagaaaggataagatagaaggagaaatgaaggagtgatccagtattgatggcggataccgttgtccgtcactcgccgaacggctggtatcccggtaattaattagcacttcgccacttccatatataaataaaatcctagaccttcggttttggtgacttgtctctgtctagagtttgcggtgaaaaacacattatacttctttttagataatggaggcaatcaaatcaaattatatagacatggtttcaatttttatgggcagagttgagagtccacgacacaggggtgatctcataaagtagtcctcggagcagttgcgatagctagctaatcgatcactacgtactagcaactactcatcaagccagtttaattagttcactttgttcttcagtttaatactccctccgtattttaatgtatgacgctgttggcttttgataaacgtttgacctttcgtcttattcaaaaaatttatgtaattataatttattttattgtgacttaatttatcatcaaattttctttaagcatgacataaatatttttacatttgcacaaaaattttaaataaaacgagtggtcaaacgttagtcaaaaattcaacggcgtcatacattatacggagggagtaataactatcattcatgtttattctctctcatgtactctccgatcgcgctctgctgacctagctagataaaacagaaatatatgcattgcatacatatatatactcctataagcaagaggttgatattatgcatacatatatgtattatatatagtttgcatgcatatgcttatttgccgttatgaatcccgtaggtagtcgtagtagcagaaaaaggaggatattcgtcatgaaagatgtgtctgccgtcccagaagttgagtttgacctgatcatcaccagcctgcggtcagaaaatctaacggccacatacgtatacgtatatagattcatcaacaaaatatgcaaaccggcccgatcatcttgagcaagttgacagttgctaatgtgatggctcatatacatatagtttaatttatctagaagaactgacaccgaatttaaactaaacaagagaaaatagaattgataattatttcctgcggtacgttttgacctacttaaagtttgagcaaatttcagaatacccccacatttatgatctaagtcgtagaaaaccaaaggtttaagacgtgtggcacataaccacatgtttttaccccacctttattcaaatcttgattaatttcagcatatattaaacaattttttagtagtgaagatttaaactaagtcaagaacttaataattatttctcaaaaaaagaacttaatatttaaaaatttcattaacattttaagtaaatccgcgttcaacatgcataagtgtgaggttttgtaaaactttagaacatatatatgaaaagtataggacaaataatacaacgcaaaaataacaccattaatttttactgatgatccgcttgtattatttccgtgcactacattagcagacaaagtacgtcatgcatacgaagcaactaccaataattgtgagaaaagaaaacagagacaatgggtatctaatattttttttagaggtaaaccatgatctgagtagtattatatttccatgttgggtggttaattcaatggttgcagctagcattcgctgcatttggcctgcctctgagtgacatcgcaacgcctttaaactaactgcagataagggagaagggagacatgtcatacacctactacatatatatcgtaataatgttatttttcacaaatatatcagagtaaaataaaaagggtcaaaatcacgttaacaaagacagctagcatatactaataagcgatcgaggaaacataggctgtggatactatatgatcaccagcaagtcactacaattaatgttaggaaatcagattgggaggtgttaaaatgttagcactgatcatcttgataaaaagaaaagggtattaggaattaatgtgtttttggaacacgtatgattttttcattcctaaaatattgtacaaaaattatgcagaattaattcatgtgttggagaccaccttacctatgtttgttcttaaaaataatctcggtagcaaataattaatggacaaaaggagtagcaggtttggtcagtacctctcctaagctatgctatgtactacggtacctgactccaccccaccaggccagcatgataatagtattggacagacagggaataatggtacaacaaaacaaaacaaaacaaaacaaagacactgaccaatgggacccacagcgcgggttttgactttttgtttgatttgaagttagaatagatgagatagacgactagacaagggaattggaatgggacgccggcggcgagtcaaccaccggggcagcctcgtcgtggcggctctcgcggccggcgaaccagcgcgctgtacgacgagcgatggggacccagcggtcctcgtgcgccaggcgctccctcatcgccgcccgcagcctcggcaggctcaccatctccgacatggaccgcactgatcccgacgacgacgacgatgatatcatcctcgccctcgccgccgcgtcgactgatgacctgccgccgcttgccgccagcagtgtcttccgctgatgatcatgatctgtctcctcctcctccgtctccttgtacagctccatctccatctccacctccatcgtctccatggaccgaagcagctccgtgtcgagcgcgatgaggtcggaggagttgatctcgctccatcggctcttgaacaccgcgtccgacaccacgatgcggtgcttgtagcggtccagatcagggcagtgtgccgctgccgctggctccatccgcgacgacggaacgcgctcgacgaagatgcccaggaggtcttggtcgccgtcaaagcgctcggactcggacgcccccccggccgggacgaagcgtgcgctggaggcgtacttgaggccgagcgcggcatcttcggcgtcgacgcgcgcgcggcagagagggcagctggccttggactcgagccagcggtcgacgcagtcgaggtggaaggcgtggcggcagcgcgggaggaggcggagcaggtccgcgtcgtcgaagcgcgccaggcacaccgcgcactccagcccctgcctggccccgcggagagccgcgaatcggaagaaaggcagagactcgatcaccggcttggcgacgccgtcgtccgccgccgccgccgggacgaccgtgggggcgggggcggcgacgggggaggatggatggcagaatttggcgtacatgaggagaaggaaggtgagcgagaagatcatggtgaagannnnnnnnnnnnnnnnnnnnctggggcggaacgacaccttgatgcctacgccgggcgtctccggggcggcctcggcggtggccggctgcgctgctgcgacgcaagcagcggcggagaggagggcggcgacgagggggaggcgtgtcgttgtcgacatggacaccgcacccatcgcccggattcctctcttcagtttcttcttcttctcttttctttttcagttcagacgctgctgcctgtagtgtactcagtctgtctgtctgtacatgtagtgtgtgactgacctcctctaccttctcttaatttgtttagagtattctttattataactactcctactaatccagtgtcaactaatgtagtgtcctgtgcagtgggccccagcagatgacgtccttctctacttaatcccccatctctatctatctcgatactattctttctttctttctttcggtgtttctttctgttgtgctatatacgcctgcgtctgcgcttgcaaaaaagttttgtttctgtcctgctaacctcttcctcctcgcctcattctcttcttgttattaaattctccagcgcaacatcattttcatctgcccacttccggtggcaacaaaactacgtccatttgcttcgtcgatggatgggattgtactataactgtcatttccttcacagataagggcgttctaagtttgggccaggactaagcccatcccgctgcatattgggtccaaaggaatacttgtaaggtaaaaataggtataagtccacctaagatcctaatcttgatgtcgagtttaaatcgctcccttaaaacgcaatattcaaatataagacgttagacgtccctcaccttgcattaccaaactacgtaagatccttgtctggtt

SEQ ID NO: 55248 - DNA, 1908 bp, Oryza sativa
tgatatattatatgtataaataagatatatctacaaccggactccctatatactctctccgtctcataatataagggattttgagtttttgcttgtactatttgaccactcgtcttattcaaaaagttttggaattattatttatttttttggtgacttactatattatccaaatccaaagtactttaagcacaactttttattttttatatttacataatttttttaataaaataatacaaacaaaaactcaaatctcttatattatgagacgggacgggaggagtagatggtaacctcgcacgaatccgcaaaaagatggattaaattctgttgccaaaatatttctccactacacagaacggttgcacccaagccgactgctctcaattgcatccaaacaggccggcccctgcatgcagttcgacacaacctgaccacatcctgcacacgttgcagaaatttgtcttccacgttgctgctctcactcaaaaaacctgacaatacaactcacacgttattagtttaacagccctgctacacagcttttttttttaataatgtattaagaaacccgacctctacatccatgataaaatgtacacagccaacacagcttgaatttgcctggttatagtagaccttgtggttatgtttgtttggcctcttcactcagcagggcttctcttcatcctgcctctttgttgactgataaacctgtagtgtagtgcatactccatactagatgtgaggcttcaatctggtcggtcagaccgaactatcgtaactttggtggtaataacaacttgggtttcctaatcctgtttctgaagagagaccgaagttttttttggaggatttttatgctacactatactacaaaagtatatacttatagtataaattaaggtgtagattcatccaatcttcctttcgattagttttgcagtataaatcgaaaagaatatatttgtcttttcatctttttgcgtgagggtatttttgtattttcgcgtttcagaacctgctcgagagagtggctcagatgaaatcagcttgagagaaatccgttccctttccttcgtcccatgcgctaacgccgctgtggacagccaccgcaccgcgtccctggctcgccgccgatatccaccgcgagcaagcgccggcccgccccgcaccaaacgaacagacaagaaattccagcacatgtactactcgtctatccgtccatgatatatgcatgccagagtcctaatctcttgcccgtctcgtcgtcgataggtcggcatgttcgctagctacatactcggtccgtaaaaaaaacgctagcacaaatggacgacgagatacagaacaattactcctgaatcctgatgaaaataaatctcaacttcaaatgatttagcagccctttacatgttttaaaagaaatacctactagtataatgtcgagtcgcctataaatcagacgctcgattttttttttcaaaaatcggttgctgttacaccaggtagattgagcatgtttcaccaggtagatcgaaaatgtttcagtcttttaaaaagctaaaacacaatcaaatcaactcatgaaacattttgctacaacgtatgaaacaaacggttatccaaaaaattagatgttgtttcatgttggtatttcttaacgacattactagaaatattcattcctagcaatggtgccagaaatagtcctggtatatttatggttacaaaattaatccgcaagcgtacagatgtaccattgtagcatttcacccgaaagtattctaaggtatcgtatttttaatcccaaagaaagataataagagcgaactttactaatgcacttgatacatatattacttataattgtcaaagcctaaacaggggttagactataacata

SEQ ID NO: 55249 - DNA, 10807 bp, Oryza sativa
tagagccataccgaaaactattccgaagactccgaggacttccgaacactattctatactactccacttagcactatactactaatactaatgtatgaaaagaaattgagcttgcttgagtgtgttgagaagtgaagtgagctcctccttttatagggccggtatgacggttacttcatgcgaaatgttcattttaccctcgtaaccgtcatcagcaatgcatcctagacatccatgtgtaaggggggagggggcgagccgacttgcccctggttcggctgaaccagggtcggctccaaccgacctccccttcagtacaatggctgacaggtgggtcccatttgacagttaaggtggtttccggacgtctacatctgacatgtgggcccccttatccaattgcttgcttaggagtgaggttttctccactttctctttattttatttgataaattcctgtaacatgttattctccaagtacaagtggaagtatattatttgcaaataagcatgcattgtaagcatggctagttcttcattttttttagttatattgacggtcgaaatttgtctgtaacgactgtcaatatttcaatctatataaaaacaatgtttcagcaaatagcaaaataatgtttcaattcactgctatatttgatctatacatagtgaaacatcatgagtacactagctgaaacattgttggtggaacaaaaaatgaaatagattccttaatagagcgtttccggaatatgtgagtgatttgttgcaacggccacagatggtggggtgcttggtgggggaggcacgcgagcgtgcgaggcacggcgggagcacaggaggcgcgggcgtccgattttctcttccgcgatcaggcgcccggcacgtgggattttccgtataatgtaccttaaaaattctcttttttagaccggaccgaaccacctttctggcctcctactccactaggggtgcgtttggttcccggttaaggttggatgagatatggcgatccatattttgctagatatggcgatacagttttttgtttggtggagtgaatatgacgatccagttttttgtttggttgtagggatgaaagtggatatggcgatccattttttttgtttggttgggggagtgggatggataagtggttgcaatcaccctttcattagagatggtaagtttacccctccaaattctccagacccaaaataatatcagtctactaaaaaaatataaatagaaataaaaacggaaatgctacttatcggtattccgtcccaaagggacaaccaaatcaaaaaaattgtaaccatgccattataattttggttttagctgtgaaccgcttctcatctatctcatttaagacaccggtgttgttgggattttttttacttcagacaaaactaaggcaggcttgggaaagaaacacaaggctggcatggggggaggaatcggcgaatcttgcggcggcgaagacaacgctagcgacggcgtcggtggtcattttttcttcccacaatactgcattccaggttcttctcgttctcattcctcgtttcgtcccctttattccctcgaatctagatcccaaatgctccccatctgttctagggttcgtgcgcatggtggctatttattcaggggctgttattccgatcagtgataaccgatagcaactgggattgtctttgattttctagggtttagagttagtggagaagaaaaatagttaactccttggtaatgagatatgttggggcttttttttccggaggctgattttggcaggattagggagagagaggggggcacttttaatatcatctgataccttgcaagtatcacctaacatgtggtaggaatcgcctgatacctaacaggtttcaccttatactacttcgcaagtatcaccggatatgtggtaggaatcgcctgatacctgacaggtttcacttgatacttcacaagtatcacctgatacgtggtaggaatcgcctgatacctgacagatttcacgtgatacttcgcaagtatcaccagatacatggtaggaatcgcctgatagctgacaggttttaccggatatttcgcaagtatcacctaatatatggtaggaatcgcctgataccagacatgattcacctgatacatggtaggaatcgcctgatacctataaggtatcacctgatacctcgcaagtatcacatgatacatggtaggaatcgcctgataccttataggtatcacctgatacctcgcaaatatcgcctgataccggttaggtatcaggttgtcatgccctgaagtttcccccttttccttgctttaaaaatttgttaagtaaatcgtccgaacaaattgttctaattaacctagagttgaatccctaattaataaatgcaattaataattggaaatggcattgtgggatttttcttggtttccgcatgtcacaatacattaacagaggatttttagtggaattttcagagccttggaaagaattttaaccaattaaaaatcaccaaagtgcaatatttaatcccaggaaaatccttttcctctttttcttttcttttccttcctttttctctagatgggccgtcggcccatctctctccccgcgctcagtgccccttcctgggccagcccgctcctcctttcccctccccgaagtcctccctccctccctttctctttcgggcgccgataggtggggcccacctgtcggggtcgtcccctacctctagccgcccacgccccggcgccaaccaccgccgaaaccgccgctccccacgccgcccaccttccccgcctcctgcgcctcaatcgcgccctgcgcccacgtcgctgcccctcccccacctcttcccgctctcgcgcccgcccaaaaatggacgggattcgcattcgaatccacctctctctctctctccctccactccccacatcgtcagccaaataggggccatccccggccgtttccgcccctccctcgcccataaaaacgctcccccaaacctcctctcccatttccctcattcaccgcgctctcccgtgcctcctatcgcgctcgcgccgctcgctgctagcgccgccgctagccgccgcctttggttgcgcgccgccgctgatagagttgccgccgcgccaacccgccaccgccgttagcttcgccgccacaagagctttcccggccaccgcctcacgttgccggaatcccaccggagcgcctctcccctcgcgagccggtgagtttttccctcccctccatctccggccggcaattcaagccgctgtggtcgtcgtctcctctcctaacgcctctccatcttctcctagggtgtcgccgccgcccgtccgtgcctccgcatcaccggtcatcgccgccgtcttcatccttcgcgccggctgccgtgctcacggtgaggagctcctctccttcctccttccctctgtccggcactgggtattattgcgcaataaattgattaaggacttttctttattagtaaaaacacagtttatcttctaaaattcataagtaattcatccaagctccgtttaagtccattcaagtctcagtaaattcataaaaattcaaggaatccattaaaaatggttttgtttcctgtttcagtagtcctatagcatgttttgcttgtgtgctttgtttgtcgcgtagatttcggccgtttcgtcgatccgcggtttctcgaaaacgttgctgtggtctcatcagtgcgagagcaaggcaggtcatgcattacaattgatcatattgtacccaatttacaaatgtcccgcatttctattaaatgtcgcattcttttacaatgtcacgtgggatgggtcctattactcagccatttattgtttaccctatgccattgataacctgggtattaaaatgattagatgttggtttaggaaatgcttagccatgcttagctcaactagcacacaaatggggatcacattattacatagactttgactatgagcatagctttggattggtgccaccgcaatggtgttagctaattaaaatacactggacggtgggctgtgggtacatggttttgctggtcgcacccatggcagttaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagtggggaccgcccactgccttttgaggggtgggggtgaaaccttagcgtggtgtggatggttaggggagggttatgtggagggtcttgtcacgatttccccctttgcagtatcatggtgatatttcggggcatggtgacatgtgtggaatcgtgtcttgtgggtacagttgtacacctctgatcagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttactgctttcaactactgtttttaaatgcctgctttgtgcaaaagaacctttagcctccttcggttatatcctgcatcatacctcctcttccgatatgacttgctgagtacagtgggtagtactcagtcttgctctcttttccccataccagagctgaagatcttcctagtgggagctgtcttgtcgaagttggtttcgtcgctgccgtcaaggattgcctgtggagtggagtcgccccgctgcagaagtcaagtttccaagtctagctcgttttattttttccgctgcatttgtaatcttttctatttttgtaaaacatggatctgtatgtcaacaattgtcgtttgtgtaccctggctggtcctggacagggatttcatgcacattcagcttagaaattctggttcgtgaatttctgggcgtgacaagttggtatcagagccaggttgaccgtaggacaagccaactggaaaacctaagagctctctgaacccctttttcatctgcatatgcatttttgcacccggatttgtttcgggaaaatttggggttttgcctcgttggtttgtgggaaaaatcttggtcgttcattcggatcggatctttaaaattagctcagtctagggttttagtaaaattttatttggagtttattcgactgtcagtcgggaatctatcaggtgatatgcattaggtcgtatctatgttcgatggggcaattttatgcgcattattttctatgcatctattttatgcattaatttattggttagcctgttgcattagtatttttgtctaggttcatgaaaaatgttctatgcataaaaatcagccatgcttagttatttatttgagtcttttgttgctttgttcaatttggaatttagcatgaattggttcttatcccttgtctactttagatgtcagtcctatccctcgattgcaagcgccgctccgagcttcagagtcgccgcccttagctttatcgtcttcttagtttgttgtttgctagtttccgtgtttaggtctgctgcttgtgggttagtcggcggtcgatatcatgtgtcagtggtatggctgcctttattaggagttgcgtgcctcttttcagtgttttaatcaagattaagataattgcacttaaatttataagaaagattagtttctaagccctctatttttctctcttttctcatatttctacctatcccccttcagatggtgaagacaagaaatggttcccgtgactccaacaacgctagtggcagcgaagagcatatcagtggagcacgtgccagcgatgcatctgacaacagttcatctccaccgcccgagaacccaacgatcgctcaggtgttggacaatcagactcagatgatgtcaatgatgatgcaacagatgcaacaacagtaccatcaggtgttgcagcaggtgcagcagcaagtacaacagcagcagcagaacctgcagtttggtcttctacctcctcaatccaaactgttagaatttctccgtgtcaagccgcccactttctcaagcaccaccaacccaatcgaggccaacgactagctccatgctattgagaagaagctgaaccttttgcaatgcaatgaccaagagaagattgcttttgctacataccagctgcaaggtcccgcttctgtttggtgggacaactacgtggtgacccgtccagctgggacagaggttacctgggtagagttttgtcagagtttcaataaagcacaagttcccgagggaattgtggcacaaaagaagagagagttccgttccctgcaacaaggaaccagaacagttatagagtatttgcatgagttcaaccgcctcgcgcgctacgcccctgaggacgtgcgtaccgatgacgagaggcaggagaagtttatgtctggtcttgatgatgaattgactaactagttgatctctagagattatgaggactttgagaagccggtggataaggctatccgtcaggaggagcactgtaacaaaataaaccgtaagaggaaggcagctcagttcaggactccccaggggaagagtcagaagcctcgtttcacgatgggacgtcacggtggaccttccaccatgattatccggcagcaccgtccctaccacccgggtagcttcaacaagaaccaccatagtagcagtcacaacaacagtgagcagcacagcctcaaccctactccgagttcactaaagattccagcttaatcagttcagccagctctgccagaatagcccaagaggttgggagaaaaacccgaactctgcttcaattgttacaaacccggacacacggttggaaagtgcccgaagccaagacgtgctggacccaagttcgttcaggcccgtgtcaatcatgcatttgcagaggaggcgcagtcagcaccagaggttatattgggcacattccccgtcaactcgacaccggcagtaatattgtttgattttggtgcaacccattccttcatttccaagcgttttgctggtgcacatgggttctctttagtgaaacttaagataccaatgcgagttcatactcctagaggtggcatgaccacaactcactactgcccatctgtgacagttgaaattcaagggttgatttttccagccaacctcattcttctcgaatccaaggacctagatgtcatacttggaatggattggttgacaaggcacaaaggagtgattgattgcgccagccgcaccatcaagttgaccaatgcgaaaggagaagtggtaaccttccagtctccagtgccgcagaagccagggatcagtttaaaccaggctgctggtgaagaacaagaggtagcagtggagaaaaccactaagaagttggaggatattcccatagtcagagagtatccagaggtttttccggacgatctgacaacaatgccaccaaaaagggatatcgagttccggattgacttggtacctggaactacaccgattcacaagaggccttacagaatgggagccaacgagttggtggaagtcaagaagcaagttgatgaacagctacagaagagatacatccgcccgagcacgtcgccttggggtgctccggtcatttttgtggagaagaaggacaagaccaagaggatgtgtgtcgactaccgcgcactcaatgaggtcattgttaagaacaagtaccctttgccaaggattgatgatctgttcgatcagctgaaaggagctactgtgttctctaagatagacctacgatcaggctatcaccagttgaggatccgcgaagaggatattccaaagacagcattcatcactcggtacgggttgttcgaatgcacagttatgtctttcggactcactaatgcatctgccttcttcatgaatttgatgaacaaggtgtttatggaatttctagacaagtttgtcgtggttttcatcgatgacatacttatctactccaagttcgaggaagaacatgagcagcatcttcggttggtacttgaaaagttaaaagagcaccagctatatgccaagttcagcaagtgcgacttctggcttaaggaagttcagtttctcggtcacatcgtgaatgctcaaggagtagctgaggatccagcaaatgtggagtcgattaccaagtggaccccaccaagtttggagtttcttaggacttgcgggctattaccgccggttcattgagaacttctctaaaattgctaagccaatgacacagctattgaagaaggaagaaaagtttatctggtctgctgaatgcaataggagttttgaagaactcaaacaacggttggtatctgcaccagttttaattttgccagatcagacgaaagactttcaggtgtattgtgatgcatctcgtcaggggctaggatgtgtgttgatgcaagatggcaaagtggtttcttatgcttcacgacagttgcgtcctcatgaaggcaactacccgacccacgatctggaattggccgcagttgttcatgctttaaagatctggcggcactatctcatcggtaaccgttgtgaggtatatatagatcacaaaagtctaaagtacatcttcacccaacctgatctgaatctccgacagcgaagatggttggagctaattaaagattatgatatgagaatacactatcatcccggcaaggctaatgtggtagcagatgccttgagcaggaagagttactgcaacgtcgcataggtagaggaactatgttgtgaggttcaacgtgatttggaacatctgaaccttcgtatagttgagcacggattcgtggctgccctagaggcacaacccacactggtggagcaggttcgcatagctcaagcaagtgatcctgaaatagcagagctcaaaaagaacatgagagttggaaaagcccgaggttttgttgaggatgaacaaggaacaatctggatgggagaaagattgtgtgtacctaaaaacaaggagttaaaggacttgatactgactgaagctcatcaaactcagtattccattcatcctggcagtaccaaaatgtaccaagacctgaaagaaaaattctggtgggtaagcaagagaagggaaatagctgaattcgtcgcactttgtgatgtttgccagcgagtaaaggcagagcaccaaaggccagcaggattgctacagccacttcagattccagaatggaagtgggaagaaatcggaatggactttatcaccggtttgcccaggacgtcatcggggcatgattctatttgggtagtcgttgatcgactcactaaagtggctcacttcattccggtgcatactacctactcagggaaaaagttagcagagctttatttggcaagaatcatgagtctacatggtgtacctatgaagattgtgtctgatcgaggaagccaattcacctcaaagttctggcagaaattgcaagatgaattgggaacccatctgaacttcagcacagcctaccatccacaaactgatggccagaccgagcgagttaataaaatattagaggatatgttaagagcttgtgcgcttgactttggtggagcatgggacaaaagcttgccgtatgctaagttctcctacaacaacagttaccaggctagtctgcagatggcaccatttgaagcactgtatggacagaggtgtcgtactccgctcttctgggatcagacaggggaatgccagttgtttggtacagaagttttaaatgaggcagaagagaaagtcagagctgtcagggaaagattgagaatcgcgcaatctcgacagaaaagctatgcagacaaccgccgaagggagctcgttttccaagcaggggattatgtgtatctccgtgtcactccgctcaggggagtacaccgcttccaaaccaaaggaaagttggcaccacgctttgtgggaccatatcggattttggaacgcaggggtgaagttgcttaccagcttgagcttccctccaacatgcttggcatccataatgtgttccacgtctcccagttgaagaaatgtttgagagttcctgaggaacaagcaagtccggatcaaatcgaaatccaagaagacttgacgtatgtggagaagccgactcgtatcctcgaaaccagcgagagaaggaccagaaacaaagtaatcagattctgcaaggttcagtggagccacctctcaaaggaagaggccacttgggaaagagaagatgagttgaaggccgctcatccgcacctcttcgccagctcttcccaatctcggggtcgagattccgtttaaggggggtaggtttttcacgccctaaagtttcccccttttccttgctttaaaaatttgttaagtaaatcgtccggagaaattgttctaattaacctagagttgaatccctaattaataactgcaattattaattggaaatggcattgtgggatttttcttggtttccgcatgtcacaatacattaacaggatttttagtggaattttcagagccttggaaataattttaaccaattaaaaatcaccaaagtgcaatatttaatcccaggaaaatccttttcctctttttgttttcttttccttcctttttctctagatgggccgttggcccatctctctccccgcgctcggcgccccttcctgggccggcccg

SEQ ID NO: 55250 - DNA, 1887 bp, Oryza sativa
ctggtcctggacagggatttcatgtacattcagcttagaaattctggttcgtgaatttctggacgtgacacaggtcctaatacttgtgaggtatcatgtcctgatacctaaccagtatcatctcgtaccaactggattatgttgtatagcagctccaataaaaaagcagaacgaaattcttcgcctcgggcgaccggcgcgggggagcaaaatcgcccccccccccagcgcgacgtggatgcctcctgggccccaccatttgtcatgcctccacctaccacgtgtccttaccaaacatgtttcacctagtgtactcacaatgttcactatgtacagatctaatgttgcaatgaattgaaacattcttttgcaacaaatcacccacatattttgaaaaccctctattaaggaattcgttttaatttttgttccataaaaaatgtttcacctagtgtactcacaatgttttactacgtatagatccaatattgcagtgaacgaaacattcttttgcaacaaatcacccacatattttgaaaaccctctattgagggaattcgtttcattttttgttccaccaaaaatgtttcacctagtgtaatcagaatgtttcactatttatagatctaatattgcggtggattgaaacattcttttactattcgctgaaacattgtttttatataaggtgaaacaatgcccgatttaaacgattgaaatatttttgatctacttagtgaaataattccgatatacttggtggaacatagtgcaatatttaaaaataattcaataataagctaaaaaaattcgtcggaatatatccatgtgtggtcttgttttgaagctttaattttaacgaatttaatggtacaatcgaatcatgatttggataaataatttaagagaaaaattagtttaaagtggttttacacgcatccggtggcgctgacgtcttttttttttgcccgatcggtagtggatttggatcgtctgacttcaccctgtgaaggcacgggcgtgccgtcatcacttatccaccgtccatgcaatccaacagctcccgagcacagagacctatgtcagcccaacaagaagcacgttctccagactttaggggttgtttggcaggactcctctccaagaaaatagctccatctccaagttttttttgccaaacacgagtagtggagtagctccggctcttgaatcgcagctccatctccaggaatattctggagctcctcaaggggtactccaccaaaacctggagtcatatgtcctcatggagatggtaaaaaattacccaccattgccattggtcacaaaaaaaacgattcgcttctatttcactgtaccgccccgttcccgttcctcattcgtgaaaaaattgattccaccagagcgccgcccaagtctgcaggcagatcgccgccgccgccaaccctagagccgccgccgccgagatggccggatccgcctctgtccaagatggatccggcctagaggaggaagtcccggccgccgagatgaccatgggcgccggactggagcatggccatgggcgcggcttccctcctcccgcaaccggccaggggcgcggctgcccgcctcctgctgccggccagtggcgtggccaggggcgcggctgcccgcctcccgctgccggagccgccctgcgcccgcctcccgctgccggagcagccctggggcgcggctgcccgcctcccgctataggagccgtcctggggcacgacaaccctgccgcaggagcagccgtggggcgcagctgctcacccgccggggctgcactgtggcgcgggtcccagccgactggcgatgcccagcagcaagctcgtcccccgcgtactggagcaacgaaccagg

SEQ ID NO: 55251 - DNA, 7148 bp, Oryza sativa
tttgtggcatggcaaaaattaatgaggcagcaaactggaacaggatgggatcactcaagaggcgtgattgtaatggatgatgagtggtggagaaaggcaaaaaaggtgaattagctttatacctgccccttaattattaactagaattagcttgcttctaacacattgtttcatggttgaaattgaataggatattcctggatgcggcaagtttaggaagaaacccttgcagaatgtagatgaccttaacattatgttttctgacattattaatgatgcatccgatcattggaatcctatgagtgagaaccccatcatacctgagcacatgactgaggaggtccaggaagataatcttgtagttgatgatgaagaggtccaagagacccccatggaggaaatgaatgacgaggcccaggagtgccatgaggtttctccttccattggtattggaaagagaagatctcgggctgttcttgacaaaggcaagaaaccaaagatagggacagcacttgttattcaagaacaaatcaccaagattgctgagtcagcctcctctttcacatcaaaaaagtcaaatgaagtaaccgtgcaacaaatcatggatctagttttggattgtggggcagattatggtagtgatgagcattttattgctacagagttatttgtcaaaaaggaccaaagggacatgtttatgaccctaccaaataaagagtttaggtttaattggcttaggagaaagtacaatgccaagtatggagcatgatccatacttgctgttatgcaggccttcttgttatttcataatttctcccatttgaaatatttgtaatggatttggtgtaataatagtactgttagactcatgcttgtttgtctgattgaatggatttggatgaaggctaggaaaagaaatggcatctacagattgatgtcacttggatgaagtttttttttctgtgattgtgttaagttaattagtataatttaacaagtgctgtgatggcgtctacagatataatatatgttaagtttattttttatactatttgtaacaagtgctgtgatctaacaagtgttgttctctttttttttgcctgcaggtgactgacggtgaaagtgagagtgagtcaggggactctactgatggtgaccagttctggaaacttgttttaggtggtgcccaaatagctcaagtttatgctgatatataccttcacaaaaatccaccaaggacatcaattcttagtggcatgggatggttgctagagacattgcggactcctggtgaatgtcattcacagcttcgtatgaacacagatctttttttggacctaaatgatttgttggtgcaaaggtatggactcgaaccatccctgcatatgagtactcatgagatgcttgcaatgtttctgtttacatgtggtggaaatgagtccaataggagagctcaaaataggttcaaacattctggtgaaaccattagtagaaaatttgatgaggttttaaattctttgatggccatggcaaaagattacattcgaccaaaagatcccaattttcgttcggttcataagaggataagagatgatagaagagcttttccccatttcaaaggttgtattggtgctcttgatggaactcatatccgtgtgtcattgtcacctgatgagcaagttagatatattggaaaaactggaattcccactcaaaatgtgcttgccgtttgtgactttgacatgcgttttacttatgttgcaacgggtcaaccgggagctatgcatgacacaagtgttttatacaatgcattaagagtggatgaaaaattcttccctcatcctccacaaggtaccacacttgtattatgctctctatttgtgctgactgtgcatgtgttactaaaatgtatcaataatcatactatgctatcttttgtaggcaaatactatgttgttgacgcaggacatcctaatcgtcccggttatcttgctccatacaagggtgagagataccatttaccagagtggcacagaggtatggaacccaatactccaatggaaaaattcaatcgtgtgcactcttccatccgcaatgttattgagcgatcatttggattactaaaaatgaagtggcaaattctgtacaagatgccgtgctaccccatatacaagcaaaaaatgatcgttgtggctgctatggtccttcataattacattcgtgagcatggaggtgaggatcctgattttgctaggtttgatcgtgaccctaattttattccaacaataccagaacggtacaacaaatacgcagttcctcgaacggcatctgatgagtcaactcccgaaagaagtgcaggaactatggatctcttccgtgatgaactagccaccgctttatcaatttcttggcgctagatttgtaagacataagatgataatgtatctttgttggacttcaattatgaacctttgattaaaatgtggtaccttgtgcggattttgctatgtgcggattttgctcccaactcgtttctcaattgtggcagatttgcatgtgttccattaagatgtaaaataaatattacgataaaaaattagctactcggaggtgcaattccctactacagtagcagcattgccatgcgtgttgctttgcactatgactgtgcgctctccagtctactgtgtagctcgatcgtggccattttggcgttttgctgcaacattacctctcgcagcaggattgaaataggtgcttgcatcgtcttgaaaaaagtctattttataattttttttattttttattataaaaaaattagctattcgagctaattttgtaccgttcttgaaatagctacttgcatcgtcttgcaacaagtctattttgtaatatattttattttttattattgttatggctgtgagaaatattaaacatcactatatattagtaatcaacatccatacaagatccatgggcaaaacagtcctttcactcctcctcctaccaaatctggagctggaccatatgtattattacccaaacaggtgctagctccaggagctccacggtggagaagatttcctggagaggagctcatttttttgtagagtcagtttggtagacttgtagtgccgccatcgctgctgccggcgaatagctggagctcgtctttcgctacgcgctgccaccgccgccgtcttgagcttcatatggaagctttgccattccatcttcctactaggactggatgtatcaatcggtagtgatgcagcatgcttgctgcccggaatttggattttggaacattattacaatgagcagagcagagcatgcattcgattcaactagtcagcaagtaaagcatgcattccatcagacaattcataggtttcaaacaacaccattcattactaactacaacagagaataagccacatcgtaaatcaaaagagatagagaatagaataagccacatcgtaaatcaaaagagatagagaatagagatcgtaaatcaaaagggattgaaaagaacaaaagcaacgcactagaaactacaatctccatagctaaaatatgtcttcagtaccatcaacagttgaacaaatgaagaacaacaaaaaatgaagaactaaaatatgtctttggtactttggccccgaaaaatgaagaacaacaaagaaaaagttgggcccaggcgatggctggtgacggcgcacgcttacaagcagacgagctccgagctagctagtcaccgccatcgtcggcatcgacagtggcggcggcggcagcagcgacgagaggcctcatcggattaactcatcagtgtgtcttgtcgggctgccatggactgatttcaatagcagttaagtatgcatgacacgtgagccgttggattgcatggacggtggataagtgatgactgcacgaccgtgccttcacagggtgaaggaaagcagatccaaatccgatcggtaggaaaaataaaatcttccttctcgaaatcgccggccgcaccgtctcctctctccccggccgtcgctgcgcctcctctctcgctggcgcgccacgccgccccagctccggtcgtcgtcctcctggcccctccgcgtccgcgtccccaagcgagcgctcgagctttgctttcaagctctcgctgagctccggagggtagagatgtcgtcctcctccgccgccgccttagccagaggcaaatccggaatctctgccgctaaattcgaagtacgaattctcccccaacccctctccctaacacacatggagtacacttgaatttagctgcggccagatccagacggctggctacctctccaaaatctaaatcgaaatcgatcttgatgcgcaggcgtctaagggattgggcgccaagccgaagcgatccgcctccgccaccggcagcagagggaagaccgagaagaaggtctactcgctgccaggccagaaattcgacccccctgaggaggtcagcttatttccactcaaccaaatctcatctcatctcatctgtgttgttgcctgatgccattaatttcgtccagagagagcctctcaggatattctacgagtccttatccaagcagataccctccagtgagatggctgaattctggtacgcacaaatttttacaccttttagcgtaatatataaattttcttctatctcaactgttagaaatactcctacccctatatggaatatatatacagtagtagtacatactagtgacattcaggtgtctgtctaactagtggagtactagctatctagtaggattctgacagtaaattcttctaagaatacttgtagcttcaacgcatgaagcttactgctatcaactgactaatatcgcctactcaaagcagacactagtactaaatttggttgcctcatgttagcacaagttcacacatcattctaatgaagggcatgaaaccattcatataaataagttctctcacttaccaatgataaatcctaggtttgtcttacaaactgcagtgatcaattatattaccctagtacctcatccacgaaaatgtacaacaggttgatggaacacgggttgttatctcccgaaagagcaaagaaagcatacgaaaaaaagcaaaagcggcaacagcaaatacgatcaggaacaccaattaaacccagcgtaaagaaagacaaaccggaaagttcaaaaaaaccaagctcatataatagttcagattcaaaggcaaaaaaaagagtcgattacagcgatgacgatgacgatttcattgtaaaactgaagagatccaggggatgatagttttcagataccagcatattcctatagcaccaaggctaataaacaggtgctgctctgaggtttccatggcaatggtaacaaccaaatgggttcatgatgattctggtggaacaacatttctgtttattgtcaatattggagtagaaagaaaaatggagatcctttacaatgataaaataaagtcatattggcagcattgtgtcttatgtaaagacaggcactttgtggagctaaagataaataggtttccctttgctttgctggtgtcgttgtattctgcaatttgtacctgcacggtaccgtaccttacctttggtagataagatttggtttgttgcattgctgttactcttgcattgggaatggacattgttatgctgaagttgcctagaaagaaaagattagatttgttgtgttacttacagtactagagctacggctagagcatgttggatgtgggactctgcactgcagcttaatatggaaattgattagaattacaaagcaatagaggcaaatgagaaaaatggtattgtcaaagggggggactggtttcttgctgttacgttgattgaatattatattatagggacaattgcatccatgcccccactttcaaacccaattgttgttttaccctcactttttagggtttgcagttttacccccaccttttgaatctgaatcagccgtctgccccccacttgtaatagttgattttaacagtgttagaggtagagaaaaggacatttatacccttggcggttattgcatttttgcccccattttttcagctgtgttattttgcccctattttgtgatttcagcttgtgtgattgttataaataattcaaatatgagcatctcttgtgatgtttttgtacttttaacaaaaaaaaatcacaaatactagggaaattacaaaatttgaccaaaatttgaacaaaattttgacagaatttcaacacaactagtacaagtcacatataacaaagtgtccacaaacataactacaaagtgtgtccacggcagtggtaggggacggaaaaaaaatgaggtatggctcatagacacatacatcagagactagaaggtagatgagaacagtatcaatcgcactacggcacgacattgtatcaacattcagcatggcaataatcactgatcacaatccgttatccatttgcaaacaagcctaaatagaagaataggcattgaaaaatacctcaagtaatgaagtttcagtaataaatcacatataggaatcagggaggatagatatacatagaatctgaaaaaaggagagcaaggattgattagggactagggtggattgaatcgggaggaaggccacttgcttctgaggcggtttcacgagtttcagctgatcaaatatctcaagcaacccatgcatcattccaacaacaacgcctcctgtcacagggatcagcagtattctgtgccaagtatcagctagcctctgaaggcagagccaagctgcaccttcgttgggggtacctgcccaaacccattcatggatgatatgaacctaaaaattccataacaggagctatctatagaatcagtcatgcaaggcagaactgaaaaatctcaaccttaacttacattggaatcactaggaaggttttaaattttaacaaaatttatcgtgttttgggcaaccgcagataccgtgtgacataaggcttttcatttactgctttcagtgcactgttaagttgctttgagtttgcacaattaaatgaaactgattttgcatcatttgggtgaattcatttgcactagtttagtctgcacacttccgtcaaaaaa

SEQ ID NO: 55252 - DNA, 1407 bp, Oryza sativa
aaacccacttaaattgcagagatagtcaagtttccagtctctgagcataaccattgaaatgctcaccccacggttaaacgcggcgacgcaaatgccggtggcgagcccaaggaggcagccgatgagcagcagtgcccactccggcggcgcccaatccccgagctcctccccgaccctctccctctgctgcggcgacgatgtcggggacggctcggagcgattgagctgctgcggcggctgctggcttcgacgcccggatccgcgcgcggagagggggaggtcgaggtgctgtaggaggccgcgcacgccgccgctgctccgcctcggggaggcggtgacggtggccccccgcgcgcgcgcgcccaccctcgccgcagccgctgtcgcccttgcagcggcggccgccgcctcgcgcacgccctccccgtcgccgccgcgccacgctctcgccgctatggtttcgcacgcacgcagggaccgacgcacgaggtggaggggacagattcaaccctatcctgtccattccctcaggggtacaatggtaatttcatattttctcaaacctttgttttattttcttttgtatttctttaacacaaaatgtgggacccgccagacagctgttacaagtgggggtagacagccggttcagattcaaaaggtggggataaaactgcaaacaaaacagcaattgactttgaaagtggagggcatggatgcaattgtccctatattatatagaaggacaagcaaatgtatatatagacttctgtagtagtagtagtagagcagagtacatgtatatatatgattaattatatattacatatataagtaatagtattacatgcgatgcgagcttaataatggagtgagtacgcacatgatagatacgtacgtacgctacagatatatatatatatatgcggaagatgagtaattaataggagagggatgagccgctgcagcagatgaattgaagatgcgtgcgtgcgagcgaggttgtcaggcggccggataaggaggaggagaagaggaagaggaggaggaggaagaagaggccttcttgtggtgcctgttgagctgctgatggttgatgcatttgtccttcctgaacctgagcacagtgctcatgtggtcgatctcccagatgtgctcctgcatgagcacgttgccgatgatggaggggccttgcgaaatccggttgaagccgaggcagacaacccccgggacgacctccggaacgacgatgctctttgcgtcggcggccagcctcgcatccccggccatctcgatgctgaaactgggtatcgtcacgttgtgagccgggtccaccccgtcaccggcgaaggtccagttgtagcagtactcgaagcccttgatttcggccttaggcaggtgcgccag

SEQ ID NO: 55253 - DNA, 1275 bp, Oryza sativa
  unsure (1)..(1275): unsure at all n locations
caagtcattaacacgtcttctctatcagaaaggacaattgagagctacactggaggacatagaagatctgaaaagacaagaaagatcccgtcagcaaaggatcttgaaggctaaggaagcccttgctgctgctgagagggaacttgatgatctacaaccatatgaagcacctaaagctgaaatggttggtttattcaccttattttccctagtttttgctgtcatttattttagataacgagcttttgctgtcatacatctttttttttgtttgcaattttgcatatgtagcatacaagtattgtgtacggtttatctgctctagtaattatttaagcccgttaataattttatgtttcttcacagattcaactcacggaggaaattgcacgactgacttgcgatataaatgagctaaaaaggaaaaagacagatatggagtcccagttagttcgagagagagaaaatctgaggaactgctctgataggtactcgttttgtctattaatttctactttgtccaagacttgggtacctactagctagttattatttatcacaggttgaagcaaatggaaaataaaaacaataagctgctccaagcattgcgatattctggtgctgagaaaatcaatgaagcatacaactgggtgcaagataaccgacacatgttcagggctgaagtttatggacctgttctccttgaggtttgtttacttgcatgttcaccaactattgtctgctttgctgatcatacaagtaatagtacatcttctttgtactgctgtcaggtaaatgtccannnnnnnnnnnnnnnnnnnnnnntggaaggccatgtcgcaagctatatatggaaggtatagatactacgatagcaccttatgttcctctctgctaattagtgtgatgcttatgttttactttattttagcatttccatgaaacaatggaaagccaagaggaacacacttaccagtggctgctggttctgttgtgcactgcacattgtgttttgtttttccttcacatagtcaatgtgctgttgcaaatttatcctccagttgctggacatggttagtgtccagtaggatggcatctcattaaaccatttctagacaaggtcccttatttattgtcatcattgacttggaaaccataaaacactaccatgccatcttattctttcctcctatggaagatactgcatctgtaattaactgccattttgcttttatgtggcagtcattcattactcaggatgcttccgatcgtgac

SEQ ID NO: 55254 - DNA, 13582 bp, Oryza sativa
cctccgtcgtcgtcgacttggatggacatggtggtggcggcggggggcacgtggggccgcccagggtgcttgcccttgcgccggcgcaggcggcagttgatccaggtgacttcgttggccgtctccagggcgaggctgtaggggagcgccggggtgccgatgcggacaaccaccacgtacatgcccacctgcgcgatgttgagcgcgcttcgcatcggcagctcgaacatgtccgtcttggacatgagctccggcacctgccgcatcatccgcctcatgtccttggccatcaacgcccggaagtgctcgcgccgctcctcccccgactccggaacgtggggcgcccacaccggaagggtgaagctgctgctgcctccctcctggtcctggacctcctcctcttcctcctcctcctcgtgctggaggcgcccatggatccctgccaccaacagcagcaggcttaggaggaggaccaccaccaagggaccgggaccggccggcatcatcgatccttcgcttccttccttcctttcctcttcttctttgtttaatttgccaattagctagctaccctcatccatccatccatccatccattctactactccatcctcctgcgcgtgcatgctttgtttcttccgcacaattaagatgattctatgttaagccctgtggccatgagctctttcaggaacacccaccactcctgaattactattttactatatatattcccccttattttccttctacatacatacttacatacaagagaagcgatcttcatctgcatgcatggcattgcctctcctcttcagtcttgcggccttgccagcttatatatatatgggccttttaattacatgggccaccaccgtaatcggaattggaacaagaactgaaaagataaggagtaagttcactataaatccctcaattcactaggcccatcccccggcggtatagtagctggttttggttgacgggatgagtgggatccacatgtcaaccgccaacccttcttcctcatctatttctctcccggactcctcctctcccctctcattccccatctctcgctccaagtcgggaggggggaggcgtgcgacggagagaaaggcggtggtcgacggggagaggggtgacggtcacggaggagctcatcggcgagctgtggcatttccctctccttctccaactatttcgacatcatgctggtggtgctatcgtgatgtgtgaagcaatgcggcccgctgttcaacccgctcatgctgatgctggtggtggtggcccgtgctgggctccctcctcaacgagaagatgcatcttggaaatctactcaacggcgtgctcatcgtcgtcggcctctactctgtgctctgtagcaagcagtacgagcaggggactatgggtcaagacgagttgtgcgaccgcttagggcctaggtcagcagggggccatcatcaccacacctgcccaatgcaggtcacccaatattgctgctgggcaccgaggcaggtcacccaataccgctactattctcggtgccttgagggaagaatgagggaggcagggagacgcggtcgtgtggctgtcgccgatctcaatgagtcgatcgaggcctcgaggacatgacgcaatgcgttgtttcatgttctcacttctaatctcacctcttcctcgtgtcgccattttatctcacgcatcactgtagcgcccgttccgtcgtggcgcctagcgggaaaattatctcttaaaaaccctaattgcgaaatttgtttccttgcttgttgtctagtgtccatgccatctcaagatctcaatccccgatctatcgtcaagttcaattctgaatccaattccttccaaatcaaatttctccgcaaaagtctatttggcctcccccgaggtcgatgggccgaatctcgctcggcccatctccccctcctctccctcgctctccgtctccccatccctcgctgccgctccccgcgctcgttcgcgcgcgcacccgcatggatgccgcccggtcccgctgccctgccgcctgcagccgagcagccgcccggtcccgctagccagcgcgcgcgcccgagccacgccgctcaaaaccaccgcgcctcccgttgtttcccgcgcgcgcgtgccgagtggccgaccgcccggtcgccgccgccgtcaccctctgccgcgccagcccgcgcctgtcgcccgtgtcgtcgcgccgctccaaaccgccccgctgtcatcgccgtcgtcatcgcccggccccgccactccgcgcgcaagccgccaagggacggaggcagcgcccctcctctctctgccgcgtcgcccccgctcccctcctcctttttcccaaatcggcaaaggggcaagcccctttctccccctcctttctccccttttcctcccgccggcgtcattcccctctccctcctgtcgccgttttggccgctagccggagcgccagctcgcgccttgaccgccaaagtcggtttccaaaccgacattgccgccccctataaaccccggcgccctcctttcctctcccattcacctccgcgccattgccgcccctctgttcgccatcgccgttcgtcgttgcgcgtgtcggaggagccagcatgagcaaggacgcggaaggggacttcggccgcgccctctccttcctcttccccggcctgaggccggagagattactcccgcgccgtcggcctctcgtcactgcgccccgcccgcacggtagtgcaaccctccgttcttcctcctcgctccatcttccccccttagattttggtagtagcccgagtagcctccccgtagttagccggcgccgccccgaccgttgccgtcgctcgccgtgtgctcgccaccgtcgccgctcgagcgccgtagcacccgcacgtcgccagcctcgcttggcgtagctccgtccaatccgacgctagcatcgagttcccgaagccgcgtagatgctctcaccgctgggaatcgacctctcgtggcctcgtcgccgtttccctcttctcccgccgccggttgccgccgccgcaatccgccgccgtcgagcaacccccggcaaatccgagccgttggctcgtctccccttgtcctgtacaaccgcccggtgtgctcgcttttgcccgtatcaccgtggttcgctccgccgctcgccgccgccgcccgccgtccattcgcggccgggtcatcgtctacctcccgccagcccacgtggcagccacgtaggcgccacgtcggcgccagctcagcctagaccgggtcgagccgaccccggtcagtccctcccgtgcgcgcgttccaccgcaagccatgaggctgcgcgtgggcccgcctcatcctttccaccgtgaaccgtgcgcgtgcaccgcgtccctttccgcccgcgcgcgtgcgccgcgtgctccctccgcacggtgagccgagccgctgacaagcgggtcccacccgggaccgcgcgtggtgagcccggtccaccggccctctccctctcctcccctctcgcgcgcgcgcttgggccgccttgggccggccggcccgttaagctaggccgagccgccccaaatctcttgggccgcaccctagccgcccgagaaaagtctaatttccatccctcttttctttcttttcttttctttttcaaaaaggatttaattaaatccttttcctttagaccaaaaattcaataatcttagaaattcaatatcttcccaaccgtaaatccgtttgactccgttcgacttccaaaattccccaaatctcgagatctatctaatggcacgcttagaggtcattaatagggctttattttcgccgtttgttgagttgtcccgtttcgcgtgtagttccggagcccgaagacccgcagtgcgaggatttcgaggatcaagctccagatctcgagcaaggcaagccacctttgaacatcttgagcctatatttgaaatttaattatgttacttgcaaaatattatgcattgataggatcacacttaatctgttgtcccgtctgcgaggcagattggcggacttacctaatttgtcgcatttgatccttccattgttaattgctataccatgtccccttgtaaccacccagttgcgcctcgatactcgtgcactctgtgcgagtatcgacggtcgccttcaaacttaaaatctgagtaacaacttgggtaaaactggagttttacaaaagacttggaaaacccaacacttgggtcggtgcttgcgaactaaatgaatttccaaaaccgcggaccgggaaacgtaccgggtgtacagtttcccgctcttgcacttaaggaccgtttccttggaatttcatccgaacataagacaagtacgaccacatgggtggaatgggacacccctggctgagtaactagcttatcaggggagccttgatgctgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgacccgggttagtaatgtcgtgtgggtaaagtgtaccccctctgcagaggtcattaaactgttcgaacagccgtgcccacggtcatgggcggatgtgaggtgattcctagcgtagttttgtttgactactgcttgtgaaattgctgttgtgaaactgggttcgatgtttggaaaatcagcagctgacgggatcagctaggcccgggtggccgtttgaaaagttgttggcccgggtggccgtttgaaaagctgttggccgggtgccaaccctgtttcaagatctaaagactgatacattgcacatactccgaccggacgagacgcactgtctcatccgtgtcgtttgagaagcactcacttagttgtttttagaaaagagtttaaataaaataaattgcgaaaacaacagcctttccttgaagcctgcattaaacacttatttcccctggcttgctgagtactcccgtactcacccttgctctatataaatatcccccctcagttgctgaagaagataaagcggatcctgctgatgaggagttcttccaggagcaagccggctacgatgagttttagggtttcggcctagttcccaagtcgcgcctgtgatgattggtccaagtcctggcttccgctttccttttgtaatgcagttgtgagctcgggatctgtccgcagcccaacatgactgtacttctactctataataaagagacctctgttgctgtgatattctgtctccctgtgataccagcactgcttcctgggactggtatcgattaacaggttaaattggagcgtcacgggccagttccggtcgggactagttcggggcgtgacaatcacgctaacttgctgactcgccaccaggaaagaaggaagatggccgacgtagcgaaccggctggcgacgtcgtcgcccacgcgccatgcagccacgccttgcccttgtggccttgccttaccttcacgaggcatctgattagcagaaaagactagggcaaggtgaggtcttctgatcttatttgcatctatgtagttcgaaaattaggttatagttttgttttgctctttttgtttaatgaatttagtttatgatttcaggtgttagaaattagaatattgcctcagaagcatctttcaggcctcaccttctggtatacaccaagtagccagcgtgcgggtcttgccttctcgttggctccctagcgtaacccctgcaagccgcttaccacatcgaatccgtagttcccggtctctacaatatcgccctatgcctccgcgctgccctactccttgggggtgggaggaggatgaagattagggtactaacttgtggggtttacgagggttccacgcttactctactgatttgattttattatactaaacttgtcacatcagtaaaacctggacataataccgtcttaagacctcgggtgctctggttttacaagttaagagacatgttatgtctggtattacgggcttgtttggcacagccaaatagtttcagctccacctaaagtgggagtggagttgggtggagctctctcacaaaatgaactagagaggtggagctgggtttaggcagctccacaactccactccaaacccaactcctgaagctaaatttaagagttggagctctactaaacatgccctacaattaaaaaatgtgattaaaacttgacatatctaaagtgaactcattcggaaagacaacaacaaacactcattctgcagtgcagctaggaggaatgtggcatcaccatcagcttctgcattggagtggattttcatccctggaggggatatcctctcgttatttgcgtatcactcaaatggttatgaaaaaattttaaaaaaaaagagagaagatgtattaacatgtatatcacttcacaaacatgcaagttcaaattcaacttctatatctcgcaacgaaaaaaacaaattaaactacaactagttaacagttaacgtatatccacaatcaagtttgtttttttcgttacgaaatatagaagctgaatttgaacttacatatttgtagagcgatatatcacatcttaatacatcttctcaaattttttaattttttttcataatcatttaagtgacatgcatacaacgagggaatatcccctccagggatgaaaatagtttccggcttctgcataccttgtgatgtccctctcttgtctagtactggcatgaatcggcacgcagcactgctgtggctgctgctgcttcatgtcatagtaacagtacattctcatgcaccggtgaccgatgcactgactggtcgtccgccacgcccaacaagaacaactactaggctagtactggaggactatcttttttccgagaaaattactctccatcccttcttatggagtaggagtattaaacaaacagaagaaaggataatgatactctgtttgggagtcctttccctccctttgatgcagcagcagcgtttttgattgcgcatttgcatggcgcgcggccagcccaacatcgcaacgcatcaaagtagggacgatatatatatatatactccgacgatcgatcccttgccttgctcacgtaccgagctgcttcaagaaaaaaaaatcaatggcgtctcagaagaaagcaaggacttgaagaagagctcatagtatggctctgcggcctcagcttgtgcctccgctgctctcccaccgccgccgccttgtcatacctctgcttgtcttgctcctcgccgccgccgccagcgacgagcagctgctaagcctgcgtgggcaggctgctgtccttgtgtccatcaaagacgccttctccccgcctctcccgacgccattgcgcactacctggagcatcgccaacgacgcctctctctgctcctcgtggcatgccgtccgctgcgcccccgacaaccgcaccgtcgtctccctcgacctctccgcccacaacctctccggcgagctctcctctgccatcgcccacctccagggcctccgcttcctctccctcgccgccaactccctggccggcgacctaccgcccaccatcgccgccctccggcacctgcgctacctcaacctctccaacaaccagttcaacggcaccctccactactacttgtccaccatgaacagcctcgaggtcctggacgtctacgacaacgacctctccggcccgctcccgctcccggacaccaacagcaacctccgccacctcgacctcggtggcaacttcttctccggcagcatcccgaccagcttcggccgcctgcaggccatccagttcctctcggtcgccggcaacagtctcagcggccgcatcccgccggagctcggcaacctcaccgccctgcgccagctctacctgggctactacaaccagttcgacggcggcatccccgcgtcgctgggccgcctcgccagcctggtgcacctggacctggccagctgcggactgcagggggagataccgccgtcgctgggaggcctcgccaacctcgacacgctctacctgcagaccaaccagctgaacggcaccatcccgcccgcgctcgccaacctcaccgctctcaggttcctcgacgtctccaacaacgcgctcaccggcgagatcccgcccgagctcgccgcgctcacccacctccgcctcctcaacatgttcatcaaccgcttccgtggcggcatcccggagttcatcgccgacctccgctcgctccaggtcctcaagctctggcagaacaacttcaccggctccatccccggggctctcggccgcgtcgcgccgctccgtgagctggacctgtccaccaacaggctcaccggcgaggtgccgcgctggctgtgcgcgctccgcaaactcgacatcctcatcctcctcgacaacttcctcttcggcccggtgccggaggggctcggcgcgtgccggacgctcacgcgggtgcgcctggcccggaactacctcaccggcccgctcccgcgcggcttcctctacctgccggcgctcaccacgctggagctgcagggcaactacctgacggggcagctccataatgaggatgaggacgctggcagcccgctgtctttgctcaatctctccggcaacaggctcaacggctccctcccggcctccatcggcaacttctcctccctgcagacgctcctgctcagcggcaaccacttcaccggcgagatcccgcctgaggttggccagctgaggcggctgctgaagctggacctgagcggcaacaacctgagcggcgaggtccctggcgaggtcggcgagtgcgcgtcgctgacgtacctagacctgagcgcgaaccagctgtggggcgccatgccagcgcgggtggtgcagatcaggatgctcaactacctcaacgtgtcgtggaacaagctcaacggcagcatccccgcggagatgggcagcatgaagagcctcaccgacgccgatctctcccacaacgacttctccggccacgtgccccacaacgggcagttcgcctacttcaacgcgtcgtccttcgcgggcaacccgcggctggtgctgtgcggcacgcccgcccccggccccgcccccgggacgacgacgcctggcagcgggggggacgggcgggcgccggtgatgtggctggcggcggcgctggggctgctggcttgctcggtggcgttcgcggcggcggcggtggcgacgacgcgatcggcgattgagcggaggcggcggtcggggtggcagatgagggcgttccagaaggtgcggttcggatgcgaggacgtgatgcggtgcgtgaaggagaacagcgtggtggggcgtggcggggctggggtggtgtacgccggggagatgcccggcggggagtgggtggcggtgaagcggatcgtcgacggtgggttctcggcggaggtgcagacgctggggaggatccggcaccgccacatcgtgcggctgctggccatgtgctggagcgcggaggcgaagctgctggtgtacgagtacatggccggggggagcctgggcgacgcgctgcacggccaccaccggcaccacgacgagtacgacgacgatggcagcaatactaatattattgggtcgttgttgttgccgtgggcggcgcgtcttcgtgtggcgacggaggccgccaaggggctgtgctacctgcaccacgactgctcccctcccatcctccaccgcgacgtcaagtccaacaacatccttctcgacgcccgcctggaggcgcacgtcgccgacttcggcctcgccaagtacctgcgcgccggcgcctccgagtgcatgtccgccatcgccggctcctacggctacatcgcgccaggtataagcttactactcctactaggcagctttcaatctttgaccgactaaaattaagggtatgtttggtagaactttaactcctaaattttgctataaaagttaggtctggtgtggagttgactaaatccagctccacctctctagtttattttataagagagctctatcaaactctgtttctatttttggtagagctgaaactatttggctgggctccagttctaaaagagatggaaagctgaagctgtgacaaacagtcccttactccactactctagactccagctactagctagacggaccaatcatgcatccatccagcattccatattggacggacgttggtggtgtagtgtactagtcgtcgtacgtggtgctaatctcctctcctactacagttattattattattagggtgtgcgcattcttttctttccatgcaagcatgtactccgtactgtgtgtcaccacaccacatttggcctgcactgcatctgcatgccattgccagccaaaggaaaccaagcagcagccctctgctgcgtctgatgatgactagactcctcaaaggacgagcctttctttctttttcttttctttgctgcatagtagtacggatgcatgcatggatcgactgaatctttcgctttcgcttttacttttactgctagtacatgtcttgcggttgatgatttgcctcaatgagtcgtcctcctatcctacctagacaagcgatgcgatgcggcggcagcagaacaacaaagccttgtttgcttttaaacagagtctaaaaagaatgaacaaagtctcttttcatttggtctttcttcttcacaaagcatatgctcctcttttagttagttttttttaaatttctgctgattaattgagtatataaatgtgcttttgcagagtatgcatacacgctgaaggtggacgaaaagagcgacgtttacagctttggggtggtgctgctggagctgataacggggcaaaaaccggtgggagagcacctgcagctgcatcaagaggaggaggaggaagcaaatacgacgacgacggtggtggacctggtgcagtgggtgcgggcacgctgcggcagcggcaaggacggagtgtggcgcgtcctcgatcggcggctgggcggcgacgtgccggcagcggaggccacgcacatgttcttcgtggcgatgctgtgcgtgcaggagcacagcgtcgagcgccccaccatgcgcgaggtcgtgcagatgctcgagcaggcaaagcagcagctcagccgctgccaccctcctcctcctcctccaacatccacgtcgatcgaccatgcatgcatgatataatatgatatgatatgcctgctactgtatatgcttagcgtacgtctcctaattgccttgctaataggagtacttctacaccacatatgcatatgcgtgcggatcgtttcgagccgacatacatgtccaacggatgctcatatgtctgatgacaacgtacgatcgagatatatatatatacgacatgcatggagctccggccggccggcttgctgactattaggaatactttgccatatatgtacatattgtattgtattgtttctttccttgtattctcctctaattgagaatcctgtacatgtgcttcctatattaatacatggccacccctcccattgggtgtgtggtgttctccccattccattctacatggtatcagattccaagttttcttctcctcttccgttgctctagcgctgcttcctctccggtcgctgcgtccaccgagcgtcgccgcctccctggctgccgcgcccctcttccctcaccatgtccacttcctcggctacttccgctaccaccgactccgctacggtgttgtcttccacctctaccgtcgccccggttttcgtcaacccgtatgcgaccgtcgccgtcaagtcccatgttccgatctccctcgagcttcataaccccaactacaacaagtggaaggccttcttccgctcgatgtgtgggaaattcggtctcctcgatcatcttgacgctgctcctcccgccaaccctgacgccgcctgggaacaggccgattgctgcctctgcagctggctcttcggctccgtcgccgacgacgtcctcgacctcgccatggagcatgatcaatcggcccaggacttgtggatcgccatcgacaacctctttcaagccaacaaggagcctcgcgcgatctatccgcatcacgagttccactccatgacccaaggcgatctctccgtcgccgactattgtcagcgcatgaagacggcggctgatgccctccgcgacgtcggccaccccgtcaccgagtcccagctcgtcctcaacctcctccgcggcgtcaattcgcgcttcaccagcacggccgacaacatcgcgagcgcccctatcttgtcatcctttgcctctgcgaggaacatgctggttctcaaggagcttcgcaacaccaactcggtacaagtccagtccgagactgccctcgtcgcagccaacaacgcccactccaactgcaccgggggcacttgccactcctctggcagcggtgggcagcagcagaaccgcgccggcggcagcaagaacaagggcaagaacggcggccgccctggtggacagaacaacggcagcaacagcttcggcaccagcactttctccatccctgctccacgccaagctgcaccatgggtgtgcttctcgccctgggcaggacagcagcaaccctggcgtgctcccagcgccgagatacttgggccgtatccttaggctcacattgccttcgccgggccatactcctcgccactgcctgcagggtctgtccagccggcttgggaccaagctggccttgtcgccgctctcaatggaatgatgctttacaaccccaactcgtgggttctcgacacgggtgcaacttcgcacatgtccaccgacggtatactcgttactcgcctccccaactcacaaacttatattaccgttggtaatggtcactccattccggttgtttgccgtggcacttcctttctccctattggcaccactagatttgaccttcatcatgttcttgttgctccctctttggttcgcaatttactctcctttcgccaatttacccatgacaataaatgttccattgagtttgacgagtttggtttttctattaaggaccctcggacccggcgcgtgattcttcgttgcaatagccatggcgacctctacaccctcccgaccgatgcaccttccatcgcctcccactgcaacctcgccacctcctccacgttatggcatcgccgcctcggtcatccgggtccaaccgccgtcaccactctccaacatttatccgccatacctcgctccaagacaaataattccctttgccatgcttgtcagttagggaaacacactcgtcttccttttaataagtccacctccagtacctcttctccttttgaacttgtgcactgtgatgtatggacttctcccgttatgagcatttcgggcttcaaattttatttagtgctagttgatgattttactcatttttgctagacgtttcctctttgccacaaatccgatgttcatcgcca

SEQ ID NO: 55255 - DNA, 10278 bp, Oryza sativa
ttaggtgctgatgacatttcatttatttcaagccgatgtcatgcgtacatcgatcggcaaatatcaataagtaaatcagaactaaatctactcgatcggctatagatattaatgatatataatccttatattgatatatacttaaatcaagtgattgggatagatcggtcgtcttgccgagacagtataaatcacttagatcaaaatatatattaatagtgggattatatacatttatagcatagccggtcaagtggatctagcacgtatcggctaatgctccgatactactctatattaagatgttaaagcaagtagaatataccaaacagaagcctaatatacctagatgcgacaagatcctaacataaagggcagatttaacatatagattaagcatatggaataaaagtagttaaatcagataagatcggctgaaactccgatactaccctaatcggcaaccagaaagtaggctagagattgcaattctaagcatgacttaatagatcaaactcaattgatgcagcattaagtatgaaaagaagaacaatatctagacaatcaagccgctgaaagtttcatagagtggtagatatatcacataatctaagttaacgtcattatgtaacctaatcggctgccttccattaacagatgttagccgattataggttagataaagatattatcaaagattatgtgagatatatgataactcgacgaattatatagacaagattagagtatcataaagatggaagcactaatcctgagaacataagtcatcatgacaagttttacctctttgttgaagatcgaaaccgatgcagctcaacccgagagtacgaactcgtcgaaataaaagtaaagcaaaaagggtggcgatgcgccgagattgtattggatgtctctttttttacatagggctcgggtctacttatacccgagaattacaagatacgtccataacggacacgactattatctctaacaaactctaagatactataagtctttacggcagacttttgcccaaacatatctctaaggaaattacacagaatatcctaattaatagatacaattgccttcccaggactctatccatgcgtggcaatcatcttgaagcacatcaacttgaacccgacgacatacgccgagtcatattatcggaatcggctgtattggctagccccgtccgactcgaactctgccgacctgaccttagccgatttggactgcagccgattcttactctgcttccgcaacgatcttcatcttggattccacttcgatctgatcttcagctccgatgccaatagtgatagaatttaccaaatttggtcgttaacacaccctcctattgggccgaaggtctagccaccgccacatacctcctgaaccgccgaccctcgtcctcggtaaacaactcaatcccattccagcttcttcatcgcaagattcccgattattccatgttacgagtgtttgggtgtttatgctatcctaaccttagtgccaccgctgcccacaaacttgcaccccgctccaccgcttgcgtctttttgggctacccctcctcgcacaaaggttatcgctgcctcaacatatccacccgccacatcattatttcgcgccatgtcatttttgatgagacacagtttccattttcgggagatcccgtcgatgcttcctctttggattttctactacaggatgctcctgctccctctgtggtcgctccaccactggctggtgttgagcagccgcacctgccgcacgctccgttccctgtgaacgttgagcagcggctacccacgggtgctccctcggctgaggacgagcacctgccctactacgtgcagccgcatcacactgcgggcgggacgacggcaagttccacatagccggctgccatatctccatcttcctcaagcaaggcaccgtcgtcaccagctatccggccgtccacgtcttcttcacgaccagccggcacggtggcgccattcccgtaccactaccaacgacgaccggcgccgactcctccaccccaagtcgtcgctccggctgcacccacacctccccagcgggtccacaccatggtgacacgctccaagaccggttctctcaagccagtggaccgactcgtgctctcggcatcccacagcgccatttctccactgccggccaactaccgctctgcccttgccgaccccaactggcgtgcagccatggccgaagagttcaaggctttgatcgacaatggcacgtggcggctcgtccctcgtccacctggtgcaaacgtcgttaccggcaagtggatcttcaagcacaagttccactccaatggctcgctcgcccgtcacaaggcacgttgggttgttcgtggctactcccaacaacatggcatcgactacgacgagaccttcagccccgtcgtcaagccctctaccattcgtgtcgtcctcagcatcgccacctcccgctcctggccgattcatcaacttgatgtgaagaacgctttcctccacggcaccctcgatgagacggtgtattgccagcagccgtccggcttcatcgaccccgctgctcccaatgctgtgtgcctcctccagcgctccctctacggcctcaagcaagcgcctcgggcttggtaccaacggttcgctacatacatttgtcagctgggtttcacgccatcggcctccgacacatcgctcttcatcctccaggacggtgatcgcctcgcctacctgctgctctacgtcgacgacatcatcctcacggcctcctccactgagcttcttcgccacatcacggctcggttgcacaccgagttcgccatgaaggatcttggtgacctccacttcttcctcggcatctccgtccgtcgcacacccgacgacctcttcctatcccagcgacagtacaccgtcgatctcctgcaacgagccggcatgtttgaatgccacccaccgccaccccggttgatgctcgcgccaagctctccgcctcggagggtgcccccgtcgccgatcctactgagtacaggagcctcgccggtgccctccagtatctcaccctcacccgtcctgagatcgcctatgccgttcaacaggtgtgtctttttatgcatgaccccgcgagcctcacctcgcgttggttaaacgcatcctgcgctacatcaagggctcactctccgccagcctccacatcggcaccggtccggtcgggtctctgaccgcctactccgacgcagactgggccggctgccccgactctcatcgctccacctcaggctactacatcttcctcggcgataacctggtgtcttggtcctccaagcgacagacgacggtctcccgctctagtgccgaagcggagtatcgtgccgttgctcacatggttgccgagtgctgttggctctgccagctactccaggagttgcatgctcccatctccaccacgaccgttgtcttttgcgacaacgtcagtgctgtctacatgaccgccaacccggttcaccaccgccgcaccaagcacattgagatcgatatccactttgttcgggaaaaggtggctctgggacaggtccgtgtgctccatgttccatctacgcatcagttcgccgatatcatgaccaagggcttgcctgtgcagatatttacagattttcgatccagcctttacgtccgtgatcctcctgctgcgactgcgggcgggtattaggaatactttgccatatatgtacagattgtactgtattgtttctttccttgtattctcctctaattgaggatcctgtacatgtgcttcctatattaatacatggccacccctcccattgggtgtgtggtgttctccccattccattctacactgacgatcgacctgatctgatcaatgtgtatattaattttatatatatatatatatatatatatatatatatatatatatatatatatatatatatatatatatatatatatatccaagagatcaatgtccctacgtacctactccctccgtttcacaatgtatgtcattctaacatttcccacatgttaatcattaacatcaatatgaatatgagaaatcctagaatgacttacattatgaaacgggggaagtaactagctactactacctccgtttcaggttataagactttttagcattgctcacattcatatagatgttaatgaattaaggcacacatatatgtctaaattcattaacatatatatgaatgtgggtaatgctagaaagtcttataatatgtgaaagggtcaattaggcctagagggggtgaataggctaatttaaaattttatgcggaagctaaaactgagttagggtcagaaagtctgatccacagtcagactatccgaaaatatcagatagtctgatgttggatcagactgtctgatccactaaagtaacactacaagtagatctagtgcacaaacaagaatatgccacaaacagcgactagatctatagcggcacaaaaaagcaaagctaaatgaggggagaagtgatatcaccaacaatgaagttcaccgagttgtttccggagttcaaatccttgagggattctactctccgttgaggagctcactaagagccgggtctttgctaaccctttcctcaagaggttgcactaagcactcctccttccactaaggggtatctctttccttgctgaggcgagatccggccttcacaaacttctcccggccaaccacacgtagatcggtggctcggaagtgacacctagccgtctaggagtcctcaacctccaagagtaacaaacaccacacaactcttggtcaaaccctagtgctcaagatcgagtgaaacacacactaggccctcaaacaccaaatccacaaccaccaagatccaccacacaaagaacaaggagggatttgagagagggagagagagctcaaagatccaaagcaccttagcaccaagctcaacccaaagtgaatgagaatgaaatgagttgggtaaccctagaaaagggttaggtggggggtatttatagatgcccctaaaatgtggccgttgggagagaatcttttcatcccacctcggaaagtccgaggtgacatcggatagtccgatgtttttgacacccaagcaggccagagacaaagaacgaaattctggagaatttcggacaatccgatcgatcggatagtctgatgtcatatcggatattccgttatttttgaaccaagaatttcatcctctcacagagactcaagttccattgaatttcggagtctttgggtcatcggatactccgatcacatcggatagtctgatttgaaactcactcaagaggaataaaaagcaatttaaaacagagagtgaagttctgggaaatttcagatagtccaaagtatcggatagtccgaccttatattggatagtccgatatttttagccaacactcagaccaaagacagagagcaaagttctgtgaaatttcggatagtctgagcatcggatagtctgatcaagatcggatagtccgacaggaataaaacaggaacacttcaaataaatgattttgagcactagtgttctaccaaatatatgcatgtggtatccctcttaatagtacggcatcctaatactcaagaacacaagatatacatggattagaagacaattaccacaaaagatgccgcaatacttattgtgttgacatccactcctttttcatccttgcatacatctcaacaaaaagcattagttaccctctaattgtgttgtcattaacaccaaaataaatgaggggtcctagatgcactttcaatatgaaatggggaagtacctcttttgatcgagatggtatgatgttgggtcgtatctaaaaaagtttcaatatgcggagactgagaaagcggcttgatatgcatgtagtcctaggcaaagtggggcaaacccagcccagccgagcaggtaagagggcctcaatctcccctccaacggggattgataggcccgggccattaatgtctcaactgaaaaaacgggtataacgcatcctccatcttcaaaaaccggtacagatagactacttcaattgtttgagaagtgactacactgacgtagcaagtttaccgcggtttgagttagcacagggcaagtgtccaccttgggttcgatgctcttagagaacaaaaaaaactcaatgtcagtggaggaggagatcagacgggtgttatccatggccatccagcaacacctcagcgttgaaatagaggtagtggccagcgtcctgagggacccgaggtctggtggcaaagatgacgacgagagtactaggagcaagacacgagcctttgacgctactacccaagccacggtggaggaagacgagttgacaggtgccgaggagcaaggccatgacgagattagtcggagtgaggtgcatggctctagaagcaagccattgccaaggagcaacgtgacgatggtggcagactcatgtactcgacggatgggccaccaacacgagctcgaccatagtgccagatctggaaagagggaagaagaggtgggtagaagctcgtggtcatcggggagaaatcttttgggtggtgggtgtaagcgatgttagtgaagatggccactcgcacaatctaggctttgccgccgtccgccactactgatcttcaccacccatcgagttggcaaatggcgagcgagacacgagcgtgcagtggcagtggctggttgacaagatgtgagcagctctcggacgaccggtttgacaagtacaagactatgttcggtgatggtgtaggggtagcgacatgggctgggtcgatacagagatgatcttggggttaccgagaggcacgacaatggaacctgcaagggtggccaccaagacggggttaattttgcaacaaaaatctcaaatagggatgatattttgtaaaaaatgagaatgtgatccttggttgagcctcgagttttttatagtaccgagcaccacctcagcctcgagctcaacctcctcctccttgtggcgtttagcgagctcccttttgattccgctatgcctccatggctccatcaagagaggaggtagagagattgagggagggagcctggtaaggagaaagtacccctggcatgtgggtcccacattatttgtcctaattttttccctaactaacattgacaggtgggtcctattggtatttttattatttattttgtgtttaatgtcacgtaggacaaaactgctatccaagttgttttttgggtggtaaattcactcgatttaaagagttgagggagtttttatatcgtgttttatgattgagggatacgaatcaaactctaaccacagttgaggtgttataaaaccgaccctattctgtttctgatttgcactaattgaaagtcggagttataaaataaaagaaaaattaaaggtagagagttcggagagaaatacaatttatttagaaagagagggacggtaggagagaatcttttagcgtccaaaatctttctgtcgtgtatccgtcttcccctctgcgtcgaaggaaatctcccgtctcgtcgtcgctccttgcgccgatctccatcccgcgagtcgcgagcagagagcaggggaggggaggggaggggcgcagtcacccgtcctgctgcatcctggtgaacatccacatcctctctctcccacctacttttatctcgaatttgcttgcgttaaccctagcttctcttctagatctggaagaagctcttcgatctcttaatttcagagccttaaccttactacaagtaacgatttgtttgttcccctcaaaacccccatgtcccaagttggatccgcccctgctacttagcacctgttcctattctctaccttgtacttacggtagcacacctcataaggccttataacaatacaacttaaaaggataggtatgccctgcttcaatgtgaagctatgttcaaaatacctggctcaatgtgcaattcactatctgtttttttttacccccaaatcatcatcaacaacaaaaaacaatctaactcctgcatccagcttatgttgtacgcgcatgcgccaattacaataagaagagatggaaatttctttcaaactactccaggcattaaatgaataatcaatcctaaacatgcaagtatgacaggggcggatccaggaacaaaagattgggggggctcaattacacagtttctttaacctccagctatctagggacctttagtttatcattcatggtgaaaaaattgaagggggtgctccgggggtatccatgagtcttgtgggtgtaggggggacttgagtcctgggacttgagtccccctgcacccacgttggatccgcccctgagtatgactagctaacatttttgggcttccaacacagtagtcaactacttgtattttcctgagctccccctttatacaaacagtattaaatactataaataaatttctctctagtaggagtatcatcttatccattgtccgttgacagttatttgcattgtgttaaacagactatgctctttctaatagaggtaacatagttggatggatgatgtttatggaaggatagaggtcttcccccagcacttcttaccatcacaacaatccatggagacccctgctgatggtctctccacaagtaagactaacctggattctccaccaaggtgatactttcaaccaaaggaattctctggctctgaaattattttcccccctttcttactgcaatagtatgttgctcttgtcatgttaacagttcacgtagacgttcctggactccgaaacgagtaatgggagctgcatcacttttgcatttattgtctcttcctcgcataagatggtcttccagcactgaggatgatgacaaggttaatcaagtacttcctagtgtagaaattttacatcatgctaccgtgatctctgtcttatatagcacaagcatttttcattggtaacagattgagttaaccagagctgaagtagaatcattaagaaccgagattgctgatgctgaagagagggaatctcagttaaaagctcggtacggtacattagttaaccaagtttattgaccttattttccaacaatgtcacagtatgtaagcattttttttcccgccatatgtgattgatatagtttgtgtcttccaggttggaaaatattgatgaagttttgagatatgcacggctctctgggtatctctatattagaagtgtaagaaacctttgcactttgaccttctccccattgcttcactcttgtcacgtggaggctgatatgatattttgttgcatatagagatggactcaacttcctggagagccacctattctagatgatgctgatgtcgatgattggcttcctcggtttgttgttctgcaagggcaatgtgtatactattatcttaaatctacaggtaaatattttgttatggagtatgtcatgtgttggtcactcaatcacacattaattagtggcgggtcaaggatttgaacatgaggcggggcaagaggcaatggcataaaagatgacaatatatattctgcatctagggtaatagagcatatctatatatattacatatgcgtttaggcatcttaggcaacacaaaagaatattttgccctaactgtcttgtaaaagcaatctaacattcttttgccttttcattagtctgataaacacataaattacatattcacaaaattacccagcaaaaatgtctaaccaacattccagtatccactaagatttcataataactaaaagtgaaccctaagacaaataacatgcatactgtgatcttctagaggcatggctaattaaccgattgatcacagggatgactcctggcttgtttcctgctttagcccattagcagttggctgcattagagcttagataatacataatttggtacttagctggtttggagaaaaaaaattgttggggtggctctgccactaaatacagtcgaaacatatgtacttaatgccccagcaacagcatattttgccgggtatgctggaatcttgatacagttagatcgactaaattcataaaccttctagcagggtttacaaaaccgtgcggttatcacgtgcgataaccttctcagtttttgatacctcacgataaccacgtggttaccacggtaaccgccaaaaccgtggggtggcagtaaccccaccccaaacggtttggtaaacc

SEQ ID NO: 55256 - DNA, 1005 bp, Oryza sativa
agtagaaggagacgatccaaagcagctaaaattaattccgacaagtgcagccgcgactacggcgcctctcttccaccttggcctcgccctccccctacacacaaaggctgggccttgcaccttggatcctttcctctcctcctcctcctcctcctcctcctccaccagctagaagcttctagaagccaaggttccttccttcactggcagctcgtcctctccaggagttactttaatttgtttcttcctcttactacttccttggcttgagcaagtcgccttcttcgatcttggcaaacctccctcgcactcttggctggctgtctgcaagagccttcctgcaagcatactgcaaccatgccaaacgatgcatcagtcagtgtcagtcagtcagtcagtctccttgtttgtactattattcatcagcctcaatcagcttctctaattaatcatgtagtagtaccttctctgtccttatgttctcttttttcttttctttgaaaaattaaaaaggaagaggacaatatatagttttaccttgatctttctgccaaagtttctcttcaccttcttctttctgtacctagatagcttctgcttcctttcttcagatttcaggtcactgatggttacaagcctctcgcaagatgctaattgagcgtttcctgagttcccgggtcgaggggtgctagctccaagattctgttggaaagacaactagcatcgtaagtacaattcttcaacaacctagcagggtctgcaaatgtttactcgaacaatctcacggcctttctaaaataatacagtatataaaaacaaaaaaccataggatatacacgtacgctttggcacctaggtagtctcttagaaaccaactttgtatgcaggagcttgcatgtaaaagtatcttgaaagaaaattaaaaccacaaggaaaaggcctactttgggcagaaatagtaaaatcagtgtcatagctttgatggcctttaatttgagtaaagaa

SEQ ID NO: 55257 - DNA, 1171 bp, Oryza sativa
gcgaccggcggcgagacgcggcggatggatggaggcagtgccggcggggaggagtgcgataggaggagcggcgatgtcgacccgcgacgacggcggcgtcgattcgggcgagcaggagtggcggtcggtgaaggcgtggtgggggcgcggcgaaggatgaggggagcggcgtcgacggttggatagcgagcgcgatccggcctgtgggggagaaaagtgtgattcgcggaggggaggagtgcgtgcgatgggatcctcagcaccgtccgatctgccaatcccacggttaataagtcgcgtgtctgctagggttggagtgactgtcaccactacagaattttaaaaagtagtagagatacaccatgcatgcatatgatatcctgcaaattatatccaaaacatatgttttattaattcaaccgtagtaattttaagttattgttttttattttttacaaaattaagatatggttaacattgtggttctataaaaccttatgaccaaaatacccatgattatacgaacatgcctaacctcctatgtagggatggtaattgtgcccgtttgcccgtttatccgtgggtaaaaaccctattagggttggttttgttcgctattttatacccatgggttttttattgggtcaaaggctatgtccgatgggtaaatgggcataggtattgtcagggttacggatagggtataccctctacccttagatatacgttgtatactgatacggtatacccgcgcgtatacggatatttcccgtgtacattaaggaaattcatcacaagatagatgcggaatccacagatagaaggagtcctactcggacagaactgggtcgttcctgtatcgtgtggggtccgatgtctccgagttctacttagagaccaactgacctgcggtataaaagtgaccccccgggaggacctaaggcattgaatcttactgccaacacatccaccacagcctacgaagtcggagcctacaagagccaagttgccgggtgatctagtcgaaccaactcgactacggtctcgtcggtatcatcgagttctgctattccatttgtaatctgtggattccattatataatcccatatcaactggattagggctattacctattaaggagcctgaaccagtagatccttgtttcctgtt

SEQ ID NO: 55258 - DNA, 3750 bp, Oryza sativa
ccgctttgcccatttacccgtgaaatctaacttatattgtaggctagaagcaaaatccactagaatacatcactactacaaaatcaatttttcatggcgtcactctatttttttctctggcggccatacgcataaaccgccattaaaaatatattgaggggtgaggggctaagtaccaccagcgaaaatagattttcactagcggccgagttaacttaaaatcgctcccaacctcacacttctccccaaccttatccgctcctctcccatccccatcccatcgctcctacccatctctgtctccgtgagcccttcctcctccgctcctctcctttccgccgccgccaccgcgcgctcttcctcctccgctcctctctcgcccaccaccgcgcgccctttcctcctccgctccactcccacccgtcgccgccaccgcgtgcccttcctcctgcactccgctcccacccgccaccaccgcgcgccgtcgacactcggcgaccacgacgacgacgccggccgagagagcggatccaccgccaactcaggatccggaggctcctcccctccctctgtaccctctccttctcccagatctagctggaagggagtggttggcgcagaggaggtgatgacgcggtggaggaagaggatgaaggggaggcgcggtggaggaaagggtggggtgtgccgatcagcgacgggggtacacgagagctctggatctgtcgggcggcggcggtgctcggcagtgcacgggtgtcagcggtggtcggcggtgcacgggcggagagacgtgcgagcagcagagctcggttgcgggaggcagatggcggatccggcggcgactcgttcaagtcctgcattggcaagttctccatcggcaagccattaggcaatccggcagccccaagtcctcggatcgacgacggcgtggagctccttcctccgtgacgagctgccgccgtggagctccgtcctccaccgccgtggagctccttccttcgcatcgagccgctgccgggagctcggagccttgggttcagcaaccgctgctgttcttctcgtggtgaggcaatgggtgatgcatgctgggattgaaacattttttttgttccgcaggatcgacagcatggttggcaaaattaattttgatttttgtgatggtgaaattgcactgtgaggccaacatatttgaatcgatgcttgaatttgtgattgtggacttgtatttgtgatttggtgagaagaagaggatgcttgaatttgtaattgagggcatatctgaatcggtttgaatttgagtttttgtatttttgcaccggagaatattttcgcaggcgatcctcttaagaatgcgcctgtgaaaattggttttcgcaggcggccttcttaagaacgcgcttgcgaaaaattgattttcgtaggcggctcttttaataacgcccttaaaaaattggttttcgcaggtggccctcttaagaacgcgcttgcaaaaattgattttcgcaagcggtattatgaccgcttgtgaaaaccaatgattctctggcctttacttactggcggggctgctcagccgccagcacaaacctctttttaccgccagcataaatgtttttttaagtagtgcataagctacgttctttgttttatgtggttttctttttatttcccttattatttttctcccacttcctctatcaccgccagaggagagaccccacaccaaggcagagaatatttaatgttttcagttcgattcaaacttagaagcttgtagacttttgtttcactgattttgttgtagccggtaaacgggcacgcccgcgagcgatgggcatgggcaacaatctttgcccgtcatgtagtaacgggcatacctacgggcaagggtatgggtaggcactgcccgtgcccgtcgcacccgattgccatccctactcctatggttttttgcaacttaaggtttgtttgtatgactaccgtcaagtgttgggtagtaccaaattaaacataggcaagtttggcactaccaattgtttgattgggtaattttgtatttagtttatagtgaagaaagttctagactgctaccaaaattagtatgggtgctaccaaaagtattggcttcaatccaaattaaccaatagtagaacaaattttggtagcaattcaaaactgcccttaaagcataatactggggttttgtaaaaattatttatttcttattttcaccctcgacttaacaagaaataacgaagcggtgacgataacaagtcaaacaggatagcaatttgcttagcttggtgtggcccagtagtttagtttggagttgaaacgatgatagcgaagtgtaaaaggcggtttggatttctcggattttccttctgtgcagcttagcccttttaattagaacaggtcaagcaaaactttgagcctttcgttctgtgagactgatagactacgaccctgtttggatcagggcacatcgaatgcttaacactaattaaaaatattaaacatatactaatgataaaacccaggactaattcgcgagacgaatctattaagcctaattaatctatgattagcctatgtaatactacagtaaacatgtgttggctatggattaattaggcttaaaaaatttatctcgcgaattagctctcatttatataattttattattatacttctaattagtatttaaacattcgatgtgacagcgactaaaatttaattcctagatccaaacaccacctaactacgccatgatttggatttcatgacatgcaccaaggacacacattggtggatccatgtacatgattccgcacgtgtagaaactatagaacagattttctgagctaaacgtagcatccatgattttcacatatatagaccagcaagttaatgttacttgtcaatttcatgaaacttcaataccagttattatgattcttttgctaatttatttttgagataatccaagaaatatcattgacaaacatccaaatccaagaaatatcattgacaagtgtaagttttaagatatgctatcgtacaaacgactttgtctaaaaatgccatcgccgttaggttccgttcattccgcgccgttaaatactataggatgaacaatgcatttaacgacgtggattggatggaaccctaacggtgatggtatttttaggataaagtcgtatgtacgatggtattttttggaactcacacttgtcgatgacgttttctagatttggacgcttgttaattatatttctttattaatttataaaaccaataatctgggatgatggcgtgggtcccttcctcttccccttcagatgttgattcaatcttccacttcccctttatacgttgattcagcagtaacattttatgatttaatttctgtgatttgtttttagtttttggaggctgcgtttgtttcagcctgttactaatctctctccctcgttttccacgtacatgattttcaaaccgctaaacagtgtattttttaaaaaaaagtttctatacgaagattgcttaaaaaatcaaattaatctatttttaaaaaaatagtaatacttaattaatcacgcgccaaagaactagtctgttttccgtacagaggagatgggttactaacccagtaacgaacacagcctaagacttgaatggagtgtgtagaccggatgatgggggtcggcgccatgcaaattggctccaaagtttaagagcaaggat

SEQ ID NO: 55259 - DNA, 2584 bp, Oryza sativa
atgtgttgggttcatccctattttctggaatatgatggttctattttttgtttggttagagggatggagcgcaccctattttttgttttgttagagggatggagtgagatggaatggtcccatcacctgtttggatagagggataaggtgggatatctggataaaaatacttcctcaactagaattggtgaggttacttctcacatgaacaatatatttttagcacctacaaaaatttaataaactctcacacaaaaaatacattcgtagcagccccaaaaatttaacaaaaagataaatatgttgccatatcatgctcaagcactaattaatcatctcatcacaaattacttgcacacatcacaaactaattcttgctcacatgaaaaaaatgtctactgaaagaacatgtacagatctgaaacgaaatccccatccaatgctgtcgttgggattctaggaggattggagaaggaacatcacgcatgctgctgacattggaggccgacggcggatggaggctggttggacaccgccgtggccgccgacggctcacccctgctcgcgtgctcctgtcaaatgagtttccgcaaaaggtctcgaataaaaaaaatccagagtcagcagtcagcactcgggtaacgcaatcgacaagggttgagctagttccaagcaagtgtttccttcaacttctctcttcttttttttttttgaactgctgagattgtgttttcttgcacggatcctggtactatttggacagacgcaggcaggggaaccttgaagtcttccccggcacagaggatcgggtgtgtttcggggggcaacaaggtggcgtggcgtggcccccacatccagcctagaagtagaaggccgcgagacatcctggcctgacctcaaaagcagctccccccctccccagtctctcatccgctctaccgtgcgcgagcgagaattttaaaataacataactttaataaaaaaaatataaaaatacattttgattgattaaaaaaacacaaatttagcaccttatcaaataatcaatatctattgaacaatcattattcgatttgtatttatcaaacaacgattgttcaacaggttagggtggtctaccgaactcgataggacccacagcccacacgcatgcatgcacacacatcgaattctctatttttttaaactctatcgaacaatgtttgtttgacacggttattcgataaggtgttaaatttatgattttagttaataaacatttatttttataatcttccattaaagatgtactatttcaaaaagaaagaaagttccgagcgtgatgcggctctcgtgtggctggactgggacggcaggcagcggctggccacacgagctccgccacacgatgccgcggaccggaggggcagtctcgtccactcggtggacgggcggtgcgctctcgcgcgtcacgccgcgaaaaaccaacgctgcacgctatatagactatagccggttgctgacggcggctggtggtgtggccgaaagcgtgccggccacacgggcaaatagccatattacaataggggaggaggaggaaaaaaaaagaaactatatgctctgctttgagctttctggtggttgatggtcagttggtcacacaagaaaaaaggcaacttgagtcctcccatctctaaccgtttttcctttttcttccttttttctgcgtttcatttgctgtcatgagtcctgacaccctcctatatggaaaaaataagaagagtcttgacaccctggtcctatgaagctgtgctcgtactcctgtggcgtagacatgcaggtgcatgtggtaatgtgggataaagggcctgttcggctgtctggtacagccactgtacgtagctgttgctgctacagcagcagactcaacttactgtttgggttggctgcacaacaataaagttaagtgcagccgaataggcccataatccttgagaacgttagaaaccatgcaggaagcccattaaaaaaataatgaggtttcctataatttcgtatgttttgtttaagttccacacaaccccaagatcctatggccctctttgaaatggaaggattgtcaaaataattttagaggatttatttttctaaggatttttttaataaaatcctttgattcataggaagatgatatgaaaattttcgtaggattgttttcaccaattctttagggaaatgagcaagtgactagacctcttgtgatatttttatttggttgatttttttctatggtacaatcaactggctcatctttccgattattgtgttctcaattactataggattataaaacatacttcctccgttttatattataagactttctagcattattctcattcgtatgtctagattaattaacatctactccttccgtcccacaatataagggattttgagtttttgcttgcaacatttaaccactcgtcttattcaaatttttttctccaaatataaaaaacaaaaagttatgcttaaaatactgtagataataaagtaagtcacaaataaaataaataataatttcaaatttttttgaataaga

SEQ ID NO: 55260 - DNA, 12852 bp, Oryza sativa
ttttttctgttcctatgtgttttttcacctgtgtttcaaaaggggacttaaattactttttatggcaacctatgttattgaaatgtcgggcacagaacattttcagtgtaggagaaaataaccattttttcttgaggaccaataccaggggagtgaaacttgatatagttattgaagttcagagtcatcattactgaccggtcatctttatgattttgaattttatatggataatgaaaaagactagaagggcaatactaatatatatagagttaaaaaaagagaacaaaatattggaacatcactttgaattctacacaaacctatattttgtgcttaacataacattaatatcgagtgcatctttttctcttcacatgctagtgttttgtgagcgggcaaacgttgttccgaggaagtaacgcttaagccatcaataaaaactattttcacatacaatgttttaactgttaatccctctctttttaatcaccatcacatattatattatacatccccctcctatttgaagaagaagtacatacctacaaaaatgtttagtaaccttccgattgacaccctttatttattttcttttcaatcataaggactaaaacgaaaatgccaagaggaaaaaaagtgaaattccgagaagtacaagcccttgaagcgaaaagcgcaggtattttagctgccttgctccaagagagcagaattcctcggttctttcaaaacgcaagggaactaaaaacgaaacaacctgtaattaccatttctgtccctttcccctcccctccacgactccgccgccgccgccgccgccgccgccgccgtcatcgccgccgtcgccgacgacgaagccgacacagagccacacggcggcgcgctcgaagcaatcgaaccaacaagcagccgcgtcgaatcgcataggaggaagagagaagttgggggcagcaaccaacagctaggggtgggtaggtggtggtggcaaagcagcgggggtagcgggaggagaccggggcggcgggcgcgcgcggtgccctcgggagctagcccttggccccgccgcctgcgccgtcgcgccgatctccatcgccaccggcgagcagcggcgccgggggcgtcccgctgctgcttccgccgcgtgctctgagcgtctgattcccctcggccccgcggctcccgtctcctcgcgagctcgtctgcccgccgcctgcgccgatctccatccatcgcgagcagcggtgccgccgccgtcgtcatggtgagcaccccgtaccgacgcgcatcctcttcctttctcatctccatctcgttctacgcacacttttctcgaattcgcgttatccatatcttctcttctagatctgggactggaagctaggttttctatttgtcttaactttagtacgaaaacagcattttttccccaaaacaaaaagttaggggttcaactgaaattgctcatagtagttccatcattacttggtactactacacaatttttcattgctctcactgtagtgtagttacaaattgtttagctgcctagtttgccaccttacgagaaacctggactcatgcaaaattgggatagagcaacttggtttggagctttggatagtagtaacttggtaggtgaaatggctcctgcgagtgacatggatgacaacaatggttagctattatttgcggagaaattgattgtgcaataatgtgaaggacgcggaataagatgtttgcttatagcttcgtgtgaagcatggtattgtgttttacttttggtgtgcttgttgaagtttgctaggtgatgtttgaaatggaaccgtgccctttcatatgcattatgagcagtttttaggtcccgagtcctgacacaactttctgaactcgaatatttattcgaaaagctctaactaaaacaatttgaggagactgatattttcatgtttttgaaccaactagctaggattaagcttaaatattactgaaactctgcaaaacttaaatactaaggttttgaagcaactagtaaggaaatgctattatactttgcaaaacttataaatactgaggttttgaaagaactagtaaggaaacactattatactttgcaaaacttaaataccaaggtttttatatcatgaattcatgatactctgataccgcaaaagacaaatactaaggttttcaagccttaacaagtttgcacatcacaaaactgattttgacatattgcatggtaagtggactagtggagtgaatgttagcctgatgttttagtgctctgatttttgaatcttatcaatcttctagatgagaccccgtgtttttgctgtgggaaaattgcatgataaaatggtaggcataatgagcgaagtcggaattttcttgttaccaaatggtttatttcatgtgctttgtacgataagaacctttaatcatttctccaaaggctatacataattgatatgcatggtgtggaaaagagagacaatttgtaccttagaacaatcacctaaaatactatgaaaacaattgaggtaatgtgtctacatgagagatgagagaattagcacttactacagttagtgggaggcaactatgtaagtataggatacaatcattggaggaattgttaactaaaattcacctgcgagatctactatgaatccacctatgacctacacgttggaggaaaaaaaaagaagaggacatcgaatcactcattccactaaagcaaatcctgtgtttacctttcggctaaaatccctatttcttgaaaagccttttaatgatatgtcatatgacgtattcgtcaaccctgagtgtctgatgcttggtaaagttggcagcgatacgtcatggacgtctcctttttatcctctgtcatgtccaacatacttatgcatattctcagttgtcagttatatatgacaatttcgcaagatgtaacacaaccctctgcatgagaatgagggaggagtattagatcatccatcaaagccttaaattattcttagttctgttttatctaggcatctgtttgattactgcaccatgtgttttgcaggggactcctgttaatattattgttggttctcatgtttgggtcgaggacccaattctagcctggatagatggagaggttgttagcataaaagacaatgaagttcatgtgcagacttcaaatgggaaaaaggtacagtttgcagtttcttatcttgcattctgcagatcatctctttctagttcttagtatttccttaaaatccttcaatggatctattttgctctgttttaatgtacaaggagaacttcgcaatactgtttgtttagttatttatatgtggcttcattgtaaccatggattgtatcattttgacataaaatggattacgagtttcatcacaagtaatgcttttgcacaggttaagacaaataaatcaaaagttttccccaaggatatggaagctccaccaggaggagtggacgatatgacaagattatcatacttacatgaacctggtgttctacagaatcttgctacccgttatgagctaaatgaaatatatgtgagtgccttatcatttctgcccaaaatcttactttagatgcactacatgactagcgcatgattatcattctgttgcattcccagacttacactggcagcattttgattgcggtaaacccatttcaaagattgccacatctctatgatacccatatgatggaacaatacaaaggtgcagattttggggagctgagtcctcatgtcttcgcagttgcagatgttgcttacaggtgaactgttgtataatattgatattgccatatatatgatcctgtcagcagattgtactttttatatacctacatttccctgatatgacctattaatgcgagcaaccagagcaatgataaatgaagggaaaagcaactctatattggtcagtggtgaaagtggtgctggcaagaccgaaacaacaaagatgcttatgagatatctggcacacttaggtgggcgatcaggagtagaaggaagaactgtagaacagcaagttctagaggcaattcattagccttctctttgtctgcatagtaatttatttttcaaataaaaaaaattccgttggctgattacctaataactgatataatttcagtcaaacccagttcttgaagcttttggtaatgcaaagactgtgcggaacaataactcgaggtaagttaaccttgttgctttcattttcttttcctttcattgacacttcttgctttatttggacatcaccaattggttttttgacatcctcatttgctttacgattctggtaaagtcgctttggtaagtttgttgagatccaattcgacaagactggacgcatttcaggagctgctatcagaacttacttgctggaaagatcccgtgtatgccaaataaatactccagagagaaattatcattgcttttatttcctttgtgctgcacccccagaggtatgttttcctgttgatttactgatatttgtctgatattaatctctgtttcgaacgtggaactgaatgtagcctaaagggtattctttactatggatatacatatgcaggatacacaaggtataagttggccgatgctagatcctttcattacctcaatcagtcaagctgtattgaagtagaaggaattaatgatgctgaagaatatttagcaacaagaagggccatggacatagttggaatcaatgaggaagagcaggtttgtattgtattgtgctgaaggcctgaagctgttggaaatactagtttgaggactaatggtaaatacgtaattaccaaattgtattacaggaagctatattcagggttgtagctgctatacttcatcttggaaatataaattttgctaagggaacagaaattgattcatctgtgatcaaggatgacaaatccaggttccaccttaacactgcagcagaactgttgaagtgagtaaatttcttcttttattattttcctatatgttcagggtgaccaaaaatcatattgctaacgactaaaatttcttaaaggtgtgattgcgataatctggaaaaagcactgataacacgagtaatagttactcctgaagaaattataactagaacacttgatcctgcttctgcacttgttagcagagatgcattagcaaaaacaatatactcccgattatttgattggtaatgatcctttccctttgccctggcagaaaaactcaattagatttcaactatgcatcttgacatttccccactattactgttatcttcttctcaggattgtggagaagatcaatgtctccattggacaggacccaaactcaaaacagttgattggtgttcttgatatatatggttttgagagtttcaaaattaacaggttagtgttttgcacctttttcaaactaggccaaaaatccatttcataacatacgctaaaacagcaacgtgttgcactcctctaaacagttttgagcagttgtgcatcaattatacaaatgaaaagctgcaacaacattttaaccaggtacatcttgaatttgttcttgaaagagggctttgctctagagattgctggtttgtgtctaacgtgagatgtttgtcctgcagcatgtgttcaaaatggaacaagaagaatacaccagagaggagataaactggagttacatagagtttgttgataatcaagatgtgttagacttgattgagaaggtacacatttcatcatatcttacatgctatgagatggcatattttggctatgcaaatgtataccaaaatcccttagattatggggcggatgtagtataatataagctcttcaaaagaatatatattacaagctaaatttatctagttccactataagcttttcggaatattagatgaagagatgggataaaatttcccaaaaaaacctattctcatcctacaaatgatggttgggcaacaaggcttgttcagctgttcctatggggttatatctgcagtactattcctgccaataatagtgtcagtaattataaatcagtaagaaaatgatccaatttgtgttctcattttgaaatgattatcatgtaggctcctagtctgtttgatgtttgctgctcgagatagcttaacttaggctagaggaaaatctgttttgtaagttttgaaccttcagggccctaccatctgggagtttactgatttcatggattaattaaattaatctgtttatttggtgttatgtccttaggttgtaggtctttttggtaacattgtacttgcagtgcatataatgtttcaacagacttgtgtcagatagtatgtggttggtagaagaaagtctcctagctataatgagctttacagattcccttcatacgtgcgatgcttctagttctaggatgagctaaggcttgtccagacagcatattgcttgttagtatttgattgtggaaattggaaacaacatattgcttgtaataaccttttattttggagttctataaaatggcaataacatatgtttccgtactcgcagaaaggtggtttgatcgcacttctggatgaagcatggtatgttctggaattcacaactatcattccaaaccacttgcaagcaacatatatatcttcaatcactataacatctggatcaattgtagattatctcaatcctgtgacatgtaactgcttgcgaattaataatgttttgcaaattttgttcgcagtatgtttcctagatcgacacatgagacgtttgcgcagaagttgtatacaacatttaagaataacaaacggtttgccaaaccgaagctttcacgcacagattttacaattgttcattatgctggtgatgtaagccttcttcattaaaacatatgtgtattgttacagaaggtaaccatcatactaattagacatcgttatgtatcatccacaggtgacgtaccaggctgattttttcctagacaagaacaaagattatgtagtggctgaacatcaggatttgctgaatgcttcttcttgtcctttcgtagctgctttatttcctgcactccctgaagagactgcaaaatcttcaaaattttcatcaatcgggtcacgtttcaaggtgaaactttacttgattttgttctagcttccacaatatggttggaaaaatttgtagtagcatacaccttacttatttacacatcctaccttgtttgtagccttaaaatggtaccaatgtatcgtatcagaagttatctagttaatacgtgcatcctttttaaatgttatgtactacgtatgtcgctgcatcagtgttattcaaaattcctagcatgtgagttctcacatatccttctgaccttcccttcgtactctcctttggttgccataatggcggcgtatgacaacactgttgctcacttcctcctgctatacatagtgacatagtcattaggtctgcatgtatatcgtacagaaaaaaaatggtgttgttacatctgtaaagattgctcaagtcttcactaattatatttataacctctagcaacttagcaagtcaaacaaggcggtccctctgtctcaaaatgtaagttatcgtgcagtcaaacttctgattcatgtaaaagtatatatagattcgctgcatgctaatgataccattcaatttgtcttcctaaataatttcatgtgataatataaatatgattaaaattcagtgcagaagtcttgctttatttctatctgggaaagtatatcttgtttacagtgctgctgaccttttttgtgtttacattcctgctgtccaactctcagctgcaacttcaatctctcatggagaccttgagctcaacagaaccccattatattagatgtgtgaagccaaataacctcctaaagccagccatttttgagaacacaaatgttatacaacaactgcgatgcggagtaagattcacatgttctattattgtttttatgctagcttctggtgaactaatcctgacaaaatgcagggtgttcttgaagctatcaggatcagctgtgctggatatcccacaaggaaaacattctatgaatttgttaatcgctttggtgttcttgctcctgaagttctagaaggaaggtaagaaatccagttgaatagaaaacatagttttttgttgcataagttttttttttttgatgtttcaagctattcacttttatcttgttcttgtacctagcaatgatgataaaattgcatgccagaagattttggaaaaaatggggctggagaactaccaggtaatacatgcaactaggccaaatgcccatggtgtatacatgagtttgcgccattgtgttaacagaatcagtgaaagcaatgtttgaaaaagatgcatgctgtgtatacacgttttgaggttttattgttgtcgtctttgggttagctcttacataatctcttgattgtctttcagatcggaaaaacaaaggtatttctgagagctggacagatggctgatctggatgcacgaagagcagaagtgctaggaagagcagcaagaattatacagagacaaatctctacatatatcgcacggaaacagtttgtttcgctcagaagatcagcaacacagctacaatctttcgttagaggtactcctccccttctgtataatgcagtttctgcagcactggacagattttatgcagctgtccttttccctttttttttttgtaatctagggaccttggcgcgtaaattatacgaatgcatgaggcgggaagcatcagcagtgaagatacaaaagaatgttcgtcgtcacaaagctcgcgtgtcttatttacaactacaggaggctgcaatcacgttgcagacaggattaagggcaatgtctgcccgcaaagagttcagattcagaaaggaaactaaagcagctgtccatatccaagtatgtacggtttcaattacattgttttgtaatagtatttcatcaattttacaaattatgccatggcttgagaagtttaggtccatcatgtttctgttctatttgtagttttcctttgttgttgttaaaacacttattgtaatattttttgatgaaacacattgtaatattgtgttatggcatttttaaacataggctcgatggcgttgccacagagactatgcacattacaagaatctgcaaggagcagctcttacttatcagtgtgcatggagacaaaggcttgcaagaagagagcttagaaagctaaaaatggtagcttgttatccctttgcaatcttcaaatattctttaccatagtatatgtcatagttgtgtttatccatgaatcgtctgcaggctgcgagagaaacaggggcccttaaggaggccaaggataaacttgagaagcgtgttgaagaactgacatggcgccttggactggagaagcggttaagggtatgttgaggctgacgtgacactatttgggcttggtagtttggtacttgatgcttaagtgtaacattctcaatttgcagactgaccttgaggaagcaaaagcccaggaaattgctaagctgcaagagacattgcatgatatgcaacagcaagttgaagaagcaaaggctatgattgttaaggaaagagaagcagctagaaaggcaatagaagaggcacctccagtaatcaaagagacccctgtattggtcgaagacacggaaaagattaactcactgacagcagaggttgaacaactgaaggtatggtagaatctgaaagtggttcctagtagttggtgcatgcataaatacagccttatttttacactgatcttttaatgaaatgatctttagctgaggcatttttcattgacaacaatattagcttgccttgtgaaaatttgcaaggtttatgccatacttttgcttatcttatgaaggaaatgttattaagtgtttagtgaaaaagaggtcatgtggtttttgttatgtgtgctaagtttgaagaaatccctatacgcttagaaatcccatttccacaatttgccaccctcttcagaaaaagactgatggtagtagtggaccctgtgtatttggaattcaaaatatatgttttttgtatagttgaacttacgtcaagtttgaagaaatccctatacgcttagaaatcccgtttccacaatttgccaccctcttcagaaaaagactgatggtagtagtggaccctgtgtatttggaattcaaaatatatgtttgttgtatagttgaacttacgtctgactgtgatgttttcaggctttgctgcaaacagaaaggcaagcaacagaaactgcaaagaaagaatatgctgaagctgaacggagaaatgaagaactatcaagaaatttgaaggtgcagagaaaaagattgagcaacttcaggatactgtccagaggtgaagtctaaacaacgctatcagttgtcattatttcatttcgttgtttgtaatgcttttcttttgttaaggatgatgcctctgtttatacttgtattaactcctttttcttcattctgaatggtctttatgtaaaattgagcacaggctggaagagaaagcaactaacatggagtctgagaacaaagtgctacgtcaacaggctgttgctatttctcctacggcaaaatcattagctgcatatcctaagtctcccttccaagtattccatgaccctgactacttgcattctgtattaatataattcttttcaaatttcacattgatggtctaatatttcaaatcaattgtgctttgttagcttaaaactccggagaatggtgtagctccgtatggagaagtgaaaccgttacctgtaagtggaaagaataatttgtgcatttgatattcattcaaaagttgctgatatttggtatctctgcataggatatcacccctatctcactcaaccctaaagagcctgagactgaggagaagccacaaaaatcactcaacgagaagcaacaggtgtgtttttctgtttgtttgacatttctgtcctgaagcaaatttcacacctctgtttatttgaccctgaagttatgactattgtgagttatttttcatactgtatttgttttatgcttcaggaaaaccaagatatgctgatcaaatgtgtatcacaagatctaggtttctccagtgggaggcccattgctgcttgccttatatacagatgccttctgcattggagatcatttgaagttgaaaggactggtgtttttgaccgtataattcaaacaataggcactgctatagaggtaataaataatatattgcttgtccattccgctttacctcctttttcttggaagttggaaagctgcatatgatattctgtttgcctattacagatatcttaggcttttgctgtagaaattgaaaaacagaaatactggagcttaaaatttttaatgctgctataactcgcaccctccgtccccccaaaaaaaacaacttctggggatactgtcagattcatccccagaagttgtccttttttgggatggatggagtatagattaaaattcgtttacccttaatgttttttatatccttaatttgctatatagctaagtttaaattcttactttccaaaggcccaggaaaataacgacaaactagcatattggctctccaattcatccacattactcctactattacaacgaacactgaaaacaactggagcagctggactcacacctcagaggcgaagatcttctgctgcatcatttgggcgggtgttctcggtaaaacatatttcatctctgtttgttttactcttaggattttctagtccgaatatcttttaattcaccatttctgaaattaaaagggaatgagagcttcaccacagagtgctggccgtccttttctggctagccgcttgatgggaggaataggtgatcttcgtcaagttgaagccaagtatcctgctctgcttttcaagcagcagcttacagctttccttgagaaaatctatggcatgataagagacaacttgaagaaggaaatatccccattacttggtctttgcatccaggtatgaattgggggcactagcttggtatttgtttataaaaagagagtgaacttcaggtttgttttttttgtgatgcttattttttgcaggcgccgagaacatctcgtgctagtctaattaaagatctcgttctcaagcgaatgccttggcccaacaaaccctgattgcccattggcagagcattgtgaaaattctaacgaactacttgaatgttctgaaagccaattatgtacgtaagcaatgtgttctcacatacaattttgattgagttgacattaacttgtgctgtattaaatgtgcaacaggtcccttcattcttaatcagcaaggtgttcactcaaatcttctcatttattaatgttcagttgtttaacaggtaagatttggtttttgctttacctgttctacgtactctccttctgttgggattttgagatgctccttatcttgtagtctgcttcttcgacgagagtgctgttcatttagcaatggagaatatgtcaaagctggactggcagaattagagcagtggtgtatttatgcgactgaggaggtatttatggaccttttaagtttcctggagatcattttaatcttgtgctaacatacgcattaatatacagtatgcaggttcttcctgggaagaattgaagcatattaggcaggctgttggattccttgtaggtgttctataccgattatttgttttgtttttgattttctggatcaaaataggataatctaactggttgtattattaggtaattcatcaaaa

SEQ ID NO: 55261 - DNA, 2244 bp, Oryza sativa
tgctggacgatgattcaagggttattcccttacaccaaattcaacaaaagtcaatcacacctgaaaaagttgttctctaacgttggccatggtacttctgattgcagcattccgttttcggtggatgatatctcaaagtcaatgaaagaaattgaggtaacagatgttgacatgccgcctttgatcagggagaactctggctttaccttcctacactaaagaaaggactatcaagagtggtgatcctttcaatgcaaaacatcttcctattctccttttgtccaactcatctccaacttgtgcataactcatgtacatactactcgtgcccttttgcccttttaccaaaatcacatggtctagtctggtcagtaatcgttaggcctatttgttatttattatttaggacttcggtttgatttgattggttctttgtccaattttctcccctttttttctgggggatcaaatttatattgtaatgggaggggccggatgcccctccctggtcaggtccccgagctttgttaaaaaaaaaactcgtgttcctcttagcgtctggaaaaggttttccgcatctgtgtcgggtctccggtgtcgttcatttcaatcttcaccgtattgtaaattgcaaagaagatcatagttgaaaaaaaaatcacattgaaaactgaagcttttggtgtattgtgtgattctgtctgccccaattttcatccatttctagatctctttgatcagggatgcaacttagacccaaaaaaactagatgtctcgttccatccgagaatcccatcaagagatttctcaaatatataaatcacccacaggaaacatcaaccccaaagaaaagaaatgccgaaatgaacaaatgatcccaaatgtaatgttggcgtaccaggtccttgtcgccggcaaggcaatgtttcccgtcaatgaattccttggtgtgcatgtcgttacctctgccaccgcgcaagagaggttgggagacttgggagttggagggagatgatgatgtatgtcgccgctatgctatatttgtcttgtgccggattccagggatcacaactcactagtgggaaggtagttgttgactcgcccaccaacgatatatggcagattggcaggtacgaggtgcaccggtcactagcgagcgatgcatccgaaaatcacagtttctcagtgcagcagacggctccaaaacggatggactgcttggatctgactcagtttcattactccctccctccagaattcatcgtgttcgcattgagaccaaaggaggagaaaatcgacccatactctatttaattagcgtatcgatgaaagaaaaatattacttcactttagtggatgtgtcatatagtgcacacgaaggtgaagggatacaatgaggcactacacgcaaacaattgcatgcgcatgcatgcgctgatccatttacttcgtaaaggtaaatggaaaaggaaaagacgctgagagggaatatcaatttaccaaaatacaccgatcatttctgaacaacataaaaatatgataatctagactaatataaaaagcacgagttgtttagtgcaattagtacacccacctattcctaaccatcagatcccctcatccaatgatgcaaattagaagtaggattaaccttgcaattagcgccggattaactaccgattagcgcttctgaatccttttcttcgcaaaaagaaaaaaaaaccgtcgcccaaagccccagaccgcccgcgcctcctcctccaccttccgccgccgcacgctcctcctccgccttctgccgccgactgcccgcgcctccatcgtgcctcccattgccctcgccagaacagcgacgacccccttgctctcggcgccgcatcccgcccctccgccgtcgtcgtcacccgcgatccctcctcccttgctgccgccacgccgtccgtccgttctccacggcgccacctcgccctcaagctgtcataggtatgccgccagacggtttcaggtcgcgcctcaacaggtcgtcgacgatcccccaccgtcacctgagatcccctcaccatcacccgagatccccttccaggggcggatccaggaacaaaaatttgggggggggggggggggggctcaattacacagtttctttaacctctagccatttagggacctttagtttatcattcatggtaaaaaaataaagaggttgctccgggggtatccatgggtcttgtgggtgtagggggg

SEQ ID NO: 55262 - DNA, 11984 bp, Oryza sativa
agattatttatgtcactggttgaggagaaatatttcagattcaggacagttagccgcttgaaaccttcaaacttctgaggcaagctgacaatgcatctttttaagtgcagataatccaaatcactgatagagaagaggctcgatggaagcttataattattcccattgtaaaacttaattctaatagaccttgatttttttcttgacagcatgtacatgcacctatcaaatacatcatgatatgttctgcaacatgccattgaaaacaaagctagaggtccattatggaacagcaatgccagatcaacgagagttataaatttggatcatgttctttcagaggaatcccaattgtgatacaaatcagacagaagtatttcgggcgggacctgtgctttggaagagcgtgtgtggagctgattagtatattgggtatttagatgttctaattctttgactcttttggttcgatctcccttggttataacgaaacattctttttttacttttggcataaaaagctaatttgtgcaaaaattgaaggatacaacattatgactactcccaaggatgtggttaatgttgaaaaggttgattttattggttattcatgagaacatgaaagatttatattttatttatgtagcctaaaaaggtaaatctgaatttctgatttaatgtggtactgcaatccaccatttgatttctatagctagccacgctaaaaaaactgccataattgtctctgcagttaatacaagcatatgcaaatatgctgggatggagtgagcataatggaagaacggcctttatttgatggcttttagctttaagatgctcaatgaggagggccaaggagattttgttcttttatttgccattgattggcctttggttgatatatctgagttcatgtactccacaggcaaaaaaaaaaaaggtaatatccatatatgcaagattatttctttactttaggttttttactattttactatgaatagacaaggataaatggatatattttcatagtatgaacctattagatattagataagctcagcttagtgtatgtagaggtacaaacaactgattctgaataggaattgctactctccttttctggtctacgaatttgagtgtgtaccttttcattagcaaggcttaaatgctcccaattagcagttgttggtgaattgatagaattttggtaatttttggtgaaatatattttccaaagagataaaccttattttagataaagaagatattttattttgaagcagaagatgtgctatatccccaacctctgccccaggggcatgcgacgcgaccaaaacgcattccatgatgctctataagtctagaactactacaacatatataatttcatttttatatcgagcactactacagcatacataattttcatttttatatcggcattgatctgggattatcctgccattgctcgcaagttgctaataggtagtccttttattttcttctttgcaagaggagacaaccttaatatatacctggtggcacctctgaccacaggtttggaggatggaattaggcacaatgtgatgcatatgacttcagtggagcaattttatcaggattgcaggtttggtggatggcattaggcaaggtgatgggcatgacttaagtggagcaagttaatcacgattgtaagcttggaggacaccattacttaagcatatttccctgtcagaataatatttgatattcacatgtttgtacttacatattgcttgatctctcagttctatattccctctgacaactacatgaccatagctacatgttgctcaatgttttgatttgctgcgagctaattaaagttatgagttcttatagctcaagtactgaaattttacaaattcaccaatggatgtaaggtttgtctgagtttagtgtctgaccttggcccttgcaggttgtgtaaacaatatactcctgttaccatttaaggttacaatttattctctacaaattcatactaaattcatattatacaagttcatgcttaacaattgatttggatttctaggtatttataaaatccagattattttgtgaacgtgaacatggaatgtatctaaattcagcgtgtggacacagccttgccatgtttctcaagtcagtgtatgaatatatccttgcgcacactgtttccccctatttttacttttcttaaatatatattatatgccggtgatgacgacggcactatacccatcccgcggtcgaacctcaacggccagctcgacgacatcgcggaccgtgccgacggctcggacgtgttgttctccgtcggcagcgagacgtttcatgcacaccgcgccgtgctcgccgcgcgctcgccggtgttcaagatggagctcctcgggtccatggcggagtccaccatgccgtgcgtcaccctgcacaacatcgacccggccacgttcaaagctctactacacttcgtgtacatggacgccttgccgtcgccgaccgaggcggtgccggctcaacgtcgacgacgaccggatttttcgagagcttgctcgtggcggcgaacaggtacgcattggagaggttgaagctgatgtgtgcacagaagctgtgggagagtgtgtcggtggagacggtggcgatgactctaggctacgcgcctacgccgagaggtaccattgcccggagctaaagagcaagtggctcagcttcttgatggcggagatcaacttcaagaaggtggccgtcactgatggctactttcatcttaggcgggatttcccgttaattatcgaagagataaaaaagcggattgagagttaaaaactttacatacatctatatcaatctatattaatataaaaaaacaccagttttctatttagtacacccacacgttcctaaccgtcagatcctctcatccaacgattcacattgcgagttggcaataatatatattatgataatgtgccttgcacgtgcaagttcactagtcatttataaatggagggggtagtaaacacatcttggtgctaaacaacataaatttatctacaacttttttttatccagacaattagttccaacacctagcaagcacctatacaagtttgtgtatcggaacacgagttttccaagatttttatactagatcgcacccatcgaataagctcatataccactttaaaaaatgaagaagtcatgggaaggagccacgcaatagtcatggggattattataggtgacttattttttggtcggcctgccttattcccctccggtgcactaaaacaatgtggagggtgtgaactcgacagccaacattgtgcttgcccttagagcattcaatctactacgcgctgacaaatagatgccctacacggtggctctagggtgtattcttttctccttttcaatttttactccctcatttccccacacatgctttccaaacggcatgtattttaacaaagctttcatataaaaaaattgcttttaaaaaaatcatatttatctattttttaatttttaagctaatacttaattaatactccctttattccaaattgatcattatataatgttctatataatgtttgtacaatatacatacttacattgattaagataatgcacaagtacacccttagcatgcacgtataatgcacaagtacacccttagcatgcacgtattctcctcctgtgatgcatgaattgcactccaataaaatccgtattcatgaggttatatgatgatcaatttgtgagtgaaggagagagtagtgcgctaatccatcactcgtttcacgtaccacgtcccaacccacgctaaagaacacatcataatattgcaccgaaaatgccctagcaagctttgtataccacaacaattggaatggttttcaaattttaatgacgcaagcaattcctcagtgcgattattaaaaccttctgtggtacagccatacagaacagtaaaatcaagaacggaaatacagaacggcctctctaagaccttctggatctgagcttttaaccaaacagaaagcatatgaccaaagcacggtagttcaaggataaaattttcaaagacgtcatttggatggaaacgggtttcttattgcgaccacacttcctcacgaacggcatctgcagaaaagaaaattaagaaaccatcaaatcatctgacgctccaagtaaaagataaacgaagaacacaaatggactacaggttttgtaggtaacaacacatgactgggtgacctgcaaaaccataaaatttacaagatcctatcatcaggcaacataaacagagatactaaacaccacaacaggggtctaaagacaaacttcaatagctgagctgatagcatttttccatgaacaaactacttgcatttatgaggctattgccatgttcaacaaatgtgttagatcaagtggaaaatgaacacccaaagaactctataattttcgtaggttgattggaaaatcaaaatattgcaataatttgctcgcaatctataagcctgaagttaacaacttggttttcttttgtttgcaagcttctgataatgtagcaaccatactcgaactgagggtgggtctgagagactcagtgtgcacttccccagattcccgtcaagcattaatatggactttactagcatctatttatatatcataatccaacagttcaaaataaaagaaaagagcaatgaaggcagtcaaggtacttactccccattcaacattaacatggatacgctgtaaaatatacctatataatatcccattatttcaaattaggggagctgaacaattcatgagaggtaaacacatgaaaagagtaagacactgactccagcgcccaaactataattgtttcttatcatccagaccatagaggcccatcgaacattttcataactaggaatcccaatggacatactctgtctctaaaattaggtaaatcaaactatcaaagacatacaggagtctataagttaatagcagcaaccaactaatcataaaaaactaggataatgcgaaactataagcacactagcctaacaaaactttgatagtgcgagaaactttgtcagggtaaaatttatactagttaggagagaaattttgatagtgttggaaaaaaaaggcttccatccaaacatcaacaagatactattgaagataccaacaatttggtgggtaaagttatgtaaaagcattgtaggaataaacataaacaaaatattactaaagttggcagttctagcatatgcagcaattatatgagtatatgttccagcatttgattttttttttggatatgtcaactgaaaacataataactactttaggctcaattttaaaatccgagtctgttaaatatatatgtagttagaaaattttaaagtcttagtctcaccgcttgggaatacaggcatagttaccaacacgtcatgcatcatctatgaatttggaagagctaacaagttgctagattcaaattcaaaaatattgtttccttaatgtgacaccaaaacaaagttaagaaaccattaagtatttaacacaccttcttcctcactcaacttcatgttttaaagaaaacctagagctgtgacatccatctgcactgtatgagtcaacaacctactcccaggataatagttgaacgaacctacaggttccaaacaagcattatttccctgtccttgactcgatacattccggcgacatctcccgaatctattcaatcaaccatgtattagagcatggccaacagtttcccaatactcttcccaataccagttttgaggagttttgcaggaaaaaatcgctccaacagtatacctaaatcacccctaaaagcttggcgtttccaaacccgtatatttcgttctcgacttgtagggaagagactcggcgcccaatccttcgatagcatgcacttcgcgcgtgctgggtaaaaattttcctaccaggtttttctttgtgcgttcgtccgcctgtgagtcaatccatcatgccagcagcctcatcttccccgcagatgtctggaaagcagccatggctcccccaagctttcacagcatcgacattttttctcagtggcggcgccggacccatctccaccccaattgggcagaccttcgtcggcactcccaccagaaccaccaccgaatcgattcggccgtcgccccgattcatctccaatcgtccctcgaccctaccgcgtcccgcaacacagcctgtccctcgtgtcagactggcgctgcactgtctcaggctcccggccacccggcgccctctggtaatgtgcaggagacaaaggccccatgcgaccagccggcgacagccggaggtgcccagtcgctggccttcatcgaatcatcgtgcacctcggtcggagtcgatttcattggtctctgggcggtgatgcccagatgaagaggagttcgtccgtcaaaacaatttaccatcgactcgttcagcggtgcaggtcaatgatcccaaactatttggagtattgctcaaacttgctctaggcattcaaatatttattcttctccttaataagataattgtttcctccattctccacaatatattttcgaccttggatgattaagtgctgttggtcagtgcttttttgttgcaattcaatgatggaacatggctgttcgttagcttgctattgctgatagctgaaaactgatcgttgctgctgctcaaattttgagcttgctgttgctgagaactgcttggtgctggtaatggaaatttgttgtttgctggctgatgaaaactgttgttctttgccgctaaaaactgctgcttgctagtactgaaaagtactgttgcagctgctgaaatatcttgttgtttgctgctgaaaacttcatgttgttaattaacaccattcacactaaaaaagctgattttttttctgggctgacacccccactgttgatgattgcagaaccaatattttttccatgtaaaatacaggagatcgtggtaataatcaagtgaaatatcattttgggacaaatactcagatggtagctgaggccaatagaaacattgttcaatgcttcaactgtcagtaatgatgtcaaagagattgatcactgaatgtcctgaaaggagccgggaggaagatgcaatgtgtgcgagcgtgagtggaggagaggaatgaccattctgttggtagttgtcgatgtggcccactttttttgttttggggattaaatttttggaatctcttggagatacagctatactcataccttaaatcctttttagagatctaaaaaaaatgatttaggggattgaattttgagtggctgttggtgatgtcagattggaaatagtgcagtcagattggaaattagttcagtgaacacctcaagcttagcaactcacaggtgaccaagcctaacctaatggaacatatacaaactatccgaatgcaatgaacattgaatgttcgacaagcaagcttaactttggagttccccaaaaaggggaatcgagcaacgaacagctaagacattttaaaccctctaaacgagccctaatcgcttaattggacctccccaagaggggaatcgagcaacgaacaactaaacctagaaatccaagaagcaaatcgaggggcaagttacctattccggatcgaatcgggggatcaggaggaggaggggggtgggttggagtggcggtgggggacgtcgtcctaggggtcgcggcggccgggggcgtggctgatctggggatcccaggagagctgggagttgaagcggtcgaaggtccagaagccgtaggggcggagcgggaggctccacgccgccttggtgcgctcgcaccgctccttcatccggtacacgtgctcccgctgcgccgcgtcccgcttccccgggtcctccatcatccgcaggatcaggttctccgcgaactccatcacgaaacccatccctacttcctcttcccctcctcctgatctcctctcttcttcttcctcggtcgcggtgggtggtggctgacggctgctgcctctgcggcgacctcggtgtgcttaggtgcgattggagtttatccaaggaccggcccaataagctttgctgcctaatgatgggccagcccgtttaatggggttgtactgtaccgtttttttttcttctttttgtagttgcttttttttctgaatttctttgggtgcaattgagccatgggtatgctaatttatcatcgttaatgctcagtgttatcaagtcacctacggggaaaaaaaactactcagttttatgagcgcagctttacatagcactaatgggtaaggagtaccgagtacaccatgggtaagaacaacattccaggttgtgaacctattcgcacttgacctatgtttccacctatatcttggtaggtaaattgagtgacaataagcatgccactactgtctgttacaggttttcaataactgtacagcatattttcctgcgacggtaatcatcagcgttgtgagacatcaacattaggagggggtcagtcacacagccacacaggtcacacatattcacatggacacacacacacacacacacactgcagaaattagcctactagcagccagtagacatggggcaaagctaagccgtgccgtcgtttcctctaccgccatcctgaccagtgctctccatcgccctcgatgagctgctacgggtgagttgagaagccgccgccgcggcggcggttttctgggcctcatgagggctgcttgcaactgcaacacctgcctcttgctgggaaggagcaatcgccgctgctggagctggagtaggggctgctgcttcttgagcttcgctagggtcaatgtgggtgctcttctctttggagccaactgttataacatcaagcacacaacatgcattaggcattttttcgggtacggaaagaagggatacccagatggcggaagtttgatgcgataccttggggagaaactgtggtttgctgtgaagctgtcgctgtcgatgtcggggctcctcttttacttcttgactgcaacaagaacgggtaggcgttagttgaggtgaagggggaaggttatatggttaaatactgggcatcatgttcataccttcatctcatcgcagtactttacaacggctgatatattggagtaacggccgtggaccaaggtataaacccatagaaggagcttccttggaatactgaggtcaaggttctcaattgcgtctggggcttgctgtaggccttcaacaggtggctgcgatggggtgactgtgtacagattaatacccgatgggaatgttccgcaagagctctcccgatagaagttgtaggtgctcttcatgacagtaacagcagtctccatgttatcttcggatgtttgcctgatcggaatgttcttaattctgttaaaagtctcaaaccagttcatatcgaggcctttgaattgagcaggcccatcaggagacgagatgagaagctcatcaggttgcaagtcgatgtaaagcactagaccgctggatagtggagcaggctgatcagttgtttccatggattcaggcagtggagtgatggatgcaagtttgatgagaatacaacggcaccatgccagagaagcgtgcttgcatatcttggcgaaattgctgtttgacagtttgggtgttttaaaacgctttcttatcttctcatttagtccttcaagaacatccagtcggacatcactctcaagcaaatggatgtattggtggatataactgccacaaggaaataaagtatgaaaaccatctggcttgagtaactatgtattttgcactctaatctagtaattacctgtaaagattgctttctgatagctcgggactattgacctctggaatagtgcttatatcagcccataagtttgcatggtccatgaacacaccaaacattttctcaagtaggttctcaacggaagcatcgccagaaactctacgaatctcaggattgcggattgctgaagttagaacttgaaggtacttcccaagaccaacaggaacgatatcgcccaagcatagagcaaactacaagaaaaatagacttattattataatatatccacaaaacaaatatagctcaacatcattgttgtgattattagggggtaccctcttatcagttcgcagataagtgtacgccctctctagggtccacaaatccctgtttttctccaaaaggttcaagtaaagtatcatgtacttcctgatgcatgtaatgaatttccgtgaactttctgacaagctgacctccagattctttttggatccaccaatatttggatttttcctcctggaaaatggaaggtaaaccagagtttttttgggaagataataatattgtaagctgtaatggttggataaatcaacatgcatttgtaaatgggtaattacgacattacacaaggacaaaaaaactttaccttccttttctaacagaaccatcaatttcccacatgttcaccgtaaaggaagaacgagtagatttgaaacaaaatgaaagctcttctttagctcgctctaggtcccctgcttcaccccttctatacaatccttgtgcaagcttgtatctcgccttatggaaatgcttcagctcaccttccacacaagtaccaagggcacacaggcaatcatcatataggatgtgccacactttatcaagtagatcagggtcaacaaacttattctccgctgtgctatcaaggacacatttatcattatgatcagagggtgaattcttgacattatttatggactgtagcatgctcaagacatcttccttggttgactgtttgtatgtataatcagcaacaacctaaaaaacataaatcaatagagttaatatcaaaatatctattataaactagcctgtcacaatcgaggggaaaaccagaaactgctagtagtaagctagaccagtgaggccaagggaggagcaggcccctctttaaggctgcaccctttccttggcccttggccagtgcccatgtcaatagcctagttaagactgtacacaaactattaaataaggaacccaaccgtgcgtaacacttttacaaagaaaaaaaaaagaagcaaaaactgattcatgaatcttagacaaacctgtatagcatccagattctgctttccttgggtataaagtaacttcatgcgtgatgcatgcatcctgtaaaccgggtcgactgccgttggattcaacacaacagctttgttgtagtatgaaaatgcttcagcaggggaatgccccagtttctcacacaacttcccaaggtaaaatgcatagagccactcagccctgtgaaggaaataagcattatcatcctacttgtggcaaacaacacacagaatatgagattactaacaaggtatgtaagattacttcagttcaaacgccttctgaaagtgcttcatagaatttcgacaaaatgtctcccatgttgaatccttcactggcaaagtagccctttgatcataaaagggtaccacattttgcaggctatcataataaactagggccaacatttcatgcatttgggcctgaaagaaaatgagttagacgtcattgccaatattagtgaagttctcatcaagatagaaagaagaaaaatagcacctaaggcatctcatagatgagtacagaacaagaggacacaccttatcagaagcggttttagccaatgctaaactcatcaataggcagcgtcgactatgtctacgacccatctcaactctttggattaaagttgtatttgttcgccagtccaaaatgctaatatgtttactaccatcgttcagcaacaagtcaacctcctgtttttgaacaagacaaaaacttgttatgcaacaaaaatgcatgatacaatggaacaggttcaatcaact

SEQ ID NO: 55263 - DNA, 1504 bp, Oryza sativa
agcaagcttctgccagctttcgaaccgcaatgggttatacagtagatcgtacttgaaaaggttagcactctgttgaacaaattcacccccttctttttttaacacaaaacctgtatacttgtcagaggcacttatatcttcaacttgcgctatgtagtgatacaggttcccataaacttctgagtatggctctgagctgcagcaatcagtcaaaaatgtacttagggtatatccacaactaaacttgttccagtgcaaaagaaaaataaaaggagaggagggactataggtacaatgcacaaagccaacctagcattggacagtttcttgaatgcttcgtagccattttcacctgggaacagtacattcaggacagcttccttagatccattagtttcgtaaatttcagagagaatcttttcgcatgaatcaggtccatccaagaaattgtcaagaggattattgaccaataagtcataaggtggctgtggaaagtgtttacgtatagctcgcagcactcttcgtaatttaaccaagccagttttctgaagaaaatgaataaagaatgaccaaggcactatgcgctgcaattgatgcttcttaccaaactgaaacaacaaaatgaaggaactcaatatgaatttactcacagatagagcttttgcatatggcaggacatattgaaacacatcagcacattgttcttttgtctgataatcaccacggcttgtatttttgtgtactgctaaatcatcttcactgcaagaatcagggtttatcttcaaaccatataagcagaaaaaggcctggtccaaggcactgtcaatgctgactgtatttcatccaattctgcaaaaacagagaatttcagggtcaatggtaagtcggtaacagaaaccttattcaatcatttgtcggattctaatttgactatatcaccaggcatttacgtgtcagtaagtcaatatgcatgcgacataatcagacagtattgtctgtcattgtacatcatgtctaccacaagatatataggaaaatggaatagttacacgcaatgaatatggcctaccagattcttcctcatcctcagaattatgtttattgtcacaaacagatgcctcatcagtcgtaacatcttctgctctgtcattttctgctgcatcttcttccatcccatttggatctaacaataagatagagataataaacaaattctagtaattaattgggacagaaacatgataccataataaatttgctaggaaacacctactaagttgggattttagtttcacatctagtgccatgagatgcttgatagtgaacttgaggaatgtcccttcctccccttcaccatcacgcccagcacagcagagcccatattcagcaagcaaatcatgcactgccacaatcaagtcaacctgcaaagaatcatatgtgaacaaaagcaactaaagttaatcatgaaaatcaatactagagagttttttggtaaagtggtgcg

SEQ ID NO: 55264 - DNA, 8648 bp, Oryza sativa
aggtgcttctaaagatttatgaggggtgaaaaataaagtaatggttagattcaacactagcaagtgttaaaactcatagttatgccaggcggttgtcctggcatatacaagatacaggctagacttgtaatatactcgtaaatgatctagcttcctgagattaaagcaaacatgccaaaacatatacatatctaattgtatcgtatatggaactggttgacatggtaagtatggacatgacatgaattatacgggacttgtaacaagtaactgtcatgggtaggtggttttggccccaagcgtcactgaccaggagctgtgatgaggaaagcaaagaagacaagaggcagtgagagaaacaggaagacagaataagtgtcatcaggacaggatttcctaataacagaatctcatccaaaatttccatactcttagctatatcctttaaatcctcacaggcaatctctaattgatctctcgatggaaatctcctaaccaaagaggagtatcaatccaactaagctgaagaggatgcaccagtgccagtccacagtagcaccagacagtatataccttaaaattaacctcttcgcagtatactatgtgcttgtgtctttttgagcttcaatacttcagagttcataaacaaatacggggtgtttattaaatatgagagcaaacctttgcttcatccatctcgatgctagcatcttccaatccatctagcatagatgagtctttacttactagagagacctggagaagttagtacaaaggcagagttgagaaagaggcaggagtcacaagtaagcaacaaaaaggatctaaattataagcaacagaccagtataggtgttagttgcccttccaaatcaagaaggcctttggcaaatgctgctgctgacatctgacaagtacaccatcatgaacatatactcagatgataaataacattacaagagaaaataacgcatagccacatactataagacaagttgcagacgatccacttctattttgctgctatcttctctctactatacccagtgatagcatccacttttatgattatcctactgaataacttatcctatcatttctgcaatatatttttctgtatttatgtgttcgagtacaacaatttgtcagtgtataacagtggtgtaattttatcaaagtagtgaaagtaccaaaatgagcgtgctgggcttgaatatacagatttgaagttaggctattagttatgacaatagtatattttgcctggttttccagtagtccgggaaatagtgaaaaaatgcaattatctaggagtacaattagattacagagtttccaataaagtttgaatatgcattgattaatattagactgattattgcttccgagccatcctgaacacggtatggatatgatcaagcagatttagcactatctgagaagaacaaacatcatatatcactgagaccaaacaattttcatcagcttaagttatgtttgcccccatccattgttccgtatttgataggttaaacacaagcaggtatgggctttattaccacaggaaataaaaagtagttgaaaggtaactaacaacaattacctatcaacaggtaaaattttcctaaatcctgttggcatgaccaatgtcaacatagaaaggaaaaacagaataaattaaaaaaataaaactatttcagattatctaaattgaactatttcagaggggctataaattgaaaaaaagaagaccaaaagtatacctgcacacggccttcatctgaactgtatatttttaaatcatgtctgtacgtgctatgaaggcgaagcaaaccagttccttcacctatattcaggataacatactagtaagaaaagaatattgagtacaagaaataaactttttttaaaaaaaaaaaaaagagaaaagaaaaccaagatgatacaaggtcatcatgcaagacaaggcagcctgacagagatcacatttcattgagaacattacattacttaaaatgttttaaagcttaaatacatgcaactttattcttaaaaaaaagaaacctgcaacagactgtaatgtcagtaaagttacttttcctagccaatcattgcctataataatgccaggttcttattgcatttatatctaaagaaaataactgaaattttcactagaaggcccattaatgacaggtgtgctagggccctacttgacaattctgtcgtttatgtcaatgagccaattgtaagctgaaggttttgaaaaacataattgatgtaggtattgtacagatatttaactagctaaaataagttgcaaagataaaaaatgggtgttctataatttcttgtttgctagcatcaagaacttcatctaagcagtaacttcaacaagccacatcaactactcacatacatgttattatgacagctaagtcaccttttacatgaacttcctttccaaattaattagaaaattgttgtagtaaactaagtggaacaggtgttcaacatcacaagcctgccaaggacctaggccactactgctcaagtttatggatctccagtgtaaatttctcttttcacttgaaaagaacatcaaagataaaaaaagttctttacataataacagaagcaacacaatgtgaatcttacctggatatatattgtttctgaaaaacctacccaactcttcagcctgaatgagaagcatgaaaaataaaatcatgacgtaagaataaagttgatcacaaatgcaactgtatgaactttgttcctgttgtatccaaatttgctcattcggttgtaagagttatttgtggattgatgataaattgaaaattgtataaaaattttcaaatttctattgtacttattctagatcattacaactcatcgatatttggctagtacgacataatagaacctagttgactaaccatcccaccaccacctattgagttggtgggaccttctatggatatgtttttcttctgatatatatatagagccttgcaagtttacaatattctggtatattcatttaaattccattgcaacgcttaggtactagcctagattggagtaacagaaaactagtgattgatacagaataattctagctctgaggcttattaaattaaacttagattaattaagttgtaatgagggagggtggatatttaccatgagaatacataatactccctccgtcacgaaataagttcatttttcacccatcacatataccaatagaaaactaactccgatgaaatgattgctcaaaaatgaacttattttgggacaaatgggagaggccaaaaatgaactcattgcgggacagagggagtaacaaacagttgaaaattaaagtaaaaagttatgagtacaaaacctgctttctcccagcatgagtgagtacaccgccatattttagaatcatcagtgcttcaattggtcgttcctcttcaccatcaccacagcgctttggaactctaatccatttcagtggctttagttgcacttttctataaataccagagaaatgcccaccctagtgttgcaatgataacaaaaattatcatatgtcagcattcttgtaaaagaatggtataaccttgttatgacagatatgccagcaccctttagaaggctggaggatatatacaagttccgtgctccttttaccactaggttcattatgtttgactacaaggtatgcaagacaaatatggcaccttgttccattaacggcaggaaaagaataagtaactaagagtgaaaagattattatagctccaaaaaaaattataatttcttgaattgaccaaaaattaacaaaaatctaacaatgttagtatcagagtctactggtttataaattaaaagtttgagaaatcaatagtaaatagcattcatgcctccatttgtggcatcatgaactaagtggctacaaagcacactgaatacatttgtgttagctatataatagtaaagagcctccacggggtatatctagtgtaaacctgaacaaatattaggaacaagaatattagggctcaaattaatgaaaagaatgttaacaaattgacaagaaagtctatggattgatagcaaaaacagaaaggaagtgaggttccgtggaagcggaaataacagcatgtatttctattattattccatagcgagttgaataattgtcccactttgtttcttccagcgcatagtcatttgaaatataaatttctaaataagggactaccccattcatccagattcgagtgtttgtcatgcctatttgatgccaaactgaaaaggttttgcatgcataatactagctactcgtatgagtttgcgcaagatatgttcccccataacctggtgaagaaatatccatatcacatggacaggcagatttgaattaaaaattacctcctccagtactgctttgacttgacgaagcttttcaatatgctccaaatcctcagcatcactgtcactttcccggccagacctagataatataaatttggttgagtaaatagaagatcaaactgactaaattaacaagtttgcgaattgtggcaagccaatagaagaataaacttgcacagacagctaattctggattggcttaccttgttggtggtacaagctgccttgtggcatctagcaagtcttgtagttgcacggcacttttcagttttgtctacaaggaaatcaagaaaaaatgatttagtttaagcaccaacaggataatgaaaaatgaatattccacaaaggggatacctcagctcttggctttccaccattgtatttcaacatcaaattcaggagtttttcctcagtaactttcaatttcactttctgctttggtgtccgatcgccactaaacagatattagatgtcaagacacaacaccaatatttatcattcaataccagcttaaccagcatagaggcagtaatccttactggcgtatcacaacaatgacagaacgtaattcttctgactgcccaaatgtgccaattattccacttccttgtcgtgtaagaccttcagtgggctgaactggttcattagatttccaaggaaggcttggagggatggttgaagaaagatgaggtgcctttgcatctagaaatatctttcgtaagatgcatgcagcatcgtcataatacctgaatgatagaaaaacttacgcaaatctttcagaactaattaaggtccatagacagtctgtaagaaaagaacactaggattaaataaattacttgtacgagttcttcacaaagctccatccattaacgtcacaaacatatgatcttccatcacaccttaagagatcaaaaccacaaacctatggaaacaagtcatatcagaacataataggaatattaggaaatactatgataaacgcaaggcggttatcatgaaaagaagatgagaagcaagcaaacacgatagatgcaaagtatctaaagcataactatagagatagtaaaacatactacttcccccaaaaattggacaacatgcaacaccttatctattcagcagagttgcaaattgaaacgtaactagattatataagtctgctgcagtatcagttgaagaattcactctcaagcaaaacaaaacaaaaataaaaggcacaattaatctaggcgttcatttcataggatattcaaaataaacttaagatataacaaagtaagctagcttaccatctgcctaaaagcactgcacacgtctcttgacatttgtttctctgtaggggtcaaaagcacaggataccgtaccttcaagtaataaaataaaaggtaagaaagatgacaggtaggaaacaggaatatcaagaaatgaagaggatgacacattgttcatggagtagatgaaaagctccgtgtcaagaaacttaatttagagtcataattcaaacattactaaacaacatccattaaatagccaatagatttttaaactactgtgtgtatcaattaacaaactccatgatcttaaaaataataaggttttattaattatcattagccataggttgattgctccatgcctgtccacattggtctgactatagggtagccaattacagcctggtgcaatacagcaagttctcaccccaaaaaatagtccgactatttcttctatgcactgatgagtaatatacaataaaaatgctagttcacgatatattgataccagagtttttaccatactccacggtataatcatttaacaaattgccaaaccaccaaaaatcaatccattgtcttgttcttggctacattatgtaaaattgtttgcacaaagcatgcccagtttaagttgacttcaatatcgaataaaaccttaaagctggtaataacaatcagaagtccattgtggaaaacggtatcaatttgacctaacagatgtggacatctcagcaaagagacctgcttgactgtgaatttgcttggaaacacatgaaatatgtgcaggtttcataccagtgatgataacacaaattttaggtggattttttctattttcatgtagcaaataccatggcacaacatgaactttgaacaacacaaatcaatgcatattcaaatgaatttaacaaaaaacatgtgtaatcgctcacttctttcccatcagggttcctcataacaacaccatcaacaactggtgatttacgtgcctcagcatgtgcatatcctgggccaactgtgtaaacctgaaaatagttttgtgataatttagacggaagccagaaaagtgaaatttttggaacatatgttccctgcatgatttactcaatgcaaaagctctccaaaccgttgaatgaaccatgtcaaaatagacaaagaatccaataaaaggagctgagcacactgaggctcgactttcttttattggaaaaaataggccaaatgatttttcttttgtgaaatgtgaacatggatagtttccacatttggtgagaccgtgagaagcttctcatccataaataaattgtatatggctgactgcaaggatataggtccattcaatttcaggttttccaaaacaaagctgaacataggaaagaaatagattcatgaatccttttaagagaacagccagaaccattaaagtgaaactaatatgctatttttcagtgtacagcagttgaaacagaacacttgcccaactaaaagaacagaacacttgcaaaagttttcttactttaacatccgtcccaccagtaggcatgaactcctcgtaaatgtaagatccttcacgcctcactctcctgacatcaggatgaaattcactagatcggttaccaacctacatttaatcagaaatataacaaaaagtttatttttgtatccagatacaagaaaaatacataagaatacatgaagaacagaaaatgttgtttggtttcctctgtttagaaaccacctgacatgttgacaaacaaaatataaaggagctaacaattgaattctgcaaagggaaatgcaagggatcaagcattcaagccatgtgatagcatagcaattataattaggtaaacattggcccctttttccttaaattgcagaaaataaaaggcatggatcctcaactcaaaataactccagagatatgttttcatgtatctttgttttccagaagccaaagaatcaaagcaattggcaggtttaaggactcaagggggaaaggtaattacagtcacccggtaaaagagtggtaagtatgatgcatgaaacttaaactgttgtggcgtgctacattcaaaattacctttcggaacagttccttcattccaccaccagcagaattaggataatatatcattattctatggtcatcccctgaaaaggattaaggaatcagttatcgtataattgatcattgtgagtgaaacatagactaacaagccatactactataaaaagggaggctaaaatgatagtatttcgttcactgttgtaccctcagcacaaaaaaaaatatagtgtatgctttcatgcatacagcaaaatcaaccacagcagtgccaatgaggcaatggaaacaacaattcaaagagacgaatcacagtacagcagaaataagttaattagataaatactggcaattaccattgacaggtttctccacgaagggcttcataaatcgctttccatgaacctcaacaaaatcttcttgctcaataaagtagtctaactcttggtacggatattctctattgacaagagcataattgggtacaggaattccatacttctccagatgcttaatcatgaaaatgattgcatttagcaaaatttagtaattattccaaagaataacttggaagagtaaatgagaaatcatgaaaaacacatcccataattactagaaaattattgcaacttgaggaagagcgacttggtgtctgataaacaagatgtggaagatacatacaaataaaatatttagaatgctagccaattcggtcagtggcaatcaaaagtacacccaagctgaaataaccttagattttttaaaaaaaaatgtcatctgttaaacttcgtgcttcagtactcctgtaaacatatgtgctgccagtacaatatagaagaaactaggtgcgttggtggtcgtca

SEQ ID NO: 55265 - DNA, 1592 bp, Oryza sativa
  unsure (1)..(1592): unsure at all n locations
cctgcagccctatagatattcagcctgatagattaaagaaactgatacaggcaatatagaaacaaatatgaaattgaaaaatctcagaataatgggcgtttacaattgctcatatactaatttcactcatgctggatagcattagtgttaagctaaactggaacacaccattgataaacaacttccacataaagcagtaaacagtcaggaaggacagtacaaaccatcctagaatgcacagcataacctttaccctaacaaccatccttaagggttaaattgtatattagatagctcgggggcgagttgatgttccagagaagctcaaaagatttacctctgacatgctatacaattctacatattgtaattccctgtgatcatttatggtattcatagtattatctattcctttgttcaaaaaataaacatgaaaatttcctttatactgtctgcaagatacttatttattaccatatgttactaaaagcctaaaatcatagatagaggttatttttcacagcactcaatgagcatgcaatacaaatatttctaatgagtaaatggtcaaagtaaaaaaaagtttggcagtcaccaatataccaattcttaaattgtatacctagcttcttttttgtgtgcatttttctctctggtagcttagcggtgtgtccctatacttgagcctagctcacttctaaccgcaatgatacacagttctcctgcctattctccacaaaataaataaaataagaatatttaagtttcctcccttcctcctcctccactgttctatgcagcttcaccaacttatatagacctacggaattttatgaaattatcatttagctccacacatacttcttcctttataccttgtttctaatattcttttagtctggtgcagtgttgtgcattgacctataatataaaagtgaagcttggtagatagcgttccaagtatgaaagacttgaattaaaatgacagtcaagaaaatccacagaaaatagaacagtcaacttacagggttatcacactgatcaacaaaggctttcgctttactagcatttcgagaaacatctttgactgcttctacaacactttccagtcgattcctattcattgtttccataaactctatatcacttgattttttcccctcattggtggtaaccgatccaaccatgccagctgccacagttagaacttgcattttccttcgatgagagtcaaggtatacctggatgttcattggtttagcattttcacatgctgatattaaaacatccaaggcacctaactctagtgaaataactttctcactttctcttggtggaccatatgcactgccaacatagacatctttggtggaaagcaaaagtggaggaagcaattccatgaactctgtatgagttattttattgatgttttcatcattatgccaaagtaaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 55266 - DNA, 940 bp, Oryza sativa
catccactgcagatcgccatcgcacgcctccgcttctcaaggtcacacgctcgtcgccaccgctcgtcgcccgacaccccgccgattggggaccggacgctgaccctgcatcgacgccacaacagccgacagatgggagatgttgaagacctcactccaacgacggctgcgcgcggtgacactaccaggcgttgagggagagaatgaagtgcaaggtgcgacggggttgttcgtccttgcccagatcaacgccgccgccgatccctcactcgcccctcgcccaggtcggtgccaagggcgaggttcgccaatctgcttcccagccgcctcgcccgctccatgggagaggtgacacctgtgcccgcctccagcgctccatgcccccggtaccatccgagcacgatccctccggcagaacttctgccggagaagggacgcatggttaattggttcgttctctttacgttgcaacccattcatttgtcaagaatcatcactgtgagtgtcgagggttattacagattgcaggatcactaatgctcttttttgcccaaaaggtgttcaacgaaatgctgcttagccaatgtattaccagaaattgatttctctgtaagtgagaatgtcatattgtcatgtcccctatgttgttatttatactaatgattgcaggattctctctgttgttatttatgctaatgtaatgaaatatccaattactatgtatagactctagggctatgaactgctgggaagttgagagtgttgctaccaagcagaaagattcaaattatatgttggagcaaactaatttggatcttgcagtctcaaaactaatctggtcttgattgtttcagagtggatgaaaataaaaaatggaacgatgcagtgaagattatgtaagcaatgttcgtgatatatcgatcctgaaattctcatagat

SEQ ID NO: 55267 - DNA, 1059 bp, Oryza sativa
aagtatagccactcctcgtggttttgtcaatgtataagtcatcattcacgatggcattagcaaatggttttatgcttaactagttaattttgtgtagtaagactagtgagcaactacaaacacattatgcacagactacagagttgtgccatgatgatgaattatttgaggaaaaaaaaaaggaaatatggactgaatattgtggatgtttgtcatgctattgactaagatactaggtcttctgattaacaagtcaccttttcaattgttgtaccttcccattttctcttcaaccttttccttcaactccttatccccccccccccctcatgtcatcagaattttctataaaatttgccatttaagaaaatatatgatgtaaattagttggagcttgaaaatgttacagttacaaaagcaagtatttacggcagaggaagcaatttttttctacatagtcaatatggttcaaatactgtatgcgtttgttcgatacaggtatctgtttttttgttctttctgtgcatccttaggatttctcgctcttctgacttgagatattgtagctctaagcctgtaatagaatccaatgattgtcttactgcaatactatttcagcatgttatccaatttgaatctacgcatacttactgttggttttacagtggatctcaattaattgtgattatgaaatttctcttgtcatagctgctgcttaccctagccatgctgtggacatggttcccataagaactcttcaggtaagtttttcatcttcatttctctcattacatggtgtgatgcaatagattatagttgcacaaaaagtgacgagggcattagttcagacacttcatatctgggcatgtgcatctggtgaaactttgtaagatgcacttatctttacagtactgatttgactagtatcaattccaagttgctaattctgcaacttgcttgcctgggatcatcagatgttacgttacaatgaagctttcaggatgagaacagtgctagcgcagttggcaggggcagtcgtgggatggaatactgttgctt

SEQ ID NO: 55268 - DNA, 25841 bp, Oryza sativa
  unsure (1)..(25841): unsure at all n locations
tcacttaagtttacacaattcagcttactagatatcaaacatcattaatgttgaagggatgagtaaatttctgtcaggttttgccagctatcaagttaattagaatgccgtaaagctggagtgctgcacaagtgcattacccatagaaatttatttacatagtgattgtgcgtgattgtaggtgagttatatcaagttagatcaaaaggaaggtgtgcaagatctatatgtggtgaattgaagatgttcagtgcttcaagcggtaactaaaatccgaatagacgaaaataaagaaaataggtctaatcgttgacatggtaccataaaaagttaaatatttttggctttaactcgtgtcgttctttcaaaagttcagtttcctagacaccacacgtcttcattctcccatgtcttcaattgtatcttgctaatcattactccctccattccataatataaggcacaaccactttttttttagatgttccataatataaggcatgcatacatgtaggcaattaactatgatccattctccattaaattattacttttttaaatcctacactctcatgttctctaattctattggatgcatgcattgtatttactaggtgaaactccgcgtattgctgcgggaatttagtatgaagatatacattgaaacattatttgaattatgtcggatgataatttaacatgtttgtgtttgaaaagctcttaaattataaaaactataaagatatagcatgtttgcatgatgtccaaatgtgatgattgttagtggatgatgatgtggcatcttgttaattagtggatgatgatgtggcatctttgcatgaagatatacattgaaacattatgtgaattatgttggatgataatttaacatgtttgtatttgaaaagctcttaaattataaaaactataaagatatagcatgtttgcatgatgtttaaatgtgatgattgttagtggatgatgatgtgacatcttgttaattagtggatgatgatgtggcatcttgttagtggatgatgatgtggcatctttgcatgttaagcttaaggagttagtgcgggataactttatagtaagatatgattaggatgatccaaactacaagatgataataattgtttcttggtctttgggttaggggtggttatgccttatattttggaatggagggagtacctagtaactagtggcactcaacttataaggtgacatttcctagaagcatgttgtctaagagtaatcttgctagcaagagctcataattttccattgtcagcaaccaactcttattcatggtccatactcaagtcttaatcttaaattaattgaaccatctaagtgaacagcagattcaccttggatctttctaacgtcagtgcctgtgattgttactcttgagttgttttttcctggctgaagggatggcaggccatgctagttgccataattgtatgttgaattgttggttggtgatttgttccaggataacatatagagatcttatcataaacagaaactgtaggataccaataactaccaattgaattgtagtagtccaaggctggattcatttgtttgtttacaactttacatgttgtattactgcagattaactcttgatctcttgcaggatatccatgaccgacagcaaagtgtgataccaagaaattttgctatgcgttctcctagttctggaagccaacatgatggattctcatattggaacatggggaggtttcggcgaaacaccaccacttccttggtctcaccgactggtgtcacacctagcagttttggcaagaagaggaacgccgattcaagcaatttcctccctctgaagttcaggaaaatgagcggggcaacttgacagccggccaatgcatcattgagggcataaattctctgctctctggaatagcatgcagtaactcaattcacaacgtaatactatagcttaaggaggctggagctggcggcatttttggggcaacctgtaaattgtaaatttgccccatatccgttgcatggtatccaaatccaacacaccgatgtgtttggtcattggtgctgggtgccactactaacctgcatgtttgtagaatctggtggcaccatatatagccgtatagatagggagatgcaatgtgccacatctctcacgatgcttgtatacctcggaaataaagcattgcgtgcacttatacaacagttttgccatgagaaaggctctatgttgctgaacattttttgtttgcccctcttgtatttatgatgtaatcgacttgattaatactctctccggttctgtaattcttcttgttttggataaagttgtggttaaactattagaactttgatgaagagatcgtgatattgtacaaaatgacaagaatcatggaactggagggagtgtatttttgacctgttaactgcagaagtgcagattagtagaaggcaagatggttataaacgaagttgaacagaggaggaggcgaaggttgcatgggctcagccgacagagaaagatggatggagcaaagttgtccactagcccaaccaaaaacagggcaaccacataggcccatccttgatagtaacccaaatttgcagatttgccggattgaaagatggaacgtttgatgataccgactagagtgttgctaataaccagttgaataacaaaggttagtcttgctacctccattctgaaatgctcctcacttagcatttagcaacttcatgtactatatatattggtacttagctataaccatgaagttcaattcatatatatgcatccggatgctttgcatattttactaaactaacaatgttagttcccctttaaaatctcgttctactcattgtttttctaagctgttggcattcatcacacaaagatagaacactgacggctcttgatggggatgcgctaacaacagtccacacaaattaattttgctactcgacaggtcagaaaaggacggtgaatagtttcgacgccattacaagtgtcggtcttgctatctatccataagccgtacatacgtttgcctagattcctggccttctgtccatttcagtccacactctttcctctctgtttcaactacagttttttttttgttgttgttttttttttgggggttcatgtcgtcactttacacactctctcaagtcaagtctcaatctcatgttgacaaggtaggagtagaagaatcaatggagcccatggccacatgctgaccttgaaattaagtggactctgattaactggtcatcgtggatgtgatcgagctagctcaactgaatctaaagcactccctcggtcctaatttaagtatagtcataatttttcgtgtctaactttaatagtttgttttattaaaaaaaataaaagtataagtcacgcataaaatattattcatgttttatcatctaataacaataaaaatactaatcatattttttaaaaaataagacggaatatcaaagttggctatgaaaatttatggttgcacttaaaatgatacggagggagtaggacacacagtacagaacagaaggtatttaatttatatgatgtgtccaattaggaagtagactttgactgagatggcacaaggttttattgcgtgcaagagttaaaatcctcttcggtctctgtacatgattgagcttagggttggctgtgacatttcgtgaaatgaattctcagcaatctaaccgaggccaggtttagttcgtaactttttctttagacttttaactttttcatcacactaaaatttttctacacatataaattttcaacttctccatcaatcatttcaattttaatcaaacttttaattttaacataaactaaacacaccctgaaaacatggccgtgtttagattcaaaaatttttcttcaaacttctaattttttcgtcacatcaaatgtttggacacatgcatagagcattaaatgtggacgaaaaaaaccaattgcacagtttgcatataatcgcaagacgaatcttttgagcctaattacaccatgatttgacaatgtgacgctacagtaaatatttactatgatagattaattaggcttaataaattcgtctcacagtttacaggtggaatctgtaatttgttttgtacgtttaatacttcaaatgtgtgtccgtatagtttcaaaaaatttggcacgcgaactaaacacagcccatgttattgaggtcataatctcataacagcaaatggccataaaaaggctgttccagttgaagcattccggggttgtttggatggtgaccatactttgccacaactttggcaagctattttggccaacttagcctagtgtttgcttagttgccacatctttgtcatgtcacactttttgattttgtgaccctatttgtcatagtcacatatctttgccaacatttgtctaacttatggccaagaatttcgtagccacataaattgcggtatgccacactttagctatagaactttggtaaaacgaagcaagcatcaatcagccccatttcgacgagacgaacatgttgtatccacattgctctggtttggtgctgtagcaggtgatccccgtgggctgcagacggacggcccatccaagcgaggtttgactaccgaaggaaaagaggtgttaatttggtggactcaaaagccccattctactttaaaattagcccctaataagatactataactaaccaacatgaagccggcagaatcaagctgaaaaaaacaaatgaagcagaattggagtttggaaatgatatgcagagtgaaaagaaaaaaaaacagagatgatagcggccgagcaaagtagttaggtcgtgtatatatatacttagaacagtagatcatatgtatgtatatatagtaaggagagactagcgaatccaccagtgttgcatccgctaataataattaaacgcagctgctaattaagcttctgaattcatggcctccacgacccaggcaaccaacgaaccaccaatattatataatcgtttcacgtctaaatcaaattagtactactacttgtcnaactaactannacccaacccaacccaaccaaccaaccaacttgttactccggacgcgttggaacggaacgatccaacaatataatgcgagtgtgtgtgcaatgcaagcaagcgcctaccttagcctagctaccttgcaggtgccccaacaaaagcccaaccgacgacgaatcgatccaaagctatagcctgcatgcactttggtcgtcgtctcgtcggtacgaaagcgatatgccacctgatcgatccatccacgcatcgcatcgcatccaaggctgctgatcgatcgaagctgtaggatcgaagtcagatcgccgttatccggcccctctgagtgatcgttcaaacacctatggtatggacatggatcctctctagacctttcacagtgcaagctatgagatccgtacttttaacttaaaaagttagccgaaagggttaattggattaatgtagtgtgggaggtaaccgaatgattcggtccaaatccacggtgcgcgtgacctcgggcgcgtggacatggggtagtggggcgataaaatttccccacctacccttagcttctctcgaactctcctcctcccggtcgcgagctcgcgcctcgcctcctcccactccgcctcaactgccgctcctcctcccggtccgccgtcgtgcatctttctcctctcctcccatgccgccgtgcctcccatgccgtggcggctttggtcggcgcggtcggtggcgggtggcgtccccggctgccgcggcggagctcagcgtcgacgggctcaacacgtgtggcagtggagctcagcatcaacctggccaaagcggcggaacacggcgtcgacgggctcggcgtgcgtggcggcagcggctcaagaatggccggcgaggaggaagcgggcgaggtgagcaccgggttggggtgcttgcactggcgaggtggcgctctcttcttcgacaacggccttcggaggagccgcgccacccacgccgcttgctcctcccatgcctccagaccccgcggaggagccgcgcagcaccggctaccacctactcgtgtgacagccactgccgccgccgccgccgccgcgagaaggaggagcagaagcaggaggacggctgctgtcgatttgttgatttgttgccgcgattttggagggtgatcttggggaaaacccttccacaggcggcgcgagggcacgagcgagcggggcgaggtgctccacagcgcaaaaaagccgtcgtttcctcgcctcgcgtgggctcacggcaaagtggaatcgcgcatcccttcgtgggagcgagctcctctgctggggagcggaccctgacgccacacaagctcgaatccgacgtgtcgagctggagcaccggtccacggtgttgcactgtgaaaggccttagtactgcatctacagtagcagtggctgataggtggacccaatcccacatatcagcggttgctactgaacgtgtagtactgcagacaatactcactgctatggtataaatcgaacttaccctgtattagtaagaaccccagtgttctgacactttaccaatttcaccacaattttacaaacatcaactcaaccattttttttggttacctttgacaattgttcatcatcaaggctaaatcaacaaattgatttcacagaagcaagatgatcgattccatgactaccagggatggatcctgatagaaatagtagagggatgaataaattagataaagcttcagcatctttcatacatgtatatgaaaaaaagatcaggtgagatatatatatgtagtcatgtatagatagagtgggcgattgagggagcataggagtgcttcacacctttagttttagctttaggttgttgtggtggtgcgtgcgtccatcagtgcacgtccttgtcttgcctctatcttttagctcattccatatttcgatgtatctaggccttgtttagttccaaattttttctttaaacttttaacttttctatcacatcaaaacttttctatacacataaacttctaactttttcatcacatcgttccaatttcaaccaaacttttaattttggtgtgatctaaacacacccctaaccgtggtgcctggcctctgcctctgcaatctgcatgcatatggccactcaagctggagtaccaaggacgcacagcctaccaacgagaacggttaggaatttggttgttgctgctagaaatgaatgaatgatcaatatcggtcgcatttttctcccaaggtagtagtgcatatcgagttaatttaatagggaaaagtatagtaatatatatgcatagttcaaatccaacgatcagaaatggtctattatatgtgttattactcaattaggacttctttgaaatacatatatataaatagaaaaacgtaggatgatttttttttctagctaagaggttaaagttcatgttagaatcccttcaaaaaaattatggtttaagccaatccaaatgtatatattcttataagttttagatagccattcctttaatctaaatgattatataggaaaaaactttatattaaatttcttcgaaaattccaagattacttgttccaaagagcccttaaatgggctgggcgttcggtggtgtacagcagcaagttctatcttattgcgagagacagaagaacagacaaggctctcctacactttatagctgccaactttcttgtgtgtgtctgtacacttttttttttcatcgcctgtactgattgcaatgcagcatatagcaacaaatatatgctaaagtacatatatatatatatatatatatatatatatatatatatatatatatatatatatatatattggagacgtcaattctgggtagttaagcatagctataacgaagttattataacgatcataatgatttgtgccaatattatctgtagatagcaccaataatataagtagcatcgcgtgcacgcatcaggttcttccccggtcttgggtgacagaagcttctttttttcctggaatgaatcaaacgcttgatcagttggacatgcatgcacaacaactctccagtctccacatgctgctatcatcgtatgtaaaataatagcctaattgcttggatcataaaggataaacatatattgaaagaaaatgtgtcaattagccttcttgacactactttaaaaaaatacagtgatctgatttcagtatatggtcatgttcggtatatcttactgcctctgtcttttaatagatgacgccactgattttttgtcacacgtttgataatttattttattctaaaaatttacataattacaatttattttgttgtgagttgttttatcgttcaaagtactttaaacatgatttatatcttatatatttacataacatttttaataagacaaatgatcaaatatgtattctaaagtcagcagcataatacttttatactgtaactcaataacatgtcctataacaagaattacccggtaacatcgattaatgtcggttggccgccgctggttgtgtatgaaccgactacgataaggtgatccgttaagcctctgttttagttggaaacatgagaatatgagatatcctctgggtgggtagcaaatctacagtgtaaatttggtgctagctttggcataaatctgtccaaagctgtaccaaaagctttgtgcgtgcatgcaccgtacatggatggaagaaatcattcgagccgtatatctgcattcaattcaacgcagcaagcaacaaccgaacgagttcttcgtggctaccaacctcctctgatcctggcttgtactagtattcctgcagcctgtttagtttcttccaaagttgaaagtttgggttgatattgatacgatgtgaccaaaaaattgtgtgtgtatgtaatgtgatggaaaaagttgaaaatttagatccaaagtttggatctaaacacagcgctacaaaggaatagacacgaatccccgtgtcttttctctctcgccttgactctgacctgcctactgtaactctgacaatgacgaatggaaggccaaattggcgattgcaaatctgcaatgcatggattgcagggtacacaagcagcccaaaacagcgaccgctacaccccgaaaatgtgggccccacagatgatactcaggtctccagtcgtccgtctcaaaatcaaccaatcacgattaggacaagatataataatctaattcgttatattataatgtgttatatattttgtaattagattaatttgttttagaacggatggagtagtacacaaacgcaacacaaggacggcatgttggtgtgtcaccgtcacgtgcccgatcagtctaagttttgtcatgttactatttgacagtgtcaattactagtagtccactagtcctactgtactagtggtttctgtagcacatagtccatggttgctgcttaatcgcgtgcacattttagaagggtgattagactgtttttcaacttgtgatcgccatcggatgccctcataaacatgcattcaggttcttcttctctgaaggttagacggtactgtactgaaactactccatctctgtcaacaggataagaaaaattctccaatgagcagtggcactcactggctgtatcacatgtcagtacgtcgcaatcggattggtgataagggtaataatgttcgtgtcagtaaagtactccttaactcctcacttgttaactcttaggtctggattagtttccaactttttctttaaacttttaactttttcatcacatcaaaacttttctatacatataaactttcaacttttccatcacatcgttccaatttcaatcaaatttttaaaattagcgtgaactaaacacacccttagtttaacccataagagattctttcacccccaaagcctgactgatcaagtattgttagtactacaattaatccaaaccaagtccacgtcagagactatcttgtctcaattaattcttcaagccattgcattgcactgcattgcattgttctcaaccactgttcatgatgttgcatgcatggtactagagtatgatagggcctattcactttaatggcaaaaaaaaaaaccttactaaattttgatattagtatagttgtgccaaaattttgacatgatttcttatatagttaccaaaaattagtaacaaactaaatgtagccactttttttggcaactttaccaaaatttggtaaagttaaaaataacatcaaagtgaacatgcccatagtctatctaatactggtacagttaaccagcttccagctagtcaaccttgcttctccacacatatcagtcacacactcacacccttagatccaggagacaaccatgtataccaataatatattttccttgatttagtttacagattagtactaataatacagatatttagtgggtaggtcgatccataacgaccaaaagcaagcaccaactagcaattaacaaaatgcatcatgcatacatgaatggatgtacacggcctgtatataaatataatttcaagcatagctgaagcttcgtgcatgtgaagaatcatttttgaattattatttagttagtgaacaaccatgtgatcgatcgatcaaggtaggtacagtagtggtagtgttttgtttggttcacttgtttaaaatccaatgcgatgcaaaaggacggacacgcccactcattttgacgaatctttgagaaacttttttgaggcgaccaatcatcagttaaccaaaatggttcatgcatcatgcacaatagaaaaggatgcatctctggacagagaaaaaaatgaattttgaaataaggaattcctgagagctaacgagattcagatgagaggtcaattgcttgcattccacagcgtgattaacaaaacggaccaatgacagatgccagtcaactaaacaacaatgacaggtaaataaagatgcaaacaactctggctatgtatctaaatggtggagactgaagatgtaaatttcaggatcattaagaaagtgttagtaggtatcaaaattttacgctaggcatctcgaggtacttaattagttgaaggtatcaaattttataaaaaaatatagtatctcctggtaccttatgataaaattaccttttttattataaaaaaatactcattctttttatatgtacctgtcaccatatacaatttataattaaacattgaaagatcgtcttttgggcaaaaaatatttaattataaatgcttagaaagattagtgttctacatgattggtcaatggtgacaagtaaagaggaacagagggagtgttacttttacaaattatagtacatgttactttcctttaccatttcaaagcaaaaggaccttgtatgcatacacaagggcaggcaatcctaggactggcaactcggattcctctcccatgtccgtccctaacgtaggtcacacattggacacaacaatcaattgcacactacaagcaccctagtaacagaaaggagaaagttttgtgtgtcattcgatgttgatgtgcatgccccatacatcatccattggccatggccatgggcccaaaagggaagaaagaaaggaggaaggaaggaaagaaagaaaatggcgtcgctttgcgtgttgttgtgcatgtggtaaggaacctcatgagctcaataatggccaattggccattgcaaacatggcaaagctagagagagagagagagagagagagagagagagagaggaaaaggaggaggtttgcattttgctctcactcactcactcactcactcgatgacagtagcgtactagtcaccgggatgctgccatgctaacaactcttgatcgatggatgatgcatgctttggtagctaaacaatgcaattatcaatcggtttaagcacccctcaacaacccccccaaataccacacgctgatcctgtcctgcactgatcttcttggtcttctcttctctcaagggcacctaactgacctaaccatcactctttctgctcggctctgtttctgcttctcatttcttggactagcagctggaaaggtcaaacgtttcaacatgcccctcacgtctcaccggaaagctaattaagagaggccaaccggttggtttagcacatcatttaggtactactccaaggccctgtactttcatgattatggtttttcgttcacatgttttccaaactgtttatcaatgctttcataaaatatttcgtacaaactgttaattcattcgttaaaaccctcaaataacctaaaaaataaaaccagataatccagcaattactattgtaacctcagaaactttaacaaaattggaaaaagatgtagtagggacagacgatgacgctaattagcatggagtgcaagattcagctgaaatttggcaggttttcgggtgtaaaaacaaactcggactcaacgacgacgctacgttatcagatcactagagatcgatacacacaaaggaagaggacacgagctgtgtgcatcactgaacagactcgcttggaaatttttgcacaagggtccaacagcaatggactttgtcgcggcaggcaacgacggcgacagagacagcagcagcttgcactgctcaccggaatgccgccgtgcggtggactcaaaggcaaaactcgatcgatcgatcgttcgttcgttcgttcaattagtccgtcctaactcgacagcgatctcaggggaggaccacggccagctagctcctaaactacttgactccccgatgtttatcgtgttgtcagaaaacgccgtcttcgtttttaaataattgttacagtttatcaggctgagttttttttattgagtttgagaactaacctcttgcaaacgcaaaacggagtaattcatttgcacatatgattaatataaatattagctattatttaaaaaagtggattaatataatttttttaagtaacttttgtatagaacttttttgaaataaaatccgtttagcagtttggaaaatatgcgcgtgaaaaagagagatataagttacgaaatatgtaatatggatgatggatagggtgttttaggaagattgagtgagggagtgtggtagtagtaagagcatctccaatagtctctccaaatcaaactctccaaacactcatatagtcaactctccatctgatttggctagttaaactagttattcacttcaacagtctctccatctaccctctctattacaagtctattacaaataggacccatatgtcagtctctactactcttcttcctcctcttccaacccattttccccacacatatatttcccttcctcctactggactattgcatcatccccacatcatcttctttgatacggcgacggcggacagcgggcacgtgaagcgacgacgggccgacggagaacagcgagcggcggtggcgccgagcctcgccgcgcggaggcggcgggtggcgccgcgtggaggccggcggccgtggcgagcgaaggcggcaggcggcgccacgtggaggctggcgactggcttggtgcggcggcgaaaagaggccggcggtcgccgtgctcgtcctcatgctcgtgctcctcccgtgcctctcctcggttgccgtgtggggatggaggagattggctgtgtgggcccaccattggctagccaaatagagtggtcaaatttggctagtggaaggagggttttggccagctggaaggcttagccatctggttggagaggctgttggagcgctttttaagctagaataactaaaatttggcttgaagagtgggatgtggaggctgttggagatgctttaggaccttgagttaggtagctcaagatcattccatttgtccattttcaaatttttcaaccatgcgaagtcacccaattgacttggaactagtgatttccatcggtttcagctctgtcctccaacattacggtttcgttcgattcagtagtttggctgagatgatagacattataaaaaacgatttgagtcaatagtacatgattaattaaatattataacattaaaattgtatttatttaattttttaaagaaacttctatatagatgtaggagcagatattttgaggtaaaaatttaacttgcattatataaagctagattattttttagtacaatagatatagccataaatctcaaccttcaacaacattgaacttttgaaccaaatttcaaaccttttggcaccaggcctaaaatgaaccaattcataaaacaaaaagatcgtacaaaacttgtacatggcaaacgttagcggtgaaaacgattcggataatatctgatctgatccgcttcgaatccgtccgaaacgaggatatagtatgggcttttagaaatccggcggatatcgaatccgtccgaaacgaggatatagtatgggcttttagaaatccggcggatatcgaatccgtccgaaacgaggatatagtatgggcttttagaaatccggcggatatggatgcggatatgatatctctaaaatccggcggatgcggattatccgacatttttatcggattatccaataagctgtttgccgaataatccgaaattatcaacatatataaccactctatctattgcatataacataagttggtacatccaataccctaattcatcaattaacaaagattttttagtctaaggtttttatcgtctcatgtcacactcacgtagctatattttttatattatgaacatcatgtgtttatgttgtttagcacttaatcatataattattacgatggatcatttattgattattgtatcgttgttccttggatttctaactggatgttgcattgatcgcatatacacgtagcatccgataaatttaatctgtttccgaactgattccacactgactccgcaccatttctgacatctgaaacaatccgctccgcatccgcatccgtacattatttgcatctgctccgaatccactcaaaaaaaatatgggttaggatatagtatgaccactatccgttcgaattcgctccgttttcacccttcgcaaacgtgcccttaagacattttgtctcaacaaaaaaagcgcgtgcaagtcagtggcgacgaagatatagcaaaaatatcatgacgcagtgtgaagggagagcattaactaactagcaaagaagaaagaagaaaaaagtttggcagcagggaccttgttgcaataaacgaaaagtctaggttgtttgaagcaaaaaaaaggcccttccccccgtgacgactgacgactagtacgaatcgcgcgtctcctcctccttcccttttataaaccggcaactcggctcggcgaggcagtcagtatactctcactctgtctcctcccccgcgtcggtcgcttcgcttctactggaggagagcagaggtggtggttggtgagagaggatgcgcggcggcggcggcggcggcggcggcggcggcgaggaggccggccagaagctgaagagcatggacgtcgacaagctggagaacggcggcgacaagcccgccctcaagtaccacggctggagggccatgcccttcatcataggtacggcgagatcgccgattcgatcgttttccccctccggcggcgccggcgagcggcgatcggcggctgatggaggtgtggggggtttgggtgtgcagggaacgagacttcgagaagctggggacgctggggacgtcggcgaacctgctggtgtacctgacgcaggtggtccacatgcggagcgtggacgcggagacgctgctcaacggcctcaacggcaccaccagcctcgcccccatcatcggcgccttcctctccgacgcctacctcggccgctacctcgccctcgccatcgcctccgtcgcctccctcatcgtaagcccacctcccctcctcctccgccgccgccgccacgcattcgcctcccaattcgaggccgggcttcgaattttgaggcggatgtcgctgcgatttgggggcggcgcgatttcgcttctcggattcagatttgtttttttttttaaaaaaaaaaagaaaatcgggagttggtggcctctggcttgtcagtagctcggttgggtgttggactttcgagttggcctcttttttgttattcttatttttatttttcttttctctgcgatggaaatgggcggcaaagtgagcgaggaaccacgtgcgcttgtgcgctcgtgattatttttaattaattaattcacggcgaatgtggattagaagagttcaatccttaattatttgggcggtaaattgaaacgacattagtataatttagttctgtggtgaaatttatatccaaatttttgctggaaataatgggttaatctgccaatactagtagtagctttcccaaagaggcggcggcctacatcggttagcctcgtgccctgcattatctgctccccttttgccaaagcggcactttgcagcggcgcagtggctcatgattagcgctcttctaatccgtattatatgccctataatccacttttatctatctttgtgggcagcagtattaattctgcccacactagcagctggttttctttttctgataacccatgtacaacaacaacacatcatcagtctaagctagtagttgttgcatgctcaccctagttttcttgtaaaagaaaaaaggtatggcctatttgacgtggacatatttacaattatatgtacaaatatataggagtagtacacctagttctgttttgaatagcttcagctacacctctattgtagttggagcccagctaaagtttcagctccatctaaaataggagtggggttgggtagagcgctctcacaaaatgatctaaagaagtggagctgggtttagaccgatccacaactccacttcagacccaactcctgaagctaaatttataagtttgagctctaccaaatagtcacttaggttgtgttcgttagatggggttgagagttaatctcccgtgcacggaaaacagagtggtttattagcatatgattagttaagttaactctttttattagttattagcatatgatttattagtatttttctaaaaaaggaataatatgatttttaaagctctttttctaaaaaagaacttttgcaaaaaaaatgcattatttaggagtcgaggcagttggctgggtctgtattatttgtggatctcacgtcgctaattttaagttttaaacataggaaactgtgtttgtaagggaacttgttgagcatttggattgggttagtggatcatctcgatctgtgctgaatcctgaagtggactcgcttcctctcctcagtttgtttaacctttcgcctgtattaatttcagtacaaaaataacatggggaccaaacggtgccttggcttgccaggcatgcaacacggataattttcaagttttaattaactctgttcaacaataatagtactacgtagtacaggggcttggttggtgagatgcagtgtccactgtccagttcaatttgtagttgtgttttgacttgaacggtgtctttttctaaggccaaactctggaaggccgtagcactgaaatcccaagatccaacctggttacattatgtcatgttttcacactgataatagtacctgattagactatcaagacactattagttagaacggggaaatctcttgcgttttgtttggatttgcagtaattttgtacggttcatctagtaggagtacaagtgctagaatcttggggggcctaggctaagcataagaactttctgctctgtgctgtgctgccaagtgcaaagtgcaatgagatgatgaacagtggcagccattgaggctgaagtgaggttggggatccggccatcttatccggacaatctgtatggaggtgactgccaactaactgcgcaagtggggtagtgtcctggtgtggccatcgacattgaccagctagctagctcacccccaattcctggaatatatcagcattactgtacaccattagtacttagctgcgcttgcatttcggtacacctgtacaaaaaaatcaattagtttctcgcacttgctcgcacgaaaacgatatgctcccaagtgagagtcagtgctgccatccaaagctccaggaattgactagtgagctgcccacgtcgcggcatcaatgtcacaccacctccctaaccataaccaacctgactatcaccaaccacgtactagtactaatgacgtagtgtaatcatgagccccatttaggtagtagtactaagcgtgtaatagtatggtttgatagcgagagccacttctgacgaatgatgcttgcgccgctggtgctcgtgggggcggtgggccagctgcttgattctgaaggtcacttctattggaacggtaacataattttatattggataattttttcaaattttatgttattatttaagtaaaaaaaggatcacacagctgataatcagccataagagtgttcaaatcatcagattacaaatttaatttaaacagttttcccggtttgtgtgctgtgctcgcatgcatctgttgttttgggccgactggttgtgcagacagaactcggcccaactaatggcccatttaagttcacatgggttattacacgaaactcaaagcccataatcatccaattcaaaggccctcgtttttcgcttatgcttataacttatcaactaaaatttgaattttcaatcttaaatttgaagctgattttgaggttttctcatcgaagtttatttttcaacctttgcttttaaatcgctaagaacaagtatataaaagttttattcacaaattacttttcgtttgcaaaataacgatggctccaatgtactaacgcatggtttccttccaatgatggacggacagggcatgttcttgctgacgatgacggccgccgcggacgggctgcacccggcggagtgcggggtgggggagacgtgctcgaaggcgacgtcggggcagttcgcggtgctgttcatgtcgttcgcgttcctggtgctggggtcggcggggatccggccgtgcagcatgccgttcggcgccgaccagttcgacccccacacggagtccggcaagcgcggcatcaacagcttcttcaactggtactacttcaccttcacctccgccatgctcgtctccgccaccgtcatcatctacgtccagagcaacgtcagctggcccatcggcctcggcatccccaccgcgctcatgctcctcgcctgcgtcctcttcttcatgggcaccaggctctacgtccgcgtcacccccgagggctcccccttcaccagcatcgtccaggtgttcgccgccgcggcgaggaagcggtcgctcaagcagcccaaggaccccaagcaggacctgttcgacccgccgcacaccagcgccatcgtcaccaagctggcgcacacggaccagttccggtgcctcgacaaggcggccatcgtgtccggccccgacgacgtgcgcgccgggggcgccgcgccgtcgaacccgtggaggctgtgcagcgtgcagcaggtggaggaggtgaagtgcctcatccgcatcgtgcccgtctggtccacggggatcatctactacgtcgccgtcgtgcagcagtcgacctacgtggtgttgtccgcgctgcagtccgaccgacacctcggccggagcttccagatccccgcggcgtcgttcacggtgttcgccatgctggcgcagacgctgtggatccccatctacgaccgcctcctcgtgccgcgcctccgcagggtcacgggcaaggacgagggcctcaccctcctgcagcggcaggggatcgggatcgcgctgtcgacggtggcgatggtgatgtcggccgtggtggaggaccggaggcggcacatcgcgctgacgcagccgacgctggggacgaccatcaccgggggcgccatctcggccatgtccagcctgtggatggtgccgcagctcatggtgctggggctctcggaggcgttcaacctcatcagccagatcgagttctactacaaggagatcccggagcacatgcggagcgtggccggcgcgctcgccttctgcaacctggcgctggggaactacctcagtgggttcctcgtcaccatcgtgcaccggaccaccggcgccgggagcaactggctggcgcaggacctcaacaaggggaggctcgacctcttctactggatgatcgccggcatcggcatcttcaacatcatctacttcatgatctgcgccaagtggtacaggttcaagggggcagccgccaactgagatgcaagtgaagtgaagtttgttcgtttgggtggttaattaattatgtcaatggcagataattaattggtggagtgcttttagctgggttttttttttctgcctcatcatttctctcttgtatttttgtatctgtggtgtcttgaattataaaatctataggattaagtgggtgaggaaagagaaggaaagaaacaaaagggttggtttcttgtaagtggttaaaattcaaagataaatgaatcttcaatcctagtaaatcgctacttgctgtttgactgattcacaaggaagtaaatgaaatagttttgaatgaaccttcaggtttgctgtttgcacttgtatgactttgtttgccttttcctcttcatgcagccacactccatcagagttcaacctggtctcagatacaataatttcatactcaaagcgtcagaaaatcacaatttcaacagagctctcttcttgcatagcacacaattcaatcctctgtgatatcagatcctctgtgctggcataagaagattgcgtaattaaggcgtagtaacaactcgcaagtgaggcgaccacctttaaaacctaaagcttctgcaagtgcaaagttaccggcggggggagtttttgtcaccacaaaagagatgtacaaccacattccatgaaggtgtacaaccagacacctggatacccatcacacaactatacttctccgggcaaaagacggggaagaaaagaatacacaactattctcttctcctatctaacagggtgaggcattctgacaacacccttacactgtttaaattgtaagaatctctaccaaagaaaaagaacgacgacttaaggcgaagcagataattacagggtggaacagagctaaccagctcactcattttttttgtttccattctggatggattggcctaatcatgttgataaagatctagataacaatctacaaaaatgctaccaggattgacaaatggagcttcaagtcaagtgacagtcagaaggttgttttcatgcccgttattgctcacaagggggcgcagaggatcattcctccaaacaccatcaacaataaatttaatctggagaataggcagaggggctatcagatgagatgaaaataataatgcctggaagcataataagacagaccattacctcatatctaccaggatacaacctcaggtttaaggaaaaggtgcctctttctgatctttccattcttctctgcacaaagtcaacaatgttatggaattagattatcatcagatttcagatgataaaaaaatgtacacacaacacttatttaaaaaacttccaatttgaacatataataataggggcatttgcaaatttgccaccggttttttgaatattgcaaggataccactcgaatgacagttctagtggcatttttgcaattttctagtggcagttttgcaataatgattcaaagtagtggtaaatttgcaattgccccataataataagcataacaaggtaacaatgcgaatgttatcaagcatggaagtacagagctatgtagagtgtcagattggcttcattaacattaaaattatattatatgaaatacaagtgcttgttacatcgaattgccaattacgattcaaaaccagaaccagtcaggtatgatgcagttatgccttctggaccaaatctactttaagcaagtgcaggacaatctgaattgttcaagccattcccactgaacttcaaatacttaaatgggcaaaatcaatgatatccatatgaggattctaaacctactagccacatagacgcatgatagttatttttcatattatctttcaaaattagcaccacatggcagaacaatcatcctaagccttagcgaagttcaaatattacgaaaggtaatcgagagctggttgaaatgttcacctggcttgtccagccatcaaaagatccagtcaatagaacctctgaagcaggattagaccacacaatataaacagtacggagctcactcaaggccttctcagcttcatcaagccttctttgtttctcttcaattattttgttcttctcactgatgacatggtatacaattactaaaagggaacatacaaaatttaaagcataggtaatcagatattaggtggacatacattatctccagtgccatctttccttctaatactgctatttttgcacggattgaccgcagctcttcctgagcttgcattactttggtctcttcaaattcccaatcgtcggagagcccatttggtgcttttgctccgtcaccttcggactggaaaaaaacaacaaagttggatgcttagaacaatgagtacagtgcctctggcaagatcaaggtgagaggcacaaagcacaacttcatccactagtgtttcatgtatttgtatgccctgtaactgccatattgcaatacaaaagtagctgccagatggaagtgttgctaaatatacattatagttaaaaattacaatattatgaacgaaatttcaatggaaaatcaagtcatatcatttccacgtctctaatctgcattttaatcaggaaactgcaagttaaaaactcaaaatacatttttttattgcacacttcccgagagcataaagcagatggagtattagacatacaaaagtttaattaaataaatggaactatctttcttcttttgtttgtgtggcagcagaatttttacgtaaaactaacagctttacagatgcagaaaaaacacttcgtgcacaaaaaattatagtccactagtaattcacaacaaatgaaagcaaaattgatgatgttaggggaaatatacacaccatatctgatataaccttgtcgaatcttgatcttaatgtatgaagagcggcagtaagatccaactccaaattttgaaggcgtgcatgtatatcgtctctttcagagtctacatcattaatatcataatcatgtacagccacaccattagatggcccgtgcacgtcatcttgtgcaagaatgtctaggccatcatgtctaaatgatttcctgctgttagttgaatggatttcagcagctgcaacaattgaccttgtcaacaaataatcatcaaacaaatgggatgcagtacggaagaaagttagtcatatgaccttgaaaatctgaaaaaccacccttgtcaagggaccatgttcgccatgcatcattagtcaaactctttgagcttttgttatgttctagtgctccattttgaggatgataactatgtatatttccattatcaggtacctttggagtgtacctgccaccagttgcagagtgactgggtgctccactctgacccattaaagctgcatatatgcaacacagaaggatgatttcagttatacacattatatgcaaatacaaactagaaaaggaagtagataatacatccaaaaggaacaccacaaatatgtacaaacaagttatccaataacgacaaaccaaaagttcattaataatattgtaaattgtggggtgtataatcacttcatatttcgttttacttcatttacaatattgccaattacaatgcatgatttaatcagtgatatcagtagtcaaacattcaatttcacttctcctatttataagtttctagtgggtgacataactgtcgttcgatgatactaaaagtgaactaagactaccatgaatgtgcgataatcgataaaatacctaaaacatggtcaatcttagaatataacatacatgcacacactacatttgaagtttaatcatatgatgtttgttttactattactcttgattgtaactggtgttaaaatcagaaagacacatcactgtgaaaaaggcaacttttggccccctgtgcagctatatgtggacaactgataagcaactattttactaggtactccctccatactcataaaggaagtcgtttaggacagcgacacggtctacaaaacacaactttgacgtcttgtttctataaaaatatttattgaaaagtgatatatgtatacttttatgaaagtatttttcaagacaaatctattcatataatttttagattttcaaactcaacaacttgagaattatttatgatttatattcccaaggtttaacttaaacattgtcctaaacgacttcctttatgagtacggagggagtactcaagagtgaagaattgtaatggttgatttaggaaattccctactggaggcagaagtagggaaggtttgtggacaagaccgtcatccgcaaaaatcagacggcttggataaactgacatgaatgcctctttttgccagcaaggaactgcagtactgcactgaataggagccagccacgattccacaagctgtaaccatgggggcaacaagtgcactgatacacggactaatcatctcaaatgtagtcagattaatgctatcatctcaaatgtagtcagatcaatgctatcatctcaaatgtagtcagattaatgcttccctagggacacgtaaaactatttttgcgaagcaagtatatatgatgcacaattgaaaacaattgatgtttctgaagaatatgctgggaattgaaaacccaacgcaccaacattgtcgcgttcccctcccgctccatcgctgctccgtgggagcggcggccggaccctctccctttccctctgcagcctggtaagcatcccgtccaacccagtcccaaatttcgtctccctgcaaaccaccgcgcaagcaaacgaacacaatcaggaagaaacgaacaccccaagggagcaaacagagcaacgatgccgagcagaaacccacgtctcctcctcctccgtctccggctggcgcccggacggcgaagcttccgcctccctgaaacgcacgggaatttcagctggaattcatacgggagaggggggcaaggaagaaaataccccagtagaagggaatagcaaaaccccacctggacgacgcccacacggctccctgcgctaggtcggaggcgccccccgccgccgccgccgcccccgcctcgggagggtagtcagggtgcacgccgaccgacgaggaggccctgcctgcctccgcgccaccggaggaccacccgagcgagagccagccgccgcaggcgtccacggcggcggcgaggtcggccctccccgcggcgacgagctcggcgcgggtggggaacgcccccggcttgtcggaccgccgcatgaactcgtagatcgcctcctcgaggtcctcctccccgcgggccgcattggacgccgacaacgtcctcctcggcgcccgcgtctgcgtcggcgccgcgcgctggcgacggtagacgcggcggcggcggtggtgatggtggtggtgcggcgccgcggcggcgaggaggacgaggcgtcggcgaggagcggaggcgggggctagggttagggttggggaggg

SEQ ID NO: 55269 - DNA, 6698 bp, Oryza sativa
attcctgcagcccctgcttctccgcggggggggaaacgcgatgggttgggcgggaggggggaggcgacgacacgagaaagatgaggaggagggggggagcgagacggccagccactgctgccaccagtggcgactggcgactggcgagcgatccctctgacgcatggggccctgggcaacccaacccctgttgctcctcccttcttggacctttctgcactgcagagtgcagatcccaatttggcaatttgcaaccttagcaccgcgacctgctcaggtggctacagctagtagcctgcgtttatgcctgctattgtacaactctatccgtctcattttaagtgcagccgtgaatttatttgtttaatgtttgaccgttcatcttattttaatattatcattattatcagataaaaaatatgaataatactttatactccctccgtcccgaaatatagcaacctatgactagatgggacatcacctagtacgacctatgactagataggacatcacctagtacgacttatgtccagatacatcgtactagatgatgtctcatctagtcataggttgttatattttgggacagagggagtacattacttaaattttaaactttttcataaatttttcaaataagacggacagtagaacgttggatttagaaatacacagatttaaaatgggacggagggagtagtagtaacagagtagatatgcgcaaacaaggagcatgtgactgatggttggtcctttgatgcgacttgggattttgtggatatggaggagactgtacaatgtgccatcgtggcgttctctccctattttgatagggaacgagatcatatatgctacattatttggatttgagtcactaatatatggtttatttattatgatttatgtgtaagtgatctagagtcacctggcatcatggtagagaatccgtgtctatttgattgagctaaatatggtgatggcggtgactatggcaatgaaaaatgatgtcggtggtgaactggtgatggtaataaatagaactgcctgtgtttgtaatttaatgacatgacgtgcaaatttgtattgttgggttgttttgttccagttgtgtgaatgtaaatagcgttgatggagaaaatataatagtgtagtaaaaaagatttcatttcgaaattgatttggactacattgaaaaggctcatttgtgacatgtgaaagggaacacgggtggttgctatatccgagagatagacacaaacacctatgggtatgtccatacctctcacatccttgtcatcgtacgcccgacaaatataggacaacatcaacctcacatcatcgattcgttgataacttatcgtaaacatttgagaaatttttcagtgagcataaaaatgcacatctccgatgatattcaacattctccgcggcttgtctgattggattgccacgcaattcgttcaagcagaaaacggtgacagctttgacagtgaggagcatatgacaaaaaggccaagaggcagacacttccgttttgttattatgggctgaagagagaatagagaaagctggaaaatcacagctatggaggatagccggtgccaattatttcatcgttggtcgagacggttactggttactggatgcatgagaggccatgaagttatttccactgaactgattgtgtgagctggatggttgatgagcaaacaaacagcaaaattaaattttgagtttatgagtgatggcatggggtgtagacagctgcggttcaatgttaccatcggattctccgttcatcattaagcagttcttccatttcaaaattttgccaaaatttaagctggactttttcctcgggccgatttgagagacggctactccttgccaagccaacctgggattttccttaccttcgcatgctttagttcaatatagttcatgctgcgagagtacgccgtgccaaattgtcgatacacagattttgaaggcgtacctgcatatatatggattgagatcctctgacttcaagttagagaggcgtgatcattgacatgtggatccgattgccagtgacaatgacttcgactaccattagatgacatgttaacatcatcttccgcgagcacatcgtctctggccatcatgtccaaatgatttcctgctgttggttgaatgaatgtcagcggctgcaacaatattaaccatgtcaacaaatgtttatccaacaaatgggatgcaagtatagaagaatgttaagttctaatatgacctcgaaaatctgaaaaaacaacccttgtcaagacattccgaaaatctgaaacttttacggcagcttcggttctaacaaaaaaaaaaaagggaagctattgcagtagttccgaatcaaaggcaccatatcccgtatcttgaatttaagtagacatatcctataatatttccataactacaggcggtttcccatttaagtgactaaacaataatccatctgccacaaacatgccaaatcttgttgcgtgcgcaggatttataaccatttactagatgtgtagcctctttaacgtatcatgtttggctagtgctacatgaatagagacaccaaacgaacacatcatgaatttaaatataacggaattccgcaacagtatcagttaatctgtatgatgatacatcggttgacacaccccttgttcctgggtcaccacggggatcttctcgaacgagaagagggaggacaccagctgagctccagctttggatacagaatcacttgcatcacccaaaatcaatgaggaaactgcatcaaaactgcatgcagcaagtcaagatctcgtgcagctgcactgtcactagaaagttcacccaaacataaaaggctaacagctccaagatagtgaagaagagctgcaactattgatgtcgtcatggcagctgatgaccaagtccagttttggcaacttcaggtttgctccagtcattgttccataattccattagcaacttctgaattaaatgtaattggacagaatggaggcagcgaaagcaatacttctggtctggagttagagggaggccacgtgcttcaatctggagaaacggtggaaaaagacaagttaattatttaacagcggcacaatgctccaaaagtgagttatattcagacataagttaatcatggaaagagagtatatttgcagtttataaaaccatgcaacccatccgcattgatttttaatttttatttttgcagctggttcatccttcacagttccattgaatatttatttgtggacacaatagaggatatcatatcatgaccacacagagtacaatacaaaaacttttcaactttataaagtacataagagaaaggatagacctcaaagcaatgccattacattataaccaatcgtgttcatttattgcagttacagataggtgaaatgtaaacatttgccaatggaatgataattcaattagcagagaatctaacatcaccaggtatcagatatacagagagaaaatacttattacaaagcataaagcatatcttctcccttatggttctgcctgagccaccccttttcagtaaattatccgagtagtcatgaaaaattaccaaaagttttgttcagacatctatccaggaaaaaaaaatcagctgaaaattactacagattgtcaggagggaaagaatagaaggctttttcttaaatccttaattaggcactggcaagtggcaaccgtgtttgttagtgcttttcgtgggatgcgaagaaaatatatgttcaagattaggtggtcagcaaagctgaaagaatcaactagggccacgttcagattaagtcacacttctttgttaaattctaacctgggattggtgagttaagctcttggctaaaggaaagcaaatgcgtgacaacgcaagctaattcagaaaagaagctttacctgttctctataggaataaaaaatcgttgcaacctacaaaaaatagagatgagaatttaacaacgatacgaaatcaaattatagcgtggtattcaaaatgattcggacaggagcaaaacttgagactaaaatcgcaaaaccttgcaaaagcaaagcttgtccagtgcatccttcccctctttgtcagcgactgtcacttccgcagctgccaccgagaattgcactgtcttgttccacaaaagggtttgcagattccctgcaacatcaagtcattaaccactatcaccaaacatgattacatgaggtccaagtctccaatgacaactacagagcagagttctgctgcgcaaatggtacaatcccagcaaatgatcatggactacttaccttgaggacgtcgatttcttcggggagagcttgtaggtggcctcccgggagagctgaggagatgtcactttcacattcgtccacgcctagtagcaatttaccatatgggacaggtaccacacagagtaaggattagttctccctgatggtgatggctactaaattgtgtgagaaataatctggggtttcgggggctcacccatgcccaggattcgtcgtgggtgagctggtcgcggggcgggaggacgacggcgtagaagcgagcggtggtgatgaggacgaggccggcgttggggcgctccagcacctaggaaacctcccgcgacgagcaccttccccggcgccgacgccgacgccgcccccctgccctgccctgccacagggatcggtcgaacggtcagacctggatcgagggctaggcaatcgaggtcaagtagagaaagagaaacactcacacttccattctcggcttcggcggcgaggggggacgcgatccggagctcacggccggcggcgggaaatgccgggtagcgcgcgcggcgcggcgcaagcacgacgacgcacgccgcctttcgaggtcgctccgcttacggcggggcggggcataggaagcgaggggcatcgcgagcgcgcgggcgcacgcggtggccggggggaaggacgacgacggcggcggcggcgccggcggcgagatggccttttgcagttacgcgggctcgaggactgggcttggtgaaatggcctcctgggccatgaggcccgctactcttagcttcaatataaaaattttatcctcttttttgtttcttttttgtttaggacaaaaggattcctccgtttccattcatgaaggattcgaattttatcctaaaatataaggaatttgcatgtctaacgtgtactcctgatgactctttatatatataacgactttgtagatattaacatgcatgtcgtgtttaggcgcatttagattttagggcctgttcactttgctgccaaaaaaaaccttaccaaaaatgttggcaagatttcttatatagttaccaaaatttggcaacaaactaaatgtagccactttttttagcaactttactaaaatttagtaaggttgaaaatggcaccaaagtgaacaggcctttagaacacatgatgagtatagcacgatctagtttctatgtgcacaaaattactttaaataaaaatcatatgctacacatggtgtaaaccgtctttattctcccagtcttgtttggcactcggaaaaaaaaaggaattggctgatgttttccctcgttatgcatgctcacacacttttatatcctgtgcgaatgcaaaaaatcatgcttgaagtgtttatactttatagtgataaaaacaaattttaaaaattaattaattaatcttttaagtataacaaatagttaaatgtgtctctaaaattaacgatgtcaattatttattagtagtactatgcaacatatcgtaccatccaatatataaaccactccaatagtaaatcttttggaccagatattaatttcaaggtcatgtggaggtttaattgcatatatgctagtactatagaaatctaagcattagatctggggttgctaaccaatccaattaacaaaagacagccattttgctggctaattctcctgcagcacgtgcccaacaccgaacccgacatcccatttacttttaagcaattttcacaaaactcatatattatactcccttcgtcctaaattacaatgtataaatttttacacatgttttaatgacatactttaaccaataatttattatattttatattcctagcagatataaaattaacatcacattaaagcactttaaaatatgaatctagttttttactgaaagttaaactatgaatctagtgatataacatacataatatttagcataaatatatggttaatatgcttattagtcaaaaactaccaagtttgatcttcctaaaaagaaataggacatcctataatttaggatggagggagtagtccaatttgttttataaccattataaccttatagagtcataaaccacaacattaaacattttttctttgactagtaaggtgcccgtgcgttgcaacgggaaatgctatatatcaatttcaaattatattaagtgaaaagatattaaataatcattgagtgaaaatttattgaacacggaaaaaaaatctggcaatccaaaaaaactacaaatcataattgttctatagattactttcaaagcaagaaatatgttatcattatagaagtatagtgcaaactttctgccacatatataaaacaatctcatggtgtttattaaattataa

SEQ ID NO: 55270 - DNA, 1646 bp, Oryza sativa
acatgttaaatatttataattataaaatatagttacaagcccgcgctagcgctatggtgacgatttatatcgtaaatgaaacaatcataagattggctattaagtatgtcgacgtttgatgtcacgactacagtatttggacagtatggggatcgttggtgctaggatatatgcgagactgaggtaaaagagatggtgacagggatttttatacaggttcaggcccctgagctatcaggtaatagccctacatcctgttggccggagccgatgttgctttttattcaccataatcacaccaatacaatatgtggggtagcctatctaactattgtcgacatggcggtctgaaggtctgactcgtagttgacaacagggtagccttcctcctcgagctcgtgcccgacggaatcagagacagtgctagatccctacggccggcctctgaaggtaccggatagggtcgatccaggcgtatctctgatgtcgatatccgacggcttgtcttggcgtatgtaggcttctatgttgattgaggtggccgtgtctcttcccttcctagggggtcttgtatttatacccatagatgttccattatccaagtagaactagggaaaccaatatggatacaatccgagtagtccttgtcgtttccatgtagaactctggttgtctttccttaccggaactcctcctatatctgaaggttgtttccgtataggacatgatatgtggtgggtcctgccgagatttagtcaacttctattaagtatgtggtatccataaccatgacaaagtatatattcaagacattaattaagacttaagtatcagatagttcaagcaggcaggtttaatgagctgagtacagaagctctttgtcaaaatataatataatacgcaattcttttaaagaatagaccacgctaaacttattgcaataagtttcggtccatttttgcaataagattttagcacgatctattcttcaaataaaattttcaaaatggtcaaattgtcaaaatttcagaaaatactctttgtcacaatataatgcaatatgcaattctttataccataaatactgcttaaacagacaaaacgctaattttagcgaagttacattaagaaggttttcacttcacgtcagaccagcacaaagagcctattacaaggtccttagttttactatagtgtaataaaccagcagccaaagaaactacatccaagacaaggtccatgattcagtcgacgatgttttatcaactccatgttatgcttgatgtcttcagcgtctttctcccacgtctcacgccagtaaccaaagaacgaaagtctgaaccaatttcaggacacatccaatcaatttgttcgaatacataattcatggcttttcaacgttaattaaagcatcacattcatatatcagtacatgacatggcaaaccacaaagccaaggttgccataatctaagctacgaccaaattacagaaatctttgcatttgcgaataaatgaccaagagagaatagattaaatcgcatgcactatttcagacacgtttggtattcacttccaaatatgagagtatgtactaaaccttaggagatatatgattgcgtccatattctaatacagaagtatatg

SEQ ID NO: 55271 - DNA, 3244 bp, Oryza sativa
attcctgcagccctctattcacttcaaggaaaaaaaaaatcaccctcaataaggtgagctggtgagggtgtgaggcggttcttactttaacattttatttaaagtaattaacagcaaagaaattccagtggttgtaagaaacagtaaaagttttccactttctcaatgctctcttgatcaactcatgtccagtgagatatctggtatactacacagatcaatagcaatgttccaatatctagatgcatataagaagcttgttgataagagttggtgatggaagatggtgatgatgtgcagtgtgctccacactacactgattttctgtggatgggtctttgcaggcaagggtgaacctttctagggttgtagaaaataattgcatcgtgtacacatgtgtatatatggatgaatagtccatatggttgtatttagtttacatttaaatataactatttgggcattttttgaatgagaatgcatgacatttatatgaaaaccagtgcaacgtatggtactacactagcaaaagcttaaaataagacgtaagataatattgaagaggaacaaacagaacttcaaaaataaaaggaacacttccttgacgccggcctagttgtctaaatgttgtataagaatcatcatgtacattccaagaaaaatgatacgacaaattataataaaaattttgagaagtgctctataaatcatttagaaacagggatgtatttgctaaatcataatagaatttatgccaacataacaatgtagaaggaaacagttcataccttcgtaaagcagcataagcctcagcttttttaagagggaaaccagatgaatagaaggcaatcaagcaatcgcattttggccaactggacataaaatgcagataagtgagacattactcgtaaacttacagccaagcatgcactacatttatgccataaaaaaatactacagaagtagtgtggataaacctatacttgaaaagaacaatgattaagttatcaataacctgagttgtcattacatacatctcaataggatcctcgagaataactttatccccaaatattataatctgcaagacaaataaataatgctgaatgacaattgatctgaaacatttcaactttctgcacataacttaaacatcaattaataaaatgaagttcagatagagtaattaataatgagattaagtatgcctgagataaaaaatagagaaatttgaagcgtaaaataataagtacagtccaggtttatcaacaggtttgataaaatatatgaagtatggaacataaaacaaaagaagcaacatgatgaattaatggaagcaaggagtaattagtgacatgtgatgtagctcgaactacggtaatgcataaagaatgacgaagtggtcagtggtcccgagtagaatgcaaagaacaacatgcaaatggattaatatatgcatgccgtggaccaaatccgatgccttatcgtctgcagaaagttaagatttccattgcatttcacaccattgtttaattgatagggaatcccggttcatattaaagcaccgctcaatagcttatatacttaaaaggagtcaacattggtgcataaaaaatgggggatatggagtactcaagtgctaacattcaaatatttaattgacaatagtggctaaattatcggtaaagcaaagtaggcgaacttaagtccacccaaaaagaatattgcaaagaaactgagagatcactcgtgtccagtacagattaagggacctagttgctataagacaaaacatttggggacaaaccgcaaaagcaaccacatgatggggacctcaagtactggtatccacaaagaaaagatgcagaataaattggtatccacaaagattcacggatgtctcgccataaaatatttcgaaaaagcaattttttttaccaaaaagaagaaaatttatcgtatgcaattccatccacccatccactgatccacatgacaagcttcaatcgcacacccgtttccacttttgcaaattgatcgaacaaagaaagagaaacggcttggaaaaaaaaatctcgcgtacctcgaattctccaaatgcacggagcctctcaagaatctgctccataggagagcagaacacctgcagagaaaaacaaaaaaaaaatcaagagattgattagaccatatcataatcatagtcaagaaccagcggcgcgactagaaacctcattcctcaagaaccggccaaatcaatcaataggcagccgcagtaacggcaacaaggcgaatcaaatcaagaaccagaaacgcacggcaacagcacgaatcgatcaaggaaccagagacgtccaaaagaaagaacagataagtgattagtgaacacaggagagatcgaaaaggaaaaaaaacgaaaggaaaaccaaatcaaacagccatatccatgcgttcgcggatcacgtgaaccacccaaaaaaaaagaagagaagaagaagaaaaagaaaagaaaacgagagtcctagaaccaaagggcggcaagatccccccgaccttcttctccatgacgcagacgccaatggtgatcgagtcggcgcggccattcccctccaccaccattacgtccccctccccgctcccgatccgcgtccacggagcgtgcgcgcgaatctggaaagattcccacgcggacgcggggggcctgactcgagaggccaagatttgatctcctcctcgggtggaaactttggaagagaccggagacgctctccacctctccgtgttccacacagctttctcctctccgccgccgccgccgccgccgggttggtagccgcgggctcccgctcgcagtcgcaggaaggaggaaggaggagaaggccgaggctggctcttatcggttgcacagtggagggtggaggcggtgctgtgggggattgccttggttttaatgctgtggccacccccgttaggttaatgaatcccgtttgctttcaaaaggacgtgactattcagagaccgcaatctatactgtcttaactgagactcatcttgcctactaggacactaaataatacatgtattttttcttcttcttacagatttttcttttaaattatttatctgatttataatccgattacactattatgttcgttgcaattaaatctttataacaagatattacatgactatattttaataaaagaaatatctatgttataaattacttttattataggaaaaa

SEQ ID NO: 55272 - DNA, 21705 bp, Oryza sativa
tttctgtcaccgtgttatggaggtgagtcatggagatatatgctttgcatttcgttgcctttgttctttgcaacacaagcagagaaagacgaggacctcttcaaggctccccggttcccggccaacccctacaactgcagcaaggggagggaggagagagaggcgcgccaaagggaggagagagagggcggcggctggaagcgctgcaactgcgagctcgccaacgcgtagctccgcgctgaggctgaggacggcacgccgcccgcggccgcgcgggcctcgtccgcctcgccaacgcgcagctccgcgccgaggccgccgcctccgcctccgcgtcaccaccgccgtcgcagctccgcgcggaggccgcctccctcagtcgccgcctccgtgtcaccgtccgacgccgccgtagctccgtgccgaggctgccgccccagcctgcagatgaccgtgagagagagaggggaagagtgagagagagaggaagagtgtatgacaggtgggtcctacaattatatatatatatatatatatatatatatatatatatatatatatatatatatatatatataatactgactggactgccacgcgtacgccatgtagaccaaaactactacggattgggtcgaggggggtaattcgtccggtttgtatagttgggggtgaagaatgtcggttttatggttcagggggtaattcggacgaccgtgatagtttaggggggtaattcgtactttttcctttattatatatctaagttacttttatcatatatataaattactttttcgagttgattaaattacttattatacattcataatatttttgagttgtttattttattatcatttttagtcaattccattatttgtgttgattaaatttaatttctagatatactcacgcttttacctccataacggatctacttttaatgtcatgacaaagttacttcctttttgttttaagttacttctataatatatgtaaattaattttaagctttactgaaattacttttatatgtttaagaagtagtttagtgaaatctaaaagtaatttagatatactataaaagtaatttgtaatttttcatcaaaatataatcatatgagatcttgttagaaagatttaattcttacgaacataaccgtgtaatcggatgagtagtttaagagaaaattttatttgaaacataggtgataggaatatattttctatttacttgatgagaactagtactacagttaaagtatctagatagagactcgttagcactaaaacgagaggcctacacgtgaacagttacagacgaatgtcgtgcatgaatacacgtcatgctagagtattagaaacgcaaacgtttcccatgcatgcacgtaaattggttggagttcacgtcacaactaaaagttatactataacggagacatgcaacggtctaattctaccgccattagttattatagcacgatagggctaacataaatgcgattgttgtcatgtatgtacgtggaagatgagaagggctaatcacctgtcgacgaatttttatttcgctatttgtagcccgctagctctaaatttgttaagacaaacttactatatagttctcatgggacaatgtatttgtttaattatatatatttttatagtggtttactgttatcattaaaacaatactattttaaaagggtgtgccaactatgtattttcatatgtttttttcaatggtaataaagctgtggtacaagaatattgtttggttctgtccaaatagcaaggttatccacgtttgtctatcatgacgcgtgctaccagtaccaactaatgacttgctgctatataccgatcgggtttatttgatcgttctcgagtgattttaaattcaaaaataataatcaattattggagctaatttaacataaggtagacataatcatagccgatcatatactttttatattgaactagctggacactcctagtagttgctttttatggaactagctagacgctcctaattgatgaattgctttggacaggggatggaacaagaaatactggagttgttacattgaaagttgcttaattgcttcaaggcaggttttgagatgctttgatcagattagcgtaatcaacgctcctgatttcatccttagccaaccagcaatgcatcataatctccgaaatttaaaatgagaaaacgaaattacatgagtcattttgtagctactactacaaagcagagggcttggataataaccattgattccatttcataagtaaatactacttttgtgtcgtaataattctatttctgtgatttaaatttgtactaaaataattgtcacaatagaatactaatggtcctattaatcacatatcattcaaatgtctccatattttaccctcaactacctttttactcttacctatacatcatttaataaggggtatcatattttttttctttttaaatcttaatgtgtactaaataacttagaatcacaattattttatgacagaggtagtattaggtaatctacatacacatcactaattttctcttacaaatttagagagagaaaaaaaaagacaactcaacatgtatcccaccgccaacaccacctcacatacttgtttttttaaactgctataatgtggatagaagtattgaaacggctagttcgttaacatttttttactattttggtttactcggatttaacatactcgaatatagggatagcaatttcccccacagggccggggccgggtgaggtttttaccccgcagggagtcggggccggggccccgcaattaggcgagtgaggggccgggggaggcattccacccgcggggctccggaggaggtatatcggacttttaaatatagcgtcaatcctaaatatagcccattagacccaacccgacttgagaaaaaccctacccataacacaaccccaccacccatcactcatggcgtactctccccctcctcacctagccgccaccgccacgccactgcgccggcgcgcccctctatctcgccctctcccctccggccatcctctttccctccgcctccagtcgcacgcgggccgcagccacacgcccttctccctcctgtttccaggcaacggcgcgcgggttggcggcacaagggcggcgcatgggcggcaaacgatgagcgaacaagcgacgcgcgggctggcggtgggcggagcgagggcgacacgcgggcaacgcacagccacggcaagcccgacgactgacaagcaggcgacgcacgcgagcctcttcctccgccagtcctcccctggtgactgcgggtccccagtcgggttgcggggccccgtaggggccggggccgagggttgatttggccccgcaactccactcggggctagggccgggtggaggccggggtcgttccagcccaacccggccctgacccaccctattgccaaccctactcaaatgaattggttacttttcttagttactcctagttattgctaaaaaaacaggtggctaattatcgtaatcatctatcaacgaagaagaaagcaagtaaaacgctacaaaattacacatatttatatatatttttaagaaaagtctaattagacattgacaataaataacatttattcagcgtttgccttttcaattgagaagttttttaggtcttgtgtaactcacggagctgatcgaccatcagttctcggggactcgtagcagtttaacatatatttactggtatgatatatggttggatggcaacaggtggagcccaggtgaatgtgagatccgggatcgtagctttagttacattatctccatgtgggcccagaaggtctcttccatactccatccgtcctataatatattaatctattatcagatatgatatattctaatattatgaatctggataaagctttaggttgattttttatagcacaaaaggaatagcatattgttgacttattttagtctttgaattgtaaactagagaggtaatattcagtagtaatcactatggtctattcgctatgattcgggggttaagcactattttttttcacgaactcgtaaaaagattgtatgtcaatatattagaaaaaagagtgtttgtttacacaatgcaatcaaccataccggcttatgccaagggaaatgagaaaagacaaaaaaaaaacaaggaaaaatgaagagactgctacgacggctggacacagctccaatcagcggggagggggcagagccacactaccctctaaaaaaacccgaaagaagcaacgccagctaacgatcatagatggccctcagtgaggatggactctagaaccactgagaccgaagagagagtaaagtcgaaaaccctaaagtttcgttccttctacagttgccaagaaaccaggagggccagagagtcgaagccggcacagagatgatcaggtaagcatgtcctaaaagatggccaccaattctggagccaattgccacgaggaggagagagggcagcccaatcacaaggcgacaacaacggaaccaagacctgccaagcgaacacgcagtcaaggaggatgtggttcaccgtctcaagctcctgagcgtaaaagagatagatgagtggcgctgctgaaatacaaatcaaaggaataacttgcatttagcatcttcacgtggggggtaagcactaccattgttgatttgatccctttcacaataatcccactgtacaaaggaaataattaatacaggttccattgtgaataatagtatatgcaacccttgtttttagggggatatatgccacccttaaaaaaaaaaaaggaagatgtacttatgcagtactactaatatactggtgcaggacagttatttccacatgaaatcgttatagttgacttcttgtctataacctcagctccgtcataaaatatgtttaaatttatagttacaaattactatattttacaaaacagggagtagtatatgttcgtcccgaattcctcatggaatagaatatcttgaaacgaaagcaaaataaccttcacctaccctggctaaattgtaaaaccatcgtaatatcatactccctccgtcccataatataagggattttgagtttttttcttgcattgattgacactcgtcttattcaaaaaattttggaattatttttttgacttactttattatccaaaatactttaagcacaacttttcgttttttatatttgcacaaatttttttaataagacgagtggtcaaacaatacaaacgaaaaatcaaaatatcttatattatgggacggagggagtaatatataccaatgctgctattgtatatgtaactgatgtttcaaaaaagatgtttttagtaatgcctaaactagcacgattaaattaatgagcttgatattgatatgacttttgctcctgcaattttttggtcgcatgcgtaatctacatggaagtcaacaaaagatcaggtcaaaagtcacgcttttgtcaagtagaagtaaaactttccagtagagacttcacaagttgacatcaaagttttgtttagtactactgttaaagcgtcaatgaactaaaactaacagcgaccaaaccatttaccatctgtctgtaaagccaaactggcaaaattaatcacatcacgcagtgtgctggagtttggttccattccataaaagaagaagaggaaaattgaaaagaaaagaataattgcagggatcagtcatcactgtcctcgtttaattttggctgtgctgacatatactgatctttatcctcgatctgatggcgatcagatggttagagtactttctcaattattgggagaattaaatcgattttcctcgcagaaaattatatcggtttgtaagagaagccaaagcgaaagcgatgacacacacaaaacgatatatatgcacccgtggcgatcggtaggcatgcagttccatctcaatctctaagtgcgttatatataacggttagcattagctagttagctgtactaattaaaaaggtataagttactagcacattattacttaagtatttttgaagatgattacttaagtgttgtctattgtaaacttgaaaaataaatttattaaatattttagataaacttatatttagtatgaagcatacttatttaacagtttgtgctcgtgataaacgaggaattagtttagctcaaatccactttaactagaacacaacttaagacatgtttcgaaactttttctcatttaaattttctctaaaattttttacttccgatataatccagactctcatttaaactattttaagattacatatatagctataagtatagagaataagtagaactcacaagctaaaaaaaagatcatttttaaaaaataaatcttatgagctggttgctttctcgtaatctcacgagctcccagacatgacacaagctcgaacagctcgagcattctcggcgaccgtagctactactagtcggcagagagaaacaggcggttgtaaataaaacaagcaaacgacgtcggaaaagaacaaggctttgacgacagccaaactgttggtttctctgggcaatgtacagcagaaaacgccaagaaagctacgactactgctagcgtggagtcaggtagagcaagcagccagagaaactgacgtgccgccgccgcgtgttcgttctcatcgcgacgcgcatccgccgcttggtccgtagctgcgatcaggattcccaaaccgtttaaaataagatgatcgtcatctcataatttaacggccaccacgataattacgtagtacggtataaatcgtacaattaccatgagatatatcgtggtttaaaaattaaaaatgttaccgtacatggataaccgtgtgataactaaccggttttttaaaacttgcctgggatatctcagcccacaacatttaccgtgagatatgtcgtggtttgaaaatttaaaatgttactgttcgttgataaccgcgagataaataaccggtttattaaaacctgcctgcgatatcccagccggcgacatgcatgtgctcgcgccaatacagcaatttatctacgccctcttgcccaacctcgcaaaaggaaaagaaaaaaacaactactgtagtaatctcagttcagattcgtcgtcagttgttactaataatcagttaattaactaatcccgaaaagagtgtcagctactcttttgagatattgcaactggccaactacatctcgctaaaacttgggttggttttatatatgcaggattaggacaaatgcgaataaatgaagcaaaatcaattagcgataagcactgcacgttaattattggatgaatagccaatacgtccctaaaatttcgctttggctcaatttagttcttaatgtttcaaatcgtctaaacaagtcctccaaattaatcatttgggttaatataatacttgaacccacaaaaaataccacgtgagcatgccaagtcatcctcgcatacagcggtatgaatgaaattaccattctacccttatataccatatagaaaaaaaagaaaagacaaataaaaaaacaggccagcccatgtcagcattgttgcgaatgggtggctgacaaagaaatttacgtgatcagtgcttggctgcagcaatcgtaagtgacaattctaaaacaatcatacatgcgtgaaccatttatcttcttcttttctttcttttctatatggtatataagggtataatggtcatttcattcatagcactgcatgcgaagatgacttggtatactcacgtgacactttttttttcaaggactatattaatctaaatgattaatttagatgacttgtttggacaatttaaaacctcaaggactaaaataaactcgaagcgatacttcaggataattcggatcctctgcattagaggtactaatgcagaggatgaacagtaccacgcattagaataactgtggaccgtcggatcaagagtgaaaggaccagattgtgtgctacagtaaattcggaacagtaccaaatagtgtactacagtgttttgaatcctgtagctacagtaaaatagacactgttcatggcattagctgctgttcccctcacatgaacagtgctcttctgcattacggcagacgatccggatccacttcaggactgtattaactatttgcccttaattattaaccattcccattccccgaataaggcgccaatcgccatgtgtttgtgcagcagtgggcctcgtgataattctcgtatcatcgttgtcacctttacggagagtaatggacacgtagagatcaaagatgattctccttgcttctttctttcatgtatttgtcacgttgtgccatgaaaggaaccaccgctggattccatctctgcgtgcatgtggctagctggataatgtgacattattaagaaattatgagaattatttttatgaaattgtttcacctgtttttttttctacttatatacatgcagagtacagtgagttttagtgtgcttataataatattgttttagttataaaaagtccatttcatcatatacgtatattccaggctatttagttcaagatcttcccgtcataataacaaatgaacacaatagagataaatggcgaacatatgttgattattcataacttatgaatcggacaaaacttatatataatatgtgtgtgtacattacgatttaaaaactaatggtaaaaaattaactttgatgacaaaaaaaatcaaaatcatattttataaaagttaaattttagcagcgtcttataagctgagcaaaagatgctgagccttaacaaatcgagaatacaattgaacggtcaaaaacagagtaggacccggcgaaaaaaagtaatgcagcgctgtgtacctcagcaaagcctctagcgcacagaatttatgttcctgacgatattcttaattcagtgtgccaattactccctccgtttctaaatatttaataccgttgtctttttagcatatgtttgattcaaaaactttcatgaaatatgtaaagctatatgtatacatataattatatttaataatgaatcaaatgataagaaaagaattaataattactttttttaataagatgaacagtcaaacatatttaaaaaaattaaatatttagaaacggatggagtattaatcaagtcagggccatcgaggaatgagatcacgcgcgccggaggtgatcggtgaacaggaggtagcttgccggcggcgggcgtctcgccgtcgccggagcttgctctgatcagtgccacccacctaatcccggacttgtgaattccggcccatccacagggcatggcctgggaagcctcaagccgctccgtgacggcccaccaggctctcgttgatagtcttcggtgcttcaccggcacggccagagcacgatcggacccgggctgaaatcagtcgggttggcacgacccgacctacacggtgggccgggccatgcccacctacttgctgcaccatcagcccaagcacgatccaataagactcgggtcgtgccggaccgacccgaagacacgaaaacccaccgtgctcctccttaaataaagtatatcttgcctccctaatctcgttgggtcatctcttataggaaaaagtacaccgaaggtctctcaacttgtcatcgagttacaaaatcgtcctcgaaccacaaaaccagatacaacgtatccctcaacttataaaaaccaatgcaaaatagatccctcgacggttttgatccggtttgtccgatgtagcagctgactcagcgtgggacccacacgggtcctgcatgtcagcctctcattcccctcccttctccacctctcttcctctctgctcttcttttctctcactgggcactggcagcgcagccgacgggtggaggaggctggtgggggaggcgggagtccgacggcaaggaggcggcggtggaagcggccgcgcgacgaggcgacgacggggaagcaggagagcctcccccatgctgccgccaccgccgccgccgacggcacgggcgccagatcccgccgccgcgggtgaccatgccgtcgccgtggaggccttccgcgccatggtccggcgaaggcgcgctcctgaatgcctgcacctacactgtcgtcatcgagcacctcgcctccgcgggattcgtggaccaggtggtcgacgactcgatgtgttccgcctcctcctgtcgctgcgcgcgcggcggaccacccggcagtacaacgtgctcgccgtggcgcttgcatcggcggggaagttttagctgctccggtggctcgttcgcgagatgaggtaaggggaataagaggttgacatgtgggatccacgtgtgtcccgcactgagtcagctgccacatcggataaaatcagagttaaaaaccaccaggagatctagtttgcactggttttgtaagttgagagatacgttgtatctggttttgtggttcaaggacgattttgtaactcgatgacaagttgagggaccttcggtgtactttttcctctcttatatggctgaaaataagtctattttgtatcctcgtctctgtcggccatgtcttgaatgggaacatggcgtgatctcaaaaacaacagggactcgaacacagtaaaattaagatatcgtctgttcggaatggaaacacgaaacacacacgaagtcagtaaccgaacgctgagacactactactagtacagtcagggcggaacttgagcatacgaaggggtgccgagtgaccaggttttttttaacctatagctagtatattttgtacatccactcaatacaaacttaaacatccgtaccagtttaaacaagatccatgataaagtaaattaaacaagtaacacactcctcaatttcattctagctccgcaccggatacactactacactagagatacgtttattcagagaaacagcaggtatgcagcaacgcagccacgcaccacgatcaataaagcaaagcaaagcagcaaccagagtaatttcgagaatcctaattctcgcgcgcgccggtagcgtgcactcccggcccacgcggcacgcgcgcgcaattttttcttcggtaaccaccgccgttttccttttttttcgctttctttttttccgtgattttttttcgctttcctttttttttttgcgttttttcctgattactttttaatcttccagcagcaagtgtttttaattttttttaaagtttttaattcttaacttgaaaatttttaaatcttaatttaaaaattctcaaatctcgaattgaaagttttcaaattttgagttgaaagtttttaatcccgagttgaaagttttcaatcttgagttgaaagttttcaaatctcgagttgaaagtttttaaaaccgagttgaaagtttttaaatccgagttaaaagttttcaaatctaggttgaaagttttcaaatttgacttaaaaaatttaaatttcgagttgaaagttttcaaatctaggtttaaaattttgaaactgtaacttcacatgtagatttctttttaatttgttagttaaaaaaatctcacagaaaaaataaaatcttatctactaccatcattatcctaaactgttattatctaatatactaatagattagtataactacttagctcgaaaaaacgagcaccgccgacgctcacgcgccagctagcgatgcccgagtaatttagcatcaggcgccgtggctgtgagcccgcagcagctgcacgaagctcttgttcgcgatcacacggaccacggcgagcgcctcgccggcacgcctcctcagcagctcagtgaacgggctgtcccacctcccggtgcgcctccaccagaggacctcgaacgacatggtgtaccagtgctcgatgtacggcaggtgctccgccgccacgcgcgcctcaccgctctcccacctgctcgacacggtctccccgactggccttagccgcagggcttgggtcagcaccatcgacagtgttgccacgccacgcctcatcgcctcctcgccggtggcaccggcgtcgtaggaggacagtgccccgatggcgcgcagcgaggccgccctcctgagcggcaggccggggatgttctcgaggccgccaataaggtcgcggtaggtgttgcggaacgggagacgcctggcgttgtcggggaggacgtcctcattaccggggaagacgtgccaatggccgcttcggttggcgaagccagcgaaggagtagtcgtgtttgtgcacggccaggtgcacggtgcaccacgtcgccgtcggcgcctttcatgctgacaccgtacttctccaccaccaggtggtggtctcgcccggccacggccgagaggaggaagaagaggaggaggagagcggcatggaagctcgccgccatggtgaaccaggacgccgagcaaaaacaaagctacgtgcaatgcaagaatattagtggtggatctagcatttaggatatgggtggtccgacctaatttttttttctaaacacagtaaatctaacgatactaatatatacaatgcaagtatagataatagaatagaccaaattgtaaaaaaattaccatgatatatcacaatgcataagagtttaataagattttaaaactaaaaattgaaaaacgtatacacatagaaaacctaaaattgttgccttgttggcgcgggcggctgatcagctcgacgacggctcctcgcggcggcacacgcacagcaggtcagcaccaatgtagtgccagccagacgcagcacagcagcggccaaggcggcagagtgcgggactcgcgcgtggcggcgtggccgtgggggcgccgggcgcgggcgctggccgctgggtcgcgcgtgccggcgtgggctggccgctggcgccgtggccctgccctgtgattggttgtctggctgctgatcgcgtcgcgtcacgtctgacgtggagtgatcagatgagatcgcggcgaagggcgaggaggactcgcgtcgcgtgatcgcgtgtgggcctgtgggcgccgcgagtcgggactcgggaacgacgggaggaagaggattagatcgctttttttccttttcaaaaatcgctattttcatttttcttaatatatacgggtccatcgccgtttttccccggaccaccctctatatccgcctacgatgaatatgaaacttcgcactgtcttgtgtgtggtcgttaaaaaaaaaaagctatgtgcagcgtgatattatagtgaaactgtccaacgaggagattatttcggcggcgccatgaaaaaagagcgtgtcctccctaccgccgacgagaaaagctgacaagagattttgtgtgaataacctgatgtttcatatgcatattagtacagatcatcacaatgaatttgctgtaaatttgcttgattaccaccgttaccacataattacacccgacgcaatttcaaacacgtacaacgaatgctgaaacaatcccagcgttcactaacacatcctacacaaagaaggttcagatagacgaccgatcgatctacagtagattgtacaaaagaaaaattggacgaaatggaaaacccaaattcaaattcgaatgaagtatgcatcaaaaaaaaaaaattcgagcattgcatcgacctcatattctcaatgaattctcaagcctgaatcgactgaattcgtcgagctagctagcgcgccatggtgatcgagccgtccttgatgaggctgttgctgagcgtcttgaaccgctccctcgagtattgccgcgacgccttcctccaatccgtcccggatttcatcatcgccacgaactcctcgtagctgatccgcccatcctgcatgcaaattcagagattgatcagtttcagagtttatttgggagagctctaacgcctaaatttaactccgagagccgagtttgaagtggagttgtggaggaggctaaacccagttacatttctccagttcattttgtaagagcgcttcaactaatttcactctaattctgagtggagttcaaactatctggctaggcttcaaaagagatagagctgaattgaagaacatttttgttgcaaatggagtagtggaagggaagcgtgtgtgtttaccttgtcggtgtcgacttctctaaggatgtggtcgagcacggcgtcgtcggcgtggccggagtcgtcggcgagggcgtcggcgagctcggcgcggtcgatgtagccgctgccgtccttgtcgaagaagaggaaggccgtgcggaggtggttgtcgttggagaggcgctgcaggtggatggtcaccgccacgaactcgccgtagtccaggtacccattgccatccacatccgcctgccaatgcaaaatcaagaactcgccattgccgccattgctatcttgaagaagggtaaagaagcttacggcctccatgagaagctccatctcgggctcggcgagcttggagccgaccttggtgaggccgtccttgagctcctggagcgtgaccctgccgttgttgtcggtgtccatgagcgcgaacatgtccttgatcacctccacctcctctaccgacaggtgttccgcgatcacctgcgtgcatcgctgggcggtcagacacagaaacgggctcgccgtcgccggagacgacatcaagagcagagcacgcacgccacgtacccgcatggccttcttcttgaggcggttcatgagggagaactgcttgaggcgggcgcggacgacgtcgccgagggggacgttgggggcgcgggcggcgtggtggagccaggggtggtcgagcacctgctgcgccgtggggcggcggcgcgggtccacgtcgagcatctggcggacgagggacttggcggcgcgggagatgcgcggccatggctcccggtcgaagtcggcggcgccgcggaggatggcgcgcgccacgccctgctccgtctcggcccagaacggcgggacgccgcacaggaggatgtagaggatgacgccggcggaccagatgtccacctccgggccgtagtctcgccggagcacctccggcgccatgtagtacgggctccccacgatctccctgaacctctcccctgtttcctttcacttgccaagtcagttttttttctcttttttttctgtatatttatcggcaaattttctcataaaaatttaacaaatgtaaatatgtgtaatcacacatgtaactataatgtaatttgtacgtaactttcacatacttttaaaccgttcgattttgctttaaaattcatgcaaggtagataagaaaaaatcacattgcacacgcatgtaagggaattcggttccattacctccatttcatggaaataacatgtcgcctattgatttttgaaagttacttacaagttacatgatactaaattataatatagttacaacacaattgtgctataattacatctttgacaacaaatgtataactagttttttggtgaggttgaagaaaaggctggatttgaaacatgggccgtatgaaatctactgggcctatctgcacagattgcatgtaggccggcccatctcagagtcacactctcactaggctctatctcgtcacaaatattgtactgtggttagtacaaatttatccacaaatgtatacttaaccccatattttgatgctttagatatgcatttagacttaaggtataaataaaaatccattttaaacgttcaagatggataagcaaaatacactggaattttatcactgtatatattatgatgcaaagtgatggtcaatattatgtttgaaagatcatgtcaatgtgcaaaatgtcttttttttttgcttgaacatgaatgtgcaaaatggagagcctctgtttataacaaaggacttgtcaaggagttttgtagaattcaaatctttccatttatttgaggaaaggattggagatctaaaaatctcatgaaattcctttggactgctcaatgcattaatattttggagtaaggttaaaacaacccccgtctctctgatccaattcttgtacttcttttattatacggatcctttgttatgcaaatgtatttatattaaaactctgcttatttgctattcatatgttttaccaccattcttacattccaagcaataacggtacgagttgactgtattctgaaatgatctgtccagctcaatctattcggccatgcaacatcaaagaggaacaataattaagaacaagagtgacagtttttttctcccctgaggactcaacaagagcgagtcgtctattatcgtaagatccttgacaccgatcttgcttatcttaattaagatcttgacagcaatctgctgccgaccacgacctcttaacagtctggacgcaactatggaaaaaaaaaactcggcgtgtggtggtgattttgttctcttttttaatcactgtttttcgtggctgcgtatattcggtctagatataaacacatggttttccaatccattttttttcaaaataaaaatattcaggttatacttttatattcttttctactatcgttaattaaaaaagaaattcagctttgtggtaggttgacgaactcactgaccgagtaagctaaacacaggggacggcgtgatgcgtgtctgcagagaggagtagcatcatctgatgacccagcatccacagactttttctctgaaaatttcgggcagaattggctcggtttttcggctcaccgtcacgatcagctgccatttcaaatgcagactgttcttaatttcttccaccggtgaaagtgaaattcaggcgcaagagggcaccgaaacgccgacctgttctattttcactgcacaccaaatttactaagggagggggtcaaatttgggttggttagccgaccaactatgggttcacattttgttagaaataatgtgttcttattgatgtttatgattcttttttaatacgagtgattttgcggttttttatgaggcatcgtattttcggtatctctctctgcaaaatttgattctccctccctcgcggttcatttatatttgacgttaacagaattacgattggttcttccaacgtcaagtacaaatgattggagagagcacctcttttaagtaccataaaatttctcttaaagatatgtttttcatatataaaaacataaaaggctctactgaggttttatatgtactcccacctacccattgatcatttgggggtgttttgtgctttatgatttggcacccgtgaaaagataacgtgtttaagaaatgggataaaatttcaccttttataacagaagggatcttttgaaaagttgtagcaggggactaattaactattcccaactgtgcttatagtattataattctcaaagaatccacgtgcaacccaaaaaaacaactgcaaaactagtttgagcatttctggaaaatctctgttttcatgcaattagatcttttgacattgtgaaggaaaaaatatcctcttttttttgcaatttcatctttgatattttgaaaaagctcccaatttatttacatttcaatctttgagattgtgaaaaattattgtgaaaagctccaaatttatttgcagatcaatttttcatatagtgaaaatctccaaaatttcttgcaatgggattttttgaggtactgaaaatctctaaaaaaattctttgaatgggatttttgagaatatctactaccactaaaaaattttgagaatatgttctaaaaaaattaaatggggaagagaggcaaaaaaaaaaaagttttgttcaagcgtgcatgcattgcagaggaagaagaagggaagaagctgaccaggtcggaagaagacggagaggccgaaatcgatggccttgagctgcgcgtcctcggccttgccggcgtagaggaagttctccggcttgaggtcgcggtgcatcacgccgtgggcgtggcacgcgcgcaccacctccgccaccgtccgcgccgcggcggccgcggcgcgctccgtgtaccggcccctcgccacgatccggtcgaacagctcgccgccgtcgcagagctccatcaccaggtgcaccgcgtcggcgtcctcgtaggcggcgcggaggcgcaccagcgccgggtggtccgggagcgacgccatgatggccacctcgcgccgcacgtcggcgacgtccacggcggtgcggaggcggcgcttcgggatggacttgcacgccagccgctcccgcgtcgcgcggtccgtggcgaggtgcgtcaccccgaactcgccgcgccccagctcgcggccgagctggtacttgtccgtgacgcgcagccgcgggtggtgcggcaccacgccctccagcacgcgcaccgcggacgcggcggcgccgcccctcgccggcagcacccgcggcggcgcccagtcgtacgggttgggcttcgccctcgccctgggcttgggcttgggcttgggttcttggccatgcctctgcctcgtcgccgtcgtcgtcgtcgccgacggcgccggcgacttcttggccgcgtgatgatgatctcgcggcggcgcgcccacctcatcggtggtagccgagcgacgcagcacgtgttgcccatggcgatcttctagaaccttctggaaacttcctcaccacagctatatatctacctctctagctagcttaattctatctacttctacatctctcgcccatctcagctcagctcagcttagcttggatgaacaagaagcataaagaaacaagggaaattaagccgcaaaatatatatatatatatagtgtgaatcaaatggtggagagagacgggcgggaggaagagaggagggataagaagaggtcgatgtcttgaagtggtctactacgcaattgcaatgagatcaaatcgacagagaaagagagaagaaaaaaatgagacaggaatcaatcaaatatagttttttgatgaatgatatgagctgatctgagtaaaaaaaaaacttaatttgatcggtaagaagcatcagtgtgcacgcatgatgctttgccatgcatggtcgatcgatcaaagcagggggtagaaagagggaggcagtgacgaccagtgagggagggagctttgcttcagggctacgtcgtgtcgagagatgggatcagtgagtagtagagatgagaaatgaagaaagaaagggaccatatatatcatgcatactcctactgcatgatgatgcatactagtagtatatgaacaagttgcagcgaaagaacaaattaaaccgaaactagttaacgtaaatttacagctatattctttttcttttaaaggcttgtaggtgtttatctcatattaatatatcttattaagtttccttttaaaaatgtaactatttagctaacatgtttatataaacgagatggtatccttgagaaaacactttaatttccctgtacgaatctgaagttttgatgcggatgaaaggatgcgtagcttcctagtacgagggacagctctaccaagaggcaggattactataaaattacctgatacctttgctgtctcgatctccaactagctacaaccatttctagctcgaactgttcttttttattcaacttctttttctcccatacctttctgttgctgtcgaagtgtcgagttgctgctgcctcttgcattgcgtcggtccattgagttggtctcccggtgtaggcgtgtatagctaggtgcctttggctcaaatgcagaatttggcctcgtatcgtatatactcgctacgtctcaaaataaatcgatcttgtacgatcgtaccagatataaacatttattgtactacaacatatccagcctcaacgtttggcatattttttgaatatttgcaaacaaaaattaatttgtgaataaaatttttatatatgtgttcttagcgatctaaaagcaaaggctgaaaaataaacttcaatgaaaaaaccccaaaatcagctccaaatttaacgttgaaaatttaaattttggcttataagcatatgaatatgccaaacgatgaggcccgtcatatccgatatgagattggtttattttaggacggatggagtatgcagctagtcagctgatctattagcctgcggtttgtgcatgcttaatttagcttttctgtgtgttgttccctgatctgtttgttgttcatcatgccgcgcagctggggtcgatctagctgatgccgtgtggattccagcacaaagggtacaaaacgacctgggcttcaggcatgcaagtgtctgtggtttcttcgaaaaaagttaagaatttattcggttatttaaaaatatacaagtgggcaatactattgctcgtacaaagacccatttaaatattttatatcctaaaaattttagaagaaaaaataaactagaattataataatcagggaaaaaaactgcttgtctactccactggcatccctagcgctacctgaagacggatgcgcgtagagcttaagccgtatttgttttgttcctacaacaaagcgagaaaaaatatatcatttttcatgcgcacactttccgaactgttaaatggtacgttttttattgaaaaaaagagaaaaaaaaattactttagaaaccatattaattatttttagaatttaaaatagctaatactcaattaaacatgtgctaatagattaacttgttttacctatataatttttccttcccacctctcaacaacacacccactacaaaatgaatggatgaaaaatgagctgttgtgtgagctaccccccttaattgcatcgctagtaatgcgtcccaatccctcagatatagctaagctagctactaccgtttgtttgtttgttgcgatcaagacacaattgaaatgtggacacgtcttctgaccaagtgaccagacgtacgtgtgcacaatgttttgttcgtgatcaattcatatgacatgacacatatccaactcccaacatctcgccataacccatactataggagtagtaggagtgaggtgactcgagaaaccaaaatttctctcttgcaatctccaccacaagcatggcagctgatgcaattaatgaaccttaatcaagcttagaatttaggaatgccggaaaagcacttgtgtggtgtcgaatcgtaggaaaatgacccatccattagggctaattttataaatcctaattatcacaaatattacacacaacgaagggaactttcaatcgaagtttacagccacattgtttcgcctatttgtagaataagcgaaacgacattttggaaacgaaaaataatttgtgaataaaatttatatatatatatatatgtatatatatgtatatatatatatatgtatatatatatatatgtgtatgtattcttagcgatcgaaaactaaaaattgaaaaataaactttgatgaaaaaaccctaaaatcagtttcaaatttaaggttgaaaatttaatttttggctgataaacataaatataaacgaaaagatgatgccctaagtgtgataagagatgtaccgtcaacttatgtccttttagcatgtataatattgtgtgttccgccgtataattgaaaaaaaattgcccatcctgcaagtaagagaggaccacttattaaacagggcagtgagagctaacgatggaatcggcgcgaaaggacg

SEQ ID NO: 55273 - DNA, 7674 bp, Oryza sativa
taaacaagtgctaattagaagaaaggcaatggtcaaaggttttgggaggagatagctaacatgcagggtcatgattaaggcatgaagcgacgtgcaccggggccatgattagtacccatgatttcgctccttcggaaagcaagtgcccggctaattaccatgccattcgacactctctctcacacacacacagacactaatcaacctgtccggtttgctaaagtcagcgtgataaacaggattacatgtgtgtttattttttttggtagacagaaatgttaggtggaatggtggttaagaaatggtcaagtaatttaggtggagtgttaagatgtggcattgtccatgtctattcgctcagcagaaactctaggtcttctcataacacaagaaactataggtcagctgtctgattaagtccgaccagaacatttcctcgagctgaatgcatgcataaacaaattaaaacaacagactgggttaggtatgcaagagacaaacataagacaaaaaacataaacaaaaatgttgcacatagagcacataaccgcagctctcggctcggattgctcaggtaaacaacacacggtcgcacctggtgacatttgcagggtcgtcatagaacaacagctaataaaacaatcctcacaaaaaaatatggtacagtaacggacgggaaacttgggagttgagttggcacgatttagcagcatctatgaagccaactcatgaagaaaaaaaaaagagcagcaccaattatgtgtatcatgttgttgtgatatgtagacagtagatgcatgataaatctcataagcagaaaatgagaagagaagtaaaacaaccaccacacataaacacaagaaatggaattaaggagaacgaatatgaccttaaactacttccccaaagtattccgcattatcaaccaaccatccatatgaaagtcattggagtgacaaaagaactctgaggggggcaaatgttgacataataaagggctaagttagttctataataacaaaatggctcccacatattatgtcctctcctcgcgtaacactcactcctccaagcaaaatagttaggaagctaagcgtttgcgcccagctcaaccctcccaggatgggcgtggccacctccctgcgaacctccaccttgattgttgtaataagagttgccaccaccagagcgaccacccctgcctctgttgctgtaccccctctgctggtagtaaccaggctcattatagtagtacccaccaccctcacccccaccacggccattctggtagccaccgccgccgccaccaccacgaccattctggtacccgccaccgcccattcctcgccccccacgtccaccacgacctccattctggtaacccctcctgccaccaccacgaccaccaccaccgcgctggttctggtaaggccgtcgagaagtgaactgttgatctgcattcctctcttgttcctccacatctgcttcaaacttctcctgctccacctctgctgctgagaactcttcagaaggattcaccggggcttcatcctcctgaagttatgtggttagtcagtatgaggaaacatattgcatatagaaatatcaacaaatcattggtaaataccacattctgagcatcagctacattaggctgattatcgttgtagatttctgtagcctccgaagcctccttctcatcctgtcaacaaacaaaatataaggtatcagtaaacaagatataacccgtgcctcaaaagaactgactaggcaacaaacaaactacgccaacaaaacaaattgatcacaacatttgcccacaggataatagaccttcaagtttcctaagtcaaatcacatccaaactaaaaatctctcttgtagaaatgcctctacagtgcactagatgcaaaataagataatgacaatttggagcaattatgcccacacaaaatccatcacaatcgataatggacacaattctaacctcacaatatagtgtgttctatctaaatattgctcagtctatacacacgtaaaccaaaagatttggctttagaatgccgaagatgttgcaaacatcacaaacttttatcagactcttctagcaaatactacaaataataatatataatgagctcaatatgccagcaatttcaacagtactatattacacaggcacagtaaaaaaaatatccacacatatggctagccagacagttttgggttaagtgcccattaaaggcacgactttggtcatactaaaaggatatcgatgcataagcattaataatgtaagaaataataaagcaaagtcttagcaatgatgaaaatatatccttcattttgttgcttcctacgaactgatattaactagcaacatcgacaaatcgcatgtacaaagtctgtagtcgtcaaaataatctaatctttatccttctctagacctccatttgttattgctgttcctaatttaaaaagacacaatcaagttatgtcatgcattatggaatatggattatgagtaccacagttctcaaaacacaatctctcgaaaaactttctacatcaacattgcttagataactagttctaagctaatcttttggttaatccatccctatggacgattgtctataatctgttcaatcatccataaagaacagagcttcagtttgccatgttcattcacaaaaaaaattatcatgcacaaacatggacaacattggcactttaaagctcaaaatagaattctataagttgttcgatattacatactacagagtgacaaatgattacagatattaacatatatatgaatgtgggcaatgctagaaagtcttataatatgaaacggagggagtagcacttatatagccagaagggagctgattaggtgtttactcaaatgaataatgtcaaataataaaataaaatatctttaaaactcaatcacacttcaaggctcaatcatacaaaatttatcaaccatcctacaagcgtgaatggggaaataagcatattaagggtacatctgatatttgacatgcaacaaggttatccaacctacctcattagaataaaaaaaggagggttatgcctgaaccatagtccttactttcagcttgtgttctattcctacaaataggaatgacaatgatacacacaacttttaggtgcaaagcattttttttccattttataaatgcactaccttttctctaattgcttcacttaggtgttatcaactcgaagaatgaaaacatgtatgacagacacccattaaaggagttggcatgcctgtatactgccggaagggagttaatagtattttctttggacaaaatgaactccataatggtagttgctataataaatttgcacagtggttcaatattatctaagcatttttcagcaatgaacattgaacatgtgctcataagaaatctacctaaaattcatagcagaactccagaactatcacaataagataaatctaatatggtatgactgttgtctgcgataagttctagtctttatttgttgatggtgacttcagatatgacgaaacaagagctctagacagaacaatatgtaaatgggaaagcagcactagctaataatgggcacatgttcagcatggaaaactgggtcatacagaaagcaatcagcaatcctatgtagtaaattaaattgatctgaatacatcatatagacacagatgcaatttggtgtgttcataatatccatcagaacaggatattcatgcgaactagatcagtagactgtaaacctagttgcacatgactgagagcaaatgaaaacaattataaacatatccatattgaattacatcaccttataatgattttagaataaatataatcaccattgtcagtacttgttagtggttatcggtgggtttttggatgaacctataaaagattaagtaggcaactcaaagtttaagatgcaaattgcaggcaccaagcaaattggtaaaaaatgcttgtcaagaatgcatggctgtacaatagataatatattcagagtcaaaaagcagtaaaataaaaactgagtacgtctaaaacttgaaaatatatgcattaagccattaaggcatcagagaagcaatacttcagcataacaatatataaggagtatattattgcagacaaagcatataaaacttaagttacacaaattgaaaaggagaatattttgcagatcaaatccatccatgaggcttaactggtcgaaaaagaagaacatgtacagaaaaaatagatcttttaaggaccgtataaaaaaatcttaagcataaaaagttcatggaagttgtaattttgaaccctcagcatcttatatcatgctttcaaaatgatagcaggcaagagaaacatagtagtatatttgtctactacaaaataatcgattagagatacactattgttaaacatatcaatttccaacagcggcaaaatcattggcacctatatagtggaatactcatgctttttacttcagatatatgtgacatcagacccagaataatacaaatatcatggtgtagtacaaacaaagagtggcaagttaaatgggatacatgaaccttttccagcataattctcacacacaggcactaactgtcatttgtcatcaaataaaccatatgcaagttatctaacttcaagcttttgataaacacaattcggatctgccttacaatctctacccccaaatgaagtaattatccacagttgatcataataatagcactagacaacaaaatcagaccagatataatagtacaagcagcagcaataataacatattgtactgcatcaaatccatcatcaatccacagcatgataaagttagcaggacaacaatcattgggccacgccaagtaaagttaattggcaagaaaagaacaaatatttttttcaccttgtgtccctcagcctggctctcttccacagccggcgcctctggtgacacaaccatgctctcctgcacagcagccgacaaatcgaccgcagcccccatctccggcatctccggttgcgctgtgtagtagtctgaagccatgatcttgtccaacttcgccctaaccgctgcatctgtaaccaaataaagcatcacggatatatataaatcatccaatcagcagctaaaatcaaacgagaaaattgcaatattaggactgcaaacatggtggcttcgctgttttgacactccgcgtggatgacaaatggatccatctgtgtctatgaaatgtgggtccagtgtcattatagcaaaagttaatgtttgcagtgtcataattgcaaatcccccaaatcaaacaacattataaacaaaacccctatacttacaagtgatgctggattcggggtggattggctcatcggcacggcgaagccagaggcgggcgtgctgcgcgcaggactggagcgcgtcgcggtgcgagacgcccaccgccgcggcagggcgcgaggcggcgagggcggccagagcagacaccttgtcgagatcggactggtgcagcaggtcggcggcgtcctccgtgacgtagtcgtaggtgatgcagcagtcccgctcctgcgcgcgcgcgaccatggtggcgacgaactcggtctgcggcttgaggtcgaagagggtgccgaagtagatgagcgcgaggagatcctcgacgacggacgaatccgcggcgcctgcggcggaggaggatgcggggggcggcggcgcggcggaggaggagggggcggggcgggaggagagctcctcggcgagggcggcggcgagaggggcgcgcatccgctcgagctcgtcgatgagcgcgacgacggcgggcttggatcggagcaccccctcctgctccttgttgagcttcctcccgccggcgagcgactcctccatctggaggatccggttgtgcttcttccgcagcgcgcggagccgcttcgagacgacgctgagggtcggcccgtcggtggcctcggccgccgccgccgccgcggcggcgggggccgaggaggaggagccggtgggggaggcggccatggcggcagggggtgggctagggttttggggattcgggcttggagatggagcggcgagacgggtgggaggcgatgggtggaggccgtgggagagagagatttatgggggagaggagagagaggccgccgggtagggcatctggttgggcggattggttgcacgaatcttcaagcggtgttgccattgccgcctctcgctacttcctcaccggtggtgtgccgcttggactttggacccaccctgggcctttgttctagagccttcttcctttgtgttgaagtacttcctctcaaatattgggtgtgtttacttcacattgaaattgaaataatgtgatggaaaagttgaaagtttgtgtgtagaaaagttttgatgggatagaaaagttagatgtttgaagaaaaagtttggatctaaacaagagcatactgtaggagtttgttactcgttccgtcaaaaaaaatccattcctaacaatctaaggtggaattagtggagagtgagaatgactaaaatatctttaattattgaaaaaaaatatattagtaaacgtgataataaaacttctcgttttacctgctgagggtaggtaggactgtaggattgtagaagttgtttttttggacaatatttaaactctagaaattgagtttttttatggagggaatgctcctggatatatatacacactagaaaaatattattttaattatattattgttatacggtataggtagggtgaaattcaccattggaattcgcttggatatttttttaagaaaatcatgagctataattaggagtccgactttcatcctaaattagcatgtgagtttttttaaaaaaaaagatttattatatgactcctaagcaatcaaacttaaaatccgattcaaacacggatttgtatttccaaaaagaacaaatctaaaaaccgattcaaatacggataacgtaccaaaatactgacaaaaatattttttatttttataatatagtagagatagagaagatacgtagtattataacttttgtttagaaaaaacaagtgcagtaatttgcaaatggatgttactctctactaacaagtaaaaaccagacagttcgttggaaagaaatacaataatacattactcctcttgacgcacaaagcgtaaattatctgctatttttaccacttccagcgctgtaaatggcttctacttcgccggcggccggcggccggcggcgtctgcggtcagctgatgtctgattacaaacagccgatggaagtggttttaaaaaaaaaaaaaagaccgccgggagcagagacggctggcatcgaggaagacgcgttgccgcatttttaggccaagcccactaaggcccacaagtcatgggcctttaaagattcgtgagcccaacatattaggaaaaagtatactgaaggtccctcaacttgtcatcaagttacaaaatcaccccccccccacgcaaaaccagatatctggcgtccttaactaatcaaaaccggtcacaatagatcctttggtggttttgacaccggttttgtactacgtgacggctgagtcaaggtgggacccacatggaccccacatgttaggatgc

SEQ ID NO: 55274 - DNA, 15087 bp, Oryza sativa
taagggacgacagatgtatcatatctggttttttgggtggaggacgattttgtaactcgatgacaagttgagggaccttcgatgtactttccaacgtattacgcatttacgccaccactgcgattgcgatgaccgtatggcaagtcgcaacactgctcactgcacgcacatttccagcacgcgcaatcgaagaagaaaggttgcgagcaaagcagatcggggaaactgttttaaacagctcgagtggacgtccacccgtttattgcatgtcatctaaatgattatgaaaaaaattaaaaaaatatgaacaagatagatcaatatgtaatatatcaatccgcaaacatgtaagttaaaattcaacttctacaagttgttacaaaaataagaaacaaaactcaaattacaatatgtatatttacaattaaatttgttatttttttacaaattgtaaaagttgaatttaacttgcatgtttgtggagtgatatattacatatggatacatcttatcaaattttttgaaaatttttcgtaaccatctagttgacatgtaataaacgggtggatgtccactcgagctattagaatccatctcggagcagatcgattttccccacggtacacaaatgcatagatccaaatttaagttccgaaatttcgtatcgacgcagctcgatgcccgcctcaatcaaacaagtgacctaccattttctctcccacccgtgcgtgcgtgcgtgctgtacttgccggtcgcaacgacgacgattcatcacaaaccatggtgcagttgtccaacgcgacccgcatccgcatgcatgcaaccacgacactatcatcaccacaattatgtacacaatttgctctcgatcgtgtcgctcgatcgacgacgacgattccactatccaagtccaagtcgagctctcatcatcccgcggcggcgtgccggcgaagaggaagaagaaagagctctcgctccggactcctcctcctcctcttcttcgccctcgccgtctatctcctcgacctctcggccggccgcggcggcggccggcgcctccggggaggaggaggatcagtggcagcggcggcggctcgctcggcggcgcgacaggccggcatctccggcgacgacgtgttcctcatcgacctggacggcggcgaggccacgctggcggcgcaccgccacgacctctccttcgccggcttcgccaaccggagcggccactggcacgtcttccgcggcgacgagggcgccatcccgaacgcctgcaggcgccgcctcccgttccgcagcacctaccgcgacctcatcggccccagcctgccgctggggagagcggccgcggcggaggccaccgaggcgatcgcgtcgtacgacgcggacgccgccggcgaggaggaggcggcggcggcggcgctcaggcggggcgtggcggcgcctgtcggtgatgctcgtggaagccatatgcggctgaagccgatcggggagacccgtgtcgaacgggtggcgggagagcggcgaggcgcgtgcgtggcggccgccgagcacctgccgtacatcgagcactgggacaccatgtcgttcgaggtcctccggtggaggcgcaccgggaggtgggacggggccgttcaccgagctgctgaggaggcgcgccggcatccgcagcgccggcgaggcgctcgccattgccaccttggcgcagctgatcctggctcactccaccacctgatgcaaaattgcaacctctctcttttctactgcttgctagcatgaccgcatcgcgcgtgctgtttaactatttgagtaattgagttgagtatatatcattccggtcaggaatctcgagtttcgaaattacatgactttgtcgctggcacgtgaataggatagaatattttggacccacatgtaagtattaaaggcacggtgacttcaataatagaggatctcaatccaacgtatacatgtgatgtgtttcgttttctaacaccagtttgtttgactgtgtggttgttttgagatcacggggaaataacttaaataatttctttcggcaaactgacggaaaaaccacatttctctgtggtctcggctattcctataggtatatggtggtcgctattcctataggtatatggtgtgtaccacacagaaatattttctaacagtaattcatatttttcccgatggtttttggcaagtgtaaaaaagacgttaatattaagaaatgacctaatatcaaataattaaaaggagtgaggtttcgaacccaagtcatctagccctccatcttgtaaagctagccggaagacccccaacatcttcggccagtgtagactagaaggtctggtagtgatttattatatgaagatgtgtgtgccgtgtgcgcctcaatgttgttccattattcaccaactgaccatttccatcttcatgtgcatttgcatcacatcgtgtttcaatttttcaataggaactgcccggaaatgaaatttcatgaattaaccctacagcttcacaccttaatggaggctgctagtcacaagtttttcatcaatatgaatgcatcaagccatgaacaccattcataacgtatacgtatgaagcggcagcatacgaaataaaaaataaaagcttacagaccacgaagaatatacggccggatcagcttacaaggtatgcggttcctagggtcaatcaacacaaactactccctccatttcacaatgtaagtagattcattaatatcactataaatataaaaaatactagaatgactttgttgacgaaaaaatcgaacgcaccggcctgagagatctgcttagctcctgtgcaggtccaaagattgatgagatgcgggcgtgccagtcagtttgatcctgcaactgacaagatatgcaaatagtagatcaaaacagccgatcggctgacaagccgatggagtaattccagccgataacagctgatgccgatatcagccgatagcgatagggtttaagcaatcggttgatgatgatataataaaataacaatatagtcctgtataaaccaatcggctagcaatgatatgataaataagcatcgatccgagggttaaagcacacatcggctagaggtctgatatcatgaaatccacaagattagattaaacagtgaaacctttgttgtcatcggctaaatccaacttttatgtatatgcaatccttatgagccgatgcaacgtccagataactcaccggctgaaacctcgatgaaacccttattggcaatcaagaggcaggctagagattatggttctaagcacgacttagtagatcaaacacaatatctagacaatcaagccgttgactgattttcagggtggtagatgcctaggctaatctaatctagcaatgcgatttagccgataccggcagaaaccctaaagcgagagacagctgatagagctaaattgatatgctaagactagattaacagagacatgataaataggtaggcaaatatatcatccaaaccagagcaatccaagaggtcgaatgtactgatgcagccttgaacgacgccgacgtaaacgatacaattgcctgggccgacggaacattggacttaccccttcgtcagagatcgaacaccgatgcagccccgcgtcaggtgccaaatcctaccggacgataaaataaagtagaaaaggtaaaaggtggcgatgcgccgaattgtattgatcgtgaggatagattacaatgacccagggtgtacatatttatacccatgggttgatacaagtctttgtcggacaagaaagaaaccttcctaaagataaaaggaacagataaagtccttataggacactaaacacatttttctaaagataaaaggaaactaacaaactatttctatttaatagataacttgccatgccgcattctttttaaactcggtcacttatggataagcttccgttagtagattgatttccttagccgaatatagcaggaatttgactattggcgacttgataactcccatcggctgatcccgagatgctgcagccgataatgactctaagccgatgacgtctttgctgattaccaaatttcactgttaacagacttacattgtgaaacggaggaagtactaagatattgacctggagtcctggaaaccatatacctcgaaaaaatattgacctgaaaaccatagatctcgaaaaaaaaatgcaagctcttttcttgaatagttgtgcaaaaaatagtttgtgcttcgataaattggtaacctgtgaatggccaaacaacgcatacccaccacacactagatatgtgcttccacctcctagcgaaatgcatggttggccaaacaacacataccgcgtgctttatcaccacacactagatatgtcctttaacttattagtgaaatatagatacacgagaaaaactgagatatcttatctaattagacgacctacgaacatctcaaatcgtcgaaatggagtgtaaccacaatggtttatgaatgatggacagcactagcaatcggtaagggacaaacgaaaaaaaaggagtctgcaccctcttcctcctcacgacatggaaagcttgaaagtagagatggatcttggaaagtattttctacatatggatgctatcatatctaggagtatgcatgtggtttaaatagttactacctcattccctaaatgtttgacgccgttgacttttttaaacatgtttgatcgttcgtcttattcaagaacttttgtgaaatatgtaaaactatatgtatacataaaagtatatttaacaataaatcaaatggtagaaaaagaattaataattgcttaaattttttgaataagacgaacggtcaaatatattttaaaaagtcaacggcgtcaaacatttaggggatggagggagtatataaaaaaaataaaattcatactgaaccagcggagtcatacaattagtttctcccaacagtgcccggggtcctggccccacctgtcatcccctttctccggagaggtagagaggacacgctcttttgacgtgctaaaagcgatcgagctaatatctctctcgtatttatattccagtatcacacttgctcagaacgaagctatagctagagagattgggagaagtaggggtgcaagctgatcgattgatcgatttggccatgcatttccaagccgccttcttcctctacttcctcctcgacctcggcggctaccgcagcgacgtcctctccgtctccgacctcgagccgccctccgacggcctcttcgtcgtcggcctcaccggaggcctcgacgccgacgagctagccgccgtggcgctccagggccacgacctctccctcgccggcttcgccaaccggacgcgccactggcacgccttccgcggccgcgagggcctcgtcccgtccgcggccagcgtcctccccttcggcggcgacacctaccgcgacctcatcggcggcatccagaacctccccggcgtccccctcggccgcgacgccatggtgcgcgccgcccgcgtgctctcctcctacgacccggcggcgttcgccgccgaggggaacgagggtggaggagctcgggcgggcgctggcggcggtgacggtgatgatcagcgaggcggcgcgggtgaagccgatcaacgagaccgtgtcgagcgggtggggggggggggggggaggcccgcgtcgccgccgagcacctgccgtacatcgagcactgggacaccatgtcgttcgagctcctccgcttgaggcgcaccgggaggtgggacggcccgttcaccgagctgctgaggaaggacgccggcatcggcggcgcggaggaggcgggcgccgtcgccggcgtgctgatcgatcgcgacctggaggagctgcagcttgctcacggcatctgatcactgcagcttgcagtgcttgcttgcttcatcgtctcacgcgcggctgctcgctgaataaaaatattgttgtgtgttgtgatgttgtgttttgtgttttcagatcaaagtgtttagaacttaatttggtgagccgcctctgacgattattatgcagtaaatgttttgtgcctcagtgctgtttactgatgggagttccgtttcatacagattggtattgtgatggttaatccaaattaaattcagcatcaaaatttcatgaatctaactgcacctttgagagtgttgacacatcacatctacagcaaattaacagctgcaagcattgttgaacatactgtcaaaaaaaagaatatggctcctacgaaaaaaaagaactgttggatatgtacagtggtaacagatttcttctttcaccgtctgcaagttaagcggccgccaatgattctgttacacttctagttgcatatactgtttgaaaacacaatcgatcagcacgagcgtcaattccaagtgccaaagtgttggaccgaatggggatacttcttttactggacctgttcttcggcacaggcttgatactccttgttcagttcatgaggatttgggacatttgccaaactcattctagatcagagcaaggcacgaggatctgggcattagccaaactcattctaggccggccacacgcttctgaaatgatcaaacagaagcgtccaaacaaatttctccgttttccttctgccaatgcaaatggctgcacggatcatcggatgattcaaattcacacaaaatacgttccaatgtgtgtgccaccagatcatgcgcaaaaaatcttgtatactcatgccccacctgtctaggggtggacagaaaaaaaccgaaccgaaatgaccgagaccaaaaccgaactaaccgagaccgagaaattcggtcataaattcggtatgcactttcaactaaccgaatttagttcggtcaattcggtcttgaggctcggttaactgaattgaccgaaaaaaccgaaatatatcagaggcccaataccacatgtgacatctcagcccactaggcccaatacctcatcacgtgagcaacaaccacctagtccctgctcacgaagccacgatcttatcctctgcaactcccagtcccgatgcccgacggtgcagcaccgcccaacgccgcccgacggaggagcgcctcccaagaaggtcgtgcggctgtggcgatcccttcccaacccgacgcactctagcccggtcgcccagctgcaccctggtggacggtggtggaagagacctcgctggcggaggacgccggccgtgagcttgtgattaaagcgatggcagccgcgggtagccgggaacaacgacgatgggagacgagatggatgagatatggagctttcggaggggcgatggagatcgacgggatccaagtcacagtaggattaatttgcttgatttgcttcttttctctgagtcgtgctctacctgctacttgctcgtgggatcatcatattgctgtcgacctgtcgttcatccgagctgctttgattcgatctgagttgatttgattcatcgatcttttacgagtactatttttgtgattatttttttctgccgttcaaaccacagttagtgttacggttagttcggtttatgaccgagaccgaaccgaacaaaccgaagaccgaatcgctcggtcctgagttttcttgaagaccgagtgattctaaaaaccgaattttttaaaagaccgaaaaaccgaaccgattttttcggttagacggaatgcccacccctgcacctgtcagcggctctacttttcgccttcgcggtcaagagtttcgctcacgccgatcgcgcgcggcgagccaccgccgcctccggcaacaaactcgccgcacacctgccactccgccgagatctcacgccgccctcttgccgggccggcggataaatcgccgcccgcttgcccaaggtttgcacgcattcctcactcctcaccatggccgccgcaccattcctcttcgtcctcctcctcctcccgctcgtctctctcagcgcagggggcacgtcgagctgtcccccacgagcctgaggggcaagctgtccatggtggacctgctcgacttcgggagcggcgccggggcgctggcggtgagggtcgacaccatgttcgtcgccggcttcgccaaccggagcggccactggcacgccctgcgcggcagcgaccacctgttccaccgcggcgaccaccaccaccagcgagcacggcccctgctgctccggccgatcgcgcgggccgtgctggaggccagccggatggggagggcgcccgccggggagcaggcccggatcgccgacgagcacctgccgtacatcgagcactgggacgccatgtggcacgagctcgggaggtggaggcggcgcggcgagtggggcgggccgttcaccggcgtgctgagggagcgcgccaacatcggcagcgcggaggaggcgctcgccgtcgtcggctggacgttccggcagtcggcaaaagctgctcggcgacggctcggcggcggcgatgtgccgcactgagtctactgacctctatgataaactgttaaagttagttgtagagtagtagtaataacgtttccattagcgacaagttctcgttcatttgtgtatgtgtgtgagtccacaatttccagcagcagattagcttgcgcctgtgttcgattgttggggttggaaaccatcccctctgcacgaaaaacggaaccgtttattagcgcgcgattaattaagtattagttattttttaaaaaaatgattaatttgattttttaagtaactttcatattaaatttttttttaaaaaaaaatacaccgcttaacagtttgaaaagtgtgcgcgcgaaaagcgagggagtggaggttgggatcctgattgaacgaacgcggaaaaaatgctgtgttgttacgttttcgtgattatggtgtgtgctatcagcgttcgaccagttcaaaacaatatttttgcgtgagagaattgcttttcttcttttctaagctaggcaaggtgactgcagttattgggggtggtttcttcttcgaacaagcaagccagatcaatacttatttcctagcttaactagcttaacaaactgaaaagtggttgcatatttagaaaaagatattcacataatgttattactcacagtctatgtggtctgtacttaaatatctaggtgcttaatgcaaacatataaattcttttgtttcttcccatgaaacgctaattttccctattggtttgttgctccccaccttttttaaccctatacccttcaggacagttggttgtaccgtggtttaaggtaatgttattatattatagccattatatctgaagtgagcttcttcctttctatgcatttgtctatcttctaaatctgaattagtaatctgtaacctcacaatgccaaaatatttgcaactgaaaacataggtgactttctatagtccaccaaggagtgacggcaggataaaagtggtttttctccaccatgttgatccatcccagaaagcttctccaatcactacatcctattttgcattgagttaaagccagtttagacacatcaagtattctcacccactttagcatattgctagctttttttagcactacaaaattaattgtgttgtatatgcagagttcaggtcaaaatttccaatccaactatacactcattcatttcttacctaaaatggaaatatttgtgtggagcatttccagaatacgaacaagcaaagttttatatagtatcacaactgtctagcctttttagtatagtatttcttttcaccagagttgatatgggagagaaattacaaaactactcaaaagtgttgtaattttgtatcgatgtgtgatatttaagtatcttaatctatcaatttgaaattactgtcattggcaagcattgatgattggtaagcattgatatgatcgttccttaatatcctttcctttgcattgaaagactactgggaagtagtattcgcttcttatcactgcttaacactgatgcaatacaaagctggtctgatccttcacaatcaagtgacacaatagtttatcggtacacgatgtgttgatttctctactttcagatttatgtgccaaagcaaacttgcaaacgacctcctgtcgtgtgtacgagataatggtaaataagtctcttcaatatgttgagataattatgtttgatacaatgttcaattgttaattctcttgaaccagtttgagcaattgtgtatactcaattcagcagcatcatggtcaggcgcggcaatatttctagttttttcttttcaaaaaatgcatgatgtttagcagtctaggagcatacgtgtgaaaattgcgagagtttttcttccctttctctagctgcctaacgctaggagggacacgcttttttcatggcgcgaccaaaatattgtagacgagctaggctcttgttggcacgccgatcagaccggcccgcaagcaacggtctgaccggccaatacacggcggttagaccagccttgtagagaaaaccagtaactttatcaaatcttgacaattctcttcaattttaaacctaaatgccaactttaggtgtaaacagctctatcagcattcaaccagttcaccctcctggtgcagttgcccaacgcaaattgcgaggattcatcactacacactgcgcatatatagctttgctttgctgaggagagcatcaaagcttagggagctagctagctcgatctcaccatggcgaacttccaggccgcgctgctcctcctcctcctccgcttcctcctcaatctcgccggccaccgcggagaggttctctcggtctcggcggcgcagcagcaagacccacccggcgacgacctggtctttctcaaactgcgtagcggcgacggcgacggcaccgtcctggccatgcaccgccacgacatctccttcgccggcttcaccaacgggagccaccactggcacgtcttccgcggcgacgaggacgccatccccaacgccaggcgcctcccgttccgcaacacctaccgcgacctcatcggcggcctccaccacgtccccggcctgccgctcgggaaagcggccgcggcgcgggccgccggggtgctcgcctcctacgaccccgacgccgaggaggggacggcggcggtgaagcgggcggtggcggcgctgtcggtgatgttcacccaggccctgcggctggagccgatcagggagacggtgtcgagcgggtgggagagcggcgaggcgcgcgtggcggcggagcacctgccgtacatcgagcactgggacaccatgtcgttcgaggtcctccggtggaggcgcaccggcgagtgggacgggcccttcaccgaggtgctgaggaggcgcgccggcatccgcagcgccggcgaggcgctcgccattgccaagctgctcgcgaaccgcagcttcgtgcagctgctgcaggatcacagccacagcgcctgatacttatatggagtatattctgcatttgcacgggtgctgtttctctgaataaaacgttgctctctatgctctagtgtcagttcgtgtgtcaccgtgatgtctgtgttcgttgttccctttctgaatgggatgatcttaaatttcagtgtgtttgatttaagtcctattgtggtggtcgttttccagatcatatcacgcgcttgttacaatgagaaccgtttgatgggtgtagctatatttatggcgccatatttttcatcaaagaatagtcggtatgtatttacattgtaagtccctaaattacatatgtaattttagtgtatttacaatgtaagtctcaaaattacatatgtaagtactaaaattacatatgtaaattcgaaaattacatactaattacatatgtaagtgggttgtaaatgaggtgtaactactgtgtaagtggctgaaaaaaaatcgactgtagcatatggcgccatatttctagcaactccgtagtttatttgatccaaatcggcatcaccctgtgttgccttttttttcttccaacaacaaaacttattggatatgtgcctgtcggtatatgtcagagacgtaaaccatttattccatcaccttaaagaaaaacacgaactaccattgtcaattcaaaatcagcaatcaaatttgacgaattaagttacacctttgacagttcacgcacctacgtgcttcacatcacattctgcacagcaacaacacaattcgttcaacatgcagtcaaatgcagatgtcaccactcacaaaatgcagcaatatctactaccaccagattatgataaaagtaaaattacttcaagactaagtttatacataaatacaaggaaaaagtatggattaccctgaactatcacggttggctgaattaccttctgaacccgaaaccagacataacgcaccctaaacttttaataccggatgaattacccccatcgatactattttgagcggttttgacttgagcttgtacacgtggcgccaacgcggcaatctagtcagaaaaagacttcttgggcccacatttcatctctcttccttcccggtctccctctcctcggtcgcgcgctctctctctctcccatgcacgcggctgcggacgggcggtgggcggcggtgcgcggggacgcgccgtgggcagtggcgcggggggacgggcgaggcgatgggcgctcgccgccggcagcttgccatccggtttcttgtggtgatgagctcaggtagctgcagagaaataagaggaacttgttggccaaatgaccatcgccggcataggaacagcagcagcaacaggccttcgacttccctggctccagctaagaccaaacagcacgagcagcagcaacatcacttggcgcagcagagccgcctcgacaagctgaggcctgagggtgcagcagggcttcgacccgccggccgggtgagaggggaggccatggcttgctccgcatcgacggcgatgagcacgcccagcctgccgccatgtacgaccacgcagaggcgccggccgggcatggatcgtgcgcgttctcggagatgttaaacttcccatcgccgcgtccaacggggccctccgccaccgagctgctcgccagccagatgaacgccaactaccggttcgggttccggcaggcggcgggaggggtcgccggattggccggcggcgaaggcgccagtcggctatccacaaagcatcggacgagcggcgttgaggtggcggccgcgcggttccaggtcaagcggcgcgggggtcggcgcgcgagggccggtgacgggtggcgcctaggtggcggccgcgcggtccctggtcgagcggcgcgggggtcggcgcgcgagggctggcgacgggcggcgtcgaggtggcggccgcgcgggcgcaggtcgagcggcgcttgcggtcggcgcgcgagggccggcgacgggcagcgtcgaggtactcggcgatcacctcctccgcctcccttccccgccgcgctggtgcgtgccacgctcgcggacaggtccttccgcgctcgccgcccctttcgtgctcgccaccacacgacgccggtcttcctctccgccgcctccgcctccggcctcgttcctcaccggcggcggctgggcctccgcctcgttcctcccagggcggcgcgaagaagttcgccgtcgccgaccccgcacacctcccgtccccgtgccgtcgccatcttcccatccccgcgccgccgtccaccatgagctccggctgcctcctccgcgggcggccaaagggaagaagagggcggcggcggcggctggatttgggggaactggctcgcctccgcccctagcccgagtacgcgcacgagagagagagagagcgcaagggagctgggagaagttggatgacagatgggcccagggatttttttaattttttttctgattaggctgccacattggcggcacgtgtgatagctgaaatcaaaaccgcccagaacggtgttaggggtcgtttgtccggtatgtatagttatggtgtaaaatatccgttatttgaatttaggagggtaattcggtcgaccgcgatagttcagggggtatttcgtactttttcctaaatacaatcatatttacaacaacaaattagtttcattaaatcaataatcaaaattcaatgatcgaatatattttcataacatatttgtcttaggtaaaaaatgttcatgttttttctataaatttaatcaaacttaaaacaatttatctttgacaaagtaaaaaaatgacttgtaatccaaaatggaggagtatatttgacttttttttttttagtttttacagcgctgtcaatagagattccgggcacgccgatcacgcacgccggccgcgcccgcctccggtctccggcgacaaaatcgccgctcacctgccaacccactcgaccgcgcgccgccggctacaaaatcgtcgccatcgtggaagaaccgggccactggctagctagctctccaggtttgttgcacgtacgacgccatggccgccgcgctctccttcttcctcctcctcctcctcctcccggcgccgctcctgcttctccccctcgccgggaacctcccggcggccgttctcggcgaggtgcgagtcgagcgcgacctgatcttggtggacctccaggactacggcagcggcgtggggacgctcgccgtgaggcccgacgtcttctccgtcgccggcttcgccaaccggaccggccactggcacgccctgcgaggcaacgaccacctgttccgcggcgacctcgtggcgacccctctccctttcggcagcagctacggcgacctcgtcggcggcgtcaacaacctgctcggcctccccctggggtcgcccttcacgagctacgccaccgtggtgctctccggctacgacggcggcggcggcggcgaggcggcggcggtgaagcgggcgctggcgacgctggcggcgtgatctgcgaggggcagcggctccacccgatcctggagaccatcctgacgcgggggcgaggggcgcgcgtcgccgccgagcacctgccgtacatcgagcactgggacgccatgtgggaggagctgaagcg

SEQ ID NO: 55275 - DNA, 5435 bp, Oryza sativa
aacgttgcgggctaatctgaagaacatgaagattagattacgacacgcaaaaataaaaaagtattagcatattattaattgagtttaattattataagagtaaattttagaaaactgcaagtttagtgataaaactatcagtttactgcaacattagcgacatatttcagtttgctgcaacaatagcatgaaaaattatcacaaaactgcaacttttacgttatatgctgctacagtacatatatgtgacaactgtagtaacatataacataaaagttacagttttatcataatttctcgtgttattgttgcagcaaactgaaacatatcgctaaagttacagcaaactgatacatttgtcactaaagttgcagttttctaaaatttactcttattataaatttagaagatattttttttattctaaaataacttttatataaaaagttttcatacgaaacacactatatttagcatcttgatagaaaagaacaagaccgtgcaataagttatggttaacgacttgcgtgcaatttctcaactcgaacagcagatcagctattcagctgtactgtgtttatgatgcgtgtcgtcagttcaatatcacgaagtatgagaaattgcaaggaaaaaagcatcccataaatcatttaaagtttaaaatttcatcatataggttattttattaccgacatacacccctacttaattttgttgcaaaaatcatctttttgctcacgtgcttaaccaaattagtccgttatcgttgatgtaaagtcaccacagactaagttagttgagtcaattaatgttgttcaaatgtttgaattagatttatttttttttatgtttgattgaatttttttttctcatttagtgaatgtgataacatttaagttcttatcatcaattttatttatgaaatctaaaaaaattgtcaagataatacaaagtatttaattttggtaaagattacattaacagctcacactttatgaaaatatattgatttggttaaacatgtgtgcattgggatgctttttgtaataaaactaagtaggttgatgaatatttgaaacaaaatgattttagagagtggtatgtcgaacttcaaacaacttatgatgtttagcatacaacccaatgctgtgcaggagctcaggtcctatacagcattcggttgtagagaaacagcgaagggaaactggaatcccattgtagcatgttcagataagtaggagtaacaaataagaaaagggaaactatttacatccctataggggatatccacttattgtttatatgtcacttaaatggttattaaaaaaatttgagaagatgtattaacatgtgatatgtcattctgtaaacatgcaagtacaaattcaacttttacatctcgcaacggaaaaaacaaatttgattgtagtttaatttatttttttcgttgcgagatgtagaaattaaatttgaacttgcatgtttgtggagtgatatatcacatattaatatatcttcttaatttttttaaaaaaattttcataactatttgaataacatgcaaataatgagaggaagacccctcccataagaaaacaaatcttgaaaaaagccaaatagtgatcctggaggaagagcaccttcttttccagacatgaagcatgcaactccaagcaaaaagaaaacatgtgtatgtgtaatagtttagcactatggaatctgacgcttccaatggagtagtaccgaccgacgaccggctatgtgggtgtgtaagtgtaacaaccgtagatgtgtgacatgtgtcccccgtacattaccaacggacggatggaaagagtgatggtcctccacggtactgcacactgatatgtggaccccacagatatttggatctacagccaataagtagtactgcagagaacatggattgggatagaaagagagctcatagttttatctcatgttgataatggatattagaggcatccatacagtcatactagtatctttgatatgtacattgttaaaaactgttaactagtaaggtgatgtgatcatagttgctattgatataacattaacaaaccctgtgctccactcgagacactcatggctatgattggcccgatttttcgatgagttgaagataactatgatttgagagaaacgttgatgacccaactacagccgtacgaggtgttgttgcgttgcgtcttagtgattgatacaccgatgcagatcaaccttattgctacaagcaaatcgaagaaacaagcaataacaagataaaagcaatctgaattgcaaataggaattgaaaacaaatgataagttgggttccgaagacaaacaaacggactagccgacatgcgcgatgtaagaaagtaacaatgactaaactttaatctatacaaaacccgaaaaaccctaaatggtacctagctatttaagaaggtggggggacaaccaaagggtccgtagggtcgtgctccattaggtttgggcgcaccctacatgggtcctagttgggccgggatcccaaatgaagttacaagcctaatggcccaagataggtaggcatcaccttatttcttcattgcaaatgactaacatgtaatttggtgatgaggctggatcctttggaaagaggacttcgagagtttttcatcaagtactcatggatcggaaacgaagatcgtatgcatatttggcggccgtttgaagtcaacgttgctgcagttggccgaattggattctagagtgtgggcagcttgtctccctactgtgctatgatatgagcaacggttatatcaatagcaactatggtgcggcactgtcgacgtttgatgtcgcgatttgggtattttcatagtatggggatcgttggtactaggatatatacgagactgaggtaaaagagacagtgacgaggatttttatacaggttcgggcccctgaattgttagttaataaccctacatcctgttggccgaagccggtattgctcttattcaccataatcacaccagtacaatatttggggtagcctatctaactgttgttgacatggcagtctaaaggtctgactcgtagtcgacaacagggtagtcttcctcctcgagttcgtgccggcgagatcagagacatcgcaatgtctctcctatcagtatccggagacaccgtcggggactagccatgcctatctctgaagtcgatatccggtgtcttatcttggtgtatgttggcttctatgttgatcttctatcttgatctattgtttcgtgtatgttgattgtgtcccctctcctcctagggggccttgtatttatatccatagatgcctccttgtctaagtagaactagagaaatcaatatggatacaatccgagtagtcattgtcgttttcatatagaactctggttgtctttccttatccggaactcctcctatatccgaggattgtatctgtataagacatggtatgtggtggattctgtcgaaatttaatcaactaatattaggtatgtagtatccataaccctgacaatggtcacatcataaggttaaacctgtgaaagagcacacccaagatgactcgagtgattcatgattggtgggccagactgattggaaatatatactaccccgtccaaaatatagctatttctagcatagtaacttgtcctaaaataaagctatttcttcacctaccctctcctctcaacccatcacaaccattctcttcgtctactttctcttctccaccaatcacaaccctcttccaatcatttctacctactttcttaatacacgtgcgtacctaaaaaaatggttacattctgagatggaggaagtagaaaattagatccgatgaaaacaaataatctaaaatttttattctatattttaaaaagcaagggtaaaaaccataaacacgctaaattttgttttttttaaaaaaaggttgaaaattagctgcggcttttcaacagacatacaaaacctatgggcttgttcagaatgatgccactttaaatcatatcacttttggtagagttgctaaatttgcgcatccatttagttttttttttcaaattttaataaatatataggaaatcctgtcaaaattttaaaaacattactcccaaattataggacgcccttttttaaggaaaatcaaactgggtagcttttgactaataatcatactaactatatctatactaagtattatgcatgctatatcactagattcatacattgaagcactttcatgtgatactaatttcatatttattaggatcatagaataaaataaaaatctgaaaaccgtattgaaaatatagaccttataatcaaatgttacctaatttttggcttcaatgtgagcatcccatatgcaactatggaagccgtgtcaacgccagcggatgagcgggtcgtgtgttcgtgtccacccctatcccctcatcaccctcttctctcggctctcgcttcacttcctccactccccgcgacgccgacgacgacgaccacgacgccggcgacggcgacctcccggcagcttatattcctccccccgcttgcttgcttcctccccacctcgcctccatcctaggtgagcccagccacacgaccagagctgtgcgagggctagcttaagctagccttcgccttcggggtcctcctcgcggtctccggcgatcccgccctccgccgccgccgccatgtcggagcacctcgcgctgcggagctccgtcgggagccacagctccgcgctgccgccgtcctaccaccaccaccgccgcctcccgccgccgcagcagcagcaccccgacccgctcaactccgtctggatccgccgcctccacctcctcccccaccagccgccccctcccccgcccccgcctccgctccggcagccgcagcaccaccacgacgccgtctccaccgacgagtcccgcacgccgccgccgccgcctcccccgatgggcgcccccggattcggtcccttccgctggagcccgcgcccgctgcgtggcgcgccgctcgccgcgtgggacgccgcctcccccgtccgcagcggcggcggcggcggcggcggaactggaccacctatgctctcgccgttcttccgcctacccgcgccgtcgccgtcgccgccggtgaccgacttcggggagttctcgcctaccatgccacttttcgaggttggcagcagcagcggcagcggcgggttcccggggccgtcgtcgcggatgattcccggcggcagctcatctccttttgcaatgggagttgcaggtatagatttttctttcttcttccttgcacacatcttcttctgcattgcaattatgtacggaattatatatttgttccaacttattgggtggaattgcagcctgttttttcttttttttcatgcgcaaagt

SEQ ID NO: 55276 - DNA, 6192 bp, Oryza sativa
attttcatgatcttttaaagtttatttggaattagtgtggaaaggcaattcagaaatattttttttctgagtttcaattactcttacttttgtatatttatagaatgtgctttgctaggttgttcaacttttattattattttgaattttaatgacctttttatggaattcgtattaaaaattcaattttaaaatttattttatcttttacccaaattttaaacaaaatccggcggcttggctctgttattttgtgattgccagcccttgtgtgcagtagtacgttgattgcaagtggcttgatttattgtttgattgcccgtgctattggtttgcttggtatttatttggatgtactgaatcgtgaccagcataggaatcggtgaaagcctaagtggatagggctataggagcatgcaaaagcttctacactagaaaagctatagaaatctaaaggcatctctctacccccatccccatgggctattccttgcctaaccgacacataaaggcatgaacgaatggtggcgacaggtgatggtggcggcaacggtacctctcgccaccacctcgtccccatcccccgccactgccaccttcctaccaacaccttcaaccaccgccaccgccattactgtccctgttggctgcttggctctgtcgatctagagaagggaaggggtgaggtgaggagagggagcggcagcatggtggagatgaagagtacgacgccggccagcgtcctcatagatggtggtgcggccaatggcaatgacggctagggaaggacgaagaggtggtggcagcacatgaagagcagcagcaaaggcgaaggcggaagaggatagagcagtggaagatacgaggctcggggatctctccgacgaaggaatccactccaccggcagccgcgccgatgaaatcgccatccgaccaaatcgcctcctctctcgtgcatcagtggaaatcacatgtatgaccgaggagcgcgcgcaacctgagcctagcgccgggatagccggaacgatgaccacagacagatggagctcgtcgccggcgagctcctccttcacgcgcagcgcgctggtgaacgccacaatcaagagggtggtcgtcgtggtgccgtacaacatctctgtgctccagatcagcaactttgtcgtgccatcgggcgtccttacgaggccacaaccgctgctcccgaccgccgtcgctgccgctccccaaccgccaccgccgccaccgttcccctccgcctcgtccccaccgccaccgccaccgttcctgagagagagagataagggagagagggggaggaagaagggagagggaggatgacatgtgggtcccacaatactttttttatgaatgacatatgggtcccacatatttgttttatttttgtttttatcctaatgccatgtatctacatcagagattagcctagacaaacccaatccggtacctacggaggccggcaagagagatctagtgctatctctgatctcatcgagttcatattcgaggagaaaggctacctcgtcgtcgagtacgagttagtgttcatgccgccaagtcgacgatggctagataggttatcccaatcgtctcaattgttgtattctgtgattttctatatcaattccatataaacaggatgtagggttattgcctgtcagataaggggcctgaacctatataaaagtccttgtcttcatatcttttacctcaatcttgcatatacccttgtcggtaatatgggcccgggggtacccacactaagagagaagggtcctttcctctagccacgtggccgcgtagcttgtcccccccatcgggggggggggggggggggtcgggcgcacgggtaatgagcagccaagaggcgcccatagctgcataggggcctcggggtatcctgtcgcgcccctcgggcctgaggggctgcgtcgccccgaggccctcactcggctgccacgttgctgctgagtgggcagagaaagaggcgctgccaggcgcattgatgggcgacgccccaaccaccaccgccgcatttaatgtggcatggctagtcgtgcgacgttcgattgattgatgtgcgtcaatcgcccttgaccaggctgagactagtcgcaggcggatgagacgggtggcagcgcacccatgctagggctatcaacgagccgagctcgagcgagctcgtctgcctaggctcgagctcgatataagctcgagccgagcctataaaatgttcgagctttttgacaggctcggctcaagctcgatccagctcgagcttgatttttaagtaacacaatatatatttcaaagataatcttataattaatttctagttcatcgtattaatagaagaggaaaaaagaacaaaataaatatatgatgtcaatataagacatacaaataacatatttgatctcctaatttattaaataacaacaaaaatcatatattactagactcgttagaagctcgagctcggctcgacaaagctcgcgagcttagggataggctcgggctcggctcgtctggagctcgagccgaactcgaatcgagcctaggacgagccgagctcgagtagttcgcgagcctcaagcttttttgacaaccctaacccatgccccaccctgtgtcaggtggcgtgggggcaggtatgccccgtctcatcgacgcccggagaccgatgtccgaccggtgcatcccctatgcatgaacccacaaagtctctaagaatttatgagggaatgacaggggatgtccccccgtgtcagacaaaagactgcgctggggatcacctgaggacgggtggccaccttacttccgatctaaggcatgggtggcggctcgaccagagttgatgtgggcccccctccaatgacaagatgtgtagaggcggtgcatgtggtaaccccttaaactataaaaggaggaccttgcctaccgagtaagggggattcggaagatcttgaactctgggggaacgcttgcagattgcactcccggattcaagatcccttgtaacaacctaaacataaacccacacacaggagtagggtattacgcttccaagcggcccgaacctagataatctctggtctcactccccgttcaccatccacctcgctagccgagtccacggcgatgacacactcttgatcatcgcgccctatcccctagccgaactcacaaagggggggggggggtctcacgtcctcccgctagagaggtttacacttcgataaccctggtaccgacgatacccatacaatctaaatatcctagttgtgactatcaaacgtcgacacttcttctctccacagaatcaccatgtttgcatcgaccatcgttgaaggatcgacgcctcagagtagaattccaagtggttctttatagcattgtcggttctcccatccaaaagctttgcaatacatgcccgcttgttcccatggatagcatgagcggcgattataatccggtcctcctcttctgcaccaaagatcacatgtttaacacgcaatgtaaaatattcttgctagactgacacgttggtcccacttgccaatcttctctccctcatgcataatctctccgtccctaaatatttgacaccgttaattttttgacacacgtttaaccgttcgtctattcaaaagcttttttgaaatatgtaaaactctacgaatgcataaaagtatatttaacaatgaatcaaatgatagaaaaataattaacataaattttttttaataggtcaaacatgtgtaaaaaaaaatcaatagtacggagggacgcggccgcaaataagcacgtgtatgggctatttctttggtaagccgtacctgtctcgtgggcttcaaaatcgatggggggcgatttggcccgcgtagccgatttccacgcgggcttcctgcacagatcctgtccgtccatccagtactgatccggtggccgtgatttgctcatagcatggtaggattcctgccctgcatcaccctcccccatcccttcccggagtccctctcgtggcatgccttgtaaagattcttgcggtactggtgtttttttttttttttaatctcttcccatcgccatcgttgttccagtccgtccgaggcagcggagcggctaccctccggtgcgggctccggcgagcacgctcctcctccctcggtaacaggttagctcttttctccaccgccaccgtgccggcgccgaaaggcgtcaacgtgccggcgcggccccaccccgccggcctcctccccctcccctttgcctcgctttgcccccgccaccatcaccggcccaccgcccgccctcccagcgccaccttcccccaccccacccggcaaccctaaccctaaccctagttgtcgtgacgcggtcggaaaacgcgcgtgacttcttttgctagcgcgtgcccgctaattagtattcctggttttttcttggtccgattacatgcgtcatcttattggaactttacttcagcgggtcgacttctttcaacgagatcgcttgattgggtggtacaatattgctgttatatatatatatataattcaaaagatcaatatcttcaagcatacagtgtttctttagaaacccccttaatgaatctagtaccagagtaacagcagcacatggaattctgaaaaaaaatatcaccaacttatcttacatggaatattgtgcagtttcagattagttccataatgttcctttttttaattatgaagagcttgactgcttctttggtgctttttgtatgcccggtcttcactaagtggtagaagagaacatgttacatactccctccgtttcatattataagactttctagcattgcccacattcatacagacgttaatgaatttaaacacatatatatgtctagattcattaacatatatatgaatgtggataatgctagaaagtcttataatatgaaaccgaggaagtaccttccaattggaaggtgaagctaggtttgattagtgactaccttaacctgcaccccgaaaaaaatacggaggcttaagtgagctcttttctttctgttgtgtttgtgggaacagcctttgctccaagatgataccataaatgtatgtttggggaacatacttggcactcgaaatacagttggacacaacctaaggaataggcttgtacatcaggtgtgacgttgcactgtccttgtcacgtcagcactccatgctatagctgatagttgaactgcagtggcagaacttcatgtcacgcatggtttttgcaaactccgtaagacatgtacaataacaactagctaatatttacgaacaatcaatatatctacttgttggccatgcacaatttagatgcaagctctgcgactgccaagaaattatgctttttggctaccttcttggtgtttcaggcaaccaaggaaggatcagcaaccctgacataatttacatacttcgcattcctgattagttgctcggttatagttttatattgtcgcttcactgcttatgaccccacattttgcccctttgtttttatttctaaaagaaagttctgcttcagtcttgaaaaatatgtggaaagctaagaggggcggtggtgatctccctagaagctttcataagaatagtagagccttcaagaatgagtggatctcaggtctgctagatcttttcctcttttctgctacacccctggcgttttcacagtttatgtgattattcacagctgctttatgttttattttcttcaactaggtgacctccttcggaactctaagcaagatgtttggactggtctcagtgatgggcttaaatcatatttgtctaaaagtgtcgcttctattattttgttcaatggtgattatatacgcttagtcttctcagttttctaacaagtatatattgaaatgccaccagttataaatgattcaacttgcgatcttctgtaggagacaaaatcttattttcatgctcaggcatagctatagaacaccagttttttacaaagtttttgactactgcaactctggttagagctcttaatgctacgaccaaacaccatgatgacttaaaggttggtgctgacagtcatcctttactaatctgtttacttctgatcattgtgtgctcatttctcgctttttcattttttagattcaagtgcgccttg

SEQ ID NO: 55277 - DNA, 1511 bp, Oryza sativa
caggcttactggctcaccatcctgccgatggtgttcgacattttcgttgagcctcactggccgcagcgtgtgatgagacagttcggacttaggcaggtgtttcccggcaacgtgcagccgaccgtcccccctgccgaccactcgtgagttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgaacagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgttttaactgcacgtttcctcatcgcaggacctcgtatgccttcgagcgcgttcgcaggcacgaccggcgcttccgcgagctccgcaggggcgttcgccacctcttcaggcgcgtgcgccagctcttcctctcacggagcgtcgatccctcgcccacacgggactttactttttattaatactgtaaatacctatacgaaactgatggtccttgtccagcaggatttgcagccgggatcttcggtactggggcctcttcgtctcacgccggtaggactggtcctactagccagttctacgatgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactac

SEQ ID NO: 55278 - DNA, 2580 bp, Oryza sativa
atctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccaatcttggagattttaatcttgtatagttttcaatataaaaagatttgataactattgatatttatataaaaaaaatatagagcacagtacaaaatcgccctcccccagggcggcaagggggccgcctgcaaaattccatgccccctcgccgcccatttgcaggcgggcccccgcacagtacaaaatcgccctcgcggagggcggcaagggggccgcctgcaaatttcgttgacggccgtcgcccgagagcgaacggccgtctgccacgtcattttcgccgccctctgggagggcgatttttaaaaatcgccctcccagagggcggtaggcgactatttccgtcaattttcaaaatggaaaattatttttgtaaaacttttaataaaaaaaattataaataaaaaaaattctggggatatgtacggggaattggatagggtggtgaggccgggcgtggtgtcacgtgacggtggtcaggtacagtagctgtttccgtgccggtccggtcggtccaccggttgatccggctcggtgaccgtgacaaatgatatggtgttttcatctaggaataagttcacttggtcactctcaaagttgattgaaatttagtccataagcctaaaccacaaaatcggatacctcgactctaaactcttaaaaccggaacaatttgactccctcggtgatttggagagcggtttcgcttacgtggcgcctacataacgatattgaccgagtcttcgttacacgtggcgttgacatggcacttacgtgtcattagaatttaaaaatatgcgtgggacctattagtcattcagacaaaaagaaatgtggggcccactgatatgtggggcccatatgtcagtcatccttcttcctcctctcccttctctctctctccccttcttcccttcggccggtggcgcgcggcggcaggaaagctagggctgcacgacctagcttcggctggcggcggcggtgggctggagctgatgcgggagaggatggcagcgccgtcgccgacgcctggaccaccaggtcgcagctcgctgcgttcgccgtcgaaaggagctcatcaagcaggtcgttgtcggacagctgcctctccgccaccgccacgcccatccgcagcacatccttcgatcttctaccgttggctgtacgtggttgatggatcttcgttgccgttgccaaccatgccgtcgatgatgcatgcccagatggaggagatcgcgccgccgccaccggattccgggctgccaccggcggcgatggcgatggcggcgccgcgggcagactcgatcttctcgacgaaaccgctgttgcagtatgggcacagtagtacagctcgccgtcggccgccgtcttctccgccattgctcccgatttcctcgccgccgccgccaatgcagcagcttggattcctctcttgggttgcgacgaaggattcaataaaccgagagatcaaaacccaatgcaagatttttttttcttttcttttcttctcttttcttttgctttccatcatcaaaaggcactcagatccccaaatccaagaacaggttccatcaacaagaaacaaaaaccactcagatccacatgtggggcccaaatttgttttgtgtgaatgactaatgggtcccacgtatagtttttaattctaatgccacgtaagtgccacgtcaacgccacatgtatcaaagactcggtcaatatcgccacgtaggcgccacgtcagcgaaaccgccctccaaaatcgctgagggagtcaaattgcactggttttaagagtttgggggtcgagatatccagttttttggtttagggtcacggattaaatttcgattagttttgagggtcacaaagtaaacttattcctttcatcttaagggcttgttcggttgggccggcaacggccgggatcggggcccaatcccgtggataatcccggcgtggaaaggaataagttcactttgtgaccctcaaaactgatcgagatctaatccgtccctaaaccacaaaaccggatatctcgaccctcccaactcttaaaaccggtgcaatttgactccctcggcggttttggagggcggtttcgctgacgtggcgcctacgtggcagtattgactcgggattctgcccacatggtgttgacgtggcgcttacgtggcattagaaatacaaaacgtgagcgggacccatttgtcattcaccaaaagtatgggtgggaccc

SEQ ID NO: 55279 - DNA, 3065 bp, Oryza sativa
  unsure (1)..(3065): unsure at all n locations
cgaagcaggggctagatcttcgacggcgccggcggcggacgggggccaaagcggcggtggccggtgcctcctccaccgcatccacagcctcctccgtccctccccgtggcgtcgttgccggcggtggcggtgcggcggcccgcgagcggcggagacccgggagtagcactagagcggcgactgcggcgtgcgggcgagggccggagcagcggcggcggcagagatcgagaccgccgtggaggttggccgtcggaaggaagaaaacgggccactagaacggctgcgtcctcgccatcctcggcctcgccaccctcggccctgccaccgcactatccaccgatgcgctccacgccccctctgccagccacgacacacccacctcttccgctctcccgccgcgcccacgaacgggtaagggccgcctgtgtctcgcgtcggcatcccctcgaagatggcggcatccggtggtggcttcttctgcacctgcagcggcggcgttgaaggtgggaggagcagcgcggacgggggaggcggcggcgccgccgatggatgcggtcggcgtgccaagccggccgacaacgacgcgaccccacgggagttgggaggcatctgcatcaagcattctcttgctggttcccgagtcaatcggcaaggggcgacagatgaggactgagctagcaagcagcagcaacagacagtgcatgtgtgtactaacaacaagcggcaagccaacaagcaaagggctgaccgaccgagcaaagatgcagataggcaagcagagcagcatattcgccacggccggtggcgcggccccggaggaggggacgcgagggacgggagcctccccggcccttgagcaccccccccatcgccgacgctctagctcccgtccctgcaaccgtgcgaataagggtgggcagaaaaaaaaaaccgaaccgaaaagatcgagacgagaccgagaaatttggtcatcaattcggtcatagatagtgaaagaccgattttgttcggtcaatttagttagtctcctcggataaccgaatagaccaaaaagactgaattatcaaaaaatgtctaaatacaacctaataagagtctttactcataagtgcttacgaattttttttgtgatttttgtgttgataattaccattatttctttgcatatatgaaaatgttattgaatttcggtcgggaccgagaccgagaccaaaaagaccgaaaccaaatttgtcgttactgatattttttcgctgaaattcggtcttcacttttcaaagaccaaagaccgaaaccgaaattttcggttagaccgaatgcccacccctatgtgcgaaggggagagaaaagagaagggagagagagggaggaggatgaagaggagagaggataatatgtgggctccacatgtcagtgggtccataaaaatttctttgagtgacaaatgggtcccgcatatatttttttaattctaataccacgtaagcgtcacgtcaatgctacgtggacagaagaccgagtcaatactgccacgtatgcgccatgtcagcgaaaccgccctccaaaactgtcgagggagtcaaattacaccggttttaagagttgggggttgagatatccggttttaaaagtttagggccacggattagatttcgatcacttttgagggtcacaatgtgaacttattccgcgtggaaaggataccggcccacagaaaaatatgcgttcggttaagcccagtctagattttaacccggtccatcccggcgttttccctgcgccccggcccgggaataaatcatctagtcccgaggtgtggaaaaaaacctcgagaggaggcggcggcgggagcggcgcgcggcgcgacccgacggcgacagcgacggcgacagcacggctctctcatccggccgccaccttctctccggtgagcacgctgcctttcctcctctcccctcctcttccaaatctagggttagggtttccttctcttctccctttcctgtcgtcgccgccatcccatcgagcaccgctcccggtcgcagcatagcgtcggcgcatccactctgcagccgccgcccatcgccctcgcccacggcgccacgccgccaccggcgtggcgccctcggagaagaagaggcggaggagagcacaaggcgattctttggctattcttgttgttcttgctgttcttgtaaactccaccttgtcgatagcgtccttgagctgcagcgaccagttcatcatgctggggtcgttgatccgctgcttcttcactaaactcactacgctgttcatctcctccaggaaatttgccacgctgttaagcttctcctggaaaccgtccatccatttgtgcctcttttctctgttaagcatgatgatctatttatcctagtttaggattccaaaattttgattatttgggtgcaaacattttaagtagtactgcaggtactgccattgcaaattcacaatttggctttaggataggtgaaaaaagattcaataccatataatatgcttgtaattgttgaggctgcaaagcgggagctaggcagttacagctagctgaagtgaaaatctagtggatctcctgatatgcagcagttgatgctgaaggacatcatgtgaggcttctatttgagcagtttttgtcatcttacaagctgagtcactttcatttcaatatctattttcatttaaaattactgagcctatagaatttttcacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 55280 - DNA, 1999 bp, Oryza sativa
aagtccctggtcatcccaaccgttctgcaagtagtcaatagcccgcaacatacccgatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttctatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccatggacaatcttccttcatgcacctcacttcatacacataatttgttgacttgaccaccctaaactctctctgcaatgaaactgcccaatgcttcaccgcctccttcatctcatccttatgagcataccttgcaccctcaattacctcgtactccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgttttttttggatttttagtgaatataatgaaatttcataggggaggggctgggctttataggggggaggcaaaaatcgccctcccccagggcggcaagggggccg

SEQ ID NO: 55281 - DNA, 13218 bp, Oryza sativa
tcgttgagaagattcgaggggagcagattaggagaggggttgatcccagcgagtgggtaggtggtggcgctgaggaggccatggaggagcaggaagaggaggaagaagaagaagaggaggaggaggaggaggaggaagagagcgaggaggagcaaggcatggacatggaggagaaaggaagaggtgccgataattcttccgagaatccgagtgtgactgaggtttgtcttacatgttctgacttgattgtgcttgctttcttgctgttaaattgcttgcacttgcatggaattgggaggatttggtttgcggtgatgctggatatgtatggcttgcatataattggtagattttctgataactttgctgtgggaatcactcacttttaggaatacaacatatgattgttggtccttggaatactagttttgttctttatttttatttgcactcttcactgtctacatagttgaagtatttggtccttgaaatactactagtattgaagtatttggatgtagaaaaatagttgctttacaagtttaatggtttacgatacatcgaattgacaacatggagtagatgaaaattcatttaatttaagtcaggttagctgctttcacaatttgcttaccttgggggcatcttatataacaagaaccccttcttggttatgttgtcatgtgccaaagtataagggcatatggagctggagcctttagaaatctatatattcttaggttttttgtggtttgagtcttaatcttcaccatggaatgctagttacatacttacatactagttatatctttatgtagcagccatttttaggaactaggttaaccttttacttgaaaaagaactttcttccacttgtatgatctgactcccactgctgaatccttttatcctgaactctgctaatttcctatacgaagcctaatgttccttatgggacaaaagtgcattcaatcaattcttgtgtcataggtgcaactagatcttttgggggcattatagtgtttcgcagcacaaatatgcagttcagcagttgattttatatattatcatatttctggaaaatataaaatttctttggccagtactttatacctgttgatccaacttatgctgctgaactccttttgtcccaaactcctccatacatcgataattttctattttctcgtaccctcattgaagtctaggaccaactgaaggaacattgatactataatagttttcacctggtaattattgaggtacaaataagatagtaaaaggtacaatcttgtggtattatctctgaccattggaatgactgttaacttggacagctccagtgtttcacatttgcgttgaatgatctactgacttcaattagatccacgctgactgcatatttctttgtctagtatgagagattgacacaatctgttgcatatgtgaagctcagcttttattaagcttttctattgtttctggtttttacattctgggaaaagaacatttcttgttcaacctgagaacctcttattttctaacgacaataactccccaatttccattgcgagtactccttatgtcacatcatcgtaatcatatgttctcgccctgagtccttgctttcaatctgtaactgcaggtggttgactccaacaaaactgcaggggcttccaagcaaacattatctgctgaagatatggaggatcaacttgaacagtttaccagcttgatgcaacagaagttcctgtccggtgaagactctgagcatatggactactctcggatcgataacgacgagatgctggatgaccattggtcaaaagaagccaactatgatgcggaggagaagtatttcgaagaggattagttcaaagttcaaactaggctgctgttatagcatcagttatgtagtgcatcatcgcatctcgttttttttttgttcatgttcagcacttacttagtctatcatgtacatatatctatatatgcagttgttgcccctctaatccgaataagttgagtaacttgcttatgaaaactaccgtatgtgttggaacatcaatcagaaaatagggtcctgtcttgtggagatgtttacaaattgcaaaatatttttatgcactacctccaggatgatggtgcatgcagggaaagtaacatgtgtgtattctatatttctaggggattacttgttcagtctgaaactgtgaaccgcatgagggaagtttccttcaaagcgaagaatgtatatatgggaaggcttagttagaagcagcgtgatccaaccagggtttgctttggttggacgaattggtcttcagacacttcaacgcaagctttagtattttttttttctcttttggttttgtattaagcccctgcctcgtgtgctgttctgatgcacgctttctttgtaccaaaaaaaatggagacaaatgacttattcctgaagtttttgtgaaagcttttgccgtgtcttgcctgttccattgtttttcttttcttttgctgtgtttgtgctagtgtattgcctaccttcttctttttattaattttctttcttttgcattagtgccttgactaccttcctcttttctttcctttttcttttgttatcggttaccacagtgtcttgcctgtttggtgcaagccgagaggcaaaaccacctcggttaataaagtcttaagagaaagggactaccatggtcaccgtgtgtacgggccaaccggccaagaaaacataaaagtctatgagaaaggacgatgtacatatacccctattaatgtgtatagtagatttctttcagaacatttaatccgtttgcagatagtgcaatttttattgttttgatatcccccattagatgaatatcttaaaacacatattctataacaattgaagaaaaaaaaggaaatacatttcttttttcaggaatagatagatattcaagaacaaataaaaaaagaaatacatttttcaggaatagatagacatttatgtaccagagggataaccaaactattccctctaaaaaagttagtttttactctgtcatttttctttaaaaaaatagctttgctcatttttaccctgcttcaaagaaaaaaaaacaattatagcatgcttgtactgtgaggagcagaggccaacgccgtcggtttgctgaatcagcaaaagccgaccaccgaccccacgttccgcacgcacgaaacgaaagtacgaaacccgcgccaacacaacccaaccaatcgtttaccgccacgtgcacgccaccccccaaccaaaacaaaaaccaaatttaaaaaatactacaatataaatactagtataataatttcttctcccataaagcttcgaccgaatccggctcgcctcctattaatccctctctctcctctccttttttcgatttgagaaaaaaaaaatttgctcgccttctccttccctcgcggcgaagacaccggagccaccactcgccgcccgcctatttcacgccgccgcgccgcgcagaccgacctcgtcctccaccccacccatctccgacgccgcggaccccggcggccgctcctcctttgctccattcatcgccatgacgcgccacgccggcgcccgccgccggggcggcgccggcgtcgtcagcctcatcgtcgtcgtcgtcgccgtcctctccgccgctgcaatcgccgcggagggtgtcgatgctgcggtgttcgacgacgcgcacctcctgccgcgcccgctcgtcatcgagctgcctacgacgacctcgtcgtcgtcgccggccttggcggaggagggggagggggaggcggtgccggcggaggtgaggtgcgcgagctggaggctggcgggggaggcgaacaacctcgcgccgtggaagtccctgcccgaggagtgcgccgcctacgtgcgggagtatctcaccggcgtggcctaccgctccgacctcgaggtcgtcgcgcgggaggcctccgcgtacgcgcggaccgcccgcgtcggggacgacggccgcgacgcgtgggtgttcgacgtcgacgagacgctcctctccaacctcccctactacgccgaccacggatacgggtcagttttcttttggtcacccactcagctccacaaatcccaaattgcgaaatcgttgggcggcgtgtgttcgaattggtcaatttccatatgctgatatgagcgcttgattagttgattttgaattatagggaacaaaattgcgaaatcgttgggaatgtgttcgaattggtcaatttccatatgctgatatgagtgcttgattagttgattttgaattattgggactaaaattgcgaaatcgttgggcgcgtgtgttcgatttattcaattgagatgctgacatgattgcttgcttgatttgaaaatggcaggctcgaattgttcgaccaccgggaattcgacaagtgggtggagaggggggaggcgccggcgatcccctccagcttgaagctgtacaatgaggttcgcgaccttggattcaagaccttcttgctcacgggccgcagcgaggggcaccacggcgtcaccgtcgacaatctcaagaagcagggcttccatgattgggacaagctcatactaaggtaactattccatgatttagccatcaccattctctaacaaaaattgctcctttatacatttccagttcgtcatgagtcatgacatttctatcaaaatttgcaccttgcaattgcgctaggcatgatattttctaagaagatttgattgtgcattatattttgcgtttagccaggacatttgtgagaaaatcagaggcatacccctagtattatttcattatttgccattttcattgacctgtatgtaatttgcttcaaatatgtggatgttatcaggatgtctttataatagggataattatgtggatcaatcatccattagggcgcctaaatcgccgaattgaggatgaggcagagaacctacgcccattgccaaacaatatgctttgcttgctactgtaggctttttttctgacagatgcttaatatttcccccatcccaaaatataatggattttgaatggacgagactgtcatatccattcaaaatctcttgtattttgggacggagggagtatctatttgttcaatgcttttgtgctacccttttgtccaatgctcatataacattgttgcggccataatttagcatctgcaaagtttgcttttcacctcattctaaaccttcaccaatcagtcaattactacagcattattcgacattaaaccatgagccatcaccacattacgattggtagaagtagaactagggactgttgctgaatatcgtttgtcgaaactactatacatatgttccacatgttcaaggacattaaaatttactttgcaagctacatactgaacattttgaacaacacattctttttcacaatggccagggcgccagctgatcgcaagaagacggcgacgatatacaaatcggagaagaggaaggaaatggaagaggaggggtacaggatcctaggcaactccggcgatcaatggagcgacctgctgggtttctccacgagcgctcgctccttcaagcttcccaatccaatgtactatattccatgacggaacagaagagggaaagagagggcgggtgagaaatgcggcgtttatttgatgcattttctcacccagcccattcaaactgactggtggagaaaaagaaattcacaataattcttcaaaggaattccaaactgtacaaaatctcactgacttcatgtagaatacattaaacttgtaaagtcgaatgtaattggatgaaatgagagactatttattgagttggtagttcatgatatactatattcttctcttgggaaggcttacttgaagcgataactgtttttgtgacgctgaaacatttcactcgcaagctgaattttcgttggagtctctgcactgtccatcgcttaacttatcttatttgcaagttccatgtagaaggcgaagcacgcaatcgttcgtcataaacaaaagaaaatactaacaaaggagaaagaaatatgagatagattgtttgaaagcgcattgcaaaaacatagccaccccattgcagtaaccgggctaccggaccaatccaatgtgacacacttcgcattaccgagcaaccgagaatttactaagttaaaataataaagagtaacaacaagtcggtgtggaacaattctgcagtccagttcagtaaaaatctagagcaagtcagatacagtagaaagttggaaaagaatggtggtgtatggctgaatcactggaccatcggatcagggttcccagcagcaagtatgtcgagcaacgagttctggggctccatctcttcatgccagagtggtagtttgtcaccagggtgaaatttcctcgaaacaccatcggcatttatctgcaacatgatcatatgcataagtaatccaccaatcctttggaaacatgatgggtagaacgaagagaacaggacatgtctctaaacttaaatctgcattgccaaactgccaaaccatagttgtactgaccaaacatattcagcaaaagaaagctacggaaaatgcaaccaaaacagatggccaagaaagacatgaggttgtccactctacctcactctagcatattttagcacaagagtacagcatgtctgaatgaagcaaagaggtaataccacactgaaatattccgtccttggaagttaaaaggccgatagttttcgctttaagattctttggcacagcatgccaaatatagcacagaaatttatatgtttgtatgaattccactaaaacaatcagttcaggtctctgaagtctgatgtttcaaaatgtctccaataaaggaacaaacaaggacaatagggatgaaaaaagagagcacttacggtgactgtacgaacaacccctccactagcaccatcacgggctatagcaagggaaaccaccttcaccacaaacttctgtagagatgaaagagaagaatcaagttaagagatgaggtggaacaagcaaaaataattatacagggggcactgaagtgatggaaaatggtgtttgcactctatgatcctagacttaacgtgggaagaactgaacataacgtaggcacttcgttctacctaacgcatcgaagaaactatctcttattacacatggtttacaagtaaagcgtacctcagcttcttcctgggacatgccctccttccattcatggtcaagcagtccatacaggtaactggaaccagaacctgcaatactcagaaataacggctagcgtcagaaactgtgattgatataacatagggtaaagtagggactcggacaattttatgatcaatgttctacaactaagccaggttacacaggagtatggtaatcaaagagtatggcaggacattaaaggaagaaatggatcgcgctaatttcaaatgattgcttatgcattgcttaaaaaaaatactgctcaggtaagtttgcaaataaatctcattaataggcttatactattgaactgataattattcttatgtgatacatagatatatagacacaggtggagactacatttcttatttgattactatgagcccaatgaaaagacattcaccataatatttctgggggaaacatacctccaattgcaaatggttgcctcagaattgttccaccaagggggactgagaaaatttggccaccctcatatttatcccatccaccaacaatcatgccagcttgcaacatgttctgaaaattggtgaaaaaaccaatatggcaattagacaatagcttaaaatcaatgtatgaaagaatcagagaaagaattcatctcatgtattagtgaaattcttgtatcgtagaatgctacagaaaatataccttgttctgataagccaacaacctaattaagttggctgcaactttcacagtagctggttgcccaagctgaattctgcaaatcgagggaaaatttagcatgggctatcttgcacagcaaatattcacagtaactactagttcactgtgttaattaatgaaatctaagtttattattgttcattcagtgccatcctacttagcttaaaaggagagagcattaatagatatattataattacacaagaacaaacttacgtgtgttggtggagaaaatagcgtacatattccgaaatgacttgtgtgtcggcagcctgtgagacaatgagaaatataatactagtgaactattggaaatgctgtatctgataatacttacttacttagtactggactattaacaactatgaaaaagaagcagaaaagaaaatattgaaaatgtgactgtaactcagaaggtataatttcccgctacatcaggcaagccaagacaaggggaaaatgaacaagataagatgcaatggtaaaacaaaaataatcacatcttgcttaatgaagagagtatgttttttacagcatataataataacacgaagcaacaacataaagaagggggcccaagactctaaacaatgtaggcacttacagatccagagcggcagacgtacacattgtcagtcagttgagtaattttgtcagatgcacggttcgccacatacattcctaagaattaacaccacataacaaaggcaattaaattaaagggaaaaaatagacaagcagacagagcacaccaacttaatattgatttcgattggatcaaccacatgctccaatatttggctaagttaataaggcaacatggctaaaacaactaagcttactagtctatgtaagcaaaagatcctaggtacaccagaatcaccgtaaacaccaatgggatgatacttttctcattctttactgttgagtgttaaatgagaaataaatgaacagtgaactcaaccagaacaatagaggttgtacccaacttcccctaattctacatcaaccgaacacacgacaataccaatttttcatatatcaggtcacaccaatttttgtacttatccatccataatatgctgatttaggcagaacacattagtggtacacgaaccaatttccactgacagatacattatccgatccggcagcaaacgctaaacacgtcgcctaatctcacaaaatccatgacctaaacatgggaagcaggatggatggcaggaaccagatgcgctaataacaaaaatccaccgcaacctagcataaacaagggtcggatcgggggtgggggatcgggggagcgtaccggtgctggtccgggagtcggcggcgaggacgacgccgccgtcgtagcagacgccgacgatggtggtccccatccggtgctccccggaggtgggggcgtcgcccgcggcgggagagggggagcccatgagagaggcgtccatggcggcggggagatcggcggatgcggcggcggaaaacccctaagcggcgcggcggcgagagagctcaggtgttcgctggctttggccgccaccgcaagaaagaaaaaaagaggaggcgacgcgatgcgtccggtccgagtcggttcgggcgttggtgcggctcgaccgctctaggatgagtcgtactttgatctgttcattgacgtgggacccatgtattataacatccgtctcattttaaatgcaatcataacatctaattttaaatatagtcatgacttacttttaaaaaatatataaaacttttaaataagatggacaattaaatattaaacagcatttaaaatggaatggaggcagtagttattatttataaagtccaaaaataaagtattactgctgagaatctgtttcataacaaggaactgatcggactttggagtgtactaacaatctgctgtaatcttttcatttgtgcgattatatggaaggcacatatgcttgaacagaggtacaccacacgcacacacatacacgagaacatgtccttaacccttatcatatggttaaaacaacggaagctagcaataaatactctattcgttttaaaatatagtaatactattatattagacaccacataatactacgaagtctgttaagatctataatacaattaaaaaaagtactagctctaataactcgtatattgtccttaaaagggaatacaagaaaatatgcattgactagggatggtaatgggtcaggagggttcattggtcctttcactacccacctcagtcttaaaaaaaaaattagcacgaaaaactactaaattcaaaatttcagtccaatcatttcaaggctcagccctcatattttgtagactaaaaacttgaacccattacaaccccgtgacatgccattgaatctctaatgttgatgatagcaaatggtcactctcccaagacaatcaagtgagataaaaaaaaaaagacaaacacttccacgctgtaaacaagtagaatattcgtgtacaggcccacttcactaatctaaaagaattaaagaagtacacttcactggaagtctggaacatcagaacccaacaaacatcggcacacattagtcatttagtatctctcttgtttgtgtgttgctgccattgtctatcacacaccacctagcaattgtttcaatacaaactaaacgcaacaccaaaatgaagaagaattcatgaagaaagtggacataaaagaagactcatacagacagactctacataagctgatgcacattcttgtccagtcattaagacgaatttagaatgatgtgcaaacgccattgcatatttgatttttttttttaagccagcagtttcaagggcaaactttcacaataccgaactttttcccactgttttcttattcaccttcttctccagtaggatcatccagtgaataactttctcacatgtggagtcgacgaactggaaatacctcttgcccactgccttgctgcacacaagaagccaccacacagaagaaaatcctactccgaagcccaatcctgaaaatatatacagccagatatcatggacatcattatgctctgcttgatcaacatggttatctttctgttcaaaacagctgccagaagcaagatggatgcagagatacttgttgccagcatagatgtatggatcttcatcaccaagggtttgaagctgagagccctggggtaccatcccggacagattgttgtaggacatgttcaggtggctcaacaagtgcagtgatgtcatgctttcaggaattatgcctgacagtcggttccatgagagatcaagcgactccaatgaactcatattaccaattgtctctggaatatgaccactcaggagatttttcgagagattcaggtttttgagccctacaagatctccaacttcagcaggaattccacctgttagataattgttagaaaggtcaatgctcttcatcagataaaggatcttagaatacaatctttcttctcctttgatggtaatgtatagactctcattgtgatagagagatccaccaaaactatcaccagaaatctgcatcggtataatatgtcttgacctctgtgaagccatttcactaaaatttccaataccttgtggcaggggccctgacagcttgttattggcaagatccaacacttgaagaccttgaagctgtgacaattcagacgggatgcttccagtgaaacgatttgatcgcaaacgaagaatcatgaggtattgcatgttatctcctatccattcaggtatggaaccctccaaattattatctccaatatcaaggaaaaccagaagcccgcatgaacttagagaggaaggcaacaacccagatagcctattgttgttcaaatgcagggaaccaagaaaagtaagagagccaagacttgaaggtatgtgtccttccaggttgttgtacgagaaatccaccaaaaatagttctgtgctgttcttccaacaattaggtagctcgcctgataagctgttgtttgataggtctattgctgacaaccatggcatgttgcaaaagtacgcaggtatgcttctatttagacgattgcttgacaataaaatgtaacgtgtcttgttccctcccacactattgggcaatgatccagataaagagttgttggagagatctagcaggtctagactttctggcatatcaggaatctgaccttccaattggttcgagctgagccccaagaactgcagtgacttcatatgaaccagggatgctggtagcatgccagtaagcagattgtcagagagatccaagttaatgagagaggtcaatgacgtccaaagccaatcaggcaattgacctagagtccccgttctgtgcaaatctaatgtctgcattccaacttgtgtttgaagccactgcgggacttgtgattgtagtggggaagaacctaaaaggagttcataaagttgaaagggtggtaaccaatttgctcccacagaaattctcaaggaattgtaagataaatctagcttttttagcttagttagatttgttaggtgttgttcagacaagacatcttcgagtgaattgtgagaaaggtccagttcaattaactctgtgagctgactgatattggtatgtacatgacctgatagtgagtttttgctgagatcgactgagaagaggtttgggaaggatccaatccacccggatagacttccagatagattattattccccaatttgatcatagatagtcccttcatgcagcgggtcattgccttccccaaatcagcaatatcacctataaggttgttgttcgacaaatcaaggatctgcaagttacacaacttagatattggaattgctccaatcaaactgttgtcagccaagtaaagggtattaagggcagttaaatttcccacagattcaggaattgagccatgcagctcacaatagtccaaattaattaatgacagagtgtatatgcttgccaaccaattcgggaatctagagctgaagttgttgcctgatagatcaatttcattgagaactgtgaagttagactgggatagagaattttgattagtgggtggaagattggtaccagacaaacgaagcactttgagggaagcaagcatgttcaaagactgcagccaatctgaagccacagaaaggttccacaatgacatgtcaaggtaaaccagtgaagaaagctgagagacccaaagaagattgtcaacagagctactggaagtaaagctgctaaagttg

SEQ ID NO: 55282 - DNA, 8181 bp, Oryza sativa
tttagacctacccaagaggacagcatgcctccagggtctctcagggtggccttcaagtcgaatagtgcatctctttcctttccaatgcatgctgctgctgctgtgattttggaggccaccagcaacaggggcaacaaagaaatcagtgcaaggcgcatgatgatcacggtgttggtaagtggtaaccttgaagctaatggggatttatatgagaaacacagactatatgagccacctggctcgcatcagcaccctgcaggataagatgatcaacaaatgccagctttcattattatgaaaactactcttagtattgactcaaatttaacctggagttgcatttaatagagacatagttttatcaagataatgttcttgcaacaagaccaaagaccagagcaattaatctacatttatacacggccatatctcttatctcagataaaaaaaatgttataaacttataatgatcttctggcttgatttgactacaccctaatgaccccgctaaattaacaaatcaaccaatagcgaaggtttatttggtcaatggtcatctctcatgagtcaatacgagaaattagttatcactcatcactggggaataaaagcaggaagtaacttaaacatttgccgcatctgtgcaacgatttgcattagcaatggagcagaaaatagtggagaggttaccaagtaggaggtgctcgccaccgctgtttgcatcggagacggcgaggaggtggtaggagggttgggctggtccgccgcggagcacttgcccgaggggctagcgccgccgcgcgcccgacggccgcctccgcgaggccgccactgccgccgcccatgggagccgggtgatggggccatgggttggctcccagcgtcaaatgcgggggtggaatggtgtgcgggatgcgcgtattcgagctgggaggagtatctcgaatcccggtggcctctcgcggcgggggatcgccggccggccgccgccgtgttgagagcttgaggaggaggcggcggcgggaggactaagacaaaaataatagttccaattttcccaaaataataaggaaggccagggtctaatatgaaaatatcccactgaatcgatgaattttcagcataaattgagccaattttcatgtcaattttgagccggaccaattgaaagagtactacatttcaagtgattctgttatcatttgagacacagcaattcagctaggcatttgcaaaacagaattaagggcaaagtttcgcatgaatgtcgcaatattccacgtgttttgctgaagtatctcaggttgcaagcaaagtttctgtttgagaagaaacttcagcaatttcagttgaaaacaccttagtcacacattatcctgcaaccgcacaaaaaacactaaaaatgcaatgctccatttttcatcaagaaaagtaaaacccattgagctacgagggtttacaaatttcagatactttgtagctataaagtttgcaaaaagagaagttgaaaagccttctggaatcagtaatctctgccttgttcgcttaatcctggttttgttccatttcatttttactccgtttcctgatttgtagatgatctttggttcatcaacgagaaacatactcggataagctgtattattgaacaagcagagataaaaccaaagacagataaaacgcctgaacggtaagacaatacttctccagaccatacaattgcatgacgagcccatacgaagggtttggaaacgtcagaaaaaccattcagctaaggcagaaaagcaacatacataacaacatgacaatcgatacaaccaagtatctgcaaacagaatatgtacaatgttgttatagccatcatctctcatattctgccaaacatttcacacacttcaagtacgtttctctgcataggaaacagtaggaattcccagttgaatttgtctcagttcgatatcaaaaagagcacgacgagtgctagtccttaaacccaaaatcatcaaacaggccctgaaagtggaagagacaactaatggtcattttgtgtacacttggaatcatggacagagcgtaacgaaggtattctgtagagaacgtttggtcgctgatataatagcatgctaaccttggcatcatttattccataagccacacaatagtgttcctgagaaaagagacaatgtaatgaagaagtggagttgatacacaagctgctagttttgtacgggatccctcaccaataagtggaaattctcatgaacttacctgcatcatatgccactcttcgaactcatcaaacaattccaatcgttcaatcctgcaaccatgcaatttcatgggtgttacaaaaaaaaaatagatgttatgtgaggcaagatttaacataatgtccttcgtgaagatcaaatgtaaaactcagaaactcagcatcatacatcagaaatattacctgcgtctttcttcactgtcaatgaaatcattgtatatttttagcatatcccatgcaacagctctctgcaaaaccaatcagtaaatccctagaaacaaatcatattcaaactgtgtcttgagtcttgaccaaatatacctgccatccgtgatcaagaaaaagattttccttgtgacttagggttggtgtagcatttataccaaggagagggcatcctctactctgcattagcaggacaacaaaaggcattgagctatagaataatgctatgaataaagtaataagcacctcaatatatctgtccatgagaaacaaaaagacaggtaccaaccaaaaacaagcaaaacatcacctagcttaaatcatacagtaagatgccctccataaactaagatccacaaacagaagttatttacacaaatgactacaaatatttcatctcaaacttcaacttgtcatgtttgtaatttcaggctgccttcattatgtgcataataagctaataacttcttatactgcctccttcaattgtcatgcagcaataattagcagttcattgtttaatataggtccaacagctcttgtataaggatagtttatgagaatcaaaggccacaaccgaattgttcaatcaggaaacctgcaatatgcccgactctttggaactaagtaggcctctttgactccgctcagagatatttacccgactctttggaactaaatatgcccgactctttggaattttaagatatatatgttccttcttttaacaaaggtactataaaggtactatgattggaagcacaaaaaataaggaggtctattttttaggtattgtatagttggttgtactttcttgttggcatacaaaaaggtctgcagttgattaaatttacttctcgaacaaatccatgtggcaatcatgcaattctcctataaacattccattacacctcaggggcaaatggctcatgcaccacaagggaataaaggattacaggttacaaaggttcatggacaatctacaagaatgaacaaaggtacctcaaggtttataatcatttgctctccaaatgcatcatctggatggatctgcatcagagtagaagtcaatagtgcaaaaatatatcacatatgagagtggaagagtacaaatgagagaatgatttcacctgctcatataagaaaaatatggcagtggagaacttatcagatgcccaaataacaatagaactggttgaagctgggtctaagtaaattagcacacactctgcaattataaaggtcggcaagctgatgacaacagaaagatttattaagaacttgaaaatttgatcatgattcaagtgttagagacaaaggctacgcgatgcaggtatctgacttgacaatgttcctataggcaagaggtgtacagcataagttcattggctgattaaatgagctaactcctaaaaggggcacttgaataattaatcaaacttctctaaaaataggacaagctatgacatatgaaatagaacaaaacatgaacatttatgttctgacaagtaaattatacatggcataacaggaaaatttagttataaaatataacataagcgaaaaacgtagagggcataaattatgaagctaactgaacttgcactcattgtaaaccataaagatataccacaacaacaaagaacaaaaaaaaaaaaaaaacttacgtagggtccatttcagccatctgaataactgaatcaagttttggtatgtcacgaatatcagcagaaaagagcttgtaatgcgcacttctcacttcacctttttctgaaatatttggccattatcaattaatatcagaacacggaaaatagaaaatagcaaattctgtgatatggaaagttcacttcaactcacaattctggccagggtataaatcattttggtcactaagaccattatgctgtcaattaagttataccaagagaaacattcttacaaacagaatgaaatagctacctccaagagaaaatataacaggaactttatacaaaaaaggtactgaataaatcaacataaacgtggagaatggcctctagatggattcaggcaaacaaaaaacaaataaattagcctctagatgtggagaatggcctctagatggttgaagctgggtctaagtaaattagcacacattccttaattgtcattagacacttatttctgctaaagatgcatataagaaaaaggcaccaagtattacggtagatacatatagaaagaacatggtagaaccattagtggggaagatccttagatataaacagggtaggcattaatcgacagtatcatatgcaaatgagagaactaccaattgatatcgaagcttctggtcctaacttttccttcatttgactatagtggttaatgatggcagcctttttgctggttacctgccaatcatcaaaagttgccagaaaagttacttatgcacaaagagaacaagctgctccgctgccattacatgcatcacattatgcagagtactatgctacacttgaaaatagcaaagaaactttatctacctccttgaaatccaactcaacataaaggtatggagcaatgccttcgtcctacagtaacaaatacagcacagactgagagagatgaattgatattaaaaatataccaatatactttgtgaagtttgatcttaaacactgcctccaccaaagcaggatatgattaagatgcaaggcgtactggaacctatttaactagtttatagtaacaaagggcatacagagttaaataaaaatgatataaattattcagatcaaacagtagatctgataatgggccgtaagcatgtgattgtgatgctcatgaatagtgagtaatggataacctgcaactggaagaatgtcgtgtcaaagccagcaccaagagataatatttgtttccggttttgatcattactgccatttccagcaccgaggaactgatgcagaagcttcctaagaacagaccaacgtgcatagtaccctttgcagagttatttggaaaggtaaacaaattagaattttcaaacattttcaattttagagaagcagataaagattcaatgaggcactaccaacctcgatttattattggagccctttttgttgttcgtctgacaaagaagtgcacataatcatccttcatgtatcctttattaacacatgacctgcaaaggaaaaatgaaaatgagtatggcatatagcaagcagcaacagtcaacctctactttgaaaactacaatgacatctatatgtataagcaatacaccacactttccatgcatattgaataacatggaccgtgttacatttatctgttcattgttcaagatagcggcctctgcaatgtcataggcagaagaggtgaaggtagatcatttgctctgcataccaaggtcagtaggccagataagcactggaagttgagatgcccaatcaatttcttcaaaccagtacttaaagcatcaattcactccaaacaaataagcaagaaaatatcaagaaatttcttctgaaacacacaagaatatataaagttgcaagctagctgatccactcaacagaaggacttcattcaaggcaattggtaaaagaggcacatagctcttttcctaccattacacactgatttattgcagagagaaataaaaatagaatcagttcaaaggagtggttatacgacattgcatggtcctacgcagaaaagggtcacctaagtggagcgcgattctggatcttcacataaaaactgtataaaccatccctcttgcttagtacaataattgcattttagcatcacgattcagcatggctttggcttcattttgtcacggtattccattttgtcagggtattcactagcgcaacaaacagtagcagcatagcgcgaccgcggattgatccaaacaagcacaggggcgaccgcttcccgatggcgcctcgtgcaaaggagagaatatcacgcggagcacacgagacctggtggtcatgcggatgcgactacgcgaggggaaggagagctggagaggtagagggggggagtcggggttggtcactcacagcttgctggccgcggcgtcgtcgttggtggcctgcacggacgccgggctgctccgcgccgcgacgctaccgcctccccctcctcctcctcccgccgccgccgccgccgccgccgcatccattccggccggtcgatcgctgggtcacggcgtgaaggggagaggaagacgagagacgtgatggaaacgaagggactaatgggcctcgaggaataaagctcgagaactcgacccgatttagatgggccgcacgtagctggcattcacggcccggcccaacacatgggtcgcacgtgggcagctgtcccgttcggattgggctgcaggataacgggccgttggagtagcggggtccgttttctgttgggccttacaaaagaaaggcctgaataagcacacggcttaacctacctcgacccgagtacacgttcttttctacgggtgaaaacagtacgaaaatttccgagatttccaactgccgttttcagtttgcaccaaccgtttcagtcggtatcaataattattggtgtcaaaaataaaaacggcaatatcttttggaaatggtagtggaaatgagaaggaggtttttccgactgtttcgtcgataaccgtatttgtccggaaatttccgtcaaatttccgaaaaaattttaagttccccagtggccagccagcccaaccctttgaaagctggctagcttcggccccattaggaacggaaagtagctagggaaaacgttgttaaccctaaggcatggcatgtgaactttgtaaactttggtctacttaatttatcaatgttgaagtattgttaactttgtttaaattgttcgttgaacttattatcgtatcattaatcatcatataacagtgttatatgaagtgtgatgatgcaaaaatgttataaagtcatcttcatgcatagttatgtcacactccgttgttttcgacttccgacttccacggtgccatttttgatataccaatattaccgatatcgttaccgttttcgggtctaccattccgattccgttttcaagaaaaaaatatggaaataaaaatggtagagggtttttctgaccgttttcatccgtattcgtttccgacgcatatacttcgtttttttttctaaaaactttcatccgaaaaatttctaactaaaaactttcatcgaagaagctaatcttctaagtttttgaaaccatggtaaatctcgcggttactgcgataaccgccttaccgtggggtggtggtaacaccattcaaaacggtttggtgaaccctggtgatgacacaattttattactactacataggaagaaaatgacgggagtgatggcgctaccgagaagaaaattacgtagacgggaagtccttcaaacaaggacttctagttatgcacctggataacggagataatactcgcaaaagaaaaaaaaacagaaaaaaaaaaactctggatgcactatattaaaacatggcaaagatacactgacgtagtgatgcatgcatcttgtatacaacaaggaactacattggttgtatctgaaccagaacccagctgtccagaattaccagatgtccagatgtccagaattacctaaacttggatctcctatctgaa

SEQ ID NO: 55283 - DNA, 1189 bp, Oryza sativa
aatactttgtgcgtaacttgtctttttaatttttttcataatttgtttaaataagacggacggtcaaacattgggtacggaaacaagggtttatctttttttgggacggagggagtaccatacaagttatacaagaacataaactagttaccttccgtagtatatccaaattccaattcgtagcaggtgattgagttctggctgccaagacgataaatttccatggattggcgtcttcctgctttgatcctgttgagttttatctgaactatagcacggaactcatccaatgtcttgtcagtgaactggaagtaggcatttcttgcagttctgctgaatatgaggatggcagaaacgacagataatccatatgcaaaccctagcagagtgcataagtatgtccccctgtcaatcatattctgatgttttctagtagtagtatgttgcgagcatattcttgatagcgaggcaccacaatttccacaaagatctgcattgcctagatatggttcatctgtgaaagttgaaaactgagagctacatggtatcactcctgacagatcattgtaggacaaattcagaaccgatagattaatcaaatctgtgatgctcggaggaattgatcctgacaaatcattcgacgagagatcaagtgcctctaaatgactgaggttcccaatttcgtcaggaatactcccaagtatgtgatttcctgatagattcaaggcaagcaaaaaagatattgctcctatttctctggggatttctcctgtaaattgatttcttgatagatcaataaagtttagcgggtaatcgtacgttgagctgtaactctcaagtttatcagtgtatacgtgtatggccaaatatgtacgtccatcagtataaactgtagcaaatttggcggaaggaatcatgacagcatatccatgatcaacgcacatggatgttaaatttcctagaaattgtggtacaggaccagataatttgttagaagcaagatctaaattttgcagggcatgaagttggggcagtgactcaggtatttcaccagaaaattgatttgagcgtaaagatagagtaatcagagagcccagactatcacccagccatgatggtaagcttcctgataaactattagatccgagatcgagaatgatcaatccattacatgactgcaatgaggagg

SEQ ID NO: 55284 - DNA, 6367 bp, Oryza sativa
cgaatctgtattcattcagaatgtagataaagttctgagtcacacaagatgctaaaggcaagtctcaacttcacttggttaaatcagtctttcttttcagtatatctcccatattatgcaggctgtaagtacaaactgaacttatttcagattgtaaatgttcaaatcttaaatcagtaaatgcattctcatttcacaatcacatccctttatggacacttaggataaagaaactaagtgaactaaatttcatgatgctatatgcaagtcatcataactattagggaaccacatattagagaactttgttcacagaacttcgcagataaaaaagaatgtgcagttacgcgtttaagatgagccatcatacgctacagcttttgatagcttcaaccacttgcctgtctctcataagtcataatcaatatgagaagggtgagatatcagttatgagagaggcttgcaggtgtgccaatggcgttggaagtggaagtacatgatagtaggttatattgtaatatagctcactaatatggaaccaatttaaatatgtggttctgcgaaattgtttattaaatagtatttcctacaaaattatgacatcttacatacagttatgtgaaatttactcaactatgtatgacctattgggttggatcgttgtcaacactcaacagcagttcagtagtgcacaagggagatgaatctaaaataatcattaggtggagcaaaataggatatgcacagacttgacggtacttaatgacaagattatggtgatcaaatcaacagttcaatgaagaacaagtgctcagaactttgtaagcttattacttaagtaaaaggaattgtaagcttattaaataaagggcaaaaggagatagagaaaataggtaaagctactttacttcaattaatctctccacttttactaatttaatagcgatttgcatctcttgtcaattctagatgcttagttgcctcccaaagatggtactaaagttggctaaatgttcgcgttatatgccaagggcagatgggcacaactacagagattgtattattggagttaaatatatatagccttttgagaatcaattctccacatacgtgcgtgatctatagacattcacaaaacctattctgatctacatatattctccaaaatcacacctttccacaataattcaagaggttccatgttcacttctagtcagccatccgtactgttttgtttgaaagaaaagcatctattgtcactgcctgttttagttagtatttatgttcatctgccatgcagaagtgaaaaccaagtagaaatataacatgaacacatttgctccggataggcaatttcttttcataccttcatatggagtaatgtaacagtagggttatcacttatcagcaacgtctctcttaagaaaactaattttgaattaatatacttctatgggttccaacatatttattttgaataaaactaacatatctatgtgacatcccataggccataggtgatgacctattaaatacttaacttaaagtcgtgtgattatggcatgcatgtgcagaccattggataaaacctaacttttcagattgactgccatggagacggatatatcaattctttagcaccgcatgctaaagaattgcatatatgatgaagttcatcttttttagataatatatgatgcaatttatcttttttagataatatatgatggaagtccatagtgcctatctttggaggggcaaccaaccaatagaccctatgcctttccctccaaccttgaatagacacatcagtagagcactactcctgtagaaatgagatcgctcacatagcatttatcatacaacttttccctgtgacttggatgctttagcccccatctttaaatggtagagcaagtttatgtcgatgcttctggcctgctgacttgaggaggaatcaattccacgcggaagagcaaagggaaagagattacagacattatcagttgcaaatactgtttccactaaataatgctggttcatgattcatggaatgtcgatccgacgcagcaaataaaagaccaacttgtggagatcaaataattccttcctatgaatggatactgatttgatgaaggtgaaattcagtccaaattgcagctgaatgatactcagctttcataaaaaagtaaaagatccgaaggtattaattctaatttaattatgatttgcaaagattgttccctgtgtcccctgaagaatttccgttctctgctccctcagagggagctccagtgttgagactcgtcattgccaatttagatttttcatctcgtgctgccgaaatatcatagctgtagtttttttttttgtgtgtctcctacgtattctagttggtgattggtaattcaaaacagcatgaagtaagataccttaaagcttgggcacaaatgtgaactagataattatattgagatgacaaattgacaatgacaaagctagtcttcatctatgaagctctaagttaaaaaaagtgcaaatcaaaagcactaaatcccccattccctttcatcactatgaatataatctactcgatccaatattaaattggaaagcagcaacactccccccaaaaagggaaaaagttaacaaactagatcagttcatcttttgatctcttgttacagttaaacaatctgacttaaagtattagcagctcaacttttaatattcatggtgattgaaagtgataaaggaggccaagggtaaggggggagggaccaaatcggtagggtacctggagcaaatttggtagggtttgcgactgcgagccgcgcgatggaagcggaggtctcgcggccactcgctttgcctcctccgctcctccgcctgcccgggcggccctcgacgatcgccggagcgcgaaccaatcaccggcgaggtcgtcgacggcgccggcattcaggcagcgtgcgcctcctcccgctcccgcccgtcgcaaccccgaccggcccctatccccacttgctctcctccgccgctctctccggtggagagcacggcggcggcgcgatcacgagttgggctatttgggccgacgacgttctcagtggttttcacttggaaagaaatatgaaaaaatttccccaaaatggagaaatacgaatttacagtttcaaaaaaaaatctaaagtgaaacaaactaacaaagaaagtttaaccggtctaaagtgaaaacatgagttaaacggtgatcaaaagtgaaacatcagtaaaaaaaattatgatctaaaaaaaatatgatctaaagtgaaatttactttaaattttttccactcaattttcatgtaccaaaagttgatgaggcgagaaaagagagattataccggaaggaggtcataaaataaaggccactgttttttcttctttgctagaattagtctctttcctcatactatatgttgcattttcagatgaatttttggggaatcttgattagttatcaccatatctattttttttcaaaaattgtcatagccatttgaattattttctagaagcttttgcaagtgtttcttatgtgggccaactgatgggccatatgactatctgggctacgccaaatattattcgggctagaattctacatggggtttcctggattaatatttcatggatgacaatttaagcctgcatcacaattgacaaacaacaatatgcagatttccccaggatatttaactatttgctacttttaagatgtggcaactaagaatttgtcactcgcagtctataatatgtgagtccaataaaatatccttaattgtcacttgcaatagtggtaaatagttaaaatatccttaactgtcacttgcaatagtggtaaatagttaaatatctcgatttttttctctatctatatctatatggacctttcttaggttctatttaggggagcttctaactgctgtagcttcttcgagaatcagaagctcccccaaataatctatcttttgctacaaatcctaagaagctataggaaaataaattagaagccagaagctgggaaactcagcttttctaaatgttgactaccaattagctgcttctcggaattttaagctcctccaaacatgctattagttgacctctttctttcatatcctagttgaaggaatatgcggttttaatctaagcttcagtatactccctctaacttaaaatggagtaatctggtatgaaatatgatatattttaatactacgaatcctaatattattaggttgctatattttaagatgaaatgacgagggagtatctgctagcattaacatcatgatcagtagccagttatccacaacagagcgagataagatatccatgaaggaagctcctgctcatatgcatagcttttattagcacccacaccttaattaattgcacttaggcatatcatctcacaattttcactgcatataacacagtgaacacacacatgcatgcaagaacacagaagagacaacactggtagtattctctctgggataaaaagggcatgtcattgatgccatattgctgcaaatctagttcgattttgtgagagtatattcagatttagccctggcctttgcagcctcgagggagtgcttcctggacagctccaccaccttcttctccccggcgatgaagtaggccatgccagcagctgcatcattaaccaaatcaaccatgaattaatttcccagagctcttaattatcagttgctgatctttttcaagcactattatctgttgtagtaattagctagcatcaaacatttttaccgtaggtgatgatgactgtcttggcgactgggttgcccagattggcctttgcccacttggacatacgaacactggcaaactgcaagggatcatatcaaaagttgcattggttcagaataattcagatgttgttcgcatccatgataaatgtgcattgctctgacaagaacgagcacattgtgttttttgtcacaagagtagttaattatgatcctgctaattaaattaattaattaatctgcttgcactcacggtggggatcgcggtgcagacagcagtgacggccgctgctttcagcccggcaatggccgcctctgaagtcaaaacaaaaaccatccatatacaacatcaaacaacatcacattgttagaatctaacatgcaacgatcaaacatacaatcttagcaataataatcagatatcgtgttaatagctagctaagctaggcagcaggagaagaaatcaccatgggagctctgcttggccatggcgaacttctgctcgatgagctgggaagaatccgtagccttgttcgacatctcgatcaaaacacaccagatcgacacacactatcacactaaccaactagctaattcaagctaatgaatgcgagatcgatcgatggatggatgatttgtgtgtaaagcagccatcaaatcctccaatttataggcttttcagacagcagcagaagcaggaggaggaggagtgcaccacctgacgacacatttcgtcaggcaaagaaagaacagcgaacccccggttttgccatggcggccgcgacgaagccgcgggctcctggagcccggacacgccggtttcgcaggatcacgccggcggcggaggcgcaaaccacgtcctcgggcgccgggtgcaacaagaactcggtgtgtttgcttgctgaacttttggctgcgtgcagtggcgtttcttgcccttttggttgtgtgcacacttctgttgatctctttgagtgtgagaatgggatggattaatatccattactaatgagacatatttggaactgaattctttggataaagattttggaaatgatggctttgtaattttggattaacagcttttttctggtagctatttatgccggccaagaaacctacattgtcctgtgggcttaattaaggggttcacatatttatgtatagtaaggagaacaatgtgctactggtaagtataaacaaaaatgaaatgtggagatttttttttaatttacctcacacaatttaatcgcgccaatactgcacttgttatttgtccactcgtttaaaaggaaaatagcaccagccaggaggatttacatgctcaaaatgtacttagattacttgcttgcagaagcacaaatatctatatgtgtcatcaccagcctaattaattggtagcaaaattgtgacgaatctggaaaaaataattactagtgtcccatatggtgctaccaatagtccaatacatgtgtgacgaactaacgctacaagtatcaactagaaacattgagattgcaaattttgcatgctattcctgggta

SEQ ID NO: 55285 - DNA, 1318 bp, Oryza sativa
aaataatcccaatagcaattattactaggtgtggaagaaaatcaatattacagccagatttaggtaaaaaaaaagatgccaacattcataaatagtttatctctaagaaaaaaatttaagaaacatgatgaaagcaacatggtttgctgtcctactgattttatttttcaaacacgtgtgtctttcttttttgtttgaaaaatatagaagcaaaaataaagaatacatcagtatttttatatacaatttacatctatgaatgtctatgttgtaactacaaaataaaattgaactactttttattcaactagtgttaatacatgttagtagaaaaaataatgtagcaccacatcatacatgcgtattattttggctttacaaccgttgttcaatttacttatagtttatttataagtaccaaacaaactatcatgtaagttaaagcgaccaacaaaactattaacttgaagaaaaattaggtaatttaatttttaaacaacaaggctatatggatatcagctgcctaattatttttttctcttatattttttttctttgggacataggaaggttgggagagaaggttcatttactgttttattacaaattacaatttacaaggtgagttccaccctcatgacccgttagaacactgaaccggttacgttggcgccttttccgtcgcggcttgctgagcccaagctaaccagccataagtgggcctacaaccgattttttttattttaaattttatttattaaaatatttacagaaataattttcgatttaaaaattttacaaatagtcgcccatcgtcatctgggagggtccaaagggcattttttccgacgtggcagacggctgtttgctctgtcataacggccgccaccgagggcgctgaaattttgtaggcgatttttaggacatagcaaaggcgatttttggctctagggggccacctgcaaaagggctgggagggctgcctggtagccccctttagtcctctaggagtgctattttctactgtatgcgaggggtagcatttttataggcagccccctgcacagtaaaaaatacaagggtattaggatgtccagattcattatccagtactatattgaattttttttagtaaatttcataaaactacatatactttgcataatctatcacaaaactatatattcaatgtattcatttatcacaaaactacaggtattttgaatagtatatcacaaaactacagatgtaagaacttgtttcacaaaactataggtttaatatcttcatttatcacaaaactacagatttagtgtct

SEQ ID NO: 55286 - DNA, 1231 bp, Oryza sativa
cccaaaaatgcaggattcatgcctgttgcagctgtactatttcgatcagtttaattaagctggagtgattaacaatttcgtcagtattattgccatccaaattaacgcgacatccatggattggaaggtaaaccagtgttgttttgccaggggacatcagcaacctaccgtcccaggaattcagacttaacagttaattaattaaaccaaatttatatgcatgcatgcacgatcagacattgacctcttcctagctccatccgtgttttggatgatatgatccatccatgtttccatgcagtcttgtcagctaatcccggtccatcgatcgatctgtttcctgctccgagatcgatccttcgttgtttgcaggttttgctccttggaatctgcgtcactgctcgatcgtcagaggagagagatgcagctgatgagctactacagtaagtaggtcgtctgaattagtctgaaccattcgtgtgtttcttttcttttttttcttctctgtcagatcgatgaactggtcagcagtaagatccaatattcttgtagacgataccaatgcaaaacatagcctgcctcctcaaacagttcctggccagcagcgccgatcggcggtctgaatttatttgtcccaggagtaccttcacagctgcactttcagattttattaaattcactggtggtaatatatcccagtacatgctggaatatctgaaaaacaagtgcatatatatgctacgattcaaaggtttcacctgcatgcagtgctgtggatttaagatataaagaagtacaacatatgtacaaagtacaagaccgtcaaatctttctgatgaaattgaactgtttcatgtgaaattcctacatttcaaacaaatcaccacgattttaagccagtcgtttttcacttgttactaaactcttatgcatgcattcaaataattcaccgtggaacatgaacggttaggctcccttggattgtaaggaaaacatatgaaatttaaagcattttaattctataaaaaacatactacgaaaaccttaaaacaagaaatgttgaatcctaccatttccttaaaaatttctatggaatgaacattcccacgaagattttaaagaaaagttagcaagagcttaaaccacttggaaatttttttttaagtctatctcatttgaagatgtgttttttctctggcctagttaaacaatcattcccatataattttag

SEQ ID NO: 55287 - DNA, 977 bp, Oryza sativa
aagcaacaaaaaaatggccgtctgctttttcttggacggcattcttatatgtaccaattcaccaaatctgctggttggtggattaacagcttgataattggtatattgattgtactactaccactaattgattgaattatgagaaaagttaatgaaatcttttctaattcttcagcaacaagagtattatctggagccatgtccattttgatcaaccaatcaatcaatcatttgtactactatgctcccccttttctgctgcaatgcttgcaggtgacctaacattttgcgacttctttaatcgcaaggaaatcttgtaaacagcgacacctgatgaaagttggtgatgttgatccacactatttcatcatagtactatttattcagttcctttcttggatggaaaaagagaaaaatggttgttgatctttaataaaaataaagataatctgcagagacaggtgacaggttaaagtcatggtcatcagatctttataggagatgatgatgtgattagattataattaatcctctcagtgattagttttttttttctcctgggccaagttgttttcaaccgacaattgtatctttacgcgattcgcagagatcaaagttaattgaaagtttgcttccagcttttcagctatgctcacacacaacaacaacttgcaaaatcaatcaatggaagagggagagctaacctaactcatcatggcaaagagataagatatagatagatagctgcataaaacagcagcaaacttattttgcttattgactttcctgtctaatgaaaaagcaatctgctttgcaaatgagcctgagcccagtgcttcatcattatgtcctatactttgcgctgcagattgatatattaagggggtgtttgggaactagggactaaactttagtccctctcgcaaaagcataagtccctaccctagggacttatgtttttgagagaggggctaaag

SEQ ID NO: 55288 - DNA, 1953 bp, Oryza sativa
  unsure (1)..(1953): unsure at all n locations
tatatattggggtgcaaaaacagttgcttaataattataaaagcataattattttgtagtactagcagtaactacaaactaacgaacgagatgatataactgatctgatcatacattcatatnnnnnnnnnnnnnnnnnnnnnnnnnnaccactactgcatcattgcggctgcacatgctttccggtctgggctagctagggcttgcataatgattaatgtgcatttgtgctgtgcatatatgtctgtatgattaaacttgataactactaataattacacctgtagtgctcgtgcaaatgagaaaaaaaataattgctgaaactatactccttgtaaagtttgcataaacaaatcaagatgggcatgcagtactgtctgcctgatcatcatgggtgctctctctgaagtctgaaatattcctagatctagctgaatgaggcagatgaactcaaattaaattaataattaagatggatggatggatcatgggtcggacagccaggttagctgggttaatcaattagcatgcggctctccccccaatgatttgctcatgtcatgggtgtggtttgcaaatctgcagtaaggaagcagccagcgagcgagcgaggcgacggttgatggatgggtggatgctggagaggagaggagaggagactgcgcgcacgggggctacgcgacgaatccgccatgggaaatgattggttttgatcggtggcgcgcgcgcgagcatgtggctcggccgccggatcgccggacatgccaggtgcgcgcggtcgcgggagccagagggatcttctctctcatcttttcctccctctctctctctctgtgttttttttattactcctcttcttcttctttcctctctggcggcggcggcggcgtcttctccggcgccggcctggtcgcccacagatttagttgggattcaaatgggcccattttatttctgcagcccaacacgaacgggattgcggcccatataccatgttgggctcgagcgggattttcaccaacgtacagcccatatgtatttgggctggaacgggataggagacgaggggaagagaagataggagaggaagaattaaaataccttattaagggtctgtttggtacagcttcaactcctaaatataactccaggagttgaatctggagtggagttgtggagctgcctaaaccgagatccacaattctagtacattttgtgagagagctccacccaactccactcctagtttcggtggagcgtttggctgagctctagctctaggagaggtggagctggagctgtgccaaacagaccttaagatttgccacttacacgtaggcactatatgtttttttatttattttgtttttgctaactagtatgccacgtcaacaaaatcagccatccatattattatgggatctaatttaacccagttttgcaggttgtgggttaagatttttggtattgtggttgagatgtacaaattaaaatcgacgaaaacataacgaacgtaaagtggacttattcgaacgggattaccagctacgtgtggcccgtataatttgggccgggaagggtttggcccacttatgcgtggcccattctagttgggtcgatatattgctcaaggcccatttaccccttcgtttccgttacggcttctcgtctcctctccccttttcacgccatggccgagcgatctcccggccgccggaatggacgcggcggcggcggcagctgcggcgggaggaggtggtaacgccgccgcgcggagcagccccgccgcgaaatcctccaccatctcctcttcccgcagcgctaatcttcttctcccctttcacgtcgttaccgaggcaccgagcgatcgacccggccgaaatggcggcgggaggaggaggtggtggtagcgccgccgcgcggccagcactcggtgagtgaccaaccaacccg

SEQ ID NO: 55289 - DNA, 7900 bp, Oryza sativa
  unsure (1)..(7900): unsure at all n locations
ccttcccccccccccccccccgccccctacccctcttcccccgttacccgcgcttctcgtgcagtcgtgcgctcgatgtggttcctgtttcgcttcactgtgctcgcatagtcgcatcgaagcggacgcctggctgcgcgcgtgcgcgatttggatcaacgcggaaaggtatatcgaatgagagaagctgaaaaagcgagaaatgacctggttattgttactgcagattgcgtctggtttcctgtgaaattttcttcccgcaaaacgtcagggtttaacttggtaaaactgggaatagaggaaagctccctgtgctgactttgaaactatcgtctttaacttgaagcctcttttaagttgaagccgccgtttagattgagactaactatatttatggcgtcacaatttcttttaccaaaaaagagactgcaaatgaacatatatttacattgtgtagtaattttgttgtaacttataaaaattacactgtcaatttcagtactgacattgtaattgtaaattttcgagtacacaccatataagagaaagagggaatatcgattgattacctacctgataaaggagatgtaagagatagaaaacatatttacatataagaaaaaaaaatgtagcaatcacatagggaaaaaaatgactgaaatcgaatcgaaactgtggcgctatttctttttagcaaaaatgctttaacttacatctttttatgcatataaggtagggcgactttaacttacctttgctccagggaaactaaagcttgctctagttggaagctaacttgagctgaattagccaattagccatcagaggaatgatgcaagggataatgcttgcagcgttgcttgttctttgccagttgatcaaaaatgcaggcaagatcactgatgctgcgtgcatctccagtgagagggacgctctgcttgctttcaaagccggtttcgctgatcctgctggaggggcgctgcgtttctggcaaggccaagactgctgcgcatggagcggggtgtcctgcagcaaaaagatcggcagtgttgtcagcctggatatcggccattatgatctcactttcagaggtgaaatcaactcatctctggctgttctgacacatctagtgtaccttaacctgagtggaaatgatttcggtggggtggccatcccagatttcataggctccttcgagaagctgaggtatcttgatctttcgcatgctggttttggagggacagttcctcctcggcttggtaatttgtcaatgctcagccaccttgatttgagctcaccaagtcatacagttactgtcaaaagcttcaactgggtgtctcgcctcacttcactggtctatctagaccttagttggttgtatcttgctgcttcctctgattggttgcaggctacaaatacgcttcctttgcttaaagtcctctgcttgaatcatgcgtttcttcctgccacagacttgaatgctctttctcataccaacttcacagccattagggtacttgatctgaagagtaacaacttcagttcacgaatgccagattggatttcaaagctaagttctcttgcatatttggacttgtctagctgtgagctttcaggctcacttcccaggaaccttgggaacttgacatccctcagtttttttcaattacgagcgaacaaccttgaaggtgaaatacctggatccatgagtaggttgtgcaacctacgccacattgatttatctggaaaccatttctcaggagatattacaagacttgctaataccttgttcccctgcatgaaccagttgaagattcttgaccttgcactcaataatctaaccgggagtctgtctggttgggtcaggcacatagcaagtgtaactactcttgatcttagtgagaactcattatccggacgagtatcagatgatattggcaagttatcaaacttaacctacttagatctttcagccaattcatttcaaggcacactgtccgaactccactttgctaatctgtccaggctggatatgctaattttagagtccatttatgtgaagattgtcactgaagcagactgggtgccaccattccaactccgagtcctagtactttatggatgtcaggtaggaccacacttcccagcatggctgaagtcacaagccaaaattgaaatgatcgagttaagcagagcacagatcaagagcaagttacctgattggctctggaacttctcatcaacaattagtgccttggatgtctcaggaaatatgattaatggaaagttgcccaaaagtttaaagcacatgaaagcgctggagttacttgacatgagttcgaaccaactggagggatgcattcctgatctgccatctagtgtgaaagtattggatctgtcaagtaaccacttatatggaccattgccacaaagactgggtgccaaagaaatatattatctatcactcaaagacaacttcctcagtggaagcatccctacgtacctatgtgagatggtttggatggaacaggttcttctatcactaaacaacttctcaggtgtactcccaaattgctggaggaaaggttcagcgctgagagttatagatttctcaaacaataacattcacggagaaatatcttcaaccatgggtcatctaacttcccttggatcattgttactccacaggaacaagttatctggtccactccccacctcactgaagctatgcaacagattaatctttcttgatctttcagaaaataatttgtccggaaccataccaacctggataggtgacagcctgcagtctctgattctcctcagtttaaggtccaacaacttttctggtaaaattcccgagctactatctcagcttcacgctcttcaaattttagatattgctgataacaatctatcaggccctgtacccaaatccttgggaaatttagcagccatgcagttaggcaggcacatgatacaacagcaatttagcaccatttcggacatccatttcatggtttatggtgcaggtggtgcagtcttgtatcggttgtatgcatacttatacttgaatagtctacttgctggcaagcttcaatataatggaactgccttctatattgatctctctggtaaccaattagcaggggagattcctattgaaattggatttctatctggactaacgggtttaaatttgtcaggaaatcacataagagggagcattccagaggagttgggaaacttaagaagtttagaggtgcttgatctctccaggaatgatctgtcaggcccaattccacagtgcttcctgtcattgtctggtttgagccatctgaatttatcatacaatgacctttcaggagctataccatttggaaatgaacttgcaacttttgcagaaagcacatactttggtaatgcacatacaactgtcaagaagctgtttgtaccacaaaaggaagcatcaactaaactttgacacgggaacatacttaagtgcactgcttgggtttgcatttggattctgtattatgttcgtcatcctgataccctacatggttgcatgaaagactcttatgatagcctatgctttggattggctattatgatatatgaagattttgttttatagttagttgagcattgtaatgattttatccgaacatatttgacaggtgggttaagcggtgtaatgcactaaggcttagctcttttcaaattattactccatccgtttcaaaatgtatggcaccattgacttgtcgcataacgtttgaccatttatcttattatcaaaaatatataaatattatttattttgttgtgacttattttatcatcaaataaaatcgactataattttacatatttatactatatcttttaataagacgaatggtcaaacattgtggaaaagtcaacggcattatactttttgaaaaggaggtagtattatttctcagattatcgaaacagattatttgctctatatttcgaagaataatttaaaaacagattagtttttttcaaggatctgtttaataggggtttcaaatccagtcgataggtttattcagaaaacaagcaattcaagaaccaacttcaaatggaacaggtttaaaaggagtgctcaggacactaaaaagcttctatctttgacttggaagacagctcactaatactaccttgacacatgtgatttttttgacaaatgtttgactatttgttttatttatttttttaaaatataaaatatttccattcaacgataaatcaagtcacaataaaataaatgataattacataaactttttaaataaaataaattgtcaaacatatcctaaaaggaacagcatcgtatattaaaaaccggagggagtaagagttaggcgtcgatagagcattaattcggtcgtttcagggcttctatagccggcccggtgacgacatcctctggatacactcgcaaggcccactagctagcgagcccccttcgttcctctgatcctctccgcttcacgccgtgctcgagccgagcgatcgatcgatccacccgcaccgtgcacccggccggaatggaggtggcggcggcgggaggtggtgnnnnccgccgctcccgccgccgcgcggagcagcccccgccgccgtgcaggccaaccaacgacgacgacgccgcggccagcaagctgtgagtgacctaccgaccgacccacccccttcccttacctctccattccgcgcacggctcctctgttgttgcgcggatgctgcgctctctctctctctctctctctctctctctctctctctctaccactgcggcgtggttggtggtttcgaatcaattcggttcggggcgtgctgtttgttccgcgctgtgttgcggtagagaggcaaaagcgagatgtactttgatattgatgatgtaatggcaaggggcgtgtggttttaaccctaagattttgtgttcaatccgctcacaatttcttcttaaaaatatgtttggagggatgtatttcctccaaatctccttttattattatttttggacctaggcaaaagcaagagaagcctgtaaacctggtgctgaatcgtgatgctaaaaaaatgtcataacaagcaggagagatggtttgaacagtttccattgatgctcccgagttgcacacaccacttaggtgcctctttccggcgagggttcatgcaataaataattgtaatgataaattggtgacaagggagctattcctatttcaccaatttgtattgaaagacgtccttttattgcgcggcatagttggccggccacttacatatatatagttgtatgtgttcttaatttttccctgtttgtttggagcggattgatgctttagatagcggttagccgatattgagtggcattggcaccctcaacttctagtgcttatgtgggctagtagcgttcgtaacttcgtataaagagacgatctaccttgaactcttcagcatgcatttatgagactgtataggccaatatcttgaacaatgaacaaataaatgtatagacagtgcaaaaaacatgcatgcaagatgtgggggtattgcttatacacttatgtcattgtaggttgcatagtagaaatcacccatttccctttgcaggtcatgtgttaataaaggatacatgaaggatgattatgtgcattgttaggcaaataacaaaaggggctccaataataaattgaggtatgtagtacctcattgaatcttttatctgcttctctacaattggaaattctaatttgttttcctttccaaataactctgtgaactatgcacgttgatctgttcttgggaaccttctgcgtcagttcctcagtgctggaaatgtcaggatggtcaaaagaggaaacagaaacttggtgctgctttgatacgacattcttccagttgcagaaaaagacagagcccacgcacgacgtggatatagggacagcttgacttcatgagtagactttgattgcctgagtctttaggttggggttcaaggtctggaagagaattacacatgactttaaccccgtctttggctcttctcttcttatatctactctggccttcatggaaacttgactaatcaataccctagcaacttctgtgataactaatcagaagctaacttgacagtgctagtcacaggctctactggatgtccgtgatgagaggaaggatgcaaggggtgtggcttgcagcattaatctccctcctttgccactctatcgcaaacgcagggaaggaagccgctgctgctgtgtgcatcaccagcgagagggatgctctgcttgccttcaaagcaggcctttgtgctgactccgctggtgagctgccttcctggcaaggccacgactgctgctcatggggtagcgtgtcctgcaacaagaggactggccatgtcatcggccttgacatcggccagtatgctcttagcttcacaggtgaaatcaactcatctttggctgctttgactcatctacggtaccttaacctgagtggaaacgacttcggtggtgtggccatcccagacttcataggctccttcagcaagttgaggcatcttgatctctcccatgctggttttgccgggttggttcctcctcaacttggcaatctgtcaatgctcagccaccttgctttgaactcctctacgatcagaatggataatttccattgggtttctcgcctccgtgccctcaggtacttggacctcggcaggttgtatcttgttgcatgttcagattggttgcaggcaatcagtagtctccctttgcttcaagtgcttcgcttgaatgatgcatttctccctgccaccagtttgaattcagtttcttatgtcaatttcacggccctcacagtgcttgatcttagtaacaatgagctgaattctactttaccaaggtggatctggagcctgcattctctttcttacttggacttgtctagttgtcagctttctggatcggttcctgataacatagggaacttgtcctccctgagttttcttcagttgctggataaccacctggaaggagagataccgcaacacatgagtagattgtgcagcctgaatatcatcgacatgtctagaaataatttatcagggaatattacagcagaaaagaatctgttttcctgcatgaaggagctgcaagttctcaaagttggcttcaataatctaactggaaatctatctggttggcttgagcacttgacaggtttaactactcttgatctcagcaagaactctttcactggacaaataccagaagatattggcaagttatcacaattgatttacctggatctttcatacaatgcatttgggggtagactgtctgaagtccatcttggcaatctatctaggttggatttcctgagtttagcatcaaataaactgaaaatagtaattgaacccaactggatgccaacttttcaactcacaggtctaggactacatggttgccatgtaggaccccacatccctgcctggctgcgatcacaaaccaaaattaagatgattgatctaggaagcacaaaaatcacaggtacattacctgattggctctggaacttctcttcatcaatcactaccttggatatctcaagtaacagcatcactggccacttgccaacaagcttggtgcatatgaaaatgttgagtactttcaatatgagatcaaatgtacttgaaggaggcattcctggtttaccagctagtgttaaagtgctggatctatccaaaaacttcttgtctggatccttaccacaaagcttaggagccaagtacgcttattacatcaagctctcagataatcaactgaatggaactatcccagcatatctttgcgagatggat

SEQ ID NO: 55290 - DNA, 1172 bp, Oryza sativa
cttgcatcgccgagagagcaagaagccgtgtatgattttataggcgtacgaggagaggagtggatgagatgaacctggtggcgcacggccacggttttgggcagaaacccacgagacgggtaggttcaatggacctcttcttccggagttttgggtgtgtttaattcataccaaaatttaaagtttggttgaaattggaacgatgtgatgaaaaagttaaaagtttatgtttaagaaagttttgatgtgatagaaaaagtaaaagtttgaagaaaaatttttgaatctaaactcgacctttacttcttttggaagttggtggccaacctgcgcccgcttcacactccactcattcagatggtagcactggagtacgcttttacgggaccaacgggtttgagagcctgaaactgtggtgccacccactgacccatatgccatgtcctgtttggctaatgggatatgaaaatgatctccaacccaccaaaagacatctttaaattctaatcattcattcttcctctctcatttaatcttaatctttcatttatttctcaatcataatcccatccctcatttcccattatccaaacacacccacacaggatttggggattcgatttaactgaatattttggttggttccttttctacccaaatcccatcttctttatcaggatgggagatctggttaggtagaataagtctatttaactgatcatccactataatgtactgaaagaaaaatgctactagttagtactaaatttttcgttgttacgtagcaacagtattatgagagggatgaataactaatactcggtcatatggttgccggcagtagtaactaattcttttctcgtaggaagaagacacggtagttgaggattggtgagtaattttttagtggccccacgttataccctactctttctatttcatattataaatcgtttgatttttcttttacttaaactttattatgtttattatgtttgattaagtttataggaaaggaaaaagtatgaattacccgataccatcgatgcccgcatgactacttgcaaaaaaaaccttacctgctacttcctccgtttcaaaatataagtcattctagcattttccatattcatattgatgttaatgaatctagacatatatatctatttaga

SEQ ID NO: 55291 - DNA, 1172 bp, Oryza sativa
ttgacaaatttatattcttaaaactattatttttgtaatggctaaaatataatgaatttgactttaaaactttacatgtaggtataatactattaaaagtatatgcattatttttttcttgagtctttttatgatattaattagttggtgtgtatagagtgtgcacgtagaacttgtatacatagggtatatatgctgccgctttggatttagctatagtttggaacaaactttgaacaatagaggtaattaactacattctagaatatactaggaagtatacatatgtatgcattgattggtggatccatatatgtccacaaaaagtgcaataattcgttcagtcgtttaatgtgtgcgcattccaccaatcattcgattcatcgatcgatcgatcggcccagagagaatgagacccaatgtaatgggtgtgtacatgcattcaagcttcgatcccgtacgttaatgcgcttcgatcgatcgatcattcattgttggcaacggaaagctaacaaacgccgagctggccgtcacgctgcatgccggccaccgttttgtaccatacgcttcttgtactatcatctacctatatacgtagctaattaacttcttatattgcacacacattttcactctccaattagtttatagggagtactatatatagtactagtacgtacgtgctgcaaataattttatgtgcattgcaacatgcaagtaaattattaactgcaaataataattaacagaagtagtagacgagaattgaagcgtacatgtatatgtgtagtacatatggtggcgtctgacttaggtagctttcaacttccaccatcatttgagaccaataattccctgactagctatccaattctcatcatcatcgatcgatcaacatttcaacaacaattaatctcaccaatcgatctccagctaatcccttgtaccactaactatacatgcattattaccggccaagttcttgtgccaattacacaatgcagctatgattatataagcaataatatattgtcagtaataatcaagcaaccgtccaagcaagttgcatgcgcaacgactgaagaacaaggcatgattagttggaggggatctgggatccaatgacgaaattaatcataagctaagttgagagaagctacagcaatgtatgc

SEQ ID NO: 55292 - DNA, 7226 bp, Oryza sativa
ttttttctgctgtatatcaggtaatgtgaagtaagaaaggactgacgcgaccaaagatcgtgagacgtgacgagctggccgaggatgaataaagtgactgctgtcagttgtcacattcacaggctgcgatccagaaactatggatgggactatgtagtaacgtgctgatatattattgctaagtgttactactgcatggttgcaagggtggtagaagtaccttagcttccaagatcgttgtaatgtgtgagtttaattttggcgttttaagtaataagtctagtgattgcaggattgtacggggtaatgtacttgcattatccattataatcttaagcatccaatataattatgcaataattcgtgccttactgctcttagctacagctggttgggtttgaaggctttatttgttattcttacatagtgtatgttactcatgtcattatttagagtctgctatatactgcttatgcattattattatctgttgttgaacgtttgcaaagttttagcgggcatgtttctttgttaaagaaaggtgcacgaactaattcattcagtaaggactcctttgaaaattaagcaagaagtttacagtatttgacagaatttagttcaacttctaaaaaaaatccttcagaattcctccattgtaaatgagctgtataagatcatagcttgcataagaacaaaaatgcatatatgtatatgtccatagtgaggtgtttgtggtgacgacgtcaatttcaagatataccacttcggtcttctagaggtaggatatatgtgtattcgtagttggtaaatgcacgtgtatgtacataagcttcggagcttatgttgtactagtagtcgctttaactttttttcttgtaacgtttgaccattcgtcttatttgaaaaattagtgcaaatatgaaaacagagaagtcatacttaaagtacttttgataataaagcaaatcacaaacaaaataaataataatttcataattttttgaataagatgaaaaatcaaaagttaaaaaaaaactcaaagcgacgaatatcctgggacataagtagtattttgaaaacaaacataaatgtgtagtggtagctctacaagataagagggcacgtagatgtagctagggaccaaagtggtgatctacactagcccacagtgggccactaatcgagtgtggagagaatgtattctcagctcaggtgtttatctccaaggctcgatgttttagaagattctcctattgtcctattgcctatatttgtcatataaaattgaatctttatatatatgtacttctacagtacatataaagatgcttctacagtatcacaactttattatcatatcctcgatggagataaaaggttcaaagtcaggtcgtagaatacatttgtaaatgtagatgaacttgttaggtttcttacagtgaaacatacctactcaaattaagtctatacttgatatggatgctcacttttacggctaataattttaggcaatatgtatatatcgataatgaaacgcatatggtaatttcgtatatcaaatatgccgaccaatattttggaggtgttacaggggtaagtatgtgcgtttgcatgtatttatacgggtaagcatgcacgcatattaatgaatgcttgcatttgtaacatgtttcgaaaaaaaaatcatgccataatttttttttaaaaaaataagtataaaaagaacatttgcttatgtactatgttgttatatttcggcaacaacgataattagaccataggaatgagccaactaaaagatgacctcatacaagtgcaacactaaacacatgggcccacatgtcagtctgccgctttgtcctaccaatccaagcttcaagccctacctacccctaccttgtcgggaagttgtaactacccactcgcgccggtcatcgtcattgtcgccatgtccttccatctacaagcccacgtcttcatggcgaaccctctccatggcctttccacttctaccgccgtggatgaaactttgattgtcgtataggctgagctcttatctctactttcctaactcacctccatcgtttccgcacgcacgtttttcaaaccgttaacgatacgttttttgcaaaaaaaataaaaaaaattctatatgatagtttctttaaaaacatattaatctatctttcaaatttattttagctaatacttaattaatcatacgctaaacgctacttcgttttgcgtgccagctcccgaacacaatagtaaattttatataaaaagataaaagtaaaaaaaaaaaaagctgatgcgcactaccctgtgctatttcatgatgggctgaaacttttaggcaactacgagaattgggccggcccgaccaatagatggcctcctgcaactgcaacactgaacacgagggcccacatgtcagtgacacaacctccctacgctttctcctaccaatccaaccacctactacccccaccttgccgggaagctgcaactgcacactcgccgccgccgccatgtccatccacctccgcgcccacgccttcgcggcgagccctctgcgcggcctctccgcctccaccgccgccgtctccccgtcggccgcggccgacgccctccgctccctcctcgacgcgggggccggggcagccgacgccgcgcacccgcacccgcacccgcacctctccaagatcctccccttccgccgcggccgccccctcgcgcgctcctacgactctcctcctccccccgctgccgcggccgcggcgccgccgcctcctcccgcctggcgcctcgcgtggctcccgcccgcgcgcgtccccgacgtgccctcggacgccttcgtgttcctgggcgcgcacggcgaggaggaggggaaggaggccgcggcgtactgggccgtcgatgtgagcgagcgcgacggggagggcgccggggatgggtcggcgtttgtggatttgaggacgctcatggtggccacggactggagggacaaggacgccatgggagacctcgccatcgcgggccacgtgcgtggcgattattttgttgttatcagagacattcgaattactacattttttgtggttgattggatttctgattcgagcaggctcgggcgctgctagaatggcatagcacagcaaaattctgcggagcttgtggatcaagggctgttcctgctgaagccggaagacggaagcagtgcagcaatgaatcctgcaagaagaggatataccctcgagttgatcccgtatgatttgtgctcaattcctgacctatcttgcagttggagatggcacctgttgaatttgacgttttgttatccctatttggtgtattgcaggttgtgattatgttggtcatagataaggaaaacgatcgtgcgctcttaagccgccagtcgagatttgtgcctcgaatgtggagctgtcttgctggttttatagaggtgcaaattagctcttagttttcatgatttcttatgtttaatgttcagatcttttcttcataataatatgtgcttagttccattcctttcacttgtaattttcttatgctggttttggtttggatgaaacagaaggatgctatagataacttggttgtattacacccattgttactgcatactgcacaatcctggttagatcttatttgtgagttggtgggatggttagatcttatttgttagttggtgggaggaccggaggagtgtatgtacacacccaccacacaagtttggatcctctagggctaacttggattcatcttcccccgtgggtatcctcattttatttatttttttaaaaaaagagttaccatatcctcattagccatgcttgtaatttgtaggagattatttagagcacttcactatcctaactatgatgaattcattccaaatactgaaaagtaacttgttttcttgtttaagttttgtcctatgcttatgctaacttcaactttctgtggtactagcaagttcatttcattatcatcttgccgtgcactgaaagaagcttacacatgctgcaactgttctttttgtagccaggagaaagcttggaagaggcagtgagaagggaaacgtgggaagagactggtattcaagttggggaagtcatttatcacagttctcaaccgtggcctggtaatgaattgttcttaccatatatctttcgaatgaaaaacacaggaaaggataacactagaagataagaaatatgttttaacctttctaattatcgtatcaaaatacagaagtacttataatgaaagatactaggcaagaactatatcaaattaaagtaataagaagaaataggtagaggacttgggcggtggtggtggtgtacatgcataccaagagacatgtattagggctccctttggcattagagtgtattctcaaaacaaaattatttgtgctttgggatatattatgagctgttatcgtctttttcttgagttgtagagaaaagtcttaatagaatcagtgacaatctccctaacccactctgatagtatccatgttgcttccgatgcttttttcagttgggccgagtactatgccatgccaactgatggtgggattctttgcttacgctaaatcattggagatacatgttgacaagaaagagcttgaaggtttgtcagtatgaaatgttattttttttcctactcttttttgcaactgattggcctggtccatccatataatcctacgtttcagtcggtcttctgttatttttcttatgcaatcttacaagaatatttagatactaactgagtaaaacttatctaattgttaaattggtgatctgtaatacatcgaagatacttttctacaatgaacttcataatagttctgcgcagaccttttagttctcatctctcgaatgccattcttttaccaatgtagatgcccaatggcacagccgtgaggatgtcaagaaagcactaacatttgcagaatacgagaaagctcagagaacaaatgcgctcaaggtcaatcaaatatgcaagggtgttgagaaaaggcagagcatctctgctgacctcaaaatcgaaagtgaggagcctgctccaatgttcgttcctgggccctatgcgattgctcaccacctcatatcatcatgggcttttgaaggagcaccaaaggcacctagctccttctccaacctatgagccttgatcctgttattcattttcactaaacaacacaacaacaggagatagggaataaaaaattttagtcccatgtatcatgtatgccttagtttcttgttagtgtagatgtgaaatgtgtccattgccggttgtaataaaaggttaagaaaagtacatcacgttcactggaggatttggggggagtacagattacagagcaagtgtaatattttagcatacaatttgtaacagtgtatagatgcagcacagatgtgctgatgtttgtatcttccatattcaaagagctggcatcaagtgtgaaattttgccaggtttgttacaagttgaggacaatcttttacatgttgactggtatagttctgcttggagaaaactggaatattcaagttaattttccacatgagtacatctgtttgtcatgcaagtgaatcaagaattcttgtgcaggggttgatttttcagtgtataggggtatgaaatgaatgtagagagtgatgtgcctggacttttgttgctaatcataattgaagcttctccttgaaacaagcaaccacatgacatctttgactaatctgttgcacaaaaacaataattaacccgcatcaatcttcaactggtcaacataaaatctactgttggacagcaacaccgcagcaccttgtactaattttttttatgctttcatccaactactgacaaagaattctcgtcagtttttcaagttcagaacaaaggcaggaactctgattaggtgtagcctcatatacagtactaatatatgctaggagcacttaattaattgctgttcctctctaggtagtacttaattaattaggagtactaattttgcactttgtgacacgttttatgttgattcacagtgacttgattcaagcacaagagaggtggtcacagcaacatgtgcaaaattgtcattagacgaaacgtatcaagctctaattgcagccgaagaagcaagaagcaaaccatccaatcagctgcacagctagtcaacacaagctagtcaaaccgttgactaccactgtctttgttgcgcgccagatttttccacggtgcacagccgcaacgagatggagacatggatagagtaataagcagcagtagcaatgcaacgcaatgcaacacttgaatcacttgcagcttggaactgatctgatcagccatggcggtcggcgtcgtcgccggcgtcgagagccaggagcgccgcggcggcggcgccggaaccggaagggtcaccgcgttcgtcgtgctgtcgtgcgtcaccgccggcatgggcggcgtcatcttcggctacgacatcgggatcgcaggtacagtgtaacacaatgtagcatgagacatcgagagaagtgaagcttcgttaatggcggcggcggcggcggtgcaggtggcgtgtcgtcgatggagccgttcttgaggaagttcttcccggaggtgcaccggcggatggagggcgacgtgcgggtcagcaactactgcaagttcgacagccagctgctcacggcgttcacctcctcgctctacgtcgccgggctcctcaccacgttcgccgcgtcgcgggtcacggcggggagggggcgccgcccgtccatgctcctcggcggcgccgccttcctcgccggcgcggccgtcggcggcgcgtcggtggacatctacatggtcatcctcggccgcgtcctcctcggcgtcggcctcggcttcgccaaccaggccgtgccgctctacctgtcggagatggcgccgtcgcggtggcgcggcgcgttcagcaacggcttccagctcagcgtcggcgtcggcgcgctcgccgccaacgtgatcaactacggcacggagaagatcaggggcgggtggggatggcgcgtctcgctggcgctcgccgccgtccccgccgggctcctcaccctcggcgcgctcttcctcccggagacgcccaacagcctcatccagcagggcaaggtcgaacgctgcgacgtcgagcagctgctcaagaagatccg

SEQ ID NO: 55293 - DNA, 5848 bp, Oryza sativa
ttcggccgccgcacgctgttcctcgccggcggcgcccagatgctcgcatcgcaggtgctgatcggcggcatcatggcggcgaagctgggcgacgacggcggcgtgagcagggcgtgggcggcggcgctgatcctcctgatcgcggcgtacgtcgccggattcgggtggtcgtgggggccgctgggctggctcgtccccagcgaggtgttcccgctggaggtgaggtcggcggggcagagcgtgacggtggcgacgagcttcgtgttcaccgtgttcgtggcgcaggcgttcctcgccatgctctgccgcatgagggccgggatcttcttcttcttcgccgcgtggctcgccgccatgaccgcgttcgtgtacctcctcctgccggagaccaagggggtgcccatcgaggaggtcgccggcgtgtggcggggccactggttctggtccagggtcgtcggcggcgacggcgaggaggaggagcgcaataatggcgggaagctttgactgaaacaacgcgcgcgcgcaatatccaaagtgcgttgcacgaatcttgacgcgcatctccccccctccgtttctatgctaccttgttcagaaaacagaacacacctacagattcagagttttcagacacatcaaggcttaagaacatactccctccggtttgagattaattgatgggttactccttcatgtttgagtttaattgatgttttagctttctccactactctctcccttctatttctccagaatacccctcatgcatgcatgcaaacagaaaaaagtaacggctgcttggagtattaatgaggggtataacaggaaatatggatctaattaatactgtcattgatatttgccatgatgtccaaaacgtcacttaatctcaaaccggagggagtagttaatgttgtacttcctccgtacgaaaatataaaaaaaattatatatacacattatcaaaagctagtgttatctacccctcctccgtcaaaaaaaaaaaatcaaaccctaggtttaaaacctagggtttgatttttttttctttttttttccagagtagtagatatatgaccagaagagatggagttagtatgctactacaagattaagcgttttcagataaatcaagattcggagctttcaacacatcaaggccccgttgttttatgattaagatacatattttatctcggttgtttgttggcatgtttttgctaaaccatgtgtttgcgaaaattttttatatagaaattatcttaaaatatcaaataaatatatgtttttaagtttgtaacaaattaaaacttaattaatcatgtgttaatattttttttgtgcgtgcttatacttaatcttttctctgtatctatctcgaacgggtccaagattcagagctttttttttttttttgaatccgggtgtgtttagttcataccaaaattggaagtttggttgaaattgaaacgatgtgacggaaaaaattggaagtttgtgtgtatagaaaagttttgatgtgatggaaaagttgaaagtttaaagaaaaactttagatctaaactcggcctgtgtggtgcgctctgaactaggaatgttttctaggtcagaacatgtactaccttcagattccaggtgtagcttatagagtaccaacagagtgtccctatgcttaatttcagtgtagaaaacatgcagttgctgtaacctgtactctgaaaccaatcgttttgatttcaggccttaaaactcatgtgcaaaaactgttggaaaatcacatcaacaacagttatcaaggtacatgaacaatcatgcatgaggcaccataaatgtactagctagtatcacacatggctagatctgacgagattagtaacaaacagtttgcaaggttcagaataattactgtacgagacatcatgatcatctcctctgcccagcaggtcagcatctaccactaattgggggcaagataaaaaaaagtcagtgtagatgtgcaagaacgcttctttctcctccttgatcggaattacgggcagaattattagaacaggttaaggagaatagactgaacagggagcagcagtacaagtgcagtgagggacagtatttggaccggtttgtgctgcattgtcttagtgttatggagcctgaattattggggcttgtgtgattgatacctctcgcacctgtccatgttgccttgtagatatacacacatcactccatgcatctactctctagtaattatccatgtgctcgtctggttggattggaacaagcaacaactaggtatatacacttgtctctgagtgatcttatatgagaaaaataattcatacaaaattcccgcatttcaaataaaatttatcaaattccttcataattacctcgcttcaaaggacgcaaatatagtgattttataatacttaaaaagtaccgtacttttgattaatttagcataaattttaatacctctcaaataccgtaaaatttctcaggtaaatatcacttattggacaacatgtcggccactcatctagtcatcttagagtttagctcacgttgggacgttaacctaatagcagcactccaggtgtcgtggagcctacaagaacgtcgtcgtcggtgaagatagacaaaccatggtagaaagcaaactttcatgaaaaagcgaccaaattaggcgtatccaatccaatcctccaagcgaagcaaaaacacacgtcacaagaagctcacagcaacaactaatggctccatatatataaattaaatctatcctatttggtgagtggtatttattatctgaaagaatctggtgagttttcatatggatgcctacgtggagacatgttgtgtggccaactggggtccaacctgccaatcatgcattgggccagccatcaggctacttgttagtcgatcgatcgatcgccacgacaattcatatatatcttatttacaaggagagagagaggaggaatcaatcgataattcgagacatatagtgatcaatcatgcatcttctggttgttggaagctagcaaaactgaaggttcttgttgctgttgctgttcatcattatcatagccaataagaaagcaagaatccaagaggagacaggatcggaggaggaggaagaaagcgagaaaccaatcgatcgatcgatcatgctgatcttggaggtgggcatctggttgctgccgttcacgctgctggtggcgccggtgaggaggatggtgaggctggtgcaggagctgcagcggatcatgctcgtcgtcgcctgcgaccggagccgccgcggcggccggccgccgacgttcggcgaggtcttgagccgcctcgaccgcctcgactccgccaccgtcatcgtctgaacgatgatcgattgatcagcatcctgtaagctgtaattaagttgcttcaattcctctgccatcttcttcttcagttcttcttgatgtaaatttctgaatccgaattaagtgcgttttagttcttcaagaaaggatgctctcttctgaatcttttgctctgtgatcttcagtttttggtacatgcaagcacttgcatgtatctgtaattatgtatgtacggtttttgtatatatggggctgaaattaagttttatccagctccctgcataagattattgatgaacaccagtctaaaaaaaagagtattgatgaacaagtattcataggatgaatgaagaagtgttctctgttgtatagagagaaaaggttcctttgttcttcagtttatgctgatgattcataattaatttggagctcatttctttctctgaatgatttggagatcctgattatgtgaatggtttctttctgaattttcctgaagagattgcaggattgctagcatctaggtagatgattccaggtcaaacaatgtgtttcttttgctttctgtccaacattcttttttaggatagttccagttttttgtttccttctcaaccaataaagctgctgcataatcttattgaagctgtcagaatctgtaacgtcaaatttgtatattcacatgtatgtcaggactacttaaaaaaggctgaaggggtgagatgtacatattagctagtaaaaaaaaatcaagttcagagaacatacatcattacctggggcttataatttctttaattttctatctgccattattgtgcccttctagaaatgtagggcaggttggtgtagaataaaatgcaactgcacatggctacgaatttctctcaggaaaaataattttctgagggagactagggaacggtaataccgttggaatggtacagatgatactatgtatcatgcctgatatctaggtatcatacctataccgttccaacggaataccgttctctctatttgatttactctaattatatatcacatcattatgtcttttggaaactcaaagagctggtgccacaatttagtgagtcatcataataatatacagcacgtattgctaatcattaactcttccaagcttatgttgtgagcaaaaataatttgtgagaccacaggtttattgatggtctctatacacgttcgctctcatgatttagaaattttcacgttaatcaggaaaaaaaataaaaattctaagccattgattataatgtggatctaaactataacggtgtagtttaaaccaaagaatccaagtcaaaatacaatttaaaatatttgaaggtcggaataaaaacataggaatcaaaaagagtccttttataaatacaatataaagtttggattaaaataaataatattgagataatagtccatttatttagaaatatatgaaattcatagtaaaaataaataatattgagaaaagagccaatatagaaatacgaatgcaattgtacatcacaatgaaattatcaagaggaatgaaaagtatcaaagtgaaaaagaggaattattttctcatttttctcattccaatgtccaaacgagccaaactaccaaagcaatatgcaattctttaaggaaagtaccaattgtgtttccttcccagaaaaaaaaaagacctaaccagctaatctcaaagatgcagacagaatcatgtaataacaaaatgtgtccaccagcaggttatcaggactaataaagtactactaatacattcacttttgctaaaacgaaaacaagttgagagctagagcatgaatcatatgcacgaaaccacatatatatttcctttgtcaaattatatgtcgcattattgtgctttttagaaatttgcagaatgcagagttggtgtatggaatcaaatgttgctttccagtttagttggacacataataatagtacattattgtgccttttagaaatttgcagaatgcatagttggtgcgtggaatgaatcaaatgctctacttccagttcagtttttccttcaaaaaaaaaacttccagttcagttggacacaataatacaatcacactgtgcatattgccaacgcttaactcttccgagtttatgtatgccgtgaacaaaatttgcaactgaaaccatgatcgtcggtgtaatgtggcaggaacggccgataatggtccggagggagaaaaaatgatgagtcaattttagacaactatagctatttcgttaaaaatatcagtatgctacaactttagtcaagtgtttaagagaactgcaatattgacatatataactttatcataagctgcgactttatatttctaatatccttggatctacatgtcatacatacacattaaatactcatgatcttacaaatcgggtctaccgtctacatgtcatacacacgtagggagtaaaattgtattttttatgataaa

SEQ ID NO: 55294 - DNA, 1299 bp, Oryza sativa
gattataatactctctagctaccaaagccagccagccaagtactactccagctaggattattgttcttagatcgtactccgtatatgaaagatggtatcaatatgatctatgagctagttagtggttatcgacctaattaacgagtcctacatgtcttaattaactaactaacattgtgctctaaaacaatataaaatttaactatggcgtacttatgttctcgcaactgtttgtgtacaggattttcagttatgttaacgaccacggctaatgtattctttttcaacatacttttatttgagctgcccccaacagactggtgtctggtggccagatcgaataacgatcgatcgtacgaacgtaccgactttcactcgatcatcaattcatcactcgtgatgaatcttactcctacgaaataggggttgtcaaatctaactaaatcaagggactttttattcgtcatgcatatatgatcatatggcctacttttacctttgttggagcaatataagtcttagtattaggcctagcttatagtatatcatccgctattaaattttaaattttgaaaattaattttaaaaattttgtatcttagtttattttgtaatttttcacttaaccaatcgataaaattcaactagggaagaaacgaagaaccagtggtatgatggtggagtcgtgggtgtataattctacccaccatggtttaaatcatggtgctcacgaatattacgtacatgcatagactttaaacatgactttagtgagatcaaagatgtgctgttagtttccgtgtcttaaatcatgtgttagggatgcatttcaggtgatccggggtgagagatttgtttcactctagtgcagctccacttgtgagctaggccaaagcgaggcaggccgagcgaagagaggtaggagggaacgaactgtgctagggctaaaaagaaggaaggagcttttggcccaaaaccaaggaaggatattgattatttttttcaattatactgtaatatagcgatctcaatgtttcaattgattgctcagctcataatagccattgcacccctaaaaaaaatagctttacttattgcaacgcacggtttttttctattaaataaaatatatgatagttaagtatttcttggttttgttgaaaaaacttatataaggatgaatatgtaatgaagagagtatttaatataatcagccttattttttaaaaataagtactgctctcttgtttttaatataatcagcctgagtagtagcatagcatttcttcttctttttta

SEQ ID NO: 55295 - DNA, 7234 bp, Oryza sativa
  unsure (1)..(7234): unsure at all n locations
ccgtccatattcgttgtactaaattatatcgtatctcatattatgttgggttttttttaagaacgaagggagtactctcctgttaaaaaaactaatatagaatcaaagacgatattttctaatagtaaaataaataacagcctcttgtccaaattcgttgtactatacaatgtgattctctatattcatggtagtagaaaatatcgtttccaatactagattagttttttataggacaaaaagagtacattaaacatctcaaaatgcaaatgatttacacatcagcaggcagcaatgagagcaaagactccccaatgattagagcaaaatagcatgtcgtcccccctgcatccttaactggctgtgtctcgcccggcctgaatgcccctgcattctgttcccccttcctcttccatacacagcttagatctggaatgagtactagttgtacatttaaataattacaactcctccaataatccgttaatcatttggtccattaattttagagtatttcgatgcaattatatattacatactccctcctgttttgtgaatgatcatttgtcttatttaaaaactttatgtaaatatttcagaaaataaatatttacacaaattacaacaaaataaatgatgattacataatttttttaaaataaaacaaataattaaacttatgttaaaaaaatcaataacatcatgcattaaaatacaaatggtgtacgtaatgagtaagcttgcacgtactcctgtaatataatgccgactggcggacagctagttgcagtgttaaggagtacttacttaggttttaaaccataatttaatctccaattacaggagggattaacttaacatggcagggcatatgcaagcgtgagtgacagctgatcgaggaagatcataggagggtaggccatgtgaggccggtcggtcgcacacaatgattggccagttacgttagtcgcccattgatgaatgatccatgatgatcatcgatgactattaattaattaaagctggccttaattcgatcgatctcatctgagctggttaattagaccggtcgtatcatgggtcgatggaccggtagtatatataacacactgcacgcacgtaccaacataattaagccctttaattcattagttagttagttaattaatcacactgcagcaggaatgattaccacaacatggcgttgtcgggcgcgattatgtatctagctactcactcaactacactcatatgaatgcatccatcttgattaacgtatagtaaccacattatatatgtgtatatgatgtgtcaagggtagattaagggtatgttcagattgataccaaaaataaaccttaccaaaacatggcaatgccaaaattttgccaaattggtaatattgccaaaactttggtaggattggtttaataatgttaccaaaattctatacacttaacaaaaagacacgaatatagggaagaacataatatccaatcattagaatgtgtgatgcatgcttcgaacccagaacgtctagcccaccatcttgtggagctagccggaaaacccctgggtatttctcaatatttgttaaaaaaaacgtagttatataattgtcaattttactaaataatggtatagttgaaaatgtcatcaatcttaaccggctctaatttctcctctctgcatacatgcatggtaatactgtaagcaatgtatatactgtagtcatgtgacactaatgacatcttcagaaagcaagaaaattctctgatgcatctgaagttttggttaattaatccttcctatgcttttgagtttgttgtcaacttcattgtataccccgaattttagaagagtcaatttgttggaatggtctagccagttaattttgttggttttgttagttatgtcgtttctgctagatactatatgtagtacattcttctgtttttttcttaatgatgagtacaagtgtatattatcttcattcacactatttcttttcaacaaacacaacaccatgatagttaatccacctcaaaaaaatgcagtacgtacggattatatgatgtgcacatgatgtctaccattattcaactaactgactataatcaaccaacattgacatgaaatgcatgactaatataggagtgcgcgcacacacaacatcacattaattaaatcatcactactgattgcttaattaggattatgcactatatacggttcatatctatcatgcaaagagcttagtctctgcaacttgcacactgatcacaaattggctcctctctgtctccagattccttttcaagtacaactactgtgcaatgagtactacctaagcagctatatagcatcttataattcagacacaaagctggcaatatagtccatgaaggggttaaggaccatgtagtaagctgtctcatggggtcgatccatcattagaaccatgatgaaattgatgagttgagtcgaaaatgatgagctagccagccattgccactgtaccatcatttgatcgatctgctgcttaacccaaaccgatcgatcgaccgaccgaccgagccatgagaccagcagggctccacccagcagcagccatctcgacatgcccaaactggattgtctctcaattttcacccgggaccaacaataatgtcggcatgattaaggcccccgtttggttttagaatggatttttaggagtaattatgtttatttgtaattttagatgtgagagatcgagttagtgcagtggaaaggggtgtacgattccaactccaagattccgtgttcaattcctaacacgcttataattatttcttaaacaaatgtttggagggacgtagcgccctccaaatctcttttttttctagacaacaattttctcacaaaacaaaattacaacagtttacaaatctattcgaggttgaattttatgaacgatgctaatgctttgtaataatgaatagttgaatgcatgtacaccttatgcaaaagctggaatatttctttatccaaaaatacgaattcatgctattactctgacataccaaagattgaaataggtagatagcgtaggatttttcaaaggaattgaattaaatcgtatgaaaatcctgcaaaattcctccaaataccgtcagtaaagcttcttgcactgtggctagcttcaagctcaaaactgaagctcaaaaattcctagattggcacaactacacaacatctgaaatcgtgcagccgcactccatatatttcttacacagatcgatagcgactcacccaagcacacgtacacagcaacaaatattttggatgaagaannaatatctnccttgactggactagtttattagctgctaatctcacctgggacgaagaatccccaatattattattcagatgattgatacactcgcaagcatgcagctgcaattctactaccttcttcgtcttcttctcatcaagctctatagctgtattctgtaatggtgcccgttaagtcaaaacaacaacctcgatcgcaaactgcaggatcgtcccttggcttggcctcaagaatcttcaaagcagatccacccacgcgccaccagctcatcattgtcgaccaatcttcttttcttgatttcaatccatgatcttctcatctatttatacccctcgtcttcttctcctcctctcttcatcgtctccgacgccgacgaactcccactcactagtagcacttacttgtagctattgatctagagcacttaagacatggagaggcaaggcttggatcttggcctgagcctcgggctaggcttgacgacggcggcgacatggccggctgctgggttctgtctgaactccggcatggcggagcaggaagtgatcaggcgtgatgatgtggttgcggcgacggcggcggaggatgagaggttcgcgtgctcacccggcagcccggtgtcgagcggcagcgggaagcgaggcagcggcagcggcagcggcgacgaggtcgacgacgccggctgcgacgtcggcggcggcggcgcgcgcaagaagctgcggttgtccaaggaccaggccgccgtcctcgaggagtgcttcaagacgcaccacaccctcactccggtaagcttcttctcctacccatcgccaatggtggattggattggagatgggattgaatccgagagaatggcatggctgaattttcttcctctgatccatggatgatgtgcagaagcagaaggtggcgctggcgaagagcttgaacctgcggccgcggcaggtggaggtgtggttccagaaccgccgcgcgaggacgaagctgaagcagacggaggtggactgcgagcacctcaagcggtggtgcgaccagctcgccgacgacaaccgccgcctccacaaggagctcgccgagctcagggcgctcaaggccacgcccacaccgcccgccgccgcgccgccattgaccaccctcacaatgtgcctctcctgcaagcgcgtcgccaatgccggcgtgccctcgccggcggcggcgatattccccggccacccccagttcttgtgcggattcagagatcacgccggagcagcgtcgtcgtcgtacggcggcgcatcatctggactcgcgaaggcggtcagggcggcgaggtagatcgatcgatgcgcgcgccgccatgatcgacatgaccaagctagcgatctctagctagaagatgatgacattgagcaagacgcaagagtagaacagagttgaattgatctctcgttttcctgtgtatttttaaggatcaagtgcaaagttaatttagtttttgacaaatgtaggatggatccatgtatgcacatgaaaagttgatgaaataacatgagaagaactaattaattgaccttcttttttaaaattcgtaatttagtatactcactgttttgagctgaattcttttccctctaccaggcatagcctcttttttttttcttttaaaaattaaaaatgtagctgttgaatctttggtagttagcaagcacaagtgggaattgaagcaacttttgacagttcatttagattgggagttggtctatcgtttggttagttacgtcaattagatgtgcacacttgcactaatgtagtagtatcatctacgtcagttttgagcagacaaacaaactgcaacttcaaggtgtgacttacgattttagttactctgttgtagacttatgatttaattattagcgtattcttttgccatccttaaataaaataattattagcgtattgcgccagcgatttttggccttacacgacacctatcttaggctgtgtttagttggatccaaagtttggattttagttgaaattagagatgatgtgaccgaaaagttgtgtgtgtatgacaggttgatgtgatggaaaaggactgaagtttggatccaaattttggatctaaacacagccgtagtctctaaagtttattttaaaatataacaacttctacactagcataatgaagtgttaatgggagtgaggaagtgtatacttgtcaacaattttcagggccggctcaacaattttgagagctctagaacacacttgtcaccagagtgtcggaggtggactagtacagtggagttgttgtgcagttggatggtcgcaccgtgaaccatcgcagtgatcgctcatagtacgcgcagagttcaaaatggtacacgaaacatacgacaccttgtgtatacatggacctaggcccctaatcgagcaggggcctaggccgtcgtaccctgatctatccacttgaatcgggtctaacaattgttactctctccgtctcaaaatataaatatttttatctgcgtgtccaaattaatagctaaaaattgctatattttagaatggaggtagtaaatcagagtagtacctctataatctctactacttaaaagtaaagtcatccgtccttccacccctcgcacatagtgcatgcgctcctcttcccacaaggtcttaatgaaaaaaaaagctctgtccaagagaaaaaaaaaagaaaaagaaaactgttgctaaaaaagcgcatgctttaaaatagatcacacattccattctaagtggtatggcccctattctcattctcacaatctcagagatatggatccgttttaacgtatgaacatattactaagttaaatgtttaatgttatggcattgagaaaacatctcgttcgacacttagaaactatacatgcaagttcatttttcttggctcacacgttcgatgcacttaaaaacattttaatttcctcccccgagtcaggctcactcattttatccgtgctagctagttcattagaaaaccggcactactaaaacaatatcatgtgctaggttgtaacaacaaacgacactaaatatatgacatacgatgttatcaatatcttatttttataaaccggcatcgatgtagtctcatcaatgtaggtttttgtccgtttgggatgcatggtgggaaaccttttatcaatatcggttcttatcgacctgatgctgaatgggtttaactatttgtcattttcaagatgtgacaattatggatttaccactcatagtctataacatatgggtccttatatatctatgacatgtgagttcagtgatgaatcttaattaccgcttgtaagagtggcaaaaagttaaatatgtcgatgatgataattgatagggtacctttgagcagttgtatggtatagtggctgtacatacatatacgggcctaattattctctggcaacacttctctctaggccggtcggccggtcaatccggccatgggagctagcttagagcaagtttaatagtatagccaactactagctccaattcatctatagccaatctaatagctcattcgtacaatagttacatactacactattaatacctggtcccacctgtcatacacactgtgtcttagagtccgtgctacagctggctataaatttgtagcccactactcttctctctcatcatttatctccttaaaatatatttacagctggcttatagcctgctattgtacctgctcttaaagcaagtttaatagtatagctcactgctagcttcaatttatctatagtaaatctaatagccaattcatacaatagttgcttactatactactaatatatggtcccatctgtcatacacacaatatgtcttaaagcccgcgcgcactgcagctgg

SEQ ID NO: 55296 - DNA, 711 bp, Oryza sativa
agtaaactttcatgtttaaaacaactccataagattaacttctaaagatgctgtcgttttataaacgttctgtctagcatgcatgacattgtttcggtccatacatccgcagacatagatgattgaaatgaatagcatagcttagctaaccttgtgcaaatccagtcgcctgccttccacccagcacgaactgcgctgctgtcgagggcacgggcaaagtcaccgttggcaacaccaccaccttggcctgctggaaggtccttcacaatggcgccacatttgaagcagcttgctcggctagcaaagttgtgatagccgcagttgcagtaccactcgcccgggcgaatgtccagggaggtcagcacaccacctgggacataaccatcgccaagcggcaggtcctggcgtggggtatggcagcgctggcagtagtcccggcggctgaagttgagatgctggcacgatttgcagttccagtctcctggcttcctctggatgttcattcgcagttaagccctgcatgccatgtatgaagcgtcaagaagctgtggtattgaatgaatacaacataacacaacaaaagttatatgctaagtactcttaagtcttaactaatcattgtctcatttattagtatattggactactgatcaaaagaccatgctacgaccttgcagtttacgaatatatccaggaaccaatgtgaatatg

SEQ ID NO: 55297 - DNA, 1186 bp, Oryza sativa
caagttttttatattccagatccatctaagtttagggtgaaaaagggtcgacgccaaactagacgcatcagaaatgatatggatgagtcagaagcaggtgggaggactttacgctgcagcaagtgtgatctgcgcggccatacttacaagacatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgatgtaatgagtgttcggactaaatacttctatcgtgtaatttcaattcaatcttgttgtaatgagtacctccgactattgttgtactagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgttttatacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtcgacggtgtttttgggtggaaggaggatatcactgcgcgcttcgagcaggtgatgcgccttccacacctaggaccgaccaccacccttcctccgtactctacagtcgggcctagcaaggcttggttgctccagttcactg

SEQ ID NO: 55298 - DNA, 4521 bp, Oryza sativa
tcagttgtcctcacatataaaccttgatcgcacttactggtgaaattcgcaagtaataaatgaaggcatgatagacctcacgcgataatcttcattgaggcaaatgcccccaacatatataggccattggctgtgtacaacaagatatgatctatattagttaagagctaactaacactaactactaattgttagactaaatatcccgtccagctagaacattagaaaactacttaaggtccagcgcaatcattacttaccagttaacaataaaacgttccaaattaacatttttcacctgccatgacaacggggaagtggcgctgcgcaattataacgttttcgcgctaaatcacagatcagttaaaagtaggcagcaccagttatgcagtaatgctattttctgaacacgctcaatgctgttttctgaacaatatctcactcccggagtcactaaacataaacctcatccgccccaagatgccacgaaacctagaacaccatgaagctactttctcccgacttgtagctacagtaaaaacccaaacccaagcgattccagcatcagatccctagagtcaatcaaccgatcagcgaagtcgaaggggctcacagttggcgttgacagagttgaggcccgccggggggggggcacgggggaggagcgcggcggaggccttgtcgaagaggagcgcgcggacgcggagctggaggagcaggagcgggcgagggggtggggccgcggagccgccgccggaggaggggaagaggaaggcgtcccaggtggagggggtctggaggtgctgcgcgagcgcggcatgggcggcgtccccgagccacgcccgccacgcgccgcacgcctccagccgccgcgcgaggtcgtaccccctcccgtcctcgcccagcagcagctgcgccgccgccatccgcgcgagggggcgggggcgcacaccggaggccccgcgtgtggtgcggcgtggagcgagcgccgccgccgccgccgccggcgggatctcgtcggtctcgccgccggagtttctgacaccgcctagtcggaacagggcgaagcggaagcgagagtacgagacagacaggttggtggtcatagcacacaggtgagacagacgacgcggaggaggaggagctcgagcctggcccaacatcacaaatgtctcggcccaaggcccactcatgagtcctgacgtggattttcttcgatgcaagaattttgtgctagcatgaaaattctgcagagcagcaaataaaatttgtgagctacagtagtattagtattgatctagtgcaattaaaagagaaaataatagaccagttatacgttggttctatgaacctacatgcgcacttagccaaaataaatgaataaataaataagataatgccaagtccaactttgtgatggatggagaagttagttttagtattcacaaatcacaacaccatagaacaggggagtatgagtagcactatcagtctatcacattagaaaagtaattttgactatatgattgttttagattatgatttgttatgatatggacctactacctagtataagttttttcccttttaccccattataaatatttaacatatagaataagattcgaccaaactttaaataaaaatttcaaagatcaataacttctcaaatgcttggttttagaaaaagaaatagtatgcatagatttgtcttaaaatgtatcaccataatattataatattgttaaactttattaagttaccctaatataaaattattgaacaaagtttaaaaagtttaacttaaagcttgctcctaaggtcaaatatttaagaaaaaaaggtactagtatattgtaccacttgcaatttggtagccgtaccagtacatatcgacttcgtttacctgcattctatatctcttcgcattcgctctttctttttgcatctctatcgtgaaatgatgtcatctgttgccaacgttgcaaatattacgtggatccatccgtcagcgtgcgcgatctctatctgaaatcggtttgacctactgttgtagattttagtgggaaatagctggtttggtaggtagtgggctcctaattaacaaactaattcccaagcttaaaacagaggattacgcccctaatggcctaatcaacgacgcacgacgtctcctgttacacacacatatattgtcaccacactaccacatatatccatccaagacatatatagataagcacaaactttcaatggcaaagtttcagtaatcaacttaattcaataatagtagttttgagaaaaaaaaaacgtgagcaaagggctaattacccctacaattaatcaaatgctgcctccatataacaaaatcctatatatctatataggtaaactttctcacctttcaaatggtgtgtctgcgcgttcggaacctatttctctctttttctgcgctcatgtttttcaaaccattaaatagtatattttttgaaaaaaaattatacagaagttactaaaataatcatattgatctttttttaaaaaaaattagctaatacttaattaatcacatactaatggaccactcgatttaccgatttaccgtgcggaagggattactgcccatcccttgctgcttttaaagtagtagtagtaagagctactaccaaaagtccaaaacacgtctcgttgaacgccaccgcccaccgcgccatattccaggtagaaacgcccaaaaacgtcgtcgtcgtgcagcctgctcgtcagtctacccttcgcggccaagaaagaaaaaccgtatgcatttcaaaagctggaaaaaaaacagaaaaagaaaacccgccccatacctcgtcgtcgtcggcattacgacacaccccacaacgtcaccaattcaagcagagcgcgagattaagaaacgcctagcatttgatccttcgcccaaaagtaaacaacagtggagtactagtctatccagtccactaccaccacatcacaagagaacaaaaacgttcatgtcggcttgagcagcagctgcacatgcgagagatgcgacgacaacgacgactcgaccaccacaccaccaccattccttaccccctttccaagcacattccgcccgccgccgcgcccctataaatccacggcgcgccaagtgccaaagcctccacatctttccatatccatatccacccatatcacatctctgatcaatccttctgcgtgttcgtgaattgggaaattaatttggttttgagacaaatggaggcgacgtcgtcgtcgtcgtcgttgttgaacgggctgaactccggcgtggtgctgagcctgatcgcggtgctgtggacggtggtgtggcagaatctgcagcggctgcagctgcagacgctggtggggcggcacatgaaccggcacgcgcggcggctggcggcgctcgtcgacccgtacctgtcggtcaccatccacgagtacgagggcggcaggatgaagcggagcgcggcgtacgaggaggtcaaggcctacctcagcgcgtcgtcggcgcgcgacgtgcgccacctccgcgccgagggcgccaaggacgccgacaagctcgtcctcagcatggtcgacggcgaggaggtctccgacgtcgtcgccgccgacgacagcaccgacgtcaccgtctggtggtgcgcgtactccacgccgccgccgcgcaccgatggaggcgggtactacggctggggcggcggcggccgcgcgcaggagaatcgccggtactaccgcctcttcttcctcgaccgccaccgcgagctcgtcatcaacacctacctcccgagcatccgccgccagggccgcgccgtcatggtgcagaaccggcagcggaagctcttcaccaacatctccacgcacaactggagcgacgtcgacggcctcgtccggtcggcgtggagccacgtcgtgttcgagcaccccaagacgttcgacacgctcgccatggacccggccaagaagaaggagatcatggacgacctcgacatgttcaagaacggcaaggactactacgcccgcgtcgggaaggcgtggaagcgcggctacctcctgcacggcccgccgggcaccggcaaatccgccatgatcgccgccatggccaactacctcgactacgacatctacgacatcgagctcacctccgtccactccaacaccgacctccgcaagctcttcatcgagacgacgagcaagtccatcatcgtcatcgaggacatcgactgctcgctcgacctcaccggcgcgcgcaagaagaagaaggaggcggccgacgacgacgacggcggcagcaaggacggcggcgcgccgcccaagccggacatgaagaaggacgcaagcagcaaggtcaccctctccggcctcctcaacttcatcgacggcctctggtcggcgtgcggcggcgagcggctcatcgtgttcaccaccaaccacgtcaagaagctggacccggcgctgatccggcgaggccggatggacaagcacataggggatcca

SEQ ID NO: 55299 - DNA, 1474 bp, Oryza sativa
tagaagtggtcgggaaggataagtagctagccgccattggcgccttgctggagtggttgctagcttctcgttttttctagtccacgtagcttatgatcacagtaatagactaagtttttttaagaaaattattttcattgtggaataatttgaccacatgttgtgctaaataatttgactcgattttcttagtgaactgacaatctgcttaatttgaatgttaaattctctcaagtgaagaacgccgacaacaatttagagcgtgtacatctctgttgcagacgccctcgctgctcctgatttgctcctccacctccggcccaggctgtcggcggcggccacgctcgagctagccaccgtccaaccggtggtttgccaccatgtgctagactctgcgacgaacgaccggcgcatctcgtcctcggaccaccccctcacaacaagaacaacttacgacttaagctactcggagctcacaaatgatcattttgccgggccaatctgggacaaccacgcttaagtcaaatgcaaaatttcctttgaactgcacataaggggcgcatcttcaccaatgaaaggcgagctcgacgcggattagcaacatccgcatgctgccctttctgccccctcgatgaagatgtggagcacctcttcctacgttgctccggtgtagcagctgtctggcacgcctttggccttgacggacaacagatcgcctccctaccacgtctggaagatgtctgggacatccccccacccaagcacgccgtccctccacgaatctggcgcatgtaccatcctactagctgcaatatggaatatttgaaaacggcgcaacaataaggtcttcaattccttagacgactccactccgtcagttctccggcgctgtgctagcgacattgacttatgaagcagcttcgtaattgggtctcaaacctgtaattagttcttaatttagttctctcttatccctcattgtaactcttccccctatatgtttctttaattcaataaaagttcaggctggtgtcgacgagtcccgccttagtttccctcaaaaaaaaataatttagagcgatactgcgcgacatgattcgattaattagcttacattgtatttcggaatttggagaattcaggtcaacgtccaaaacatcacctgttcatgatctaccagtatgaagctctatattgaaaatggctataaattaatgcttcaatcagatcatatcatgtgcgtgtatattaagttattaaccaacacagtggtgacactaaaagggcgatgaaaaaacaaaaggaacattggtgcatgacacaaccacatggtataattaagctaatcaagttcgtaggtatgtctggtaagtgtcttgttaatgcgcatacctacgtagcatttccggtcaaagacttcgacgattgatcttagccagatgacgacgataggtggtgcctttgcacaccccaa

SEQ ID NO: 55300 - DNA, 3259 bp, Oryza sativa
ccacttgcggctgtggtagggcgagatgtggaggcggaggcggcgtcttgagatcaggctcagagtccatctccacaggtaggctctcgggcttcgtcgtcgtcgttggcggtggcggcggtggaggtggcgggggtgggggggctaggctggggcacgtggagacggtcgacgggtccaaaaaacaagggagaaaaaatttcatgtcatcgtccacgtggcgtgccacgtaggcaagaccacggtcaaacgcggttttggactgggatgatacaataaaccaagtttaggaacctcgaagtgtactttgcaagttcgtggacctaagtgaaacctcctgacaagtttaaggaccgatggtgcattttactttattaaaaaaatacaatctatgctacaaggaaagacaaaacaaagcaacaaagttttttttttcacaaacatgcaaagcatgtcgatatcaaatactcctctaagagtgatgtaccaattttggtctcgaggactgtaaaatttctcaatatttaaaggtacttatggtgtaacttttttgcaaatgtgcaaaagcttttaacgtcgatatcaaatatacaagtgtccttaggtgtgttctttagtactccctccgtactcgtaaataaagtcgtttaggacaatgtttaagttaaaccttgggaatataaatcatgaataactctcgagttgttgagtttaaaaatgtaaaaattatatgaatagatttgtcttgaaaaatactttcataaaaatatacatatatcacatttcaataaatatttttatagaaataagaagtcaaagttgtgttttggagaccgtgtcgctgtcttaaacgacttcctttacgagtacggagggagtactaaatatctaaggatacttttggtgtgtcaaaaaaaataaacaaaaagaaattaactagttatatcaattagtgcaatgctatatatctagctatggcccatggatgactggatctcccggccttttcttctttccaccatcaattggtcgctgtcagcaaagtgtccctttctccttcagaaagcgatccactcctcttcagttcaggagcttggccgccatggcgccaccactcgattaaatacactcgagccgtcgagaattgctttaagttttctacgaaagatgatggccttacagctcagatataaaaacgacaacggacagctaatcagatgatgtttcagtctccaatttcgtcagtgatgacaagaacgcttttgtgcgcacacatctttttcctacgaacacgacatgatccgatcgcatcagtgcgatcaacggttacgattttccctgtctcttacctctggaaaggtaagatcgatggtgcactgccaaaaagcttgacgaacataaatgcgaaagtttggcactaacaaaaacgatgcttttatgagtttttggtagagtttttgccctctgaaagtctgaaaatctgaaatgcacgtgaacccattatgcaccaaagtgctcacaatttggtctccaattcagcaactttacgcgtgtacctcactactttgtgagtgatcgatatcactgatatttttgcactctataaatattgctctgttgctacgatgctagcaatgcaagaacataaaattcggttcatcaaatcagaaggaatttgtttgttgaagctgtagaattgtagtgaagagatcgatagatcgatcggcgatggatttggcggcgtggtttgggccggtgaattcggggctggtgctgctgatactgacaatgctgctgcgaaacctgcagaatttccagctgatgcagacgttcgtggcgcggcagctgaaccggcgggcgcggcggctggcggcgctcatcgacccctacctgtcgatcaccatccacgagtacgacgccggccggatgacgcgcagcgacgtgttcgccgagaccaaggcgtacctcgacggcgccgtcggcacgcgcgacgacgtgcgccacctcaacgccgaggacgcgcgcggcggcggcggcggcggcggcgcaggcgaagggggtggtggtggcgctggcagcagtagcagcaaggggctggtgctcagcatggcggacggcgaggaggtggaggaccacttccgcggcgcgacgctgtggtggtcggcgcactgcgagcaggacgacgacaaggggcggcgcggcggcggcgggcgcgcgtcgcagcgccgctcctaccgcctcgtcttccacgagtgccaccgcgacctcgtccgctccgcctacctcccccatgtccgcgaccagggccgcgccttcatggccatgagccgccagcgcaagctctacaccaacatccccagctctcgttggggcgacgacgggtaaaccaattagcttaatcgctcacactaattaacacacgcaccaactaagatatttctaactctacaaatccataaaacgttgataacattcgactgaatcattatttatttattttggatgaaatataaaacttttgtaccatcataatttagcatacaaacttcaaattcagtgaatgaagacctaattcttgattaattaccgcacttagtcacgccaagacggaggtgacatgtgttcgttctcattttaggagttacatgtgttcgttgtggacggaggtggtgttcaagcaccccaagacgttcgagacgctggcgatggatccggagaagaagagggagataatcgacgacctcgacatgttcaagaacggcaaggagcagcaccggcgagtcgggaaggcgtggaagcggggttacctgctgcacgggccgccggggacggggaagtcgacgatggtggccgccatggccaactacctcggctacgacgtctacgacatggagctcacgtcggtgcacaccaacaccgacctccgcaagctgctcatccagaccaccagcaagtccatcatcgtcatcgaggacgtcgactgctccagcaacctcaccggccggcgcaaggccaccggcgacggggaagacgacgacgacgacgccaagacgaccaccaagaaagtgatcgatcgcggcggcggcggcggcggcgtcggcggcgacagcaaggtgacgctgtccgggctgctaaacttcatcgacgggctgtggtcggcgttcggggaggagcggctgatcgtgctgacgacgaaccacgtcgaggacctggacccggcgctgatcaggacggggaggatggacaagaagatcgagat

SEQ ID NO: 55301 - DNA, 1929 bp, Oryza sativa
gatgtttacctttggtgggttcttaaaacagaaagacgctgccacatcctgccagatagaaaggatttagacccatctgtctgaatcaagatttattaatggtgggtttgtaaaacagaaagataaaaatacaacaaagattcactaccataagcacataaaacaaattatatactagaaaaataaactttaatctagctcagtaaaaaagtgcagaagaaattcagttagtttatataaaagttaaagatgataaattaccatcacttacctagcacatactttatataaaagttaaagatgataaattatcatcacttacctagcacataccattttctctcaagagagctaaatactactaaaattgaagaaaaaacaacagacactccacttgacacttaaaagatttggaacatgccaaaatgaagagcatttgttgtgaattgaatgtccaatacaacaaagcatataatgggtaacaattggtcatgcacaggggaaccaaaaatccttcagaaagaaattcaataagcagtgtaccttcagattgagattatgaacatcaaaaatgtctttcatggagtgtgagtcgtatgccaagatgtaggatctgtatgcctctttagctgactgattcaggaaataattctcgccaacgatattctcctgtccaacaacttgagttattactactagacacatttgacaaacagtgttaaaacaactcactaactgtgaaaaaacacttacaaggtgcgattgcaaatttggcactttgttttcattgaacactaattctgtcagcgaaatcttagcagcctgcaggcaccaatataatatgttataatttctcttaacttcagaaaatagaaaacatattactttgtaaagtactaccttcaggtagataagaaacttcagttcttgtggcagtaaaaacaacagtgcttctcctttgcctttttcaccacgtgcagtacgtccaactctgtgaatataatcctgaaagtaaacagattactcagtacattgaaatgagcaaataagtgaaaataacagaaaactaacttggcacattcagaataacccacctttggttcatctggaggatcatattgcacaatgaaatcctaaaacattgccaaacatccttatatcagaaaagggggactccatataagagatttttaaaaaatcaccattaaaaactcaccacatcaggaatatcaagtccacgtgctgccacattagtgcatagtaagatacccttttctgctttgcagaagttaaagaatgttgtggtacgcttctgctgcttttgttttccatggatatcagaacattctatctggagaaaattcagaagttctgcatggaacttgactgaattacatgatgagaagaacaccatgacctttttattctgtttcttttttaggaaagcataaagaaccaaaaaccttcttgcgctatcaatgacacaatatccctgctgtaagccctcaacagtagcctgtaggagcattatggttattatcctacaaacattatgaaaagagaaaaaacaacttggctgacaatttccttacattagtttcagcatcatcaacaccaacataaacaggttttgaggtactttcttcgtttttctcaaatgacaacttggcaaattctttaacctgtgtggaattcatcaatgaatcagtacatcacccagagaaaaaatgaatgaaaagtttcaacaaactgaataataaattcactaacctgctctgtctgtgtagcagaaaaaagaactgtctgtctattctgcatagcataagtagcgatttaccaaaaaaagaaatgagacattatgtaagcaaagagttacaagttatggtctgcatatgtaaaatgataaatgtcagacggccagatgaaata

SEQ ID NO: 55302 - DNA, 1013 bp, Oryza sativa
gggtgggggttagggtttaggatccctccgcgacgccggtggagacggacgtggtcttgttactcttgtagccgcgcgacacggacccacccccacattatcgtgcttgtcaatctgggccagttggcccagcccaactacggcccaactgctcttgttgccatttgcttttgaaattttcctttttgattcacggtgtttcttatcttgaaacaggtgtaaattgtaagtataatactttttcatattataattataagactttctagcattgtctatatttatatatgtgttaatgaatctaaacatatatgtgtgcctagattcattaacatctatataaatataggcaatgctagaaagtcttatataacttgaaacttgaaacggagatagtaaaagatagtaacatgataaatcaaattttggtttgaattagttccatgatgaacttcagaacttgtacggagaatggttcaaataagcacagatggggggaagaaaagaatagctttcgtttgccgaagttccaagctacaattacatacacaacacaactacacaagccatggaaaattggaaatacgggagggcaagaatcacagtttgagactgatgacaacatgcagagaatgcatcctgaagcggccaagccacaccaacaatgttactcatttaggcctcgcgatttcgcaagcatatgtagccggggtgaaacaacaatgtgacaatgactcaaaaagaagaagaaaaatggcaatctaacacgcatacgctaatacgctatcagttgacgcgtgccagacatcagtgcacacatctcaccatggtctacaatcatcagactggatcagctaatggtaattctacagctgcacttatgatggaccatatcgtttcttcacttggttcttccaagttgacaaaagcacctccaatcaggttgacgcatgaatgatgttgtatcgctctctcatgggtgctcattggcctctgatggatcaacaatgtta

SEQ ID NO: 55303 - DNA, 1026 bp, Oryza sativa
ctttgacaaccctgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaagcaacagtttacagttgagacaagatcagtgtctacattgcaagaagacaagacattccaagaaagatcatcctgacttcctgacagtgatcatggcaaagaaaggtgagaacattattacatttgtaaagaatctcattatgattggttattctagatccacatggtggattgattctggagcaactattcatgtgtgtaattgtttaaagggattccgttcaatgaggactacgcaaagaagtgaaagatccattagagttgccaatagagttgaagcaaaagttgaggctgttggagatcttcgcctagaactcgcgaatggcttcacacttttacttccagacgtttttatgtcccttctttgcaaagaaacttgataataagtgtatccaaattggattttgatagatatgattgccattttggaaatggcaaatgtgaactatggtataataatgaatgtattggtcttatgttgcaagatcagctttatttgttatctctttctgagaatgtgaatgttgtgtcctcgttgacaaaagaaaagaaagcgaactcctgatgtctcatcgaaattatggcactgttgtttaggccatatttcgagggggagaattgagagactgttaagaatgtagttcttcctccattggagttctcagttttagaacgatgcatacaatgtatagaatgcatcggtgcccaaaacaccgtatgagctatggatcctccgtgtgtgggggagtcctgcaaaggataaagtatttaacccaaaacagtaagctgccattttattggctattctgaaagatcaaagggtcatcg

SEQ ID NO: 55304 - DNA, 933 bp, Oryza sativa
atgttcacgccgccgcccgccgccgacgacggcggcgactcgcgcgtggtggccgtccactccacggccacctgggacgagcagtggggcgcccacaagagcaaccccaacaagctggtgagctccgctctcgctgtttcccccccaatctgatcgacctcgacctctgagtgctggtttggatctgagcgtgtgttggctgtctactgctcgcgcggcagatcgtgatcgacttctccgccacctggtgcgggccctgccgcttcatcgagccggccttcaaggacatggccggacgcttcgccgacgccgtcttcttcaagatcgatgtcgacgaactttcggtacggttgctacgaccctggcatgtcttgcttttttttttcttcttcttttgttttgcttgacctcggtgccaaatcgacagattctgcagagttagaagggggaaagaatttgagttatattggttattatgttactatctactctactaattagtacagtacttgtagttgactctcgccttagttcaaagctggttcaaaatcatagaaattttgcataatttctgagaaatcgtgctggttgcatacggctggcatgcgcacttgtattgagtgagatgtttgatttcacatgaatttggttcttgccgtagtatttaagcaatatagttgcttggccactagaagtctagaaccagatatggactatggagttcaatgtgatgacattctttgctgtcttgcattgtcctaggatgctttatatgtactgtaaacagtatctagctttatgggtctggatgaacttgtctttggtttgagtgattcgacttgataatgttctaagaattcacctaagcaagatcaaatcaagaatagatggctcaattatggtttataaaagcaaagaccaaatccgtttaga

SEQ ID NO: 55305 - DNA, 3911 bp, Oryza sativa
tatgatccttatttgtgggaaatcacttgttctcataaaagtaaaaaagaaactgcttgcttgtaagttgtaccttaattcaaatatatttttttattgcccagagtccctcgcctaagcaagaatcttcaagagcaccaaggcaaactgaggagggagaggagctgtttagaatgcaagatgaagagaagcttaagctactctcgttgataaagaatcttaaagaatcggaagctatcaagcgagaggacccattgtaagtgggacaatacaaagtattaccgcaatcatattcatagataccattgctaaattctatttcgcagtggtattttgcaacttgtcgatgattgcgataacccttagcatatattacttgaatcctatccattaatctttactagtacttgttaactaaccatattaattcttatatatatattttctcacatttaggtttgatataactatgaagctcgtgatttcctcgatggccatgttacttgtctggactgtctcagacatactattgatggagtaagatttttttttccgatgcactgatgtaataagatccgtatgggcactaagtgtaataattaggtgttctatatattccgttatttgaacactcgtcctgtggttatttatctactactacgtagtcatgcgtgatgtctcaacagcgcgatttcacgcatgaattctctcaacaacgcgatttcacgcatgaattctcttggatggtccctttgggactactccagatggcggtgtattttagcaccgagattgttaagaaatgagaatgaaatcgtgtgacaaaatcattgatggtattctgatgtgttatcccagtgtcttgcccctactctggttcagttcaaagatgagttaggcataatttgtattaaatgactagttttgtcttctctgataggcaaaactatagaatattggacttaaccgagaaagttctgggcttttaactacgctgatacaagcgaagatgatgaatttacttccttgcatgacagaatttattttcttgccggagatcgaatttaaccgatacaacccaaacttaaaactaagaactcatcgggttgatactagtcccgtcggaataaaggtgacgatgcgccgaaagcaattgcattgatatgtggaaatagattacaaagactccgggtgtaatctgggtgtacatatttatactctcggggtgtaatctgggtgtacatatttatactctcggggtgtaatctgggtgtacatatttatactcttgggttgagactagtccgtgacgatgggccaaaagcaattgtattgatatgtggagatagattacaaagactccgggtgtaatctgggtgtatatatttatactctcgggttgagactagtcctaatcgaataccatacaagttttatagaaataaaagaaaaaaatactagtcctgattgaatattagacaaaactttctaaagataaaaaaaagttattaaattatttttgaactccgtctcttaagaataaatctctcatcggctaaaggatcgtattaagttttggtgttactagaaaaattgcctatcgttgcaacgggtgaaggctattttaattttattattgttatacggtctagttaaggtgaaatttactgtgagaatttgctttgatatattattttctagaaaatcatgaactgcaattaggagttcgatcatcgcttggatatattattttgtagaaaatcataagctacaattaggagtccgataaatctaagttaacatgcaagtttttctaaaaagatatttcttatacgactcctcctgtatttccaaaagcgaacaaacttaaaactcgactcaaatacatatttgaatttccaaaagtaaacgaacttaaaaaccgactcatacacggaggacgtaccaaagtattgataaaaacatcttcaacttttataatagtagagataaaaggctatagctaacttttttagaagaaaaaaaatagagcaggtttcagatggagtaaattcatatttttaaacccacttagatagtaagggcctgtttagttggcaaaaatttttgcccctgcatatcacatcggatatacagacatacatttaaagtattaaacgtagtctaataacaaaataaattacagattccgctaggaatctgagacgaatttatcaagcctaattaatccgtcattagcaaatgtttaatgtagcaccacattgtcaaatcatggcgtcattaggcttaaaagattcgtctcgcaatttcccagcgaattatataattggtttttctctatatttaatagtccatgcatatgtccaaacatttcgatgtgacagcgtgaaaaattttatttgggaactaaagaggcctaaattcgtttttgggcctgtttagttcgtgaaaagaaaaatttttgagtgtcacatcggacgtttgaccggatgtcggaacgagttttcagacacgaatgaaaagcctattgcataactcgcctggaaaccgcgagacgatgtgagttactatagcacttatagctaatcatggactaattaggctcaaaagattcgtctcacgatttcccccctaattgtgtaattagttttttaatgtatctatatttaatactttatacatgtgtccaaagattcgatgtgatattttgggaaaaagtttttgaaactaacagggcctttaccgacaagtcagcccaccccagaccagttcggccgtcaactcatctgatccagatcgaatcatcgaaccacttcggaaaacagaaaaaaaagaggaaaaaaccgatcataaaaaaacactcgaagaacacaaacactcgccccgatccaaacccgagaggggacaagcccacgcgcgagaggcgagatccaaccccaaccccaacccgagccaccagaggccgaccagatccacccccgcagccagcgaagacggcggccacggcggcggtcaggatgctgccggatggcggcgccgacgacgaggagcggtggctcgccgagggcatcgccggcgtccagcagaacgccttctacatgcaccgcgccctcgtaaggcccgccaaaccctagctccctcggtctgtgactgccccctctcgcttatcatctgccccgatcggcaattcgtgcgcaggattcgaacaacctcaaggatgcgctcaagtactcggcgcagatgctctccgagctgcggacctcgcggctctcgccgcacaagtattatgatctatgtgagtgtttcttatgtgtcaggattcctcagtgcgcccaattttggctgtggtttcagctgggatttgatgggggtttattgattttgctgcagatatgagggcgtttgatgagatgcggaagctggagatgttcttcagggaggagacccgtcgtggcagctgctccgttgttgatttgtatgagcttgtgcagcatgctggcaacgtactgcccagactgtaagactaatgcaccccttgtcaggcataaacagctgttaactttgtgtaattatgtgctgttagctctgttttacttgctctgtgaggtttctggagccgaatttgtggtgggtattgcagtcctgtagatcattacaactctatacgatctagtaataacttgtagctactagatcaatggcagaacttggtacttcgatagtttaactttcgagtaactttaactttgttgaaaagactagtttgaagtttgaactactgtatatttacttggtacaactgaacttaattagtcttattgcttgactatcagtgctcataccagtagacattatataagccatatcattcaattgccgacatggttcaagaaggtgctagagagttggaa

SEQ ID NO: 55306 - DNA, 1647 bp, Oryza sativa
ctattgccactttgccagtagcgctgcttgatcatgtatcagtacactagaggcaacatgaagttcaattcactttattatatctgggagttaggacatgcagagcgcaaaagtgttttgtcctgaaagtatatgctacttcacatttatgttcttctcttttacagtacctaattgtttctttatacctgccttttgcaactttcatcacacagggatgctgacagcattaacgtcgcagttgagtttgttcttcagaatttcatagaaatgaacaaactctgggtccgaatgcaacatcaggtttgattcagcttgcaacttgaagcttttttttttcttttcaagctgaagtctgagtacaagtgctgcgatactttcccctaccatgcatttaccgccttaggtttctgcgcatgcatacattgtttcccatgctgttcatgaatacaagcttttatcacagatgtcacctctaggaagctcaagattatctaaccagataataacttaaaccggccttgatgattatggtttgcagggccctgttcgagagaaggagaagcggggaaaagaaagaaatgaactgcgtgatttggtaatcatcaattacatgtattccctacactacatgttctttggtgtcatttcaatgacattgctactgttctttcttttttctaggtaggcaaaaaccttcacgttctaagccagattgagggtgttgaccttgacatgtacaaagaaactgtccttccaaggatattagaacaggtctgcaattagatttgttgacaaattataaaatgatccatgattctactggaagctgaagaagaaatatattggcaggtggttaattgtaaggatgaacttgcacaattctacctgatggactgcataatacaagtctttccagacgaataccatttacagacattggaaacattgttgagcgcatttccgcaactacaggttggcatgtttatgttattttaacttgattgttctctgcatatcgttgcatgttagaaattaaacactgatgtggatgattataatgtgacatatttagttgattgtgtcaaccaaatgagttaactaccaagtcatccttatgtctttgtctgcttgatcaatttgatttgcactgcctgatgttctattaactactccatctgtctcaaaatacaactcaatcagggaatcaactcaagcgagtcagattcacttttaatctgcgcatgctagtagctttacatagggtctttgaccgtgtcagttgttcacttgctactttgttgtaaaatgcgactagtgaacttgacacataattttgcaaaaggctttatcatgtacatgtagtacattttgttctgtcatgatctgtagtttaagctgcatttaacacaaaaatccacaaccgtagaataaattaatacaactcagtgtatattttgatatataagaatcgggatgtaattttctgtccaattttcactgcgattgttactcactcattactattttgtggcagccaaatgttgatatcaaaaccgtgctgtctcaactcatggacaggttatcaagctatgctgccgcaagtcctgaagtaagcactcactaaaccacttcatcatggtaaaa

SEQ ID NO: 55307 - DNA, 1326 bp, Oryza sativa
aatttggaagccatgttgctcatcctaagaatgtggtcttttacaccacctccatggtacctctctgtaacaagctgctttatcagctgtgtcgcataaaactttgaagaaccagtaaaccggctctttatactttcgaggtacttagagacagtgtcatactctgggattgagcccaatatggttggctcaatcgtgttctttaccgcagccaaacaattcttgttggctgaagaccatttcgcatgctcaatgtcatacgacatgatgagggaagcattgtccctctctctcttttgccattcagcatctgactctttttcacctctgaaaatttcagcaggttctataggacatggggtagtcaacacccagtccacctctcccaagataaaagcaaggtcgagttctcttttccattcttcgtagttatctcctttcagggtcggaatatctttaatgtaacccatcaaggagtagccatctgagataatcatgtattgtgagaacaaaattaacattaaaattattatgtattaagtctacatcaccgttgggcagaaaatagacataacacataaagccataactataacattgcaattatcaacgttggtcagaaaaattacaacatcatagcacataattaatgttcctaaaattaaaatctcccgttggttcgaaatttaattttagaaacactaattttcatcaatttcatctgtttgcagcggaagatctatatacaattcatataaacaataacaaaactctgttgtttactctctgtaaaaattctcccgttggttcaaatttaaacagaggtaaaacatgtaagaacaattcaaaattctattgtaatttgcatgaaaatatacaaaatacatgttcagaagcatttctcacatttatctgttatctaaacaattttcacgttggttcaaattgcttagaaataaacacaatcattaaacatattgaaaatgcttccttcggccgagggacttttattaaacttcttttctttttctttcggccccgagggacctaaattgaattttttttttcggcctttgccggtcggcccacggccgccttgcgcgcgggcgagcggcccctcccctttcccaggccgcaacttgggcctgggccgggaaaaccgccgccgcgcgctcccttcttgggccatttttggcccggccgccaccggccgtccgatcttagggtttatgatcggacggtcgggcgccgaaaacggggatcaaaaccccctctcgccccgaccggccgccgaaaccctagcttctccttctcttctctcttgcg

SEQ ID NO: 55308 - DNA, 2936 bp, Oryza sativa
caaacttttcaagcaccatgttctcccttgtctaaatttggccaagtttctgtgtcttttgacgtggaccgcattcaacgccggtgcttggttgatgactccaatacgtttcagaaaccacataggagtatttgtgattcaagttttgatgggttgttaccacgtccagaatgtcacctgcgtgatggaattcaccactagtagtactatcttaccgaaccaacagatgtacgttcgtacaacgattttttgtgattttcttctcttcaaaatgggtaaaaaccagcatctacatcgaaccggatgtgccaataacctttcaagataataactctattcaaagaaagtttgcataacaatatatttatccttaaaagtttgtatataattaggaaattttccatacatttggagttcatggacgcacacttttttttttaaaaaaaaaacttctatgtatgtagtgactttaaagaagggcatgcaaacgtggaaaggctgagctgtttgtcttgtcctaattttctaaacactatatttctggttggactgctttctcttgctaattgtttaaggccttaatgatacagggatgcatagcagggcgccatggcttgacactgtcaatacgcaaactttagtctggaagacagtgacatctccaagacttttctccaaatttatcctatcatatggtcatatgtacaaacacgggctattcgctaccactacggcactaccagactggtgacatactaggattaatcagctatactgatcaaagtttctattactttctttttttgttctcgtatggcaaaagtagatgctcctaactcctaacctgattattcttgctggtacactgagaatttagttgttcatcgccacacgaaagacggaaagagtgagcaagtgcagcgttgttctatcctcatgttacttaatcactaagtttattggtgggtttaggttatgtttgacacagctccagctccacctctcctggagatggagctcagccaaacagttttagctccatctaaaattaggagcggagctagatggagtaatctcacagaatgaataagtgatgtgcagctaggttttggctattccacaattctactccagacctacctcctaaagctaaattttaaagttagagatttacgaagcaggatcttattgtcgctgcgagatcggaactcaagctgtccggtagaccggtacgaacgatgctcgctcatcacgtgagtattggattgcacgggtgcaagcaacactgaatccgatggagatctcgtaggagtatttgggggcggccatgttgtggtcggcagttgatgacgcgccgccgtatttggaagggagctctatttggaactagtaggcgagactccaggtcaaaccaaacttatcagcagaagatgctacgaaggccgcttgaattgatggccatccacacctttccccgtcggcgcttaaatcctcccaagtacaacttcaaacgcgtgtgctctgctctgctctgccttcatgtttacttgacctcatagtagtaattgagctcgtaattaaaaaaaaaccaatgtttgcattgtactacatgaactaaaaacaacaatgcaagttgtcattcgatgaacgatctggtttgcgatcaaggcatcatcatcatcatcatcatcacgtgaggcacaacgaaatcgtcgtacaaggttggctaccaaagcagtaactactccagtttacatgatgagagaggcagtaatcaagcgaggtaaacggaatccatcgtcccgcatttccgcgcgttgccttctcgccgcgcgacccatcccaacgtgccggacacccgcaaccgcgagccagtcaaagtcgaaacccccgcaactgaccgacaggtgggctctcccccaaccgtggcccccaccggcagcgacgcgtcgtcccccctcattaattaatcccattaatccccctcctcctcgtcaccggccaactcaactcaactccacctcgtcgcctccgccgcttggagaagaagaagaagaagaagaaaatctctctcgcctcggagagaggaggaggaggaggagatccggcggcgatggagctgttcgcgagggcgcaggtggtgaggctgaagagccaccacgacaagttcctctacgccgacgaggacgaggtgcacgtcacgcaggacaggaacggcgccgccacgaacgcgcggtggacggtggagcgggtgccgcactcacccggcgtcgtgcgcctccgcagccgatacggccgctacctctgcgcctccaacgagcccttcctgctcgggatgacgggccgcaaggtgctgcaggcgccgccgcccggcggccgcgccaccgactcgtcgctggagtgggagcccgtcaaggacggcttccaggcgaagctcaagacgcggtacggccactacctccgcgccaacggcggcctcccgccgtggcggaactcggtcacgcacgacgtgccgcaccgcaccgccacgcaggactgggtgctctgggacgtcgagatcgtgcaggtgctcacccccggccacgaccgcgcccccacctccgccgcgccgccgtcgccggcccacgcgcccgagcttaagaagccgccgccgccgccggaggcgcaccaccggcccaccaagtcctacaccgggcacccgccgccgccgccgctggagaaagacgcgccgccgcagccgccgcgaccgcaggaggtccaccaccggcccaccaaatcgtacaccgggaacccgccgcagccgctggagaaagacgcgtcgccgcagcctccaccgccgaagcccgcgccctctagactcgaggtttgtcatttgttcgaacatttcccttgctctccattgaattgaccagtgcatgttcgtcgaattggtctcc

SEQ ID NO: 55309 - DNA, 985 bp, Oryza sativa
atgataagggcgatgtggacgaagacgacgagacacgctcattcacattcaatggctccaacttggaggagctcacacacaagttgcaggaagagacgggcctccatgacataatcatctgcacacgcagccctatcactggcaaactcgctcctctccgcttgcagctgccaccaaacaatgcagcaatgcatattgtgcttgtccaggagtcctcaaaaggtgaattttgtcattccttgttgttttcaccatcctaactactcctgcttctattggatgctattgtaaaagtaaaagaaactaaattttatttaggctaatgatatgccctgaatctgtctgattagtctaagattagatgatttgaggatggactagctcaatggcgcatttgacttaggtcttgcagagcataacgtgggtattaggtaaagttagttcagtgtgttgcttagttttatagctggaaagtagagccagaggatcaatggttgccattgttccctctcatgcttccagtcctagagtactttacctcttgttaactggagtactagagcctaatatatttttttatgagaacataatataatttgtttatgatatgatgataccagccaggcagccactaattttaagtttttcaaccagctgggaatcaaagaatggatatccacataaccaacttttacaatgctaaggcacccccttttcagcaagtttaggatagtaggatgtctttataatgaagttgtaggaaaggttcctttccgtactatgtcctcttcagattttggttcagagagtaagtagtagtaacttttttttaacgaaggttgccttatttcgtcgatagagaacataaaaaacacaaagccgagatttcagagagtaagcagtaaaaagaagatggatttagctgttaatgaggttgcactacacatccattacagctcaaccaaccgtttataaaatttagatc

SEQ ID NO: 55310 - DNA, 2282 bp, Oryza sativa
aaactagcgcgtttttgtagacataaccattcccattcaaatggtcataatagatggctccaacgaccatcagccactgtcatcaagggtcaagatcgacaagagtgggacaaaacaaccaaaatgtagcaagcaaaattttggcagaccaatggtggggctgcaaagtttgtggaaagttctctggaaacattttagccttttgacaagctggtccgggtcaccatgttgttctccccacgatgatcacactcaattatcctttggttttgttcagaccatgttgcaaaaatttggaacgatattgctccaccagcgatttatccacgcttccttccccagccagctctttcttggtctttctttgagcccttcctctcttttgctccgaatgactatcatttctgtttttcctctttgccagggcatctgccggattatgtttactcgacagagttcgctgcaaaacggagactatgttaaactacttcgcttcatcgagatcgataattttgtggtgccgaaaaacaaaaggtccaatattacttacattcctatcagcggttggtgttgcatcttgtctatctccatccaacgcggtggttcccttgtttgactttcgtgctctttttgcaggcctttgatcctttcttttatcttcaaccatactttccacagtgccaccatctccagctgccgaaagatcctctgcaggcccttcaccagcgtagggtaacttagatgatctatcgtgtgattttctcttgttccctttgttgaaagcccttctgttatttgcatcagggccatcagttgcagactgatctcccagaggcctcgccttatcttgcgcagcttctcgcaacttatcacggcggtccttccaaattttctggagtctcactttctcaacgttctcaagtgcaaactccacaattggacgacgttctgcaccaaaagtttctgcaaatgacaaaaaacaacaatgtaactggagataaacagacaacactaaaaaaaaatgcagcagcaaacaagcaaatgctagttactactagaaaggaagggaagacattaagggtatagtatgtctctgatgatctgcatactgaggaaaagtgaaaactgcagctagagctaacagcagctcaaagacacagaaagctcatgattggacaagaaacagcacagataggtagcgcgaagccatgaacaagtgatacagtgattccatgcaatccaaggatgcagcattatgcaataggcaagattaacacatcacattcttctcagagaaagacatattgcacattagaaagtaagtgagacgatgaggcagttagacagcatggctgcaacaaaacaatacttagaagcatttggtatagaaaagagtaccagggttattgtttaggactcttagagccacaagagcatgctcatgttcttgaaaatctacgaaggctacaccacgggaatgtttctgtgcagtactgctgctcttcttttcatttttcagaatatttacctgttcaagacaaatgcacatgcataagcattataaagatacctagaaatagaataaaacagaggttgaataaagaaaacccaacaaacctttcggatgacgggattttgcttgtgagcacgagaaataactgcttctctacaaagcttctttacatcattaatggtcatagtctttggcaggttgtagatgataagccttgttttggacacatgaaattttggagactggagcatttccgcttttcttctagctaacctacatgacaaaatcaaagatttcgtgagcattgttcacatgatcctttggccatgagcccatgattgagagcataataaaactccatcttaagaaagattactggacattcaataaaaaaactaaatacatattatagaagaaacaattgaaaaatacttgacaaaataaaattaatggaaaaagactatgattcaatagtttcatctgccgtacagagacacctttttattatagaaaaggttgagacaccacatgctgccaatgaattataaaaattgcatctatcatagctgtttattcccagagaaatattaacacacatgtacagtggacatttaccaatataatagaaccaacactttgcctatatttcttgtcaaaagacattggctatattggtactagctgtagggtgatctaatggtgcacagaaagaaggaaaagatcaactcttaccaactacgtttattcatgtcagcatcggatacgcctt

SEQ ID NO: 55311 - DNA, 6289 bp, Oryza sativa
actagtggatccccttcagagtacagataaacaccatgcaactcttgtgaagaagggggacacacaacaactgaaaattaggattttaagtaatctcattctatctcctacccacctattctcacagctgcaattgtagccatgcaagatagtagtagtagattataagtggagacaaagcggtagcatatctattgtgtcattcacggaataatattaggatctttctaactgaaagtgagaaaagcttgattaactcactgactaatcaatctctagaggcttgtacatcttttacagatacaaaaatggagttagcggtggtgatggtagtatcttatgatgaataatatagtagtgccttttgtgaacgattgcatgtcaccatctgatctaatgtgaactatgtatgcaatatttaaaatttggggatactaacttttttctagtttagaacttataatatttagtttagatccattgcaatgaacaggcactatgttggttctggtaaaatatctagtttacttattgcaggtcttacaggacactgtaactaactatatttgaaactgtagtcaggagatctgtaatatatgtggtattcaggacgttgccaggagacacagcagcagaaagttattgttagtttgagactccagaatttgaagttccaacccatttttaattagcacatacccatccgttttaaattaccgtactaattcatgatagccaccttaggttagaacataaggataattatatgtagctttgaggagaaactaaatgtgtgcacatgcactactacactggtaaacaaaaagtggaagaaaaacggaagtatttgaagtttgtttaattgtagaatagaacaagtctatcaagctaaaataatgaagtaatggcagcacatcaaggtaaatataatgcaagaagatacctctccaccaagctgacgagcccaaacaactgctcccttgacctccttacgatgcaagtgaacaaccgaatcccaagctgatttgacactggcaaaaagtacagctgctgcatctgttgtgcatccatctcgttcaagccctgttgagaatgacagccattccataaattatactgtttcaagaaccacatgctagtggtattaaaggagaataattgtgtgtacagcaggaactgggaaaatgagataaaacttaataagtcataccatggagctccatttcctcttttggaagtggatagctaacagatacaactgtgccaatctctccagctagacgaaatacttcactcgccatagcaaagtctcgaagaccaccgaatatcacagtttttgcaacccttcatcacaagcaattacaaatgtcatgctggatgaaaaataaacaattacagcatatatccatgaaaaaactaagaattttgtgaggttatggaaaccaaactagaatgggatgggggaaaaaatcagcataattacttaaattgtttttaggtaatgttatggcttgatggtatagaatatttgagtccacacctttgcttttctgagcttttcaccttagcagtattggaaatgctgacttcctttgatagtgtagtttcctttttcaacaactgtagtggttctggttcagtaatacaccatgaatcagaaaattaaagcattgataaaatttaggaatggaaacagtgttggaatcgaacaattttcctttcaaacctgtatctgttttatgagatgtctccttgtgttttgcagtagaagtagcatatgcttcatttgttgcattggcatccttggcttcatttgttgcatcagcatccttggcttcatttgttgcatcggcatccttggcttgcacggcttacaagcaaaaacagccaggcaatcaaaatctcaatcaattgaaattcagaaccaaataccagaaatagaaatttaccattctccttcttctgtaaacgttccttcagtggagcacgatgcgttgctagcttaactctaatttttctaccagcaacagagaatccatccttttgctgaatagatcgctcagcatcttgaacagttgcactgtatcaatgtaaatatgtcaaaaatgtataacagattacgcgtcagttttatgccttatgcctatatattttctgcagaaagatattcctacatgaataatcacacgacacatctgtaagagaaacaaaaagatcgagctaaaccaacctcttgtgatttggtttgtgcattagtacagtacataacatatggtgaaagcttcgtgcagtaacatacttgtaataagaactatcggtgtggggctaacttctgtgagggacctgataggctggtattaaccagacaccatcactagagacactgaataaatgtatttccgcttagcattaaacaatttgctcactagagcattacactactcacgatcaaaatcacttctcgaattctggaattgtggcaggaaagggaaacacatttccatcggaaaacaaccagaaaagcaagcaatgaaacttacaattgcacgaacccaaagcctctgctcgtctctgaccctgcattagaaacaaacacaaccaaattactccctgctaaacagccattgaactcactgtcactgaattctcatacctttcggcgcgaccatgaagcatcgcctcaccggcccgacctcgctgaacaccgcctcgagctaaaaaaaaacagcaatacacaccgcgtatcacagcctcgcagaccgaaacagcaaaaaaatgctagccgcatagcttcgcaggggataaggctttgggattggggctcggcttgcgcttacatcggaggacttgaaggtgtacggcaggttggagacgaacacggtggaggggctgtggcctccggcgccgccgccggtggccgcgccgccttccgtggctgctcccccgccaccgccgccgccgccgcgctgcttccgcttacccatcgccggcgtcgtaggggaggaggcgtgtgaacaagctcccgtactcgacgaggcgagaggttttgttgggctaggccgctagggtttatagcttagaatgggccattgtttttgtcggaccggatgtcctagcggtgtatgcttggtttgggcctgtttgcgttaagtgcaaaaaggtccactttacgtccctcaactaatggtcgagtgctcgagtttcatttacatacaactatatactccatataaaaaactacgatggtgatgggagtaaatctgttattctacttgtgcttcttcggtttttataaattgccgcttgatattttctgatactgtagaatattctaatatttgattcaagtaaataccatatatgcaaataagcaaacaattacatgcttgataaaataatattatgctatgatattataatatattttttatctataacaaaacatagacattttctagtcaactataaaattaagtatagattgtcctaacttctaaaactagtgttaatcgagccatcaatattaagagtagtttcaactgacatgatgcttatcaaacttctaggcaccatttaaaaaaaaaatgaaacttcatcaacatttcttaataataccttttcattaaatcttcaactttctaatatcttatccatcatctctactttcgaaataaaaacttggttctgcatatcatttttcagcaactttattttttttccgtaactttataacacaacagccttgagacatgtttaagggagcttttggtagctgaaaatttttccagaacaagaaccccgcgcacacacaccaaacggtctagatttttgttcggattctgataagttgtagttgtaaaattcagaaaataaattagaaaccataaactaaaaaatcgctccgctgtattattagaagtaacaacttctcgtaattttaagttccctgaacagatccagacccttggattatgaaataaccaaggtcactaaacacaccctcatctaacgggcaggcagctcgcccgtgacgcgtgccgcgtgcgtgactgccagcagcagcagcaagcggaggagaggagagacgcgccgccgccgccgccgcctgcgaagcaaagcggcgagcgagaagccaacggcgcatcaaagtgaggatatggagaggggcgccgccgccgcaggagcgctctcatgcaccttccgctccccttccccttccccgacgtccccggccgcgccccattggcggcctctcctcggcttccgctcccgctcccgctcgcgtggccggggctggggccagcgcgcggtggtcgccggggcaccgcggttattcctgccgccaccatgccggcgcttcaggtagcgagctccctgctgtctcttgttcccttttccttgtcctccttgtctcggttgggattgggagtattgctcctgcgctcgcaagctgttcgatgaaacgcctgtgctttttgggggtaagtgatgatgccgtcatcttaggaatgggattaatcgattaggacactttatatagtatggattaggactggcaactttggatcgttgagcctgttcaatctcgtgccagtgaaatgttaactttgacagctagtagctttgctatggttggttggaggcttggagcattcggacagttctttgtgcttgtcttaccacctttccgggtttgacaatgtacattaattctaattttggatatttcagtctagatactttgagcttctagcagatgatgggcaaaagctagaatttcgaattagctgcgaggatgaaaggggttaaattagcatgtctccatgtcaagtactttcatggctcaaagttgcgggtggcttgttgcattttactggtttagtaagtgtaacgttaaacttgtgcggaactttctaacgtcaggcaagaagtatatcttgcccaagtctagcctgttggcaggtgaagccaattaaaattaaagagattatgtggaacaactgtgcccattggatatttgcaaacgaaaaataatttgtgaataaaacttttatattacgtgttcttagcgatctaaaagcaaagactgaaaaataaactttgatgaaaaaacctcaaaatcaactccaaatttaaggttgaaaattcaaattttggttgataagcataagcgaaaagatgaggccgtatatttgacgtgttccccatgtaaggctcactattgcggtattgccatatgatttttcccactggtaatcctaagatttcaggattttatttctctcttacagacctcgcataaagctatggtttataatcacatcaataagagtcgatcttttatgtttactgctgtaaatgcttaataatgtgaacttggtttctcatttaaaactttaaaatttctcttacacacttgtagatactgcagtcaaagcaagcttctaggcacgaacaaagggcaaaacagatgctcgttggcaactttcagctcatttggacagtcagggatcagtctgaacaatgaagatttagtgaaagataagctcctaatagattgtggggaagatcaagattgtgtgattggtatgcactatgtttttttttcttcagattatttaagtttcatacttgtgtgcttattttgcatgtaaaacctataccatgcacctccagtaagtgataattgcatgccaaatctattatgggcagctcatgtccttttctaaggctgcacatatactttcttagaaaactctgcacaaatcttgcatgaggctaggattaaaccagattttcattgggtattcaatgcatgtttcagatgggatagttgccttgggaaagtttgatgcccttcacattggccatcgagaattggcaatgtatgcttctaaggcaggaactccctttcttctttcttttgtgggaattgctgaggttcttggctgggagtataggtgagtgtaaaagaggctattcataatttcccttggtaatcattagccccaaataactgagtgccttgcttgtggcaattcatgactgctttcctttcatgcaggcctcctatagttgctcagtgtgatcggaagcgagtgctcacctcttgggctccatactgtaagaatgtagtgcctattgaatatcaagttgagttttcaaaggtcaggtacctaactccgcggcaattcgttgagaggttatcaagggatcttaaaatacagggtgttgtagcaggtagaaacatgttgtcttcctcttgtaggtgcactatcttactgtattg

SEQ ID NO: 55312 - DNA, 797 bp, Oryza sativa
ggcgcggtggctactggccatccggcgacgacggcgtggtggttcatcggccgatcgtcctcctcattgttggtaccaatccttgaagtttgactgctagatatatattctgattccagatattctgattcatgatcgcttctaaatctctgctatcctttcccccttttgcagtgagccaggcgtacaagaaccgtatcaatcatggcagaggtttccgggcttccggccgtaacctggaggcaaaccgtccaacgatggcagctgctcacacggatcctcgatcgacgatggtgtctagtcaatgaatcacggccgcaacgcccggtagaaacgcgtactgcaccatgtcctatggttatttgatttcaggttcagagctaatatcgatctgccaaaaatcagaggcgacacctaaggcatttgttccaacctcccagagaactgaatagattctgaattttttagcaatatatatatctacctcttatttcttttttctttatttttcgatcgactagttgattttgaatcatgtgagcatgagctcatatatacctcttgttttttgtatttgtagatgaattttgtatcatacttctaaatttttctcgtgaaaaagcatataatactgcacacatgaaaagctatatatggtttatctaagtaatagtggtacatactactaaatctaagaaatagtgtatatacttatttaagcagtatatgcatcatatatatactgaagaaaaaaagagtagtatatgcagatactgagcaaacaagaaagcagtatt

SEQ ID NO: 55313 - DNA, 1511 bp, Oryza sativa
tcgacagtactacatggttcattgcggactctctttctcatcgcataatattgattcttcacactatctattttccgtttctggaatgacaaatccttttgctttgcgttgataactttagccttcagaggattggaagtggaaagatcattctcatactcaaccatacgagcagaagcttgtgttgagatctctgggtcatatagcagagaattccaacgatcctgtatttctttaagagtgaatttacgggagaaacatacggctccttttgccaaggcctccaatgaggcaccagtctacaagtatcataacaatcagttaggaagagatggggaaccattcacaacatcagaattcagaacgaatatgcagctagacacttaaaacttatatgaagaatgtctcacagataaggtttgcctgaccctgcagactggagattaactaacttcagatcaaattttcctgaacaaatccctagtattcaacatgactaactcaggattggagtactaaatatctcgcatacttcatagataggcataataatgttaatatgataagcccacttactatgattacaaggtcaagttgccatgtaagataaaacagtattcattgtcttgagttgcaaagctagttaatcacagaatttggcatggcactatatggaatgtgttcatataattacaggtaccaacgcatgggattaaatagattaatcagggcagtcttgtacaaaaactatagatcaatcacaccatggtaggtgcatacaagacctaaacaatttgctttatttattgaaaataaattcaaataaaacggtcaaaaactcttgcagaggaatataacactcattattatttcctccaccacataggatctacctgcagacactgagtatgcaaatttctcccaagcaaaatgtcaagcgactggtctctgtgtggggtcaatagaaattgcacccggtggtgtgtgtcctgcaaacctgacccggttgcacacgcgccacattaaattcttggctagatgatagcagagccactgaactgctatgaaaacaaatccctatgctgcttcaagattttgattccccaacaaagcgattcagtacaacggtgttcaggactccgcacagggaataaccacccaaattagatacggactaacagctgagcaatttcgcaaggccgagggttaaagtgttaaaccctgacgacctgactatcatgacaaaaaatttaaagaaagaaaaatggctccgtcgacctccgccataaacaacttaagaacgaagcccgaactctccaatcgaagcctaacctaagcgacgcggcgagacgaacagacttcgagccgccccgaattgtaagggaccggggcgagagaggggagggggggatcgtctacctcgacggcgttcttgaggaggatgtcgtcctcgacgagccagatcgccgacgacgtcgccgccgccaaggcgcccatgcccaccaccgccg

SEQ ID NO: 55314 - DNA, 2964 bp, Oryza sativa
  unsure (1)..(2964): unsure at all n locations
ggttcttcctaggcctggctgtagctcttgtgtggaaaatctatgtgtttgcgtcccctgtttgagccatgaaattcttgttgattgctttttcattgccctgggcactgctactagtactagggtcctggcttttaaatatttcctgtatatataccttttcttcaggactcagcaatcttgtttgttgtgcaaggcctagctagcctctatatgaaccgaagcttgtagttggccaaattgtgttgtgcttcaaattctcagggcctttgcagtgctgttgagcatcttgtttactggatgatcagtttgtacagccttgttccatgcttcctgtattacttgcttgaaaccatttaccttgatccagaaatgaaatttggcttcctttttggctcctctctcatagattaggttgaaatcccccaaaatcgtcaatgtgttggtggtggtggttttagggatttcaactcatccagtaaatctggtttttcactgtcttgtgaggtttgaaagaatagttgtctgtattcatgacattgcactgttatgttttttttttttttgcagtactatcactctctcatgaaggaaaagaccatatgtattaatccgcataagcttctgctgatgactatggtaacacattattgcttttgaactagctgggggtgccgcaacttgtccttttgtctcctcttctcctaatgttaactctttctaactgctgtgtttttaggtcgaagacactattaccaagaaggttgccggaaacatatgctctagtctcagcaatgctagggtaattatctcttctttctctgcctcttcaagctgagggccgtgcatcccgcatgcatctaaaatgcttttattttctaccgtggtaggcgattggggctggaatctgtagtttctctacgtctgcgccaaggggatatcgaagggccttctttacaaactccttcgaggacatggggattctcaaggtaaaagaaaagctctacatgctttatttttccacaaaggtctgtttatgcgcattaatgttctgttaaatgcaggatatggctttggttctccatgcagctttcaaaggctggaagacgaagttccaggacatcccacctatgtaagtccgcaactctttcccccttcttccttttgaactttagtcgtagatagttcatgtgactggattttttggaacaggaaaaagtatgttatgctcctaggacttgcttgcttgactctccaccttgctcttcattacaagatgaagaagatggagactaacctcaagcaggatatgatcaagtttcgtgctgaagtaaagctggagattgaagcagcagccaacgcgatgcagaaggagatcgcctcagagcttgctaagtctgctcaatttagggcagattcagtggttgcattccagaaatgcaaggctcgtcctgatgtgtggtcggagtattactgcctaacattgctggaggccctcatgaggtccagaatcgatggcaaataggtacgggcggtaagaagtccatattattctgttaaatatggtgattttgtttatgagtccattgcaacagctactatggaagtactagataggatgggaaaaagtagttccttgtctttttatgccaccattttgttggttaatagcttaatatacatgcattcgatttaatatgattgaagctctatagccattctatttcaaatagatcttcatactggtagatcattgtgttaaacttttgttctggttcttaattttcttgctggagtgcttattgaagcttgatcttactcttctccgcagactctggattatcactcgaactgagaaaacgatgatcgtcactcggagcagattgtctggtcacttggtgccttggtggttgtcaaatctcgttgtttggttagtttctatgacagtttgtgtgtggtcataaagggatttagatcgatggggtacacgatctgcatgtaaggaaggatttttacgagtggctatactcatcaattttcccagctcaattcatcttcttattcagtacatccgtatacttttgctatttgcatctactgctgctgcatttatatttgtcaaaaacgatatttcagctgctttttttttcttcaatatgtcgacaatgagttttttttcccctctttcgaacttaattagaatgtactccctcggtttcataccatgtgtcactttaattttttctttcagttaaactttttttaagttcgaaaatgttgaaaatgttgctatatgtntctctaaattnggttaaaacttaaaacttaaaatttagagaaacatatagcaacattttcaatacgaaacaaacatactatcaaaatatattcaatattatatttaataaaactaatttggtattgtagatgttgctaaatttttttataaatttagtcaaatctaaataattttgactaggaacaaaagtcaaaaagacttttataatatgatatggagggagtatatgattttctattagatctgcagtcggagtatataggtgcgccaatttacagggattaaacatttaaacctacaaataattactgttttgatcttttttttctcaaagattaattttcattgatgtcagttgtgtgagtcattcggacgcacatagaagtgatcaacggatctcatatattccaagcacataaaagtctcccgtagaatatatttatttattacagctcaagtaacaaaccgttgacgacacggacgagatctctgtgtagattatggtgtgcttactagccttatctttttggcttgtactaacacgtataagccaaaatttaaaattttaactttaaatttagagttaatattgggagttttcatcatacacacacatgaacatatatatatatatatatatatatatatatatatatatatatata

SEQ ID NO: 55315 - DNA, 1098 bp, Oryza sativa
tgtgccaccgtgcggccgggcggatcccctagctgacgtggcagctacctcagcgccaccgcttcgggcgctgaggtgcccaacctcagcgccaagtaagttggcgctgaccttggctacttagagcccggccgaggccgccccagccagttcttcctccgttttttccccagccgcccgcctagggttcggtcgccaccacgttctcctcgcccaatctcccccaaaaacctctctaatcgaaggtgatttgtgcggcattgagtttgggatcggaagagaaggtaaacccctctataaaccctaagttccccaaagttttattggatattttgcattgttttggttgtagacgtggtttgataatagttggctaaggatggattattagatggataatatgggtggggatgaaatgtggaggtggcatatctttatccatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtggtgaagggtaggtaatttgtaggagtagagtttttttttatcaataatgtgtagtatttgagtaatgtacttatttattggaaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattggaatgatgagtcggttggtatgcaagggagatacgatgtgggcggcggtgtcatgtcacataaatttatgttagacttgaatggagagatcgaatggcaaacatatatagatatagtattggggtcacatttcaaatctcttgaggtgtttgcatggaagaaagatgg

SEQ ID NO: 55316 - DNA, 1227 bp, Oryza sativa
taatactccctccgtcccagaatatagactacgatgtactaggtgatgtcctatctaatcttaggttgctatattctagtacggatggagtatcatttatctgatctggtgatctacaatactccatttccaaatgtagtactttatcatcaaatactattcgtttttaaattttgaccatttgtcatttttgccaaaaaaaatgtaaatatttaaaaagacttagtattattgaagtgggatacaccataaacattagcattaagctttattcatcgtaatttgaaaaaatattagtggtgaaagttgaaacggtggcggccaacggtgctaagtattattcggggaacctaagttaagcaacagtttcaacaataatatataccacttgtttggacgattcaagaagagacataagatgatacatgcatgcaagctctcacaaattcaagatgcattgagacggtgagacgtgagacctgaggcgttttattgaattttcatagagaattcgttcgttagtacaaacaggaaagttcagatgcgttgggttttcaagaaggccattgagtagagtgttcgtctacctctgaattttcaggaaactttaccaggcctggcaggtgtacccaagccaggcagaggatctcgtcgcgtgatcttctcttctggttgggctcctggacccctggttcttacaccgagctgttagccatcacagcttcttctcctcgggttctgaaaaggttttggttatctatatttataatatctctatatattgccaattggcgtactggtagaatacaacttgtacaagcctctgtgttctgaagtctgaagcagacctgtactggagcatctgaccagtttaggggaggtgagatgcacacaagacgacagttcatgtctcagcatgcaatgcaatgcatgatttgtttgtttaatggcctcttatttacatctttccagcagttcgcaagcaaattaaacttcctaagcacacccttactgaatgaacaggaggattgtaggttccctgcctgaaggtctgaaactgacggtttgcacaacgggagggtgaaaatgggatggctacccgcccatctgttaagctgtgtgtgcaatttacccttatcaaatatatatgaaaatatattttaaatccacctacaaacgtgatgaaagattggttaatcgttattttacaagctcataagtaatatt

SEQ ID NO: 55317 - DNA, 8036 bp, Oryza sativa
ttcctgcagccctgttctacagtagttcgttcgtttgttgtgaatcgaacggctaaaaatacttccaaagtcagagcagtagagctctcagatgatccaaatccctcgcataccacccccggcacgtccatagacttttgagacatatttgtacttcctaggccgagttgctgagttatgatctgctcccaaccggaagcggcccatctggcggcccaacccgctccgcattacgcatttgcactcaacgcagcgcgacgcggcgtgtcgcgcacaacacaacgacagcgcgcgcattccacctcctccacgcctgcacgaacgtactgtactccactactgctgcgtcgcactgtgcattccaccgatacggaggccacgtcgccgtccacctccgaaagctagtagtattactgttactgcgcgcgcatttacacccaccacttgctctcatttactccccttcacctgcccaccctctccctcctctcctccctctatttaacccgcaaacgacgccggccaccattgcaccacctcagctcgcgccgcggaacacgagacacagagagagtagagatcgagatcgagtgctaagctagctagagtcgacgatggcgaagtggtgcagcttcggcgtcgcgtcgtccctcctgctctgcctcgccatggcgcacgccgcggcggcggccagggccgtgcccggcggcgacggctcgacgacggcggcgtcgctcccggcggcggcggcggcgggcaccggcgcgggcgtggaggacaagaagaacctcttcgtgggcgtcggcggcatgggggacctcccgggcttcccggccgtcggcggcggctacggcgggggcttcggcaacaacggcggcgccgtcttcagcggcgtcaccggcccgctcggcggcgtcgggggcggcatgggcagcgtcggcccggtcggcgggttcggcggcgccggcggcggcaccccgttcggcgggttcggcggtggcggcgccggcggcgtcacgccatgaaccgtagtattactgagagctacgtacgatctcatgcatctacgtgcgccgcgtgcgtatatacgcacgcgtggtgcacgtgtagtagctagtgtcatcttttgcttttgagtgtcgatctcaggtgagttgcatgcatggttgggcagggaggttggagtttgtaaaagtttgggtttgtggcctgatggcaagagtcgagtttactagtagcttctagtagttgtgtgctaagttaattgtgtgttgttaagtgcacgtgatgcatgcgagatatgatgactatctttagttaatgactaaatggtattcatgtcgtgcgtgtaaatgttctctagtgggaatgtgggatggcgactcttacctgtttcatggcacagcactggaactggatgtatcccccacaaacgatgtgggctcaggctcagagcctcagacaccatatgcatgacgacgcatggcatagcaaagcaatatgccaatatctatcgagcatgtacagcctgagcaaaagcgccatgaagcagctgtgttcttccccatcttttgcaactcatctctttacttttcccgcgtgcacactttttaaattgttaaataatgttttttttaaaaaaatctatactaaagttgttttagaaaaatatgttaatccatttttaagaaaactaatacttaattaatcatgtactaatataataaagattcgttttagtgcgcgtaggattagttccaaacaccacataccaaacacccgattcactcattcacagctacagtgctcatttgcacaagcatgatactatgtactagtaggccaacttaattaattacacccaatccgtaaataaagcatactctatattgctgtgttcactacagtactccggcaactagcagagtactgtacagtctacatcgagatgggagtaggagtttgtaggtaacgtggcgatctcgcgatgaaattagggtgtgttcagttccacgtcaaaattaaaagtttaaagaaaaaagttaaaagtttatgtgtgtagaaaaattttgatgtgatagaaaagttgaaagtttgaagaaaaagttagaaactaaaccagaccttaatcgcgaatccacgatgctgtttttggtacgagggggtagtggactagtggtacgtggttgctcacttgagcctgctagacctagaggagtactactcaacttcaattctgatgacagttgacagcacggccgtgctgcgtgtgctgcatctctcgttgcctccacatcatgctgcagcggatgagtggagcgatccttggaccttgggatctcgaaggcaaggtcagtagtcgcatcgcaccgtacggtcccggagatatggtactacagtacatttgtaaattattggtcgctttgactttttcttatagtgtttaaccatttatcttatttagaaaattagtataaatataaaacagataagccatacttatagaacttttaataataaagcaaatcacaaacaaaataaataataattctatgatttttttttgaataagacgaatgatcaaacgctacaaacaaaaactcaaaacgataagtattttgggacagaggtagtacattagagttgctttcgaggagatctctctagtactcctatcccacagcgccaagctagccaagtactttctccatcccaaaatgtagctgctcagtacgggatgtgacactacctagtacctgtccagattcatggtattagtagtgtcacatctcatactaggcagctccaggcatgacctcacttgggctatggagattcgatatggctgcattgattgatcgaatcccgcctcgagatctattcctatctcatctcatactcctacgcatagacgtatcacgtaggtgaaccggtcaagggatcagggccactccactcccctcgctctcacgccgccgctgcttggagatgttggaggtggagcaagcccgagcgaagtagcgaagtggtgtgccttgacatggatcacggtctcacggacgccattggtccacccgtcggtcgagctggtggtacatgtggctgtagcgcagtggctccggataaagcttgggcgtacgccacggcggctggcaccgcaagaggcgccatttatgacttggcagcacagagcgggcagctgagccgagagtccgcagatgagagcaggcagctgagacgcagcgtacgcgggtggccttaaatttgcggcagagctgaagagcttgcgataagatgaaggtagaatcaatgcactgcactcatcaggattggccaagaccaaggttggactcggcagtgcgtgcggattggccctggcagcaacggacccatcgggatccatcaggatttctccccagtgtttgcctccgcgtgccctgcatgtgccgaggtgcagctgcagccattgatggagggaggcctagaacaagcctctgggctctgcctgttccgggacgcaccgagcaatgcgcggtgcacacgcactaatgcactgcaccagctcaacttggaatggtcttgcattcgctgcagcaacacacctcgtcggtccttatctactccttgccaactcttcatccaaaacttgggtagctatacgaatcatcacggaaaaatcagatgttactctgtttctacaaccacgacgttcaagaatcaagactgaaccatacaaaacatgctgacgaaaacagaaacgagcttttatgtttcattgaggcctctgcttccatataagatgctgaaaaatagtagaaacgtgaattttctgtttcattactaccggtaacttcttatattagcaagcagaccaggaggaacggaggcattccgggggcaattaagtgaatctaatcatcatataataataataatagaacaaggaggttaaaatccaagctatacacacatagcatccaaaaatacacgacacttcaacccacaacccactgaccgagtcaccaaccagcattcaacagacacgacagcgtaaacactcaggcgccgtaaccagccagagcacaaactagaaagaaccaaacacctctccaatttccccccctttttgccccaagcaagcagtactgtaagtgcagttgaatgagtcaatttatgcctacttgcatttgaatccatggcacacggacaggattatgataaggatgagcgcaattattatgccaagaacaatcagcttgatcttcatgttttgcagccacatctttctccttacctgtgttcctgcctgcctgaaatcttgggcctgcatatgcccagaagcaaaaagcttagatatattgttatttcagacatacagaattgcagcataatttcataaaatcttttgttacggaaattccggctcatgcttagtaaattacaacatcaagttaatctttcttagagccccaaacttagcaacattcaggttagccagaactaatacaagactgttaagatacacataaatttagcccagatggcacaaaagccaaaaacttcaatatccgacgtggaacaccactccataaactatcaataattatgcatcaatattcaagtttgttccattcctttcacaagctcaagaactctttcagaaatgatcgtaaacacctctcagtaaaaactgatactaattcatgaccaatttttagtggcaagaaataataatttgaacaaatcaccacgtttaaagtgaaaaaagtagcacctagacaccacctaataataaccaaaggcagccagtctgccatcaagttagcacctcggtgaacactggaacacctaataccttgacttgtgttttaccaatagaactatgcatccctaataccatgacttgtgtttttacacattcaacaataacaagagtaatctaccccactagttaccaccagggtgctagtgactagtcaaaaatgaagcacacacccaacgtaaatttgcatccacttaattgtgtcattttagcggtatttagaaatatttggcatctagtaaggaaaaccaactgcataagtgggtctctactctctaaaagacagtattgagtagcactaacaataagagctccaaaaaaaacttgaagtgcaataccaggtacagggcaggctgaaggaacatgtcaggacctgtgaacgcagattctcggtcttgtcaacgagcagttcaatttctctccacgatcaagaacctgcaaatgataaagcaagcatcagcaagcacttcttcaaaggagaatcctcaatgttctgagcataaaaactgtagaacgaatacacaaacacaaagaaaacaaataccttctcaatattttccatcataactcctttgacttctgaaacttgtgccttcactttcgcaagcttgctaatctcttcaggatgatccacacagtactgcatgtgttctttaagtttcgatctacaaatagtaaatagagaagtattagtcgaagggaccaccataactttatcgactctatccctggcaacaatacgtacccaaaatctcggttgaggctgttcgcagcagcagtagcagcttttccaccagcatatctttttgtgaaatcatccttaactctatccaagaatgcaatgggaatctgccgccctactgattcaacagctacgacacagtatgctgcagaagaagtgtggtattagaaaatcaacgtcacaggctttcaagtgataaatggttaaagtaaatcgtaaaacgggtgctctcatatgagatgttaacagaagatacaagcacgtgtgccaaattttagaaatgtggtaactgtgccaaatttgcaaagctaagatcatatgggtataaaaatcagctacttaataaattttccctgctccttattggaaagtttttcaagcactataatcattgatagttggcaacatgatacctcataactaacatattactacttttagtcatcaccaaatcgtggaatttctagcattaatcaccatggcaactccaggtcttattctgaccaaagaaattataataagacatttcagcactgaaactaaactataaattgcgtgcataatagaataacaaggtagcagccgatttcattcaacgcgctatctgcatgcataaatatgagctgaaacttgacaggagcagcatgcaaagctcacaacagctgtctactaaaaatagcatgcatatctagagggctcgccattgactaaatactctaaggcactggcttacggctttgcgaataatcggggcagacctaaaatccaagctcttacaccatagctctcctatgcatacagtcagtccagggactaaaaaaccggataaaggtgaaaaaaacaatggataatcatatccacttcgatacggcggaactattgaaaggtcctaatcccaaccaacatctgcatctaatctaaccaacaagtgcgatgaccaaacttctcgcacgaactccacagcgcatcacgatctcaaccaacatcccgatcgccgatgctaaccaaaacgaaaacgacctaaccgcgtctccaacaaatcagcgagatctacacccaccatcccaaatcgagcacgcgcggtatcagatccacgcagatcagatgcactccgcggggaatcgatcgggaggaagcaaaaaggatcggacgggggatgggcgagaggggaagggaactcactgaagccgtcctccacgaggtagttgaacgtgtggccgtcgcagttgtaggtgaacttgttgttgctcgccgggagcttcatgaggcactgggaggcgatggtggtgaagttgccggtgaactccgtgtactcggccaggatgaccgtgccgcgggccacgaacgcgtagatcagcgactgctgccccatgtcctcctccctctctctctcccctcgccctccgcctgtgctcgccgccggtgacgtgctcctcgccgccggtgaagttggcgaaccctagggctagatctcggcgaggtaggagaggggagaagaagggggaaaggtcggtttcgctttgggtagtgggaggggaaatgatgggggtggaaatgggaaaagaaatcaaatttggttggtggaattttcaaaaaaggccctttgtttcctttctagttaagtataggcccctggccgccacctgttttctttgctgttaagcgattgatattagctggcattttggactattgtttttcaactttcaagttgattatatgacctctacgtctggtattatttttctctttgttgtgatggaaatcatcggtaggttacaccgttatagctgccttgtaattaatcaaactaattgatgggcaccctaatgacaattttgaaaaggacagatacagtatttcatttttagccacttgttcgttatttatgactgatgctcacatccacaaaattttcttttgctatggtcaatgctctagaaaatagtatatgtgttgtgaagctgtgatatgtctttgtagctataatgggaaacagagttataaaaacataattggaacataggaaagttatccgggttgataacagcaaaatattaattgcaaatatatgtattatattaaaaccttatgatgtagcacgtgtgtaaagtttaaaaaaacattgttctatatatattgtcacacttttttttaaaagttttcatgcatcctcgctcctctttttttgcttgccctgttctctatctctggtgaatcatcaatcgtagtagttgccacttttttttagcatgcgtataaacagattcctctaaactttcaatatcatccatcgatcctcaaattctggaaatagatagaatacaaaatatgtgcattgaaccacggtaattgctggctaacgccgtgtttagttccaaaatatttcttcaaactttcaacttttccatcacatcaaaactttctacacacataaactttaactttgcgtcgcatcttccaatgcaccaa

SEQ ID NO: 55318 - DNA, 5959 bp, Oryza sativa
aataaggtggtgcaggtgcagctcttaccctcctacattgaaccaccagctctctatatttgctaagttgcacaagtttcaagcaaaaggaagatttgacaaagaagacatggatgacaccgatctggtttgcccgtttctgtttagtagtgttggttgatcaagttagtttggtgttttatttatttgcttagacttagctgagttgacgttttgttcttagcgtttctgtgtgcagtactattttgtgttcacaagctgagatccccaatatttgaaggactagattatgttagacatgtagtaaagcttgatgtatgttttttttatctaaaaaacgatattcttaacggtgaattgcaccacttctatacagtgatgtttttaattcgaaaaaaagaaagccactacacatatgaaactgttgtcttactaccgtccgaccgcgttatggtgagtagcgttcataagcgcgtgtcaaaatttatcacgacgcaagccatttactcttgagatgattattactccctccattccgtgatttagggcgcaactatatttttttccacgtaccagaatatagggcggcacctcctcaaatcctattcatgtgcacggatgcatgtaggctttgaagactttaactcttggttgtcctatgcatggccgcatgcgagcattgaaacatgtcgggacaatgttgtgattggtgctgcatgcatgcgaagcaaagctacgtgttgggacgagcaaactctaattgatttaacggataattacaccactctttggtctatgcgtacaagacagttacgctctaatgctctatatttaggaatggagggagtatatctctgaccatacattatagtagcagattatatcattttgaagaaaaatattaatgcactagcaaaaatagaaaagtctcaaccggagttgttcccctcaccaaaccggtcggtcggaccgaatctccgatccaaccgcacggtcacacggccacagctcccattccgaatctccgatccgcacggggtagaggtaagactagacgaccgcgtccgccaatcaccgcgtggccaaatcccgagcacccccctcttctcttctccccactgtttttaattctccacggctcccttccactccatccactcttctctaaagcgctctctccctctcgtcaccgctactactagtgtacagtgccactgcgagctctcctctccgcccccgatctggtcgcctcgctcgcctcaaaccctagagctccatccaccggcgagccctcttgggcggaggtgcttcattgctgctgctgctgccatggaccccgcccccacgctcgccgccgagctctggcgaacgccgtacctcggtggcggtggtggtggaggaggaggagggcgtgggttggaggcggcggcgtccggggtcacggagcagagcaatgggagccgcgggggtggcggaggaggaggcgcagggcggaggaggcagcgggaggcccccgcgctcgaggacgactcgtccaggatcgtctccacttccggaggaggaggcggcggtcaggatttggtaggtttttttatgctccgcattggtcgtgatccgtgtggcattgggtgagtttgggggtaattttggtgtgtcagccttcggtggtgggaatctggaggtttaccagggaaaatggcggctttagactgaagtaaatttgcttgtgcgatctggccgtgtctactattggcgtggtgctgttcatgctttcttatagctctagctgggttccccgttgatgcttgtttttgatttggtaatgtacagtggaacgagccaatctgtagttctggctgcagatagacagtcactgctatgataccagtatgtaagaaaaggaattctcagcataatttagtctcgaaagttccgtaaattgaaaagaacacagaatgtgcacacaaagtgcagtaaggaaaagctagcactgtcaatagtttcgaattctataattagcaaatacctttggtaattgagagttgagaagacactttgtcaatgctgaatgcagttaggcgtaggaacatggggtgtgtcctcctcacgtggaaggcttcaccagatgaggtttcaagccttttgatcgatatagtttcctctggattgcttgtggaattacttctacatcgtagtataatatagaacacaatttattgttcacagctgggctgagctcagttgagagtgtcatgctctgttacacaggaaaacatggaacaagcttatgtgcaatcgttcatccatgtgactttcatattatagaatttctcattcaaccataagtagtgtttgacctttagtatttataaaacctggagtattagattgtcggttttctattgttaacataatggtttcactatatccaagttgattctgggtgctgtttttgacaaggactacttctatagtgtttgcacctttgtaatgttctcaacttttgtcaaaagaaagaacattataagacattcatattatagtactagttgttagcacccagtagtgctgtagtttgcatctatagtgaatttcctatcatgacattttgatttttgttgcttggtaatgcttgttatgtttgattcactggagtgttggtagcatatgaactcaactctcaagctaacatactactatactagtttatttttcccacaaaaatctaaaaaattttacctctagaagaaatggaactagttttttttgaactacccatcgatgtgaatatggcatagagcttgatatttttcttctatacataactgtagccaacactcaacactcgacattatgttactgctggaatcttcttggagctgtttatatttgatcaagctattggccaacacccgtcttaactatccttgtcgaatgccaagtgcttagtaactctggtgcaatgcaacagcttttgggtctttgactaaattgcaacagttgctgctatctgttcacgctggttaaaagctgttgttagacagactattaaattctatttattatctccattctccagtactaactactgagtcaacaacctgttggtccacacaatgttttggctggagacaaggatcctgagtggttccatggtccaccgtataattgaggcattctgcagcaccatcagatctataaccctagaaattgcatgagctcaaatacaagatgcaatcagcatttctttgcttgcatttagtagccaaaggtgcctgtaatttgaatttgaacatgcacacttaatattagtggaggtcatcattgtcaggcattctagttctttgattctattggtgcatttctatgatttttgcctcatatattcaccaattattgatcatgttgataacttgagtggttgttttaacttttgaggtcagaaggcaatatacagtgccttttcccctttaacctttaaagagaaaaaaaaaagcatggatcatgttttgatatgcacggattatgtggaatttttatgagcagactgattcagaagcaaagcgtttcaaggcaagtaaatcaagtggagataatagcagtttaagaacagaggctgaaactgattcaagaaatgctagcaagtctggtgatcaaaatccgccaccaccagaaccaccaaagcaagactacatccatgtgagggcaagaaggggtcaagctactgacagccatagccttgccgaaagggtcagttagtgtacttgtttttgttaccgttcttgtcaatcacagtcccattacaggagtggaaaatctggttacaaatcgaacctctgaagatctttcttttttttggggggcaaacggtcaatttcatgtttatactatgatatgaccactgaaaattctgttcatttttggcaggcacgtcgtgagaaaataagtgagcggatgaaaattctccaggatcttgtccctggatgcaacaaggtctcaacatattttcctcattttgtcccataagttggggtttaaatattatatttttgtaacatgacctctaaaacatccccagttctgtttctgtaattgattttcattggaaaacttttgcttgcttggccaggttattgggaaagcatcagtacttgatgagataattaattatatccaggctttgcaacggcaagttgaggtatgctgtttcaccattggcgctttatgaaatttctttaccctccatatctcagctaatcgctctataatttgctgttatctgcagtttttgtccatgaagcttgaggctgttaatgctcatgtgaataatggaatcgaagcatttccacccaaagatgtaagtcaagtagtaaaattaacagtttaaatagcatgatcattattacaataaaaggtctcaagatatatttgaaagattctgtggcatactatgcgctactggcactttatcttagctccaatctttgactttgaacactgtgttaatatgttgtttttttcaacaagtcccatactctacaggcaagccagctatatgctactaccatatgttttagtttttgaaggcgttatccattgctcccttctgaaaattattaccattttattgaagctatactcctgaatttcaaaaacgtttaggcagggcaaggcatttaatatctgcagaggatacacatcattgaaacattttcctgatttttactctttatctaaccatggcatttgtctgtttgtttagttcaatgtgtttatgtatttactaagtactagtagctctgtggagctttatgtaaacttccaaatttggtttttagtattaaaattgtttattttcttttgggtcttttggttgcagtttggtgctcaggtatacaacacggctcctggattgacgtttgatccacaaacaccaagagaatacgcccagggatcaacaccatcggaatggctccacatgcagattggtggcacctatgaaagagtgacatgaacagaacaaagtcaggatggtggcccaaaataaagcataccatgagttcagtcagaaaccacggctttagattatttttcgaaactctcgtgctccaaattcgatttcattcatagcatggagctcatgtatttagagactgcgagcacagtatttttacatctgtaccgggatacaattctcatcagattcatgtattccacggaatttcggcaggtcacgctcattcgtagcatgaaagaaaagtaataaccatcaataattctcttgctataaatcctaaagcccttcatttttttttgccatcgtatgcttatctttctgaatcttaccagtagtttgttggtaatttgattactcacatttgctacttcgatcttcgatttgtgtttgtactcccaagtcaaagccatcaatctggcaaattttcacaggatagttccaacaatttgcacaaaattcatctgaactcgttctaagcgaaagaacagggtggatgaatctggagcaaaactgcacaaccagaactgaacctcccgaaaaccccgcaaaccgcacgccacgaatttaccatcctacccctgtatcgcagatgcgtctccgttccgtttcgcagtctgttttgcccccacgcgaaatctccttgttgcccttttcccccttctctcttctcccctctcctcctcctctctctctctctctctctactcctttcctctcctctctccttgccctcctcgcccccaatggttgccgcggccacggcgccacctgcccattccgcggcgagcccttgacccacccctgatctcgcggcggcggccgatccggcacccggcgacgtgtcccggcggcgatggcggccgcaacggcggcgatggcggccgcaacgccgccgcgggggcggcagcagcgacggggggaggagggggagggggatgatgc

SEQ ID NO: 55319 - DNA, 2663 bp, Oryza sativa
cggtggtggagctgacaccgaggaggacgcggctcccgcgggcgtgcaacagccggcccaaggtgcctccccctcccccgcccccgccgcggcaggagcgggcgaggccgccggcgggggcggcggcgggggaggaggaggagacgacgccgaaatgccgcgtggtgacgccgctggtggcggagcccgaggcgcccgcggagctgccgcggtggaggctgcgcggcatgtgggagctcgcctccgtcatcaacttcctccacgtgagcgccctcttgctccccctccccccactggctaggattcatggggtttaagggtgtttcgcttggggtgttcggtatttgggcttgacatggctgctctttctccggtgccgcaggtgttccggccattgctgaacattacggtggagttcacggcggaggagctggaggaggcgatcctatcgcccaacaatacattggatgacgttcatatgcctctgctgaaggtgatcgtgtagtttctgagttcgtttgattaggccgctgcgtcttagcctcttatggaatggggtttctgagaacagagtgttttttgcctgttataaatgcaaaaaagatgtgcttttgttgttcacatgagtattgaaactcacaaccaaggaattttggctatttgaatccaaaggtgcatgtagtacaatgctactatgatagtcaaacgtattgttatgatacatactgcacatttactacaacatactactaacatcatgttactctggcaatttgctaaggatatctttgtaagaaagtgtccttgatagctagagacggatataagaacatcactttgtagaataatgcacaacataatgccgcaaaatctgtttgagtcgcccatcatgtatctagtatgagtatctactaactacacattctataaacagttttggagttatcttatttttttcatacttaattgcatcttgcagtcgattcctccagtaactcgaatggctatgggacgtggaacatggataacagtgttatgcaggaaattgaagtactggtggaattgggtatatgattttgtcctttctaagaacattttgtgtggaacagtactgcattcagttgtttagctaataaagctagtactgcaggttgcagaaggtgatcttccaattgttgcctcacacgggtgagttccatacccaagcgattcttgattgaatcgatgtttagtgttgtatcttgaatgacttaaaccgattttccttgctcagtgcggaaattgaaatgtacaaggcacttgagccagcaacacgattagtgatccttaaagcaatatgtgatatacgtgttgaggtatgtgccctatgattccagctatctttttgaaatggtagaattgaatctcatagctaatgtcctatatcaatgtgtagtaactatcgagacctactatcttgccctagctgcttgtcttgtattacgtgttacatataattccctcacacccagcttcttagtggattctgctaggtattccattctacaaaggattagtacataagctatgctgtatttccagacacaagctctttttgtaaagtattttggtcttgatctttacactcaaatatattatgtttactgatgatgctttgttatatgaaagttgaaaacagtctcggtgctaaaaagaaaaggtgaagcctaatcgatattccaaaaatggctggccgtgttagcaattataaaattttataatttatagtggatccttgtgtaaaaggaatattaattgagcatggggcaggggcaaactcaacacttattccttaagattggattgagcacaaacatagctgcaagtcttattgttatgttttcaaggcacatggtttatttatgtattcttgcaagtttggtgacaaaatgtctgatctgtaagcatctaattttgcagcaagaggatattcggaacttcatagatagttctttaaagcgtggttatgagcttcctgtgttccgtaaagaacgtattggaggagattcatatggaatctcatactggtgtgcaacagccaacttttgatataattatgcaattaaatttaagaacatttttttgtggccaggagcatctctaatcaattgatgtgctacaggtatgacgaggatcccgtccttggacatcggttatatcgtgagattaggcaagtggagtatgagaaggacccaaccaaaaaagctaaagggaagggaatctcaaatgccccagttgtatcctatcaatgggagactgttgcatgcaactttattgaatttgaattagcagcagtaagttttgagtgaaccattaccatatgtatttctttattatgcaatctatgattgaagttcttgaatagttatagttcttctgttctccattgactcacacattataaggcacagtgttgattaggtcatacaaatgagaatttctttggatatccttagttaccgttggtacatggtattaccatgccatctctgtaaaatatatccagcagactgtaaaatatatccaacctccatacctctgtaccataactaaacagtactccctcggtttcatattattagtcgtttgacttttttcttagtcaaagttcgggctgcaggaat

SEQ ID NO: 55320 - DNA, 5104 bp, Oryza sativa
atctctcactgttgtttccgaagaactgaagcctttgtagttttcatcaaatccagcaaggcaagcagtgtattgtaattgtagatgtataagtggttactaactgaggtgataagatcgatgtggtaatttatcagaaacttgagattccttcatctgcctgtcctgctagttcgattatcttcaagaaaatctgagctccttgtttctgtgaaatcagctggttttgatttaccaatccattagcgaactaataccgtataagcaaagcttaagactcagactgaagggtattttggttagttaccccaccccactttaccatgcatgctttaatcatgccatggttttctaagagcaagtttaataatatagcttattactaaatccaaaatttaaatcatcatctataatcgatctaatagcttactcgtacaatagttagctatagaactacatcattaatgaataatccacccatctccctcacatagtttattggagctcgtgctatagctggctataaatttgtagcctgcatttgttctatcttctcttatctctcctccacacaaacacaaatctgatgtggcaacttatatagcccgtttatatcatcttattgtacttgctctaaaacacttgtttgctttgatgtcgtgattaacttataccatagagtctcatcgatcgatcatatttcctaataagttaaagtggcgaaataaaaattagcttattggtagaactttatatatttatatatttgttcgtagcgatttaaaagccagggctaaaaagaaattacgttgaaaatattttaaaatcaactttaaaatcaagtttgaaagtttaattttaacttttgctttgataatttttcaacttttgctttgacttattagaacaaccaatggctcgtacttttttagccttgaaaccccgacatcaaaatcttaaatctgaagccaactgtgtcacagttgtggctaattatttcttagggccgttcactttaatgctattttcaatcttaccaagttttagtaaagttgccaaaaaagtggctatatttaattcgttgccaaattttggtaactatataagaaattctgtcaaaattttggcaagttaccaaaattttagcaactataccaaaattttggtaaggttttttttggcatcaaagtgaacaggcccttagccacggttttggctagttatttctttgccacggttttagctttcaactcaattttttttgtttgaaggaagctttcaactcattcgctcatatcacaacttgcctaaggctctgtttttttcagtttgggattattataatccagattattgggagtaagctgaaagaaacagacaacttattaaagtagtttattataatctggagcccagctcattataatctaataagctcatttaggtaagctttttctagatcatcgggtgaaaaattacccaccatgccaccctactccctttttagacttgcaaacccaataatctagactctaataatctagaaaagaaacaactaatcgcttattctactacaaattataacaatctagtttataataatctaacacaataatctagattataacaatcttaagctgaaagaaaaacagagcctaagctagttgtgggaagcttaggcatcaacaaacagcccgtctctgcagcatttaaaggcaaggtacacaaccaggtctggtctggcgccgccaacgcgattcggctccctttttttctcttggaagttggaaatgagcaggacttcctccggttctagaccgtctccctctgtcgctagacaatgacgcaccgaaagaaggttaccgtggcttgtcgagtcgagccacccatttttctccagaatgcacgtgtcggtgtcgccctttctagaagaagagttttatgcagctcgtaggggctctcttttctttggcctctgattcgttgttaatttaatccgccgcaacgcaagcgtaagaaagcacaacgcatcagagacttcttgcccgaatcatatgcttttaaccacttgacctcagccgtagaaaaactagtccggatgcctagtgatttcttgttcttgtgcactcaattatatgattaattaatacagatgagaaacaaatgctttaatagttgctaatatttcaatcgatccaaatgaacatgatgctaaacacaagggcaaacaaacgcgaacaagctgcatacacaaaggataagtaattaaaggaggacacagtcgtttattaatcacactgataggacacagtacatatatatataggaagcagcagcagctgtaagcaataagctggcataaaacaattcgagaagcagattaatactgcatccttgatgaggacttgaggatcaagccgtgctgccgtgtctgtacaatagatgcgacctgaggccaagccaggtcgatcgatggatgcatccttagctgacgaatataatcgacgggtcgcagcagcactcgtcgatcaagcagcagcaacaaagcgcagccaaactgcagcaaaatcaaattaaccagacagttcgaaacgatggcacaagttgaggtgaatttgattggcatatagtagtaattcgaaaggaagaaggaacagtgaatgcttaccagccttcgaggaaactaggctgccgcctgggcggcggcgcggcgtactgcggcggcgccatcaccggaggcccctggtacgggccctggtagtagccctgcgccgggtaagggtacgcgtacttgggatcgctcatcttcagcttcctcctcttactacgaacaccaactcaaaagaaagcagatgcgagttgcgaactagaggaggtgacgcgatgaggaagaagaagagaaagaaagcagcgtgtggtaatggagcaggtggtattcggagagcgaaaagcttaacaagaagagaggcgtcacggcgcggctcgttattataggcgggatgtaggagagccgtgtcgcgcggcgatgggtgggcgagccgacgcggcgcggtgcggatggagggaggcatctggaaagcgcgcgagagagggagatgagatgggggtttgcttccgcgggaggcatcggatcgcaccggttttcctttccttgcggttggactggccacattcgtttcgtcgtcgcgttttctctgactttttttgggtcggtttccgtggcggctgcgatggcggcagtttggcctggagtacgtacgtgcgcgtagtgtgaggcgacattgaacgtgagcagccgccatcgtccgtcgtcgcacgtacggcggcgcgtcggcaacgaatgctttggaagaacagtgaacacgataggacgtcgaccctcctggaccttggtacacgaaattcaaagagagaaaagctgctggaccttttgcgttttttcccaagaaaatgttcgccaaaatcttgctgtattgccgtgttggcccgtgttcaactatttccagattcgaccaataaaccctatctgagttgtaatttttgcttgttccgactgcctcacaacataccctcaaagaaaatccacccaccggagtggcagttggtatttgaggtaccatacaggttgatgtatacttacaaactatcaatacgaaacacctccgctcaaaaaagaaaaacgaaacacctgaattttattgttggaagagcatatgtccgcagtaaaattccctcaagatttattactccctactagtccgtagtacaatccttttagcgtccatatgatctggcattctggctcgtggttctggctgccgccgacgtgatcccttcaccggttgtgacagtcaccgttagctcggaacttgggcgaattccgtaatcggattccagtttccattgactgctgaagagaagaatgaaaaaacctgtccaaggaagcaagcttcaagatcactttcaaaatgcaaattgaatagaagaagaaggaactgctcaagctgctgccgcggatgatgaatcttccaagctgtcatgagtgtcttctgaacaaggaggagcagttgattccttctcgcaagcttaggtttcaaaaaaagaatcacaagctagcaagcggtgacggcagccactgaaagtggccaatgcattttgaacacacagcgaatttgtttcatgccatcgcaattcgtaaatgtgttacaaggtaatcttatgggacataagtaaaagcttccgtcacccgacctttggacttcagttgatcactctcaacaaaatgtaaattttgtcatgcacgaattctcctctggaagggtctcttgctgaaattctgtcatgcacgaattctactagtactgtatacagtactactgtggagcaatgggcatgcgaactgaccactgaactgcttcccaattcagagtttcagacttggaatggcttcctggtgccgtcagtttgtttgtttggtccgattctttgtttagtcccatagtacttgcccttatatgataaaatatgattaatactctatgcgtgacttatctttttaatttttttcataattttgtcaaataagacgaacggtcaaacattggacacggaaaccagggtttgtctttttttgggacggagggagtatatgtcatcagtaagctcatctgaattcaaatacgaataaacacatggtacaaacaatatagaactggaaatcagtcagactaattgaactgcatttgcccccaacaccaaaacaacaagcttgcttagatcacctaagaaaggctaacaataagcttcagtatgaccagttcactacaatcggcataaaactctacaaaaatacatcggaaggccatgctccaacgtgtgccccatgacataaagcaaaacaggctgatattgagcaaatcttcactattgcacccatcgttttcagttgatagatcgatgtgggggtacctgaattctgttagctgttgcctgttcggttgccaatgagatgataaaaatccttttttagttctcaacctcatcacgtaaactcctagtcctacaaacataacgcacacgagctataaacgaaattaagggggtg

SEQ ID NO: 55321 - DNA, 12965 bp, Oryza sativa
tttaattccaaatttttattatttcctaattgtatttctatatggagtctatactctacttctaatattccttattttttaattccgaatttcaactatttctaaattgtatttctatatggactctagtctcctcatctaatatttcttatttttaaatttcgaatttcagttatttctaaattgtatttctatatggactctgctttttctttttctctgattaatgtgagaatttctaggccatgagagcgaacgtggaggctcctttttctattcctttaataatataatagatactagcatttggtccattacatcagcggtgttactcaaacttatcaaaaacaagaaacgtttttatcactagaaatgcactcaataatacctaggaaatataccatttacattagttccaagaaaaagtatcttttgcatttgactttaaactcaactattggggagagacatcccacaaatctttgaacttagatcgagaaagacccaaacgctggctgccaaggacgcttttcgcatataactctgaaagcagttatctcatcaaggaccttttttttggtgagacccagagactgaaccctggtcagcaaccccacaactaggtgggttaccaccgtgctgccattcacgcgttctcaaattggcattagacttgcatataagatacacacaaaaaatggtaaaagcaggaatatctataacaatatttaaaaaaaaaacagctacatatccaatatcaaattcaattttgcaagactgggtgtaatccaaaccggactgggccagttggaccaaagctgaggagacccaagttcatccctgctgttatcttccaagttgaatactccaatatcacgtctattattcttgaattctgttatccaattctggctgtcatcggtgaagtaggcatgatttgccttgagagacggaaattcttcagcgcggaggcaaagtgtctggttatgcccaacaaacaggacatggtcttgcaagcgattgatcttcacaagcttttcttccaccaagtcagacttatatacttcgatacttgcagtattcttcaaaatggcatcataatcatcttctgacggatgaatgtagtcgtcctcttctgttttccagatttgcagcacatcaccccatggcgcgtgaagtatgtatgtatttctgtcaccatcccctatatccatgacctttcccataacaaccttcaccatggcaatagggccactgaggtcaattgcatgaatttctcccaacgtagtgactgcatatagcaggccatccttgtaggtgcagtcttcatatcggccgtactctggcaggtagtcccattcatcatcccctactcttgcaaatgagagctgaccgaatggattgcgtataagcaccacaaggagctttcctgtcgatgtttcagagaatacaaaagccctcccagtgaggaacaactgctgccatctaggagaaatgatggatcccattgaccttgaggaaaacatcactccgtcgtgccagaactggctccgattctcatacttgacaatagcgcccgactcgtcgtaggtgggattaacctgctccatggtgatcactggcgggagggccatctgctccctagtgactgggttgaggaggtgcatctcacacttatcatcaatggttaccagccaaccatctgatgacccaatcaggtatctatcacggatgggtggatccgggagagtaatcttgtaggttctctgctctgcaaggctgtagatacaccctacattcttaccggcagattcagaggtgtagaagaggcaaggtgtctggtgccgtttatattgtccaaggctgtgtagtgtggtgtatgcagagtgccaagaggagcagacggagctcgcacgcagcaagtcagggatctccaagcgggaaagtatttgtaccagcaaatcctccggcagatgcggcaattcagcctccaccatcgatggcagcacgccaacatgttcttcttcgatgtgaggaagagctgagagcttatgcaaagctcccaagattgcagagcacaaagccgtagctagcctgcctatgctcattatgctggctacgatgcaggtcgccatcagatcactgcttctacttgcaagatgaaaaaaaaaaagttgagttgggcttggccctggatagtgtatacacttataggcaacaaggcaaggacggcttcgaatccgaaattgaacgggaatctgaatccaagaaggaaactgctcctgtcatgcctgcctgcggaattctggtattagtgcacgggcgagctaaagcacttaaatagattcggaatcgggagtttgggaccaaacctgaaacctgttgccgcagagagtccgaatccgacgagtgttgagttcctctctccctgtgtcgtcggaagcaacagtagtagcaaaactgggccattccactcgccaggaggagccagccgacgagggcgcagcggcggcgcagttggttgggtcgtgcggctacttggcttggttgggttggccatggccgccaccccgcccgcatttcctctctctccgtcgccgctgcgccacccaccccgatcctccctccgccgccggccgccggcctcggcttatcgtcgtcgccgacacgagttgggctccgggcccaatacatacttgggcttaggccggcctgcgcgttggcctgcttgatgtgtcggcccaaaatggtggccggcgacgctgaacggggtggggtagtctgctatttaacctttctctcgccaacctgcccaccgcgctctcgctctgccaccgccattgcgccaccgctcgccggagaagccaccaccaattatcgctttcaaggataataaggtgcatcctgttcctcccttcttcagttcttccccatcccgttacagagtctttctttgcagacacgtacgccaagaagcgttcttggtttcttggccgcgcttgcgccaccgctcgccggagaagaagacaccaccgccatttctggtttcttggccgccctctgccaccactcgccggagaagaagccaacaccagtttcttggccgctctctgccactgcgcttgcgccaccgctcgcctgagaagaaaccttcaccatttttggtttcttggccgctctctgccactgcgtttgcgccaccaccaagcaccgcgccgcgtccaaagataataaggtgcatcctttcttccataacgagctcttcttctcttctctttctctcttcttccccttcctctcttctctttctctcttcttccccatcccgttacagagctcatctttgcagacacgcagggcaagaagcgttcttggtttattgcagacaagaatcgtctctccacgactgtatccggcgcaagagacagatgggtcccgactcaggtagcgtcatctcatggtgggctgaggcgccatgttgtcgttggttggccgcgctgttcggctgtccttcgcagtcgcgaggatcttctccaaggctgcagccttcttcttcttctacgcgatcacaggtattttgatgtgtttttactgtttgctggagtgatggcgcccattattgaggcttcgcatttcgttttcctttgctctgtatacaaactgctgcatctcttttaacagaactagctgggcggctggcgcaattacgcggctagcacctatacaaaaattatatatttttaatatgattttaattaaaatttattaaatagttatctcgttgtcttaaaactttaaaagactaaaccttatcatcattgtgtttctaattttatagtttttaaaagtcacaccaattgctactccttacttctgtcatatcattttttttatttgcttgctcaatctaccaatgtttctatccattctccttggaacctttaaaaattagatcttatagtttttaaagtttattgtcccgttgggatttgtttttataatttttagaagtcccatcaaacattaccattataatcctctatggtcgtccactgcctcttctttttattgtcatttgtattttaaaaatcgaacataactattgtttaggtttatttttttacattctagaagtttcaccaaaacgtcagcgaccttgtcactgtactcctctacgactcgcccgccgcctcccttctctgttgtcattgagattttaaaatcaaatatgagtatcatgggggtttattttttttattttttagaagcccaaacctttaaaaattggacttatagtttttagagtttattgtctcgttgggtttcattttttataatttttagaaattccgtcaaacgttgccaatgcactcctctacaacccgtccgccgcctactctttattgtctcgaatagtaaaaatcgaacataactatttgttagaattcatttttcttttactttctagaagttccaccaaccatcggcggctctgccattgtactcctatacgacccgtccgctgcctctcatttttattgtcatttagattttaaaaatcaaatataattatcattaggctttactttttactttctagaagtcccgctaaccgtcttgaccgattgcttcacgacctacccgttgtgtttcctattaatcgtcattaggattctatttggtgttttattaatagttttaaaatgttccatcaactgccaccactccactcctttataggcttgttacttaattaatctcgtcatgtattttagttggtattttctttcaatagtctttatttttttatcaccaattttagttatttataaattgtattcctagttgaaatcttatttttctttttctaatttcagaatttattttttttttgaattttaactaatattgtattgtgttcttttaatatttttattttttatgttcattttaagttgtttcaaaattgtattcctacttgaaccctctttttaatttatctaatttcagattttattttattttttattttaaattttaattaatcttgtattgggttcttatatgtttcttatttcaatattgcttatatttaattccgaatttcagttaattttaaattgtattcctaactgaactcttattttcttttctttttactaatttcgattttttattttttttatttcgaattttaataatctcgtactgtgtttttatatggactcttatttcaatattgcttaatttaattccgaaatttagttattttaaacttgtatttctacttgaactcttattttccttttttgctaattttggattttattttaatttttatccaaatatgtattaatcttgtattgggttcttatatgaattgttatttcaataatgctttttcatttcttgcaatgttaaactaaattgtagggggttcagtctcgaaagggaaagcatcataatgctttgctttatggcaaatattctaatagcaggacctctcgttctaccgctagggctatcaaccttcctaccagtgcagagtcttcgaacaaggaagtggtacgaacgatgacttctcaaattataacctgttagttttttttttcattttttgagttaatggttaatttgattttcttttatttgtatataaaaagggaaagagaaatatctcatataagtttaaaatctatttgaattaaatatgtacaaattatatatagtggtcacaatcagacaaatatgattttaatcatagacacattgaactttcagatcatattgaatcatttaaacatgacgcaataggatggtgtgcatggtgatgctatggtgctttaatgattgccaacttaattagtatatggcatgttcttatatgatttttcttttcctgaaattcgtagaccgtgggtgagagaaaatttccaaaggaagtggtagttgcttatgttgattactgtaaacgtgcatcagtctgtgaggagaatcagcgtgtgtgccatatgtgtgtgttcatcgagcaaagatgtcagaactacatagtcaaacaatctaaggtgagtaatctaaatgcgcattgtaggtattacgtagagacatttgtattcttgtccctatttttggatttaattgtgattttctctgtttttttccttaaaaaaaatgaagcaactgtttgccctgtttttgagatgcattgcccttgttatgtatgtaatgttgtatttcagcaagtctaatttccatgtcgtatatagttgataatccactgcataaatttgcacggcgacatcggtgtggagtgtgaagcgccaggttgcagtgtaagggcaatgacacatgaagatcttgaggttcactcctacttctgtcacattcaggctcaaggtgatctaccattctgttgcaaacatggatgttaactgtggattaacattaaatattagcgcttaacttaattctcttttgtctttttaggatggtggaggcaatacgaaaatctcgagactagccagtgaccacgaatgccaaggtgtaccgagacatcttggtgtagagcgagtagtatagcagtatgaactttgaacaagagtttccgctggtggttgttttggcatgcacttgtacatatgcttcttactacttttggagctgttctttactggatttataatgcgcttacactcttgtcataagttgtaaatgaatgtttgccgaaaaagattgttacaaaactatatgggatttgcatctacttccttcacttcacagtgtaaaactttctaatattgcccacgcggtacgagcacaggctggtttgttcttcttcttcgtgtcgtgcggctacctggctgagtgtgagtgagttggttcgggtttggcttgcaccagaattgtgtttgcattcagacactttcagaatgccaacagcgacttcttttcacgttatttaccgattattttttttcaaaaaaaaaatcttctattgtagtgattacaacacatgttttaatttatttgttaagtctatttatcaaaatatttaaattattctacaattaatctgttttaaactaaaagctagatagttctggtggaaattaagcctagtccgctcaataatatgttttaaatccagcctaacatggctttttgtcgtcctctttgtttagaaattaccctggccctacattttatatcttttgttcataaattacaacttccattaactacacatagttcaggtggaaaccaaaaaattacatcaaattggtctcacactacagcaactatatatgctagtatatattcagttcactgaaagcttgagactgaaggacgcagaaaaaatgctgaaacatgtattgtttgggggtaaagaactaatcaatgaatcaatggattccctgagagtagtccatcgatcctttgttagagtacttcaatttatagtacctgtttaactatcacattagtaatctcttacttactcctttggattcatccactaagtggtagactatcaaagccaatttagtctgtacaaaaaacaaaaacctaataaactcgattgtaacatactcatttttccttcaactcataggccaaccccgggtaatgatctcaactcaatcaaaatgattcaatatacccgattcgaacttgaatttcacatacataaggatacaccctatttgtatcagaagccaggtaaactatatgcaacaaattactttggttcttccattatcacattggcatttgacattgtacacctcttaccaattcttgatgaggcgacaggttagcactggaaccaccacacagccatagccatggaggatcagaattgagaagcttcagaagcttccaattcaagatcccttgaggccggacacctcgggaagcatgccctggatcctcctcagctcggccagcgcctcccgggcgtcgggccggtcgtccttgtccggcgccacgcaccggaacgccagctccgccaccgcctccacgctggccatcacgccggcgccctcgccgagcaccggctggtccaccacctcccgcagctcgcccacctgaatcttggccaccacccagtccgccagcgtcacgtccctccgctccctgcccacgtccaccggccgcagcccggtgacgagctccagcaccaccacgccgaagctgtacacgtcgctcttctccgtcagctggaacgaccggtggtagtccgggtcgaggtaccccggcgtgccctgcggcgccgtgcagcacaccagctccctcccggcccccgtggcgcatgcgtccggcggggacaggaggcgcgagagcccgaagtcgccgaggcgggcgcgcatgtcggcctccacgaagatgttcgacgaggtgacgtcgcggtgcacgacggcgggcttcaccccgaaatggaggtactcgagcgccgacgcgatctggaccgccatggcgaggcgcgtccgccaggggagcggtggcggcgggggcgccgccgcggtgacgccgcatcggcggtggaggtggtgggagagggtcccgttggggacgaagtcgtagacgaggagcagagcgcgcgggtcggcgcagaagccgtggaggcggacgaggtgcgggtggcgcagcgccgagaggatgagcacctcgttgcagaacgacttggtgatggtggcggatgcggaggggaacgacggcgacggcgacggcgggacgtggaggcgcttgacggcggcggggcggccgccgggcgggaggtaggcgaggaacaccgtcccaaacccgccatccccgagcttgcggcttggatcgaacccagcggtggcggcgcggagctgctcgtaggtgaacgaggggcgatgctggtggagcccgttccggcgaaggaacgccgcggcgcgggcggccgcgttggtcggccccgcggccggggccgggccccgcccgcggtagcggcggacggcgatggcgacgcagaggtagagcaggagcaccacgagcagcaccgcggcggcgacgagcgcggtggtgagcacgccgttgccgccgccggccttgtccggatgctgcggctgcggcggcgggggcgaggcgtggcgtctcgccgcggccggcgggggcagcgccgcggcggcgacggcggcggcgaggaggagaggcggtgggggcatctgggctcgcgatccacgggctggacaaaagttgggatgcgctgcgcggtggaggagaaggtcacaactactatgcagtagactccacaactcacgtcagcacatgccgcgcctggcaggtggggccggattcctttttcattaaacatagtataaacgtagacgctaacaacgcgtgtgtactcacccttataaaaacacacgtgcactatatcactataaacatctccaaaagattagattgacatatcttgatattgacgaagttatctcgaatatcttattgtcgataggtacgtcgcctatcactgaaaaaataattagttgtaaatggagtacatgtgtcaaagtatagaattttaatctagtgtattggttccattataggagatctaactagttgatctatgctcacttcataagtcggattccttttacttaaactcccatatcaaatggttcaaagcgacaaatttgaacgaattttgttcgttttcactttgacgttggcgtgtttagtcactcaacacgaagttttgactccgatgatccaatctatctccgggggtgtgatagcgtacgtcgttttcacccggcggagcgaagtttcttttctcttttcggcgtcggtttcatgaattccaagagagaagtggtgggcatcacacctgatttggactcttaacagaaaagtttaaggggagagattaggcgagtcaacccaactcaaagccatgggccatccatcgtagtggagagcgcaatagatagatatatatactccatttctagatataccacacactattgactattggacattaatcgatcattcaccttatttatttattttacaaatatataaaaatacgaggtatgccacctttaataacaaaataagtaatagatagatatactccatttctagatataccacgctattgattattggacattgattgattatttatcttctttttacaaatatataaaaatacgaggtatgcaatcttttataataaaattaattatagaaaaataagtaaaatttatattattttttaaaataagatgaatggtgatggagaatggcagtggatagacatgaatcacacaaggagatcggcgatgatgctgttttgcagcagcgtctcgctgtggctgtggcggtaggttttggtcgccggtggtctcggctacttttaatggcgctcatcatgttgggcgatgccgacgtgagatatggatttagtagtaacagcgacctggcgagatgggaatggaacggaatgcggctcttgttaattacttgtgccgtgtgtctcgacgcgatttcgattagtttagtgagggtgattagctgtttatgttaggacggtcgtcgcgattacaagtcgttgtactgtggtaggagtactaaaatacagtagttggagcgcggccactgtagtagaaagggatggacagtatatatagatagatgacagtcacaggctcgccaccagacaaccagcttcatcaatgggggttattcatggtgttccgtgccaaatttcatccaacgatagctttggcatgttgcattgaccgactcggataatcggcacgagtcaatgggccagtttggagagcattaaattctgagaagcagctgtttggtaactagtttctgagaatctgtaaaagttctgaaactcagcttctccaacttctggtttcttagttcatttttcagaatctgtaactacagattatcagaagttgtgaactgtttgaggcagcttctaacagaagcagcttttgggaaaagctgcagctgggacaaactcccctaaacagggccaatgagcaggagcaaaatttactgcccaaaccgttgtggtcttgtggatgagttcgattgtgctgcacaaagcagggttttctttaccattttgataatcgtttttggtgagagttaccgcagccacgatattacggctacagctaaaaattatgagttctaaaaacaacatattgatgagttctaaaaaattatttggctacagcaagaagtaaccgcaagatattgcaaacgacgctagcacacagcacacatatgtccggcaatgcaagatcaactttaagctgtgtggcaggtgttcgattcaatctctgtttgtgtgtactctaccgttgagtattctgtcccggcactcttttgagatggaaagaaaaagaggagaaaacaaaaagaaatcgaaaggaaaaggaaaaggggaaaggagaagacggcacgcactttgcgacgacacggattcagttatccatcccagtcgcaggctcgcaactcgcaaagcagcggcaagaagatgcgaatgcgatagtagtatcagtgtttgagcttttcttcatgtatgcacgcctattgtctacttgatcagaagttcattgtccactacttgatcagaagttcagaacatgataaagcgtaatagcttaaatcgcctagaaccgctgatacaggcagattcagattcattacccccaggctgaattctgccgagtcttcagaaatagggtatccatggatatcagaaataaacttctgaaaacctctttcccccaaaaaagatcatcaataaatgaagggtatagccgtatagatggtttgaggtctcaaaactcaactatgaactataaatatctcctcttcttttctttttctttttttgcatgcgaatacctcagctaatttaatttaggctaggctatatacacacgacaattagatcctaccaagtactccactggtacagggaaaaaaatgaatggagtaaatgtacaaccaatcattccacccaattcgctaccttctctccatagattatggaccgtatggccatggaaatgtttttgccactgaaatgcacaacaaaaagggaagatcattagacgaagaaaagaaatatcaagatcatccggttgagagcactcagcaagcagctgagtacactcaacaaaaataatgttaggagagtactcccttcgttccaaaataaacaaacctagaatgatgtaacattatacaatgaatctggatacactgttacgtcacatcacatcctagattctgtttattttagaacgaaaggagtacatgcaaatggacttgtccatattctgactgtaatagcaagatggggcaacaaactcttacaaaattcttactaacaaaactctcaacatttgattcaagtaattggaagttatagaaaagctagattaaaacatggtatgccacatcagcgtcggtaagaaatttgtaacatttttttggtaagtgtagctttttcctagtaattgggttctttggttgaaataccaaaagatgctgcgcatgcgcatgtcatatagaccacaaaaccattaccaagttatgttcactgtttaaggaaaacccacgacctgaattgtactatgtttgctgctaacagaatgataccaccatcttcagtacggtagctctctatcagaagagatgtggcactagattttgtgtatgcaccatctaacatgaacagctcatggtaacactgaaccttgtcatgctattcgtgttctgcaaaatccaaggatgcactaatacatttcttcactcttctaaataaaaagtttagtctgaaacataatctaggacagaaaccgttggtagatgcaaggacttcacatacaatttgcaacaatattgtaaaaggtcaactggatctaaataacaaaaacgggctgcaggaa

SEQ ID NO: 55322 - DNA, 1385 bp, Oryza sativa
gagagagaagcatttaccgtgccacgtgactcggaaacactggaagagaagaaacgatacggggtgagcggcggcggcggcggcggcgtcaggtgtttccggcggagaaggccgccatggctaagcaaccttggcgggataaccgtggccgccggctggggctgaatcttgggtagagcgcggaggcccatcctactcttgctcgccagagaccgaagagccgctgccgccatggtcgctggcgaaatcgatctcctctgtctatcgatccctaatcccccctttgtacttctgtgttaaccggaataagactatgagacatcttagagttggacttggacttgggagtcttggacacgaacatgtgggctgtggctgaggccttcacctcaccgtacaaaggaatataagttcactttgactcccagtaactgaatcggattcatatccctctccctctctctttctctccccttcggccttctgcaagaggcagtcagtagtgacggcgggagggtgggcaccggagcggcggcggcggcttgggtggggaatcttggattgctccgcctagaaatttccccagcaaaaatcaaagcaacagagtcaaaatcgaagcagtacaagcaaacagatgaagcagagaagggtcacgtcctcacgtcggtgagccctggaattgaagagcaagcaaatcaaggcagaaggaggcacaccttgagctcaacgttgaggacacagcagagcagatggcagatcgtagaggcgcatctggttgtcgcaacttggttcatggacccctcgacctggaacccagcacaatcaagcaaagcaagccaaaatcagagcgttggccctcgccgcacgccgcaggagagagagagggaggggggaggggctctgccgctcgctgccgtctccgcttgcccaccgccgctctggcccttgccgccgctcgccgccgtcttcgcttgcccgcgccgctccggccctcgtcgcacgccgcgggagaaagagagggaggggctccaccgctcgccgccatctccggttgcccacgccgctctggccctcgccgccacctgcgggagaagggaccggagggagggggagagagataagagagagacggcgccacaatatgcgaatgacattggggtcccacacatattttttttatccacctaggcgtcacggcaacgccatgtgaaacgaagaccaggtcaataacaccagtaaacgccacatcagcgaaaccattctccaaaatcaccaatggagtcaaattgcatcggtattaatatttggggatcgagatatctgatattgtggttgagggatatgaatcaaatttgatcagggagttaaagtgaacttagggcctg

SEQ ID NO: 55323 - DNA, 2954 bp, Oryza sativa
aaagtggctacatttagtttgctgccaaattttggtaactatataagaaatcctgccaaaattttggtaagttgccaaaattgtggtaaggtttttttggcatcaaagtgaacaggcccttagactgtgttcggatgtctgagttcccaactctaacagtgtgcacggaaaacggagcggtctattagcgcgtgattaattaagtattagctatttttttcaaaaatagatcaatatgattttttaagcaacttacctatagaaactttttataaaaaatgcatcgtttaacagtttgaaaagcgtgcgcgcgaaaaacgagaggagagtgttgggaacttggagttttaacacaaccttattccgccgtacaaaagtggagagggagagaaagaaggtacgcagtagcagctcgcttcctcccctctggttgatcttctacccttcggtcggccgaatcagcaagcgggaaggctggggcttgctcgatcccaaagccctagcctcctcgtcggcagatgcaaaggtttctgggtggattcgtcggcggcgatgcgcgtgaggaggcagtgaggtggatggtggaggcgggggatagatgagcggatgtgggggattgagactctgatgagcagaactgaggtgtggcaacgggcaatcggatccagaacaaaacgggtccaaacccaaatcaagttgcgggcccgataatagttgcacgaatcatggagcgatctacttcctccgtttcacaatgtaagtcattctagcattttacacattcatattgattttagtgaatctagataaatatatatgtctagattcattaatatcaatataaatatgggaaatgctagaataacttacattgtgaaacggagggagtagtggttaggaattcagctgaaaaaacaaaaaaaaatcagcaaggtgttacgtagcaaatccttaaaatttttattaataaattacttttcgtttgcaaatatgttaagccaaacgattgggtccacgaagcgtacattttttcctccccaacatactaggaaggagctttggtttggttcggtttgttattaggaaggagatatttttattattatatatacttccgtcattccatattgaaaaaaaaaaagagggagcgatgatgtggacacactgacatactccattgttaacgaccaaatccctcctcttcccatctctcctcctcctctcttctcccttactcggttactctctctcattcttctttgggcaggccggcccacgggcacgaggcgggagaaagggagggcggccggccggcgatggccgacgcgggagaaggcgagacgatggctcctcctaccgcgggcgcgaggcgggagagagggagggtggccggtggcggccgatgctggggcgacggcggccggtgatggccgacgcgggagaaggggagacgatgggtcctcctaccgcgggcgcgaggcgggagagagggagggcggccggtggcggcgccggccgacgctgggccggcgatggcggccgacgctggggcgaacttcgcaagcagacgcacggccccacacaggcacgactcctcccttgtcgcgaacttcgcaagcagacgcaggcactagcgagcggcagcggcgagtgagcccttgttggcctgttctgctgcccccatcctctgcaacctgcagcttttcttgagcggcacttgtttaagggagtgtttgggaactagggactaaatttaggcctctcataaaaatataaatccctaccataaagacttattcttttataagagggactaaaatttagccccactttagtccctctaaccaaacaccgcctcaatattgtttatgcatcgggtgtcatgtgctaaaacaagctagactgctgttgtgcttctgcaaacaaggaatcgcccaacagtagcaagaaagaatggttggagatgctttgctactgggtttccttccgacactgtagcggagctcaataatgtcagggatttgagctgatgagctttatctctgccctgaatgtttccttttgcagctatggttttggacttttggtgttactgacgtgaacatgttaaatgtatgtttgtggcttggtgaacctgcttaatggctgctataaaaccgttttgttcttttcatttggtgttactgatatgaagctaactgtaactgagtatgatgtacaaatacaagctagcagcctagcaaagcttgatcgatagcaatggcggcgaaggcgatcgactgcccgccagcgccgaggccgacgccggcgtcgacgcccagcaccgggttgtcgtcgtgcccacgcgacgcgctgaagctgcgtgtgtgcgccaacgtgcttggcctcgtcaaggccaaggtcggcgcggtggcgccgtacgagccctgctgctcgctgctcgacggcctcgtcgacctcgacgccgtcgtctgcctctgcacccggccctgcctcctcctccgcgcccagcaccgcggcgcccgcccgcgctgggccgcttcgccgccggcggcgactcagcgccgtcgacgccattcgagaccggccgccgccctcgccttctcccgcgtcacagccgccgccgccgccgcctcctcctctcccgcctcgccccgacagcctcttcccagccgccagccggctttgcccagagaagataagagaagagaagagtgagagagagaaagaggaggaagggagaggaggggagagagagagaggaggtgatgatgtggcatcctgacacatggggtcatgtgttctacgctgacttagctgtcacgcaggataaaaccgggtcaaaaccaccgaataagatattatgatcggttttgattagttaagtgacatcggatatttggttttgctgtttggggatgaatttgtaactcgatgataagttgagggatctt

SEQ ID NO: 55324 - DNA, 2113 bp, Oryza sativa
  unsure (1)..(2113): unsure at all n locations
attcctgcagcccacctaggtgtatgtattccatttattagtggatgatccattagcattaaattagccatgaaaaagaataaaattattaatttccaaatcaccgcatgcatatggcctagctgcccagcggatttggtgcaaatttgaacaagggcgttggcatgcatttgctttcaaatttgataacgtaccatagttatacccgtttttttgacaaattgacccttttggaaaacttatttcgaaactaacccctgccaaaaacttcaaccaaaaataggccgtcgcctcagcgccaaacacattggcgctgacttggccgtgtcagcgccaacgggactggcgctgacattgtgccaccgtggcggccgggccgatccccagctgacgtggcagctacctcagcgccaaccggactggcgctgaggtgggacttggccgcaacccccaaggcctagaccagcaaggcttctggatggcttgcgggcttggacctcagcgccagccataatggcgctgaccgtgggacactcagcgccagcccacaaggcccagaccagcaagcctgctggatggcttgcgggctgggacctcagcgccagccataatggcgctgaccgtgggacactcagcgccaggtgggccttggccgtttcgagccttctggatggcttgcgggctggnacctcancnccatccataatggcnctgactgggggaaactcagcgccagcccacctggcgttgaggttggacttggccgtttcggccgtggcccagctcagcaagccttatggatggctgggctgggacctcagcgccaggtgcactggcgctgagtttggacatgtcagcgccatttagcatggcgctgacgtcccagccctgctaaactttagcaaaactttgcacacaacataggcaaacatcaaatcacagaaatttacaggcagtaatatatccagagaaccatacaaaacatacatccatccatcaatcccaacatcattccatacatccatagaatccatcaatacatccatgtcggtgacatgggaccgggagtatcatgactagaggcttgaggcagacacaatcgcccacgtggcctggcaccctcgggggacgtcgggcccgagggtgatgtgtgcgcccacctcttggtctccccgagggggggtcggaccactccttcctcgcccccgagggccgaggcgccccgacccctcgcgtttctactccacgtgtatgagttaggtgagcacagcggggctcacctaaccgcatttattgcgccgcggctaagcgtgtcacgccacacgaagtgcagtgcagtgcactcgattatccggtctgtgaccagtcacagaccggtcaaatcgcgggttaggtggcgacaggcggtctgacgcacgcttcgccccgtcccgtcaagacgagagcttctaggcactcgtccccggctggagctagcgtgttacatcccagagatgacacgttagccccgatcaatatatgccaggcttcatcctaaccattacaagcaagatgttgtttgaagaagggcgaacatgcatgttgctaagccaacgcgtggtggacaagaatgaccgatttgtgactggtctgacactgctcatgtcgtcagcacacggccaccttcccacgatgtgcctgtctcaggcagaagtggaggtaggtgtgtgccgtcccgtcaggaggatgttcggaggacgaccgtgcaaatctccgtccatttatgaagagaagaaaagtccagtttggaaagggaaaggggcatgtggtatccccttgaaatataaaaggaggacctggcccatagagaagggggatgatctttttctagattgagaacctagaacgagggttggatcttttacagattcgggacctagaacaagggagaggttggctcacactttgtaactccttcatacacaaatccaccaaaacacaggagtagggtattacgcttctcagcggcccgaacctgtatacatcgttcgtgtgtcgtgctctttcgatagctggcaatctttcacatacagagagagctgggatcataccctgacccccggccgaaccgcaa

SEQ ID NO: 55325 - DNA, 2378 bp, Oryza sativa
tgttaagttatcgcttttggaagaaaacaccgtagtttcatctctttccaacgattacctgtagggcgttgcggagggtgccgccctctccttcggagccaggagccgtgcctagcaccactcccgcgtcgtgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacaagacggtaggtcctgtggagccacgccaagtacaactcgaactccgtcccgttgtgctgaccctggtctggtactccattctcctcgaacttctcccattgcgtgatatgatcctgatggtagtaagcccaatcagtcaccttcttgttcttccgacggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtggcacatctggaactccactgcatagaagcagatcagtgggcaccgtagggtcttcaacgcatcctctatatggcacatgggattcagttctagctcgagcacttcctgtgcctgatatggcatccacaccacctgcagcaacaaaaataaaacacattgaagcacatttagtactatatagtaagaaaccatcttcatgtgtgatagaaccccgaatagcttacatgttctggctgtaggtagtccatctcgtttgtgtagtggtagtacgccaaattcctgcggcctactactggagatgggaccgattcccacaggtgagctacagtgggacatcggtctgcatcctggtgcggccaagcctgatgggtcctccacatgggccgaccaactggaagcctcatccacatccaaacctgcgtcacatacgttagcttccaacatgttagcaagaaattgaaatgttatgaaacataacatgcgtgaacttacctgtagcaaccaaacacagcctgctaggttcgcgtccccgccttgccttcggcaagcatcacagagttgccggtacaaccaggctagggcagccgacccccagctgaaggtacccgcctcgtcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttcccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagacttcgcccgccgtaggtacgggacgtaccggtcgtcgaacagtatgtgcgccgtgtgacctctgactcgaagggtcttcaagcgctgcatcaatagacaaacataataacataaagttagcgacaatatatcatatacaagggttgtggaaaatacatcatgcaactaggaactttaattttgggattgagcaagaaaactgaaaagaagatctgtgtgtttacatgctctgctttgaggctcctgaactttgatttgagatatctctatgatggatgatctatctgtacaaactaaaatcaaagaagaaaaaataaattcgatcataaaaaaaatggaatattgttgatgctaacctctccgctggcaatctgtggggcccggtgcttctcctcgtagaaatcctccaaccccggaaagtgctccatcctgcaaatgaaaatggaatcattagtaattgaaaaaatattaaatggaaaaatcacaatgagaacggaaaggagg

SEQ ID NO: 55326 - DNA, 2041 bp, Oryza sativa
cggtaatcatgtgggagcatggcaagtgatggagccgagggaactgacaactacatgtgttatctctcgcaaccacgacgtagtgacgtccaccccattgaaccccagccgccgtgactccgccctgctcgctgacctcatatcttcatcgaagggaaatcaaaacatgctgctctttgccccaaggttcgtctttgctgctcctccaacatgtccttaacttttgtgggccacttctttccacacaggatatctacagttgcctctttgtgtctatcgacaaaccaactattgcacttcgaaaatgtgtatgccacaatagctgtaaccggcagtttccgaatgcctctcaatacattattgaaactctcggccatattactagtcatgatgctatgacgacgcccgttggtatcaaatgctcttgcccatttgaccttaagtggcatatggtcttctagccacttctttggcctctctccgaccacacccatgaggcgttttatctcatctaggaacaatgctttctcatctatttgacatatgcgctcaagatctttcatctgatcagtcgtagctccagctgtgtagaagttagcacagaagtgcctcatgcaccacctgtggtgaatggttaggtgatgaggcatgatgtggatgatggagttcaaaatgccagggtgtctatcagaaattatacacacttctctattaggaccgatcaacttgtttctcaacatgttgatgaaccactcccagttggatgtattctccttctctaccagagcaaacgccaagggaacaagatgtaacccggcgtcgacccctattgccgtgagcaatgtaccttggtatttaccggttaagaaagtgccatcaattgctagcaccggcctcaagtgcttgaatgcttctatggactggccaaatatccaatatgcacgtccaaatactcgcctctgtactccatccaccatcctggacttctcgggatgagcctcaacacggaaatgcatggtagggttctttgctttgatggcacgcatcagtgtaggcaagcgaacatacgcctcgtcccaatctccccaaatgaccttcatagcaacttgcttagcacgccatgctttgccatacgtaggccaatagtgccatatttgctcaactgcctcgacaatcgctgctggagataaagttggttcagctcgcacaaatgcctgtaacctgtttccaataaaccttgaagtaagttgcaaatgcttgccggttacttccgcactacagcatgtgtggtcttcgcccaccctaggacccgccacctatctcctccactcttccttgcattaatctgccatttgcaatggcgatcgagacaagccacagtatactttactgacgcgttagattccttcacatggtacggccggtggacacggatagaataactctgtagccatattttcagatcatccatcgatcgaaactccaaccccttccttggttcatcacacattggttcgaaggcaccgtcatattgtggatccccatcagcaattgctagcccagatctggtaagatcctcgaattgtgttatttccgggtttctacccaccagtttcgcaaacacagtcctttcatgctctgacatcttacgcactggacgatcatcatcggagtcggaagcggactcatccaattcatcctctgtatcatactccaaccagcctgggttcaatccactgcgtatcatagcctcctcacactcctctcgggtatagaatttcagcctagccaactcccttaggcccatacttacattcttagcattcgcttcttcctcaggcaactccacatcatctcctacctcccgaccatcctcaacatctccttcctctcttaccggcacattctcctccacattaacttcctcccttaacggcacattgtcctctgcatgtacttcttcccttaacggcacattctcctctgcatgtacttcctcccttaccgggtcattctcttccctgacctgggctgcaggaat

SEQ ID NO: 55327 - DNA, 1048 bp, Oryza sativa
aatagaatatataaatatatatgccatgcatctcttttctcattgcactcacattcccctatgatgatatgcaaatattttagcaaaagcaagtagattagtcctagtctcgtaatgggcaacatatatagatacacagatcatacttgaagtgattgcattgcatgcaaatgtagtaatgcaggtaatcaaacaaagtacacctgaaagtctaacgtttttcagtgtagggtcacctgaaatgcaaacttgcatgcagtttcaaatccttcctcaaaaaaattgatcatgtttcacttcttgcattctgcaggggaaccggcaagtcaggaagatctccgggccgagcgtagcggcacgcatcccgaggcatggaaggttccgattcaaggaaggcaggcatatctgtggagcaaagagatggttgcattgcaaggaggaacaaaacaagaacaacattatgatggggtctggctgtggatgttggtgtaactagggggaggtggcctatatcttctgtaagcactgctatttaagacagttttaagcataaaaactttagctttttgcaaacaaaggctgttctagtggtggggaaggtttttttgtaaagagagcagtgagtattaagcttccctctcacaacaaaacaagcatcaaagattcttggcaaagggatgtgggcaagagctcccttcttttttggcactagtaactttagacatctaagtagtactttgtttcttttctttttttttttttttgttccaggcattcattcttttcccttgtcactgtgtatcacttacaacatcatatcataagtttgcaacagagaaaaaacaggtcaggaaaggaccagcattttttttaggctctggctcttaccttctgattagatgctgataaaatcaattgcggccaaaactgactaatttatgctgtaaaaacttcaaaactgatctggtatcttttgtcttgtttctgtctgaattcctgtactttaaatccccccccccccaaaaaaaaaagaaagggctgcaggaat

SEQ ID NO: 55328 - DNA, 756 bp, Oryza sativa
aacatcaatacacactgcagttccactttcaaatcctgcatttgccaagtagcgagcaaccaacttccttgtcataagcattgcttgttcttggcttagagattttccttctactctggatccatctttccctcgatatttgttccctttcttataatactcaggcatcattccaaatctttcaagcattgcagtgttgcgactaacaggcgccggtaaattatcaagaaccccatgaacttctattttgtagatcctagacgtctcacttgttctaggaattgcgctttccgggacacagtcagctggaaacctaatttctggaatgaaagtatcatctgttaaattactatagtccccagcattctttgaggaagggccattttccgacattgggactgagatgttgtgaccctgatcatccataaacacagccctcttccttttatgcacactgcaaaccttcaggtaattggacattccctctgatgttctttttggtatatctttgtcacctgaacggaacttgccatgccatgtcctgaatttttcagcatattgtttgtaccatgtgtcaggtaactcttcgtatcgattatgtctttgagataacatagtgttctccctgcttggactaaatgaggttctagattgcatctgcagcagcaaggacaaatataaccatcagcatagcatatgaatcacatcaacattagttagtatgcaccaactgcagctgaatgctatacataatta

SEQ ID NO: 55329 - DNA, 2371 bp, Oryza sativa
cttttctcatgtaggagtgcaaagttgtactgtaaacaagtgagcatcatctctattctcaacaattcattcatagattaataatcacacataatccgtcacaatgattaaatcagtactaatcagttactatacatatagtaaagaaagaaattacaacatggttcttgtcgctggaatggttatccagaacaaatcagaactgatcagttaaaacctgactaaaacttgtgctgttggctaattgctagaagtagtactctgaattaaacacttaagtaaaatcggcatggaatcgcaaactcgcagtcatcattttcaggtatcctacattgtgagctcattacatcactagtttgttgacctgtaaaaatgtgataatgatttgccggacgtgtgaacagaagcccaaattttagatggttccaatacaaattagctccataacattttgtagcaatgaatattatcactatgttcaatcccagtgtcacaggcaattcagcgaacacctcatgggcaaagctcgccaaaaggaaaaaggtaagcaagagagacaaacccgagaacggataggacggtgaggcggatggggtcgaggcgcatccagtacccaaccggaatggccccgcgcagctcgatcaccggtagcgtagcgagcgtgaacacgacggcctcgtccgcccacccgagcctccgcagcgacgccgccacacgcagcccgaagccggacgccttgatcgagtcctccgccgccaccgccgcaccgccgcagcagagcacggcgcaccccagcgcgcccagagccagccgcctcgcgagcgcgccccagtctggcgccgtcgcagccgtcgcatcccgctccgtctgtccccacccatcggcgccaccaaacccgcccgtccccgcgatggcgcgagattcgccggtaaccggaggagacgccgcagcgctcaggcggagagcgagcctgggatttgtcgctccgcgagctgcacctgcaactgccagaagaggcggcggcggcggaggcctccatctccacgacgcgagcgcgagcggaggaggggaggaggaggacgaggcggcgagaaccgacgccgccgccatggccatctggatcgaggaggaggaggaggaggcctctcgcggatcggattgagcctgccactttggactcgatttgattttgacggttgttacgaggcaacgattcgtggtgatgcgggaggaggagaccccgaggctacctgcggctgctcgctcgcgccatgggagggaagaggaaacgggtggcgatttgttacactgagaggtggggccggaaaggtgtgggcccaccgcatccggatgtaatagctttttttttttttttttgctggttttggtggtgtgttgatccagtcgttatcaggttgagcgaatcaaaatcaacagaaggaatgcagcaggtaaaccgtcaaaattaacgactaaatgaaagaattttcgatggtgatggccactgctcgctacagacaatcagagattcaattatcagttcttgaacgggcaaaaaaaaaaacaaatattgcttctattgcggaaatatcaataaagaattgaatatgatcagatgatgactcaagagcaacaggcaattacatttccattcccaagtatcacaagtttattgtcttaaacgcgtttactcccacttcacatcgaattttgcagcatttttaagaggacaaccacagggtctctcactcctagcaccgagagaaaccagagcctggtactaaatgaggaatgcaggcataagtttgggatttaggatgaggaggatgaaatgaacatgttgactttcctctccagttcatccttcttagcaccaaccacgcgactaacctccttcccgcccttgattaacacaaaggtcggcatggcctccactttccattgcctcgccacttcctgcaaaattcaggttcaccaccattaacaaaacatcatgttcttgttatacaagaataaaagaagacgaaacactagcggtgtgtgctcgaattgccagacaggcttgcaaatggaattcttaagaaccttttgctacaaaccaaacaaagtacaataattggtctgcagttacatactttataactttataaatcataatcgggacgtacacatttgatgcatccaagtagtgcgccacatagacccatcattcccgcccagctatttattagtgcattcaaacttgcacaataattttgttgtggagtttgagataaatatgagaggatccaatactcaatgatgcaagaatttgtttatgcagactggctaactgaaacttgatcaataatttgctctaaattctactagt

SEQ ID NO: 55330 - DNA, 2251 bp, Oryza sativa
catttttgtaaaaaataaaaagtaaaaaagtaatagtttttagcatttctatttagtcatttatagaatttagttttctgttttctatttgcatattgaaatcgacaataaatagttaatttataaaataaaaaatagaccgttttcatcctatcgcgtgcctttttaggtttcgttcaatcttgaccgtccacgtgtccaaacaaagcggacaacgatgaccaaccactgactcagacaaggggtggattgtggtgtgccagcatctgaactctgcagatgtgtaaagccaagttgattccagacttgcacgggtatatgcttcgaggacacaaggaaatggagacccaaaaaggctaaagaacccaatggtttcttgccaaggtgcatcctcttgctgtagtagcatagatgatagaaccaccacacttttttacatttccaaccccactggtcggcagccatctacaatttacatgacaggaaagaatgaataaatactacggagaagcttttgttgctgcaggctgaggctgcagaccaaatgtgctagcttagctactggacatgaaggattcatgcttcatgaaccgagcagaagagagactacttgacactacatgttacacatttacaatctaggcacacggagcgagatgagcttccatggtggtatcacatcctacttgaaaaggagtagagcagcacaacgagcccaccctgtgagcgctgctcactcaatgatctccactagttaccagtgacaatgtggcattgagcttctcataaggggttgctgaacaaaaccagttaggatctagtgctccggcttcggggtgcgtgtgacgaattgcgttacagcatcctggtttacatgaaaaatgaacctcatatcctttatctgcagtaaacatcgacagatcagtaaggtgagcgtgagtatacttgatgatgaaaactaatgacattttcagtgaaacatctttcaaacaagccaacgtgaactaccaatatgtactaacctttccaacaattaattattgaaactcagcttatgaatctatgaatcatcattatatctctgaagattattatgagtgctacaccaaatgctaaaataaatgtaaaaggagctaaaggtgagtacttacgctgaaaggcccaataagattaactgtttaacatcagtattttggcatgtctgacgaataaggccaagataaaaatggcaaagggaacatttttaacttattccattatatatttgaaatgtatgtgattatctcaagtaaaattttattttgattcctgagcattagccatttcagtctggtctttatatataacaagcataacactaggcacgtctcatgatacatcgtggatcgagtataccaccacatgccagtcagccagtaagcggtgcaagctgtggtacagtggtaccttaaacaaatcatacatgttcaaattattctaagcactagtactaaaattgtgtagcacatcaaagttaagtatggaatggcaatccttcttgctatctggcataataagaatatgaacagttcaataaccgccctttcataataacaattttcactaatggactccaggatctggtaacacttaacaacaaagcatagtcaagattttcttaaatatctattttccatagtaattacatggataatgaaggatttcaaccatgtttatcagtacaactcattccaagttctaggaacagccatacgtcatatatatcacactgaaagttcaaagaatataaatgcacatatgcaaatttttataacatatgaacacactactatcaaaagacaggaccagaacaattactacagggatcatttcttaatcatgaggttacaaattaattgtgtaaacaatgaggtttgggtagtttactgcttttggttcaatcagtgataaatgaaggaaacaggaaataccagtacctcaattaacgaatctgaacttaagatgatgcgtttgcagcttggtacttccttgctattaacaaaaattgaacatttcccaatgtttttgatatgaaaagaaccagcttcatccatcttgataaccgcctaattttcatagcacacatggatttatataaacacaaaggcccaaagaaaaagagaaaaagaagcagatgtggtaaaacataatcccaggataagtttttttagggtactgcacgagcaaacaatgggggttaggatgtaatcag

SEQ ID NO: 55331 - DNA, 2866 bp, Oryza sativa
tctgggctgcctactcaaaggcagaatttttccaagccaatctcattgtcatccaaagtactactgccaatgaactgacaaaagaattgatgaaccaaagcagtgacatacttctagacaaacaacttaggcgaactgagagagctcccatggttatagcatatggaaactgatcctacaataaataaaataatttacattgtaatataagaaaccaacttttctgctacttgaggtttagaaactgaccttgaaaccacggttctggtttgatccacctgaacatctcacggttatccataagtacaaggcaaatatgagtagatggctaattcgctatggagcaaaataatactggaagactggaggttaccttttgttgtttgcatgtaatgatatatgtgacacagaagacctcaagaaaagtttctatgtacggataagggctatggcttataaacatgttcatgttttttttccggtttgcaaattggtattctaacctggaccaggaacctaccatgagttttaatattaacataattgttttgcattggaataatgaatgttatgcaaacattatgcagtctcctgaaatgaatcatccgataataccaaagtaaatgaagcagcaccgcatttatagagaaaaaaatgttttccctaagtaggcctacacttccagttgtaagaaggattcaaactaaagaaaaaccacccttccatttgtattcatgctttaaaattgtaaaatttatcttatattcttttctttttaccaatgctttcatacagtttggggatagacggtggagatgagacgaacatgggttgggagacgccgcagcaatgtggtggtggcggtgcgtgtggcagcgccggtgggtagtggccacggaggagatcggcgtggtgtcactggtgttgtcctcgacggtcggtggcggcacggagatgtcgagggtgggcttcggcggcgccggtgtggccccccgaggtggaggttgccggatgttgtatcaataatccctaatcctatacagcaaaataagaaaatcatgaggaagattacggtggtgcaatgtttcatgaagcttattgcactttgcttaaaaatgaaccattcttggggtttaaacccaaagggaaaaattttaggttccaaaaaaaggaccctttttttaaacccttgggaaaaaaaggtttcataatcatcttgaccaaatctgtcaagaatccagaaacaattggattgtcctaacatatgcatggtgatggtgatttcattaatcaaggaatgaatctctactatactgataattgacatagatggtgcatcatcttaaatattctgtcattgccagtgaaaatcgaattttaaggtttgacttctgaaatgtgtaaaatcttaaataaccagatactattgttctttggagatgtttagacatgtgcagacagttatgcgttgttcatagacatagatactttagttatcattatctaaaaacatgaattctttagataccaaaacgatgctttcggtttttttttcttttgattgattctggattatattaagaatcgtatgatcaaatcagcggcgactgatggggggagaggaaatatatatagtactggattgtggattaaaaaaaaggagggaggatgatttctgtaccttaatttcggcgaatcagatcgaggatggggcgacactgttctgaaagcagagattggtggttgcacggagacagtcgacgagccggagattgggggcggcacggaggagaccgacgaggcggagttcctggtgaagatcgggggcggtgcggaggagaccagcgagaagggcgatgaacggcggagtggtgagtggaggggacaactggcggggtgggagggcgggtgtggtgtgcggcgtgcgacggcggagtgggcgatgcggtctggacggcgggtgggggcgcgagcgccgggagacgacgggggcggcgacgtgcataggcgcgatgggcgagagaactggcggaggagatggatttcgcgattggaaggaaagtgcgacgatttcgggggcgtaggggtgagggaaggcggatgctatcccggacgttagatctcttggggataatctggacgttgagtgatgaatgaaagaatgagtgaaagtatttgtttaactatagggtagattgaagatcgctgaacagcaccatcttcattgtgttcttcgggggtcataatagttgactgcattggcgtgccagaagatacagtattgcatccatctgttgatttggccttctttcttgcacgccattcacgaagatacttgtttgtatcctctctctttttctttgcagaaagttcacttgtccctaccacacccccttcactctggtttatttcagatgtagttgttgcttgagttggattgacggatgttacagtgctattaacaacactcgactttgctctatttcttgcacgccactcacgtagatagctgttatttttttccctctttgttgaggtggcaatttcagcaacattgacctcggcactatcacattcttcatactctgacacatgcgttgtttgcataggacttgtactacatttcttcttagcctccagatttgcacgatatatacgttgtttgaagtttctttcctttttacgctgagactcattggatagcccaaattgatccacatgacctgcatttttttattaacactatagtcatactgaaaaggacaagacctgcgttgtacacaacgaactatccattatatgtacaccttgacggtggtttgttatatctccgagggatttgcgagctccaccgtcgggcgcagga

SEQ ID NO: 55332 - DNA, 3876 bp, Oryza sativa
ttgatgacaattagttgctctattcctcttcctattcgattggtaacttacatcaattactcttaattgattgttggttgatggttgtgtagtagaggatggttcatggctagttgatgacaattagttgctccattcctcttcctattccatgactcttactcttcatcttccattcctcttataaaatgggaatggatttgatctcccgcgagaagaagaagacacactttcatccattttcaaaagctgttgctgctacggtaatcccatcccgaccagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattatattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggaataaaatatgccgaattatgaccaaatttccaacactagttacattatttttctcaaaaacactccgtttcatgttcttttcttattaatgttgattagagggaaacaagactttatcattttttcacttgcgcttttagtgctagatgttgacagtatttgggaattcattggaaccaaaacctgaaatttttttcagatggttgtcctggcaaggctcaggtttagtcaaagaggttttcttgagattttctttatggcgtcatggcacatttagaagcatagcaatggacttatctttcaaaatattaaccttcatttcaatcctggaaatccctttttgtgaaataaactcttctgcatctgtgcacagaatgaaggattccctgaaacaatatgtttctaattggttgcacactttatagctttgttgccttttcttctcttttgtgtattatctgtaactttgtaaatattttatttttctataaaatttaaactgctaggcaaagccttgacagtattcccagtcaaaaagacttagtttttaactcgattttcatagtacgtttttcaaactattaaacggtgcatttcatacggaaactttctatgtagaagttgttttaaaatatcaaatatggatgaatatatttgtcaactttgtaataaatctatactattataaaaattgaagatgtttttaccggtatttttgtacatcatccgtatttgagtctgtttttaagttcattcgcttttggaaatagaaatccatgtatgagtcggattttaagtttgtttgcttttgaaaatacaaaagaagtcgtataagaagtttctttaaaaaaaccttacatgctaacttgagatgaaagtcggacttctaattgaagctcatgattttctaaaaaaaatccaagtaaattcccacagtgaatttcatcttatttaaaccgtataatattaagatagcatttgcctgttgcaacgcacatatatttttctaagtaaaacctaattaacacataataaatatatatatttgatattttaaaacaacttctctatagaaagttttttatgaaaccgtttagtattttgaaacaatatcttctaacttaacctgttgcggcttgtttgttaactcgagggaaggggattgggagtttacatgagggaattgatgatgagattaatatgggaatttgatttttaatcccaatatcttgtttggtagaggtaatggaaattgatagggagtttagttggagattaggtcattaataaaaacggatggctgagatttgcttagacaaattaaaggaggaattccctcccaattacctacccctatccagatattgaaaaggagggagttccttcctcaattcctcatcctcatcccacaaaaattcccatgtctcccaaccaaacaaaacacttaataggcttatccctctaaactcccaatatctcctaaaaactccctacaaccaaaagcaccgttggtgttggaaagccatccaccgtaatataatcagagttggggtccaggccgaaggctcgaggaaattaccatatcgcccaccaccccgggccacgttcgggacgcggttgcctaaaaagcgaaaatatattcccggaacaaagcaataataacccgtcacgattcgcccacacggcctatctataaagccgcccccgtctccgcaaggtgatcgtattcaatcagtttattcgatcgccggatacccgaggaagaagaagaagaagaaaagatgagctactacggccagcaacctcccgtcggcgtcccgccgcagcaaggttcgaaatctccggctccccgtgttcttcttcttcttcctcctcggcttttttttaaaaaaaattatgtgtgtgcttgtgtggtttcttgtggatggtttgactgaatcttggccgtgtctggatcttgtgtttgttcaggttacccggggaaggacggctacccgccgccggggtacccaccggccggctacccgccggcgcagggctacccaccggctgggtaccccccgcagcagggctaccctccgccgtacgcgcagccgccgccccagcagcagcagcacagcagcggcccttccttcatggagggatggtgagcacttcgtctcgtctcgcctctttttttttaatcaacaattcagcatcttcttcgttgctcttgtgcactactagtagattttgaatttgaagtagtactagattgtttgattagatcaaaattttagtgctatttaggcggttagggagtagtagtagtaattaccggacgctggtctcagatctgtccacgccgacgggtgcggtggccggcgcgtccgccgcggcggcggcggcggcggcggcgcacgttcgctgtggtggggccctgaatagacgcgtgaactaccaccccttgaaacgtgggtttcgttgacgtgtcggtccttccaagcaaggcgacgacgaggttgcacttgcatgccacgagggggtctggctgtcttctccttgcaccagtgatggccgtctgatcttggatggacggctgtgatgcagtcacattcccttggtgcttaccatttgttgtttccttgtgaattttggttggttgctggagttttggctagaggaaagataagttcaaaagcctgtaggagaataaaaatgtgcttttcacagattcctttggggagaggtcacctaggataatactactatactccgtagtaagtatatctttcttggttttttatagagagatattatattttcgttgacgcgctaataccaaagaacggttctcttcttccccccgagatgattatgattagtcttggcgggtgttccatcactaattgtgttgctaacctagttgcaatttgaataatgcagtttgtcaatggacggctggacatatttagggacttattttagattgagcatatgcctttgttcaaatggcaatactatacttacctgctgcctttatcagtttcaattttggtgtcatgattctaatgatgtgttgtaacagcttggctgccctctgctgctgctgtctcctggacgcctgcttctgaggatagaggcgacgggtgcaacagagctgaagagatttgtttcatggagctgatcaaa

SEQ ID NO: 55333 - DNA, 965 bp, Oryza sativa
ctaacatgaaattttaataattattaaagacaaatagaattgcaccgtaacgtttagcacggacatattactagtaatctattaaaatacaaatctaacctgccaactattatagctcgccggcataatagtaggtttgctgaattccacgtctgcgcctatccatctttttcttcggattgagaccacgtattcagcatcagcaatgctaggaaaattcaacgctgggcttttcttgagagggacagcatccgttgcaaatttttgttgtaaactacaccctctcaaatatgtgcaaaattctgaaagcaacttctaaccatctaaccattgtgaaatgaaaaaaaaacaaaaccaaaatattttaaccacgcaatgtaattttacttccagtacatatttttaacatatcaaacattcttattattgtttaggacaacagtacctttgggataaggagagagaaactccaataccataatgtgtgataaatctctgttttatgggttcgatatacaagtggtacatctctatcgtttgaaagggacatatacaagaagatttttgtattttcctagtcttttgcctaatgagttcttagcaggccacccttttgggcccaatattgtaagaggtccattacaaagaattagggcaatcttacatggctaacttctatggtcttcgccacttctgatggtatcatcggagacggcgtttctcgtcacttccacgtaggatcacgggcgggcttgttcactttgctactatttacaatcttattttttttcttggtaaagttacctaaaataatagctacatttaatttgttgctaaattttaataagtacatatgaaatcttgctaaaatttgacaaccttaccaaaatttggcaatgccaaaacttgataaggttgaaaatggtagcaaaatgaacaagccccatattcatgtttttctaaat

SEQ ID NO: 55334 - DNA, 2578 bp, Oryza sativa
aaaaagtgctgaccaggccacctgacagtaactacaaactactcttcaattcttcagcattgccagcaacagcaatatgtacagactacatagtaccctgctcacatactactaccacactactactcgtagccaaggttcacagttcatcaaacctttggtatgggttaccgtcacccgcagtttgacggttaccatggtaaccacgtggttatcgtgaaaaccacatggtcacgtgataacccagtaaccgtacggttttgtaaacatagcagggtttacagtatgatctgcaatttcttttccacgtgtgtagtaaaaatgtctcgtcatttttttacctctcgctcagtccctcgctgcgtgcttcgttctacaggccactgagctgagctgctctgcacttgccctgcacttgctctgcttccccctcgacgtcgacgacgacgacgacgacctgctccctctcccgaacacggccagcctcgcgaagatgcgcaggatcctactcgcgcaccgccgctgcgatccccaccgcatggagccaatgcagctgctggaggacaccggcgctcgccgcctgaccgccgccgccgccgccggcgtggccgccgtgtccatcctgaagctcgcctccttccgggacgagctcttcttcacggtgttgtgccgctgcagcgtctgcttcagggagaggatctcctgctccagcgcctggatcctaaagctcgccgtctcgtagcccgacgccgcgtcgtcgtcgtcgtcgccggcgcgggcgcggaccagcttcctgccgtcccgcgtggcgtgggcggtgtccgtgtacgggctgctggtgctgagcggctggctggtggggacggcggtggtgcacccggggctcggggtgtacgcggtggcggcggcggcgccgccggagacggggacgaggagctcccccgagtgcatgcaccggaacgagtcggagcactcggtgaaggcgcggtgcgtgtgcagctgctgcacgaacagcgcctgcacgatcagccggagcggcatccggtcgttctgcaccgcctggatgcacgcctcgtgcgacagcttccggcattcgaggtggccgcacagcgacgccttctcgtcgccggacaagccgggatgctcctgcaatggcagaatcaaacagcttcacaacgttagcgcgacagcttaacggactaaataatctcgtgcacgcacgagtgctctgctcgatcgtctttaccacgatgtatgtgtcgattgcttcgtagagatggtcgtgggatttccggtcgccggccggaacgacgccgatgagctcggccagccggtccggccggagcttcgggtcaccgacgatctgggcgatgtaccgatcccagagctccgcgacggcctccgcgcctcttctttgcattgagacatggctcgcgacgatgctctccatcgccctcacctccgggctgccggcgatggattggccgccggcgtcttgctctggctccggcagcgggaggtcgtccacgcgggcgaattgcaggttggacgcgaccagttcgcgcagcctcgtctggctctcgtcgctgagctcgagggtgatcgaccgcgccagcagcgcgaagtagaacgacaccgggatggcgccgccggtcgccgccgacgactcgagtgggaggaggtcgatcacgccctgcaggatcgcggtggccctcctgttggcgtcggtctcgccgtcgccggtgtccgtgctcgccatgaacttgtgcgtcttcttggagagcacccacttgttggcgtagaagagcacgacggggctgacgtacttctccttcatgccctgacgccgcagcgccagcacgatccgcctgaagaactcgaaggggagggcgacgaggtccttgatccagaggtcgcgcgcggcgagctccttgacgagctcggcgtcccaccggcgcccggcgaggccgcgcgccgcggcggcggcgaggaggcccggctggtcgcgctcgcgccgctgctcgtcgccgtcggggtcgaggatctccatgcacgccatgaacgccagcgactcgacgcagcggctgacgacgaggagctcctcggcgacggggagcagcggctggcatcgctgcaggacgatgagggcgtcgtcccagctctgcagcaccacctggttgatgtacaggtcgcagcgcgcgccgaggccggacacgtcgaggaactccgccgcgcaccgcaccgccgccacgttgaacgggtcgagcgccaccgcgtcgccgtagcagtacagcccgatcacctcgaacgcctcgctgccgccggggaagctcgccggcagctcgacgacctcgccgtcgccgtcgccgcaccggagaatcgcctgcctcaagtacccgcacctggacaccagaggatcctgcaacgacaagatcacacacactcatcaccatcttcttcctcctcatcccaaccaagaatccctaattaatcttcacacaatctctcctaaccttgtgcaggttgaagctcctgtcgccgacgtggacgctcaccgtcgccggcggggctgcaggaa

SEQ ID NO: 55335 - DNA, 6583 bp, Oryza sativa
taaatggtttgaaatttatagtgtggtaggaagtggagaaagggggagatgtgtgcgtgttaggggagggacgggcgtgctaatcgcccaaggcgatcacccgtccattaggcttacccgttcccagttcctactcagaccttttctaaaatataaaaatagtttttttggactacaaaagttctttttttctttacaagtatggtaaatgcaaatgctaacaacttgcgcacactgttatagaaccggcctagaaatcacatcgataaccgaacatgtaaaaaacatcataggagatccaaacacgataatgacactgaggtacgatatttgttaacgagatttaatcgaagcctacaacctaagggcgttgattacgaatgctcctcccagatcaaacataattataacatattagagttataaggacccttgatttgatgtcatcggcagccgctccctctcacatatactaagttgtaatgcggtttataacagatgtatctctctatttaaaagagagcttaggatagagtccaactctaactttacctacacctattacaaactcctagtcctacattgtaatcgactacgtacacatattcgatacaaactctaacatacacacacctccctataaatatacgcgtacaccctatcactatgaacacctcaaaaagactgaattgtcacatctcaagatcggcaaagtcatcaatgatgtttcggtgttgatgagtgtgccgtctattactgaaagaataattagccgtaaatgcgagcacctcaagtctataacttgaaccgaatatattgattcccccacaagttatttaaccagttgctacgctcacttcaaaataaacttttgattacatggcaaagacatagcacaccactacacacgctgaaaagcagaataattatacggagtactacgaccttttattttgactacaaaaaatacccatacgttacaacgtgtgaagattattttaatcttattattgttatataatttagttaaggtgaaattcaccgtgagaattcacttggatatatatatatatatgtatgtatatatatatatgtatatatgtatatatgtatatgtgtatatatgtatatatatatatatatatgtatatatgtatatatgtatatgtgtatatatgtatatatatatatatgtatatatgtatatgtgtgtatatatgtacatgtgtgtatatatatacatatatatatatatatatataagaaaatcatgagctacagttaggaatctgatcgtctcaagttagcatgtggtatttttaaagagattttttatatgactcttttgtattttccaaaagtgaacaaacttacaaaccatctcaaatacgaatatgattttcaaaagtgaacgaacttaaaaaccgactcatacacggatgacgtaccaaaataccgataaaaacatctttaattttaatttttataatagtagagagcagacgcaccattacacccactcacacgctcaccaccctaacatctgtgtgtttccttactaagccatttattttacataaattttataataagctttataaagagatgaaagttattatattccccgtaaaaatgctgactcactaatgtgtcttgaaaatgaccattgtatacaaaagttgtgcatgaaaaagaggggaccacctacaaatcgggtgtccgacgctattccaccgagtagatcaaaattgtttcactaagtagatcaaaaatgtttcaatcgtttaaaaagctgaaacacaaccaaatcacctcatgaaacattttgcgacaacgtatgacacaacggtttttgaaactgtttcaccatataaaaaaacaatgtttcagcaaaataatggaatgatgtttcaattcactgcaacatttaatctatacatagtgaaacaacacgagtgtacttcctgaaacagtgtttgatggaacacaaaatgaaacggattctcttaatagaacattttcattcaaacacaaaatgaaacggattctcttaatagaacattttcatattgttagagtgcgcagcccgggccaccaatcatgggccacccagggtcacattgggcctactccaacacaggcccaaccggagtcacaactttaggtcctaggcctatacaacccaaaagattagtctgatgggtgaggaccaccccaccttttaagttgtgctcccccatcatcaattaccgatgtgggactaaacccaacaatctcccccgtcgttgatcacccaagacacgccagatgacgacacaggaacacacgatatttgttaacgaggttcagccgaagctacatccccggggctctggttatgggcgctcctccccaatcaatatagctcatagcccctacgagtccatggccacactgccatcatctccctgcgtgtctacgctacattgtagtcgccatggttacattgtggtgctcccctctctatttaagagagatgtcgggttatagagtctgactgtaactctacccctaacacctatttacaactccaagtctaactataaccaaataagactggtatattcgacacctattctaaaacgtgagttattattgcaacggcacatgtggtggggcgcgtggtaaggacggcacggaggcgcgggtagcgcccgacgcggggcattttccaaaaaagatgtctaaggattacgcgagaccgtgagagtgcgtacgtgcaaaatcagggcggaatttctctcccgtgtctgccacggccaccggtgcattgcatatgcgcacacgaggagcaaagctcgcgacctcgcgcgttgcactgccgcactgaacgatcgacggacgacggcagcgcgcggccgggcgtcgcgcgctgtaccgcagcgcgcaccgcaccaactgaactctgcaaggtgcaagcaactagcgtacggcgtagcgtcgcgctcgcgcggccgcgcctcgcctcgcgacgtacgcgcttgcgaattgaaagccttccttttcgtccgttccctgagaccctgacccgcgcccacccactcgccaagcgggagcgagacggagcggcgcctgcacccgcgcgcccgccaatggcagggcggccactcgtcgcgcggcgttgctacccgctcgccacggcacgcagcacatgccgtgcatgcaaaagggtgggttcttataaaaaaaaagagagagtaagaaacggagctgtagcgtcggtccaaaagtttgtttctcgagcagggagatcgaagagagaagcatttgccctgctgctgctccggctggccggtttaaattcgtgctgctgcattcggccgggtagctagccggcccgtggttgggctccagtaggacacgcgacatgcatgctccacgtgtgacgctttgcctgctgtttcgtgtaccgcagctgcatgtatgcgtaaagtttttctactactagtttattttttattgggcggacaggtcgtcacagtagagcatttaccgtcgagccgcgtactttttggaacagaagagttagatccacagtgttttacatatccagtcgatttatgtttgggtttgggaaatttcaccggtgtaaaaagcttctcacttcatcgggcaccgtcttctgtaaatttttttcgatatgaactttgataaattttgctcctcgtccaggcgaagaaactccggctttggctataggaaacggatggtgcatgcatctagtcccgacgagcgacgtaagcaagcgttcgcccggtcttgatgtgtgccacgtgctggagaccgtcgtcaccagcttttaattcatcggaaagatagcaaagcgtttgtcgtcgtggtttacattgcatcgtctggtttccctccgagattttgtatgtacatgcatgtatagtctcgtagaccatacatgaccagcaaaaccacgtgcggatatatcaacttttaggcggttttgtgctggctgaaacaatatgtacctcagctgagaagtaatctcgaaagcatgagtacaccaccggagtcggagtgtacatgcatgcatgcacggcaaggtatgaccaaaaagcagttttgacgcagattgatcattcgatctggtagtgaaaaacaaaaaaaaaaaaaggtaaagtggtgtgtcccggtgtccgcctatacgctaaacttaccgtggtgctagagtacaagcgagccggttggtggaggcgagcgcaaaagcgccacacggccttctgccaatgaggcctcacgccgtcacgcggggcacgccagccagccagtgaccgcggcggaacgcgccacgggggacgatgcgcccgaggggggcggacgccgcatgcagcgcaacgcgagtacgcgacctcgcctcacctcaccccaccatacgcctcgcgctgctggctggaatccaccggagcgcgcggcccgcgactccgctccgcctacgtgtcggccgcgtccccgcgcggtcgcccacgtaccccgccccgccctcccacgtgcccctcccccctgcgcgcatccgattggccgcccacgccttcttaaccccaccaccccaccactcgggccccaacgcatccgttcaccacctgcgagagcgagcgtaccgttcgttcgttcgtccggtgtacgtctcgccatggccatggtgcagccggtggacatggccgtgaaggccaacgagatcatggcgaggttcaggcccatcgcgcccaagcccgtgctgccggcggcggcggcgggggtgacgggtggtggtgacggtgctgcggcggtggcggcgacgaaccgcgtgctctgccagctgcagagcaggccgtgccgggcgcggaagcgggggcggcccagcgtagtgccgccggtgtccccgccggcgggggccaagaggaagagggcgccggcgtacccggtccccgtggcgccgctccggtgcgcggcggtggccacggcgacgagggcgcgcgtgtcggtggtggtcgtcccggccccggagagtgcgggcggggttagtgcgctggcgccggtgtcgccgagtgccggggactcgacgaggctctcgccgacggtggtggaggtggaggacgaggacgaggagaggggcgtggtgctcgtggagcgcgacctgctgcggaagctgctggagccgcggaagctgctggagccgcgcgcggtgcgccccgtgggctccaccatccacgtcgagtcagtccacatcgacgtcggccgcaccaccgccgccgccgccgcagccgccccgaagacggcggaggaggtggaggcggagctggagtcggactccctcccggcggtggtctcggactccagcaaccgcgtccggctggtgaacgacgcgtacaagcgaatggtggggcagcccgagtgcccgtggctcgacgccgtggccaccgccgcgtccaggaggatcagcggcgaggtggcgctggtagtgtccgagccggcggcggcggcggcggcgctgccggagacatgcaaggggttctcgtgctcggccaagatcgcgtgggagcgcgacggcaagtggtcatccgtccatgcaccgtgcgacgtcacccggctgcagtgcgagtcgagggactacgtcttcgcctggaggttccgcgccgccggcgacgaatgcaacacccaccgccgcgccgccggcgacgcgtgacgacgtgatgcatcaagccggagcaaactttagtagtgcatagatgtaatcgtgttaaggtgcaatgttactagtagtagcaaactagatcggctgcttcctcttttgcgaagcttataggatgcaaggccaggttctaaagtatatatgatgttgaccggagaatgcaagggaaaattgtaacttttgctttagtgagatttgtttgttctcatgtagtttagcactaatgatccatttgacagcgacaagtgattgcgtctgcatgcatggacatcccaggatagatgcatgcatggacaacccaggttagacaaatgcgtggtcgcaatcacattatccgtgtcgcgttatcaaacaaaataaagaaaaacgtcttcactgtcgtgttccaagagttgagagcaaaccagggcagaacaacacttaagttttgctttaacaacctaagcaaacaggtaaaggatctttatgaaatgatgtggaaggataatggtaaacaattttagtacacaggaaatcattctatttgatcacagtgcacgcttattataattgagagttggttgaggaacggtctaagcccacactcgcacaacagattggagaaaccaaaaacaacacatatgggggtaaacaccatcttgtgcatgtcctgctagcaatgtagcatgcaagattagtgctcaggcttgctctgccttcgggggacccctccacttgaagttctctgcataagatttggcctgcatgacagaaaaacaattggttaattacagggaagctactaacttaatgcacaacaacctggacggtatgtattaaattggtcaaaaaatctgggagaagagtgatatccccttcgtcccg

SEQ ID NO: 55336 - DNA, 851 bp, Oryza sativa
tttacgattaacttagtactatcagtactatttcataaacttcttcggataattactcagtagcatacccttcgaatgaatcatgacaaattatcattcaaatatacaaataatgaaactaaataattcaaatattttaaccaacaaataaatactacaatttctgaccaaacattatcaaaaccctaaatcacatacatataacattacaaaaatattttcctttcttacacactaaaataaattacatattattaaaaaaaataacttattacaaataaatggagaacgcgaccctgtcgaactgcggcagttcgacagcccagcctatcgaacgggggctgttcgacagccctgcctgtcgaacgggggctgttcgagtcctgtcgaacggcagccttccgatctcctcgccagtcgcgctatggccgttcgataggtgccctatcgaactgcacccgttcgacagagacctattttcgcgattttccccggttgaccactacttttgcgattttccataaaaataatattaattctcaaaaaaattcctccccccactcccactccctcggtttttcaccgcacgcgcacctgaaagaatcaaagaaacgcctccgatgcgctgcgccatgatcaaccaccgactttttgaccacgcgcgcgcgcgcgtgcaaagcgcccacctcctcaccgtgaacaccgtcccgtccccactcctcgccgcgctgccaaatgtacgtcgctgccacctgcccaacggtgaaaaaaaaaccccaccgaaacgctcccgctgcctccacgtctccacctcgcaccgcgccaaggcggcaacacccatgcccattact

SEQ ID NO: 55337 - DNA, 3108 bp, Oryza sativa
  unsure (1)..(3108): unsure at all n locations
ttgtagcgtagcgcagcgtgggagtactacactgcactgcatcgcgcaaccaaccaaccacccaccacaacacaaccctcctctcctcatcatcactcgctcgctcgctctcgcgctttgcggcaactggcggtgtctcctagcccttgcctgccatggtgtcgctagccggctcccagatcccgtcgccggggcagagtccgtgcgcggcggcgcggtcgcagcgccgcggcgcggggtactccatgcggaccatccggtcggcgctgctgcagccggactcctgcccgggctcgccgcatgtggcggccgcgtacgacgcggcgggggcggactcggacatggagaacttgacggactccgtgattgatttccatctcagcgagctggcggccaccgcggggcccgcgcaccccgcggcggtggccaagtcgtcgtcggccaacgcggcggccacggagatgctcgagctctcgcgggacttcagtgactactcgagcttcaactcggatatctccggcgagctcgagcggctcgcggcggcggcggcggcggtggtgacgcccagatccgacgcgccgcaggtgggcgccgtggatctgaatgagcttgagtcgatggatctgtccgtcgaggcggcgccgctggagcgcgtggagccgttcgtgctggcgtgcgtgcgggcgctggggcccgacgccgcgccagacgcgcggcgcaccgcggcggcgaggataaggctgctggcgaagcacaggtcggacatccgcgagctgatcggcgtgtccggcgccatcccggcgctggtgccgctgctgcggagcaccgacccggtggcgcaggagagcgcggtgacggcgctgctcaacctctcgctcgaggagcggaaccggtcggccatcacggcggcgggggccatcaagccgctcgtgtacgcgctgcggacgggcaccgcgtcggccaagcagaacgccgcgtgcgcgctgctcagcctctcgggcatcgaggagaaccgcgccaccatcggcgcgtgcggcgccatccctcccctcgtcgcgctgctctccgcgggctccacccgcggcaagaaggacgcgctcaccacgctctaccggctctgctcggcgcgccggaacaaggagcgcgcggtcagcgccggcgccgtcgtgccgctcatccacctcgtcggcgagcgtggcagcgggacgtcggagaaggcaatggtggtcctcgccagcctcgcgggcatcgtcgagggccgcgacgccgtggtggaggctggcgggataccggcgcttgtcgagaccatcgaggacggcccggcgagggagagggagttcgccgtggtggcgctgctgcagctctgctccgagtgcccccgcaaccgcgcgcttcttgtccgtgagggcgccatcccaccgcttgtcgcgctctcgcagtccggctctgcccgtgccaagcacaaggtaaaaccttttcaactttacattcctcttgtttgctaatgtcatatcgggattggatatttgggtatgatttgcaagatttctagtatgtcgattttcaagtgtagattttgggtttgagcttttggtgtgactgaagcttttggataattgtaccgaacagtatccaacgaattcacctgttagagtttgattgaagtctgattaccattataataagtactgaaaagtacattaaacctagacggaggaaaaggttcactgtgcacgtacctgagtttaggtagatttctactacctgattattatcaaagctgtttaattcagccctggtttctattaagaaaaccatcatgctagctaacacgcaatgcagatttgcagtacactagttgttgacttgtagattcttttcacatagtgcagatatgcactttattaattatacatatcttaggtacagtcttggatttgctaaaccttcgaggtacaagaggatgcacgttcactcttctgcaagtcaaaactgcagtacctttgctgttagcttggtccttcgatttaagaaacattgcttagttcttactacctccgtcccacaatataagggattttgagtttttgcttgcaacgtttgaccactcgtcttattcaattttttttttgcaaatataaaaaacgaaaagttgtgcttaaagtactgtagataataaagtaagtcacaaataaaataaataataatttcaaaaatttttgaataagatgagtggtcaaatgtngcaagcaaaaactcaaaatcccttatattatgggacggagggagtaaacaataagtatattaattatttatatgacaattatcattttgccaccatagtctagcctgtcgtgctttatctgcctagttgtacagtcggattggaaagagcacccccgaatgtgtgcttcactagttagctatctagatttactgaatctgaaatctgcttccaaattttggagacacttatgtttagctgtgtgatttgcaggctgaaactttgcttgggtatctccgcgagcaacggcaaggaggtggtggctgcagggttgaacccgtggcagcttcgagcttggccaggtaatgctgtaatcatgtggtcgcagtatgcttcgctcttatttaacctcgtgtgctctgttcttggagaatggagtagctgtgtaaggaggggtagagatgatcatctgtaaataacggttgatggctttggtttggtaatgtgaatacaaatgtggtttgcgagtgacggatggttagttggtataactaacatcaactgagaggaggatccagccatccagggggtggggacagagggtttggattgttggtaactgctaaggtgacgttgaattttagatgtgtacaggatgctagggtggtatgcttgcttggcttggaaaggttataggagaatgatggatcatcaaccatgtcttttttccttctggtttggagtccgaattcccctgttccaatttatctagtgtgacttattttgcaaatatttcattattctctttgctccatgtggtttcctttcttttcctgttgaatcaagatattctcaattgtgatgaatatagggctgcaggaatt

SEQ ID NO: 55338 - DNA, 745 bp, Oryza sativa
tgatgttataaaagacataaatcacaagtcataaaattataacttttatggatttataatgttataaaagacattgacttgtgatttgattttcgcagcggaaacagtgccaccattggtgccatagttctacggtgcatatgctactgtcttcagtaacgcgttcggcgttcggccataccgtgcaaattactttacaattcttgtcttctgaacattcgatttcgaaattttgtttttcagactgagaccgatcgatgtaaaagcagatgggatataaagtttcatcaagattaactgctgattttcttaaaaaaaagaaagaattaattgttgattacttccttcgtctcaaatgtaagcatttttaaggtagtcacagatattaaaaaaactagttgataccccgcacgttgctgcgggatatatagatatataactttgaagaattatggctccagcaaaggttttaatattttgcaattcaagatatgagctttcttaacgaaacaggcatagctgcaggccttagcaagcatgcagatgaagttaattactttgacaaaaacgaactgcaccagaaaagtctgaacagaaacttgcaaatgtaagctaccaggggccaggcaaagtaccgattgtagctaacatattgcatttaacccacaagattagtacagtttgttgacaaaaggaaatgaaattctataagagcatttgaattgtcgtgtctgggctgcaggaa

SEQ ID NO: 55339 - DNA, 1323 bp, Oryza sativa
agccgggcgtccagtagctcgtgcaccaaggccatcgccgatgccaaggtgctcttccagcgtcgccgacgcctttccatctcctgacgcggttgacgcacgtgtgcatacgagatgatcgatggctcgaattgggatactttttttgttcttctcaatttttgtgggacttgcacgaattgtgtggcgtgacatggacgatggcacaaaattgcaaagaattgcgggcatcgctgtcgtcctgtcgccgacctccattgtcagttggtattgcttccggggccttggctaggccgcccggcgatgctccttacatgtgtggtgacagtagccagatgatggccggtgatagcaagcaggtacagcgctggccgctgcagccttcacttcgccgctccgatgaggacgacgccctccatcagggaagactagaagagcacaaatcttcaaaggaaaggggaaaccgagcaagagcaagcaaagtaggtggactgaaagaactcgccgccacctcacttgcagcatgccatggatggatgccctatcgtccagacctaggaggggtaaaggaaggaagagcatggtcagtgggtcactggcgggtggatcctacaggatgactcaacgggctggacaattcaaagcgttgtatcggtgaccaccttccaaaaatgccgagggaggcaagttatacctgttttaatattttaagtgtctagatatccggtaccacgattcaaggatatgaataagattggacatatattgagggactagaagtagacttactgcgctgtataaccatctcacagaaatcaacccagtaccccgatgccgtgaagcccaccaacaccccgtggattgagattctttaacgaattaacgtgaaggtaaaaagacgtggctcggtcacatgttagcgatcgtcagagggaacgtagcatgaggctcttccctcacctcgtttccggcctttcagttttggggggcgcccgccggcgcgggtcgcgtcacacacacacaccgcaccgtgacagcggcatccgtagaatcgccggcggcttggctcacctgagagaccccgacagcttgggcgccgcgtacgcgctaccgtggccaacccaaaagagggagcgagcctgatcaagcagagcagtgacttgcctagcgtgtcgctgccattcaccggttgacgaacggactgcgatactgccagccaagtaaactgtactatgggatcgcgaccgtgtagccaacatccctttctgttgtcacttccggcaggtcactttttttttcgtcatttgtaatttacgcattttt

SEQ ID NO: 55340 - DNA, 1819 bp, Oryza sativa
aactatacacacccaaggtatgcatagaattgcgttgaaggtactactacaaggagagaagcgaagcatatatataaatattggtcgttgtcataaactgctatagctaccggtccatcacccgttgaatttcgagaacatatttgtatggttgaattgtgatgagaaaattgacgtcgttcttatatgtgagcgagaggcgcggtcgatggcgggagactggactagcgcgagaggcgcgtctggtggtggaggaggccggcacggcgcgatgaggcgcggccggcggtaaatgaggcgaccacggtgtgagtaggagtggccggggggtgtggcgtggtcttcggcgcacgaatgctggccgacgggggcgccggtgcagtggttccacatgtcagcagaggttgagcagtggtagagcatcggtgcgtcagccatgaacttgcaggtgatgagcggcgggtgaaaacccagcccggcctggccggaccgacaacaatgttccccctccaaagggcgttgtcgtgtcgtctcatccctcaagggtgtttgccgggcgaaaacccagtcttggctcttttgagtccctgacggacggcggcggcggttttccgtcgcttctctccttggagacgtcgtttaggcatcccttgtcgaaaccactcgaacgactggtgcaagcacactctagatagagttgggctttgtgttggttgtaagggcgtcttttgggcattctcgtatgtgttcctttgtcggcctagcggcggtcagtcacgcttagtggcggccggtccggtgctagccttcttccggacctatgtgttggcgctgtcggtgtgggtggtagtattttttttcctttttcctgattacgaccttccagggttgtaatcttgtaatttttttctgctctatcaatagaacttcgcaccatctcgtgcgagtcgttcaaaaaaaatagttttgaagttacaaagtgtagtcacatacatatgtgcttgtgtcgactaggctgcattcggcagcatgacaataggagtttgtttgtttcttttttttcgcgcacgcttcccaaactactaaacggtgtgttttttgtaaaaaaaattctatagaaaagttgcttgaaaaaatcatattaatccatttttaaaatttaaaatagttaatactcaattaattatatgctaatagctcatctcgttttgcgtatcttcccaatccccttctcctcaaactcagccttaatacaagttaggtcacatcaaatctattcccacccccaatatggttatttggtctattaatatgtagtaagcttaaagtcaaccttgatgaatggtgacgaatgaaattatgttaagggaaaagccaagacaccatggggatgaacaccatgttgatgtattgatgtgatgggttcataagtcgatcataccaacaccaaaaatcgcaaagaagatatttggaaaaatagaaagaaaagagattcattttcaaaatcataagggcatgcacaattctcatgcgtggcaagtggtttcggctcaccaagtaggatccttaggcacgtgatggctcatcagggtaaacgtgtggggcgacaagggagaaaagggtgagaggaaggctgtgataactaggggagggagaggaggggcctaccatcatggatgctccgtcaccctgatttgtgccatcgttgaaaagttcattggcccgctgccgctgaagagcggagcgcctagtcgatcagattttctccatgctgccctgatctgcaccgctcttgagggtcacgccttgtcattactcg

SEQ ID NO: 55341 - DNA, 3908 bp, Oryza sativa
tgtttggctcataaaagctagtatacctaacaatttaaaatctcagataaacttgttgacaaattcaaatgaatcgaaagacatgagccgaatgagctagcaaaccacgagtttttatccaattttaaaagtcgggttacaaacgtctctcacacaacgaccagtgatgaacctagaacaaaatttcctaggatacaatatatagtaattatctaattattaatcgatatactaattaatatgatataatttagttaggatatggataatctatctggggtccttgtcaataaacccgttattcagaaaacccatatactctgtatcaatttaatcacgtaaaaaaaataagtcagatgatcctcttcccaccgatccaccaaactgaagcggagcatgatggcggccgcggaaagggccagtatccccccgttgaaaactccgcgcgagcgtgcggacgcggcggggcccctcacgccacacccaccccccgccggcaccgcgcgggcaggcgcgggcagccgcggccacgaagcggactcgagacgagacggttccgattaggaaaaccaaaaaaatacgcccgcctgctcatccaaaggctgcaggtggacgcgccccattggtgcggcccgtcacgcgctgccgccacaagcagccagagcccagaggcgagtcgatggatgcctttgcttgactttttcgggccatatcgctcaaaaccgtggaaaaaaaacgggagtaaaatatagcctagaaacagcgcacccgcctgatctgagctcactgcattgccccggactttctgcgacccctttttcccgacctttctacaggccatcctccctttttccagttccctttctacccctttttaagctacctgtacacgtactaattctataatctacacttctacagatacagtggtttgaacgaatgagtgaaggtatactcggggtaattttcttgaggctagggctgtgtggctgctaaagccaaacaaggcaataaaagcaagcttagttaggtacgggagtagaaaaaaaaaagcaaggtgagactaaaaaaaaaaaaatctgctgctactaccctaatccccctttggtgttatatcctcgagccccccagtagacgctgcctgctcctgctctctcctccgcctgattcctcattcctccaaccagtggtgtgtgcttgctgctgctgctgcttcagttctcgagtagtactccagtacagacaaggtaagaggcgaaaccgccgaatcctctcgtgctttctgctttcagatttgctttgcttccccgctctgtagcttctgtgctctcttggattccctgggatttgtgctctttcttgcgctttccctttattgggatggaaacctacgcggcatcgatcgccctctcttttccgggagtttatttatcttcagttcttgagtggttgtgtggttgaatcgagttcttggggctgtgaactggtagtgattccatctgttcgagaaacgttgacgaggaggagactctgtgtgctgcagtttctgggttttatttttcttttttgtaagcatctgccgacagttcagcgttgtgctgttcttccacctaccgtcggattttgactatgcagctgctctcccaccggtttcgatttctttagtcggggggaaattcggctcaattttgtgtggatttggtttgattcgttgttatctcttttggatgttgtttgcaggcgagtggtggtggtgtttgttgccatggagtcgcagcaggagaaggcggtttctgcgccggcggcgaacgggagcggcggcgccggcggcggcgagctgatcgggtacgtcgacgtgcacgtgcagagcgcgcgggacatccagaacatctgcatctaccacaagcaggacgtgtacgcgcggctgtcgctgccgggggagggggcgccggcggcgtcgacgcaggtcatcaacggcggggggcgcaacccggtgttcgaccagtcgctgcgcctgggcgtgcgcgccggggacgtcgacggcgcgctccggtgcgaggtgtggatgctgagccgggtcaagaactacctgcaggaccagctgctggggttcgcgctcgtgccgctcccggacgtcgtcgccgccgagggcggcacgctcgcccgcgagttcccgctctccaccaacgacatcttccactcccacgccgggttcctgcagctcgagctgtcctacatcggggtcgtgcctgaggtcgtgcccatctcgccgacgcccaagccggccctggccgacgcggaggagcaccgcgccggcggcgcggcgaacggtaaggagtacgagaagatcgagttccccgatctgaatctcgtggaggagaaccagatcatgctgtcggagtacatcgggctgccgtgctccgccgtggagccgcagagctccgagagcctcctgacctcggaggaggacggcgacggcgccaccgccgagacccacgtcgccggcgtgcgcgtcgtgcagagcttctcgacggacaacagcaccgccgactcggccggcaccttccggagcgacaccccggtcagcagcgtgtccaccacggagtcccccgccgccgccgcggtcccggccaccccgcagtccaactcctccggcaatgccgtctcgtcggcggagcagaaggagaaggccgcctccgacgccgccgacgcggaggtggagtcctcccgcaccgtgcagagcagcgccagcccggcggcgaactcccccggcgccatgtccgagagcgcggtggataagccgccggtcatccgcgtcaacctcgagcaggaggtcaaggtcgaccagaaggagatcatggacatgtacatgaagagcatgcagcagttcacggagtccctcgccaagatgaagctcccgctggacctggacaacggcagcgacaagagcgcggccgtctccggcgccggcgccgccgcttccgacgcggactccagcggcgccgactcgggcgcggcggccgcggcggcggcgaagaagccgatggccggtgggccggagaaatctcccaaagtattctacggaagccgtgctttcttctgaagcaaagagatggggcatttgcagccgtcggatctcagctgaaacttactactagttcagaggaataacacgttctcctcctcctgctcctgctgctgctgttcttgttctaggcttgtcatcagatctcgcaagacgagcaaactagctgctctgttttaatatatcagtactcttaatgaaaaaaatggtttggtttcttcgttccttttcagctatatttcgatcaaaaacggttaaattcgccaagaaggaacacggtaaaatcacccgtctttgtactaccatccaaaagcatcgaggcgtatttatctgtcgattaaacgctaaaaagtacgttcatctgtcttgggggatcatagaaacactcgcatttgatgcttgtcatcaccatctgattggaagaggcagctgcccacaccatctgattgtactacctagaagggcggtgtgggacagcgtggaaagtgcaccggtgccaattctgaagttgttcgtatgccatttgtcgatcgatcttgctcatggtttcaaggctttttaataggagtcctgaatacaatcaataagcgatattgatcttgtcggatgcatgtctgcgtatacaggtatactgatggatgtggatgtcgaaagtagcacatcaataacctatatgctgtgatcatggaatactcctacctttctttctcaatccacactcctgtttgtgtaggtctgtagattgttgggttcatcttgaaatgtacgaattttacacggttttttaaaaggaaagaagaaaatttaatcgggctgcaggaat

SEQ ID NO: 55342 - DNA, 744 bp, Oryza sativa
tgcactgttttgagaactttttttaacaaagatatcctgggacatcttatttctaacttatattaaagaaaacagaaaataccatatcaaaaaggaaaattacaatcaaatttaacaaagtcttctttttcaccgcatccatcacaaccatggctgctctatgttgttccacatccccgtcgatcctgtcactagtggcagagaggacaaacagagaacaagaaaaaaataatgaacacttgtattttttttagagcttgaacacttgtgtttcagctttttttttctctctctcccttcatccatgcttattcataattttgattgttatatttgtatattcatagattttccattgcatacacatattagcatatgttatcccacattttccgctgcatatttttcctattttaatcttattattctctatgtcttaaattataagaagttttataagattatagatctatcaggaaagtgggtggaactacacagtgaatggttgtgctaggtcaagatgagatagtagttaaagaaattaaaagtagaggattatatttggttgaaagaagagagtaggtggagaagttctattttatgacaatttttgaatacgagaagttattggatcttagaataaatgaagtaattttctcggtcattgaaatatcgaaaaggaaccgacaaattttaccaacaaaacgtaccatccgagcggagctgccatgcggggctgcagga

SEQ ID NO: 55343 - DNA, 706 bp, Oryza sativa
cgatccgtaccagatccggccgcgatccgccgccgatcggacccggggcccgggcacgcaggcggatcggatcacttaccgatcggctgctgcggcggtcgtcgtcgtcgtcggctgctgctgctccggcgccgccggcggcggcggcggcgaggaggagggatcgggggcgcccgcgtcgccgctcctccctctcgatctccggcgcggctaagatctcgatgcgggcatgggaggagggggaggaggaggaggcggaggttggggggatgttacttgggcttcgacgcttcgtctcctcctctccttttatcgaacttttgctctccacctccctccctccgctcgctcgctcgcggtgccgcgatgcgctggtggatggttgttttgggttttttacttttttgcggggagaggccaaacttttttattcggcctccggaaccctgcaattgcggtgctcgcctcgattgggaaagcgggggaggagggtggggggacgcggaaatggtataaataatggacagcgggggcggggcaggtcggcctactggcccctttgccgcgctggacgcgacgcgactctacgtggctggaggaagaagacgacctcacctactgctgcttccgccgccgccgtcgccgatgctgccgtgaagcaatctcgctcgctcgctcgctagcggcgcctttaaagcaggggagg

SEQ ID NO: 55344 - DNA, 885 bp, Oryza sativa
tctccttctttatttgcttgctcaatctactattatttctatttattcttcttggaacctttaaaaattagattttatagtttttagagtttattgtcacgttgagtttcgtatttataatttctagatgttccgtcaaacgttgccattatactcctctacggcccatccattgtttcttctctttattgtcattgagattttaaaaatcgaacataattatcgtttgggttcattttttactttctagaagtcccgccaaactgtcagcggctttgccattgtactcctctacggctcgtccgctgcctcccttctttattgtcattgagattttaaatcgaatataattatcattgggttttttttactttttggaagttccgaacctttaaaaattagacttgtagttttattttttataatttttagaagtcccatcaaacgatgccattatgcccctctatagcccgtccgccgcctactctttattgtcattgtgattctaaaaatcgaacataactatcgttggaattcattttttattttctagaagtctcattaaccgtcggcggctctgcaactatactcttatacaccccgcccgctgcttctcctttttattgccattgagattttaaaaatcgaatatgattatcaatggggtttatttttttttactttctagaaatcccagcaaccgccttacttgtttgctttacggcctgcctgacatccctcctttttttttagaaacacagtacaaatataggcgctcacaacgtgcgcacactcacccctatgaatgcacacacgcacaccctacccctatgagcacctccgaaagactgggccggcatatcttgacatccctccttttaatcg

SEQ ID NO: 55345 - DNA, 5051 bp, Oryza sativa
attcctgcagcccatcacacttcacataacaccgttatatgataattaatgatataataataagtttgatcaacaatatgaacagaatttaacaatatctcaacaccgataagttgagtagaccaaagttcagcaacgtccacatgccatgccctagcgttaacagcgttttcctttggtcacttcccctttctaatgtgctacaaacctgctaggcttccttcattcataggcttccgatatgtttgattggttgagtcgctatggaacttttagaattttgacgaaaattaccatacaaatacggttatcgataaaacggtcagaaaaaccttcatcctatttccggaagatattaccgttgccatttctaacacggacggtaaccaatactgactgaaatggtcattggaaacggcagccgaaaatcttaaaaattttcgtaccgttttcaccactaatcggagccgccggatgggggggtcggcctgaccttcggaaacagtcgtgctctgaatcgcgcgtattgacatttccccctagcaactcttcagtactccacaatatcgatgcttttgagatagctactcggtgaatgagacagtccagtgatgctacctgtgagaactgagagcacaaaattcagcaacttcgttattgcgtttacgtgctaaaacgtggtgtttctgtctctctgtctcgggtttctgccctgctgatgccaccaaagacgaccgttaaggttcgcttcgactggaacttgtactggtggtccgtcggctacacggtcaccattctgagagcaggtaaaataggtaaaatagaaggctataaaccagctataaacatattttaaaataataaagaaagagagagaagagcagcagactacatatctgtagcccagctgcagcacgaactctaaaatgtaatgtgtgtatgacaagtgagaccatgtattaatagtataataagcaactattgtatgaattagctagtagtgggttatattattaaacttgctctgagcatcgtcaatgggcatcggcaattcggcatcctgcaacctgaccagaagtgcagaaaaaaacgttggtgccgttctggtcatcatcgccagcgcggacacgcggaacgcgacgtcggccgccgttcgcctcggtggtacatgcgtccagtgcacgctggcgctcagctcctccagctcgctgcactcctctcgtagacgcggcccccggcggagaacgcgcggccggcgtcgaccacgacgtcggcgccagcagcgaggaataggaggaggcggggaggcgaggcgccatcaaggaacggcccgagcccatcatcgcaggtggcgaggatggaaggatgcagaacgggaaagaaggttgtgcttggagtgtgccaggagagctggagatgaacaagtgaggagatatgccctgcaatagtgcaatttgtcagcgggagaccgaggcgtacccggagaaatgtttggttcatgcctgcatacgtgtggagctgtgggctgggacaacatgggccaaatgggatggaatgtcagatcggggtaaaaggcctagtttcgtagacttgtggccttttgggcttacgagctttgacggccttgggaaaataggccagctgttgggttggaacttggatctggatctgaagtctggaaaggaataagttcatctgaggtcccttaactcgtcaacgaatccgattttcgtcattcagccagaaaaccagatacagtaggtccctcatctatcaaaactggtaaagataaggtccctcggcggtttagagagcagttttggctgacgtggcgtccacgtggttaatttgactcggtcttcgttacgcgtggcattgatgtggcgctttcgtggcaattctatcacagaaaaaataataaaaatcgtgggcccacatgttagttacacaaaaagaaaattagaaatgttggggcccaagtgggccccacatccctctcccttctctctcttcttccctttccctctcagggcctgtttggtacagctccaactcctaaatttaactccaggagttgagtctggagtggagttgtggagctgcctaaacccagctccacaactctagttcattttgtgagagagctccacccagctccactcccagttttggtagagccgaaactgtttggctgagctccagctccagaaggggtgaagctggagctggagctgtgccaaacaggccctcactctctctcttcttcccgggagcgccggagcggacgggcgagtgggcggcggagcagcagccggcgacctcagcgaggcggcgcccttgctgccgccttccctcttcggcgatggccttcacgcggcagctggaccaagacggtggacaacagcgccggcgacggaagcctcaaccgggggagaggaggtgccgcggtggccggagccggggtggtaggcgcggcggcgggtgtggtggtggtaggcgcggggtggtgggtgccgcagcgggggccggtgtggcgggggtggtcagctggcagcaggcgtcctccttctccatggacaccggcaagcagcacttgctcatcgtcggcagcaatgcgacggcctcgatgcgctcatgctcgaggtcgaacgacatgatctacttgccctcggtcacccagtacgtggcgccgttgacgctgacaacgccccaggcgacgcacaggctccacggcgacgcccccaccgcgcgccgccggcggcggtggtgtcgtctcccagcgtgaggatattcaccaccccatcaccgttgccgccgccatggcgggaggggacgacgacgatgcggtgccccccagcgtgacttcatccaccagcccgccattggaagggaaatggacgatcttgtacttgccagtcgtcgaatggtagccgaagctgatcatacccgcgtggctgcggctggtcgccaacggcggcgacgggatatggagggactcgccggtgaccgggttgatcacgatgatgctgccgcagacaaggggatgtcgcttgagccacaggcagttgcacgagccaaccatgtcgtcgttgtcgttactggctactggtccaggtgccgcgtgaaggccatcgccggagagggaaggcggcgacgagggcgccgcctcgccgaggtcgccggctgctgctccactgcccaccagcccgtccgttccggcgctccccgcgaagaagagagagagggaggagagggaagaagagagagaagggagagggatgacgggaggagtgaggctgatggtgtgcaacatctcgtcttccccgacgacgtacacctcctcgcacggcttcaccgccgcgccgcctagccgccggccgcggacctccacggaccacggcctcagcgtggagcgtgcacaacacaagcctgatcagtgccattgcgaagcaccacgacgccgtgtccgttgccgacgcggtccccacggacagctccgccgcgtcgttcatattccggaggtggagagaccaggcgcgcacgcccggagtcagccgtcgctccatagctagcagggagagggagaaacaggggagagaggaagtgagaagagggacttgtggggcccacgtgggccccacctttttttgttaatttgtgtgtgagacagacatgtgggtcccacgaagtttttttttgtttttgggattgatttgccacataattgccacgtcaatgccacatcatatgaagaccaagtcaaatttgccacgtatacgccacgtcagccaaaaccgctctcaaaaccgccgagggacctcatctgcactggttttgacagttgagggacccgttgtatggtttttttagttgaaggacgaaaattggattcgttgacaagttaagggacctgagatgagctcattccgtctggaaatgggttcggtttttcttagagggaataagttcaacggagatacctcaacttaacaccaacattctttgaggtcccttaaccatagaactagaaatgtgtatccctaaactatgtaaaaccatttaaaaaagggacaatttcgtttctgcccctattttgatgtctaatattgattttacccctacttttttcgttttacttttttgaactgaacgcttgttttgcccctactttagaggtgaagttaacggtgttaagtaattgacaaaatgacatttataccctctcatgtatgttcattaattatgtttttgtccccattttatgcatgtagctttataactttatttttgtgagtatatttaaaattaaatgaagcacattgactagtatctaaaggaacagataattacattttataaaatgttgttaaaatgttgattaagttatatcaaaatgctgaaattttgtcaaaattccatcaaattcagaatttgtccaaattgttatattagtcaatgcgggtcatgtaattttaaatatactcccaaaaataaagttctaaagctacatgtataaaatggggacaaaaacattattaatgaacatacatgagagggtataaatgccattttgtcaattacttaacactattaacttcaccatccaaagtaggggcaaaacaagcattcagttcaaaaaagtgagggtaaaaatgaaaatcctaaaaagtaggggtaaaatcaatattagacatcaaatagggttagaaacaaaattgcccctttaaaaaaggtcccgaggcagtatacccgctgccgctcccccaaaaaacgaaacagaagagaaaaagggagaaaaaggagattgctgattaggattgtcgaccccatatttttttcacttacgtgtgggtcccacatatttatttatttttatttttttgttaactaggatgccacgtcagtaaaaccgggcaaaaattgagtcgatactgccatgggacctcctttgaacgatttgaataagtttaggggtaaacatttctggttttacaggtaaggaacctcaaaaaatctcgctgttaagttgagagatatccggtgaacttatt

SEQ ID NO: 55346 - DNA, 837 bp, Oryza sativa
ttctccttccccggccccaacaaatcgagatccaggatgccctgaaccgtcaatacacgatacttacctcacttgaatgaagcaatccctaaccgcgagcagaggtgtgtgctgcgtgcgctaagctaggggggtgcggcatgcggcggcggcggcggctccgcggggcatggcgacgatgcggcgcctcggcggcgtgcggcagcagtagtaggcccgcattgcaaagtggtggctctacctttgcctcgctccagaacgacgacgccgttgggtaggaaaagatggacgcggcgaggattggtatcccgtgagaagttaggattagatcgtaccttgtatccatgcgtatcagagaagtatccctaattatttcatttttctgaaaatcagaaaaatagaggatacgtacgggcgtatcggagcgtatccgaatacgtatccgtattcctttacgtatccgatacggatacgctcccagccgtatcagggtatcctaggaggtcagtattgcagcttttgctcaacatatgcttgaggaattggagtagttagttcaacccaaatctgcgtgacgtctcgttccttccttaaaagaataatcttgtttagaagtaaagcgttttagtattagaaaggggccaaaatgttcgcttaacgagagggggcttattttgctattgtagtgttgtgcacagcaaggtttcgtaagtacaatgtacatatattaacaacctgtaatgttgttccccatcacgcaataccatactccgtattagattagtgctgaaccgggaagccaatgaagcctagttttacacggtaatcaaccaatat

SEQ ID NO: 55347 - DNA, 3182 bp, Oryza sativa
cgacaacatctcataggtaacgagacgatcaaccaataactggccttcctgactaggggaccatctgggttgatcgcgacattccagggatatgagatcaatgggtacacattctacacgagaacccaagacataaagagcacgaaccaaaatagcgttgttcgtatcgatgccatgggacacgatggaacaactggcacgtattacggtgccatcaaggacatatgggaacttgactatggtcctctcaaggtccctctgttccggtgccaatgggttaggttgactggtggaggcgtaatgattgatgacagtgggatgacaacggttgaccttaacaaggttggatactcggacgaaccttttgtccttgccaatgatgtaacgcaagtcttttacgtgaaggatatgtctagcaaaggaaagaagggcagagggcctgacgagccaaagcgtcacgtggttctcccaggcaaaagaaaaatcgtcggagttgaggacaagaccgacgaggattatgatcagttggatgggcaaccccctttcacggtgacgattgaccctagcatcctcctaccaaatgaagacaccccttactcacatatcgatcacaaggagggaacaatagtgaggagaaagtacgtgcggtcaaccgtcaccgccgatgtattgccgtaattattgtgtacacgatgtaaactattttggatgtattgattatccgtataaatcaattgttgtatggcatatgttaattacgtacgattattagaggttttaacaattttaaatcatgtaattgctagttatatgcgataattagaatttttaaaagttttaaatcatgcatgtggcatttacatatgttacttagagtttttaacaattttaaatcatgcatatgctagttatatgcgataattagaatttttaaaagttttaaatcatgcatgtggcatttacatatgatacttagagtttttaacaattttaaatcatgcatatgctagttatatgcgataattagaatttttaaaagttttaaatcatgcatgtggcatttacatatgttaattagagtttttaacaattaatttaatatcattcatatgctaattatatatgattattagaatttttattaattttaaatcatgcatgtcgtatgtatatacatatgttaattacaatttttaacaatttaatatcattcatatgctaagtatatatggttattagaatttttattaattttaaatcatatatttgcttattacgttttatccacttaatttactatagacaacaataatgtttcgaagtaattgtcattaatttttcgactttaaataattttaatgcattattttctattttagaaacacatatgtaatggaaattaatattcattgcgcttatcagtagtcccgtttcttaaccctaaccgggtttaaaaagaatttggaaatagcgggaaaatatctttagtccccgttgatgagaacaaccgagagtaaagatatctttactcccggtagttgagaacaacagggactaaagatctaggggtgtatatatattccagatgcgcaccctcgtcttctccaccaacacttagaagttttttccccgattgatctctctcggcttctccttcgccgccactccatagggcatccccgcaccgacgccgccgtcgtatctcgccgttgcttcgcgcgcgtcgtcatcgctgcctccgccgccgccgcatctctggggtgagagccgccgccgcctccctctctctctctctccgacctcgatctctctctctccccaaaccgccgccggccgcctcgttgccgacgccgccgccgacgtcgtcgcggccgaacacgactccgccgcgccgacgatgccgactctgacctcgatgcggccgccactagccacgacgtcgcgctggcagtgccgacgaagccgcgccaagccgcagccgcgccgccatgccgccgctccgctgccgccacgtgaacgaacgaagaatgatcgtgaacgaacgaaacgtacgtgaatgtgaatgaacaaacgaacgtgaacgaacatgaacgaacgaaacgtacgtgaacgagaacgtgaacgtgaacgaacgtgaacctaacgtgaacgtgaacttaacgttgtatgtgaacgtacgtaaacgaacgaacgtgcgtgaacgaaaagtgaagttaacaagaacgcgaacatgaacttaacgtacgttaacgtgaacgcacgtgaacgaatgaacgtaggtgaacgaaacgtgaacttatcgagaacgcgaacgtgaacgatcgtgaacgaaacgtgaacttaacgagaatgcgaacgtgaaatacaatatatgttactttgcgtttatcctaatacatcttatgttgcagaaaagacgttgtcgtcgtcgtccctcaagccggagtggtagctagccctcgaaggaattcgcgcaggcaagtgatgtaaatatatgattgttagatttttaatgcaagtaagactattagatttaatatacgacacttagacttagcatatatgattatctaggtttgtaatgtacgacacttagacgacttagcatatatgattacctagggtcctaatatacaacacttagacttagcatagtataagattattagatttgtaataagacgcatataagattgtttgagttagcatagttctaatacaagattatttgagttttaatataagattattagatttgtaattagacttagtatataattattgtctagggtcctaatatatgacacttagacttagcatagttgactattagagttttaatacaatattatttgagttttaatataagattattagagttttaatataagattattagatttgtgtaataagacttagtatataattattgtctagggtcctaatatacgacacttagacttagcatagttgactattagagttttaatacaatattatttgagttttaatataagattattagatttgtaataagacttagcatataagattgtgtagggctctaatatacgatagttagacttagcatatttgacttagcatatatgattgttagcatataagattattaaagcaaaaatgacctatagacttagcaactatttcttgtataacagggg

SEQ ID NO: 55348 - DNA, 3338 bp, Oryza sativa
tgatgacatcatctacagggagtacattgacatcagtgttgctgttggaacttccaaggtatcgccacctgtttttctttatgttgactgccctaactattattttatgcaatctgttgtaatgatgtgacatgtcatttgttttagggtcttgtggtgcttgttatccacgatatagatgcaatgaattttgctgacatagagaagggtataaacaaccttgcaaagaaggcaactgagggggcacagtccatcaacaatatggcaggagggacctttaccatctcaaatggtggtgtttatggaagccttatcagtacacctatcattaattctccacaggtgctcacttgtttttttttgctgccttgtaattttgtttgtaagttccctctaacacgagctttatctaatgtagtcatcaatcctcggaatgcattccattgttcaacgtcttgtggttgtgaatggcagtgtccttgcaaggccaatgatgtaccttgcactaatgtatgaccataggctgatcgatggtagggaagctgttctcttcttgcgccgtatcaaggatgtggttgaagatccacgaaggttgctccttgacatatagttccatgcatcatagatggcctacaaatttcactcgtttcaaaataattgcatgaaaaagttgactcatgtcatgcttgcttatccccaaaaaaaatagatggttgcaggcctttagacttgtacaagagggcatttctttctttctttcttttgttgaggtattacattttaggaagatgttctctaatgttttaattttactagagagaaagacgattactatttaggtcaaatagaagctttggagccacattctactgaacttttggcacacaattgtgaaaatgaaatggcaaccaaacatgcttttatactccttgaagtttgcctaactagcttgtataggcggaattggtctccacaggatgtgcgggttggcacaataatattaaatatctgttaacttgtgattctcattggtttctacgatagccacaacaagttgaaagaggccacaacaagtttgtatacaataacatcatctgcatttccttcgttacatgtttccactaaaaccaatagcacaaatttctccgtattttgttctgcgttgccgtcattttttgtgtttggtgtattttagtagttggatatcaggtattgtaaagtttatgagttctatgggttaaacctcactgatgcaatgttgcatagtgctaatttccaattccatgtggcgtgccatatgattgtgaacaatcagacaatttcccctagcaaaaccattaaaaacctcaccctccatgtacttcaacaaaatgtgcaaaacaacatgagatgactactgcgtcagcacaacgattcttacacaggttgctcacagagaaaatgacggcttgttgttataaattgtaaccaacagttaatttttttcactaagtgaaaacaatatgtgtttgagagaactcaccagaactttgataaactactaggctaaacctctacactagccttttctacattatactaaaccagcattctcctattgcaaactcagaactccaaagtcacagctgcagcagacgcaaccaccccttggtgacctggactgagactcgggactaactcatggtgtaaagctatacatatttttcgatttcccacacgatattccatcttcatttatctagcaagttgtcgatatcagttgttccaatgagatgcttcttgatcttaccaaggctgcagaagtgcttctcccttgtgttaataggtacaacctcttgaacaaattcgcacttcataccagctgaaacctgtacatttaatttatgttagatgtgtcgggaagaatcaaaagtctataaatggatacgcagcagatatttcactaattacatcaaacagtgcatctccgagctttatcttcattttaccactattgcacacaagtatcttccccatgaggccacttggaagctcatacagtctacaaccttggattgactcatgcctcctcttttgatcactccaatctaatgctgtagtagttgaattttaaattgcatgtctgtggagtgatatatttcatattaatttatcttactaatttttaaatatttttttaactatttaggtgacatgcatgaaacaaggggatatcctcccctcgagggatgaaaacaatttccccatctctccccctttccggcggctccatcgactacccaagagggacggggaggctacccgtacgtatcgatctggcagggcaccgctgctacccctcgtccccgcggtgtggcctcaccctccgcatctatggccagtgcggtggtgctcggtaaagtggagcagtgcacgtacgcatcggttgcggcggtcatgttgctcctcttcttcatgtcgtcggtggaagccaggggtgacaccaacgacatgtacaagctgtgcgcggacatggcgatgcagcgtggggatgaggaagagtgggccgccggtgaggatattggccatgatgctgccgagcaaccacctatcaacgaggaagtcatactcccgtgaccccaggatgagctctagcacgcggtacgatagcgtgacctttggtgatgtgtatagcggtgctccggccttggtgacgagctacgtgccgaagtcgctgatcttgaggtcgtcgtgggggctgacggcgatgttgtccggcttgaggttccgttgcatgatccctgctatgtgcattgctgtggcaccgtcgaggagctgccacatcagttgtcgcaccgctcctcctgcacgacacgcacaaggcttgacctgttgatgtactccgtcacgacatagcaacacgggcaagctctgccatcgccacccctcttcatctctctgtgtgtcgtgggatgctcaacaaggtacgggtggccctggcacgcctcgaggcaccgtggctcgcgaaagcactccacctcaccgtagttgatccctctatggaggcacttcacggcgggtttccctagtcctcgggtcctgcaccctatgcaccacaccctcgacttcctcccgatcttgtcgaggcacttgtagtgcttcatggtgggtggccacaatgacgggtgtcaaggggggaggggggtcccttggacagcggggagtggagacccctccccgagagtgaagagtcgaccagggggttagtaggcgagcggtgcgaggtatctacgatcacagcggtttcacggggctcggccgccccgcgagaaggaggcaggaggttatacaggtttagg

SEQ ID NO: 55349 - DNA, 3774 bp, Oryza sativa
tgcggggcatggtgcggcgtgtgtcccaggcgccaccgtccaaagtgactcaacgctggcgtcttgtccacgtcctttcaacttagactggccagggatccccctataatcctgtttcatttatggcggggcgtgctgccttacaactaattgtggagcacgcccaacttcccagaagtttctgaggtcgcgtcctattgcgcttaaagaaggtttattattccttgatgagtttctcgaaggcgtcgttgacgaaagaatatcttgagattgtgtgtcttgtaccttctgtcgcccctctgagtagaggggcgcgagctatacaaggtccaaggtgagccctgggcccgaggcaaggccgggcccgaagcacaccttggatcacgcctttatgcttggcaagcctcgtcacccttcttccttgagcaacgtgtgacttgtaggggctaaggcgagctcagggcccagagctaggccgagcccgaggcagatcttatctcatcctcttaagatatagatcttgcatgtttttacgccctcttgccgaggattgtagaatctgcaagggctagggtgagcccggggtatggaacagggccgggcccgagacagaccataggctatatttttaaggcatatttggggtatgcttggggcccgagccaggccgaaagctacttctatactcggagttttggaccatatacgcagtatccctcctcagccagagaaaatcccatatataaaatcttaggtgggcccaaagccctccggaagggccccctagctacaacaccctagggttaccttttatttttaaatatagtgctatttatttgagaatgatccttttgccgtataaatgggtacgtgggttcccatttcaccgacaacggggtcctagacgggaggcggcttgtggtttgtggagttgtgcggtctcttataggggaatcgaggagttttggttacatcatgcggctgagacgcaaagtgtgaagcgagtgctgccgtagatgccaagtggtggtcttggatgatgccaccgaaggcccaggtgacaccatagaggctgacgccaccacattcctcactgacgatggcggcgtcttggtgtttgtgcctgataaccatggtcaccgtctcgtactggaacaatagtgtcaccacgaactcggcgattgccgcgcggtacagctccaatgtccctacctccaaatcagcctctgcgcatgcggcactgctcactctctcgcacctaaacccctctgccaaccctcctagccatgccgctggccctccagcagccggcgccagagtgcatgtgagctttgcttgagagagagagaagggaggaggaatcagagaaggagaactggggcttacaagtgggccccactattttttatgtttacccttgtggttatacgtgggacccgcttctattttcggtttctttgatgaccgggtgccacgttagcacacttggaccaagtgaaactgctcccaaaactaacgagggagttgatttgcaccggttttcgaagatgggggaggcattatactcggttttgtggttgaggtatgcgattcgaccaaggacaagagatgagggaggcaaaatagacttaatccaaatattgaaaatactattggtaatgtgtagtattaggaagtattggtggtaaaccaaacattgacaaaattactattcaaaataccaatattttggtatggcaaatttcggcttcaaaccaactagcccttacatacatttccctctaaaacattctaagaaaacatttgttgagacaaaaatgaaatggtataaattcgtctaaattttattttatttttgatttacatgaaagacgcatacacgcacatacaccacactcacacaaaactcttaacccacattaaaaaggaccattagaaaatcttcagcatcagtaaaatcatattaaaagtacatccgcgtgaggaaaaaaaatatcatgaatacacaattccaaaaaaatataaaaatatacgtgattcgcttagggaacggatcttaagcaatgcaaagcattgtcatcatcgctaagcggagtggcgacagcggtgtggtgtcgcgggagaagaggagaggctaggaccttgggtatggcacgactaaaacaccatgccaccgtgcttctcgaattcattacaaaaatgattcaataatactatagtgttattataaatataatgttgtagaaaccggtcaaacatatatgattaacgctatttaaaatttcacaaatattttttcttgtaatagatatgtaaatattttaaattctgcacaatataatcgaagtacgttgatgataaatataactataaccatatttctttagttgaacgtaattgaagtatttaaagtggtcaaacacacggaatatatcagccaacttgtagacaatacgaacttcaaacgaagtaaatagcacactttttgttgtatagaaatattactatattgcacacatttacttcttattagtcgagaaatcatccgtccgccctttcacgtcccacctagcatggtcacaattgacctcctgaaaatcagaaatagcctgttttttcaacttcatgcatattccatagttcattcttaattgtatggacgcctaatcatgaaaaatataatctccataaaactaaatgtttcgttgcaatccatggacatcttaccaataaacatgtaacacaaacagatcaataagagcattactataaaataggtagcataaatagcatgtaatttttcatatccaaagaagtcctgccatccaaatagttgtttccattgaggcatctaacatttgaaccaatgcggcgcagattgcaaagcctgcacaaaaaagaagagtgcagcatgcagccttccacgagagacaagagccgctccgaatagccaaggaagacatgcctatatatgtatgagtacagagtactacacacacatataattgacgacaggactgatcaggggataatcaaaatgcagatgagcagcgtataaacacatgcacataggcattaggcaagtcatccttggctaccgaatcagctcttgtcctcatggaaggcccctcctctactaattaagctctgaaattaaccctctcaaatctgaatctttcatgcatggcttgctctgcttcattacgcatgtcttcaggtatttatagcacagaaaaggtatatgtgtgcagggaataatattagttggacaatgcagtgtaaatgcatttatatatttgtcctagatacccatatctcccctcaacaacttcgtctgctctttgacatctatacattttgtagtaccatcggaatatattcggttaggttaggttttgacagcttatggtcatggtctatcagctcatttttccctcggcacatgcccaatactgtccgtctatttctgaggtctacaaggcaacacgtctcaaataggttcaattgtcaagtttggtatggctccgactccaagcattctcataaatatatatggagttcttagactctaaatatagtagtttaaaagttaacttttaggcataaaaatatgaatatgacggcctactaaaataactccgagctactctgaacttcaactctaaggactcctttggagaataatcatgattctgtttaattcttataaaaactctcctaattttttttcaatttaaaagaggcctaaaatttgtttatttatttggattggca

SEQ ID NO: 55350 - DNA, 2669 bp, Oryza sativa
gaaattgtacactcaatcaatctccttatacactaaaaagtaaaaacatcgatcctaacaaagtataatgttgacaattatttaagtcatcactactaggaaaactattctccaaaatgggtcttcgcagacggacgaccggtccgcctgcaggaagtaatctgaaagaactgaattatatattcgtgagatggggaagtaatctaaaatatgaatttcgaacccagccttacctaccttggttaacatagttaacattatacttaaaactaacttccaaaattctatcatggctgctgaccatccacctgttcggcaaatttcaaatccattgtcccttttgacattttgcctgccttttgacattctctccaactgaaactttgttgtctttttgaccctgttaatttgttttgtctccagatagaagtcacagattataatggatttcaacatctttccatctgtgcctgtatgcatgtgttccaatggaataatgatcatgttttcattaatctgggaacgtgcatgatgcccaagtatatcaaaagttgctgaattgggaatctgagctcttttgataaactagtttagttgattactccacttgtcttgatgcaaacaaaaagatggatcgatctaactttacttcaatattttggatgcagtagaagatattttggcacaactcctgttaatacaaaaatgatccatctcatcagcatctcaatctctatagctagcttgctagaagatgctttgctactttccctcttggcaccttttgatggaacaaaaatgcatccttttggtcaattaatgctacttcctgcatcccacgtacacattgaccactttacttgatcatggacactctctggtttttaataggtaacatcattaccttttgaatgtatgttccgtcttattttaaaaaaatataatataaaaaaaatacatgtttatggtacctttaatgataaatcaattcacaataaaattaataatacttaagtattttttaataagatgaataatcaaaagttaacaacataatatattaaaaaccgaaaaaagtattattttccaacaacggagactagaggagaggcttagaccagatagcgcaaacatggaaaaacatctaatatatgttgaaggggctgcttagaagattgattgctaaaataggcataaattttaatactatacccatgagtttcatggtttcatctttatatgaagttcccctcttaattatccccgtttcttgaaatatatggaactattttccaagcatatatgtagatatatattacatacagcctagcagtcctcattgcatggtagtaactgtatataagtagtactattattatatgtatgaagtttcacacttagaaattttactttatagtatgagctgcaataacccacattcttgctgacttcattcacttcaaaataacaaatactccaaaattccatactaaaagatatatgactatcaacagaaaattaggatggcatgttccaaaattccatatataaatatgatcatgacatggatgaatttttatcaaatattaacccaaaaaaaagaaaaatggggaaatgatgaaaccaactattattatctatcctttatattttactccctccattccatattgtaggtcgttttagttttacctaagtcaacttctctaactttaaccgagtttatctagcagcttatttactatgtcatttacacccagccggtgggataattaattttcagtggttatatgactttaccaaagcaagaaattaagcacccctaactaaaaatgtgccgacatctataataacaaataaatgtagtatcaaaacatatttcaaatggtggatttaatgaaactaatttgttgttgtagatgtctatgtatttttatattataaactcggtcagaattagagaagtttgacttaggacaaaactaaaacaagaactgagagagtatgatcctatatatgatttttcagaatatctaataattttcataagatctctaactgtttatttttgtgttccaaaacctcttatactctcttgttatgaatactagtccttgattgaggaacactttttatgtaacggttccttttttacttggcatcgaatactatctatgtacaaacattaattagccgctcgtattgtttgagaaaaatataaatattttaaaagataccaaactatcaaagcacctaattataactatactacttacattcatcaaaacattgtaatttaaaagtttttattggtcaaaaataaaatcacactggccaacagtactggcaagtaaaagagatcagagagagtgtagttccaatccttacccaggaaccaaccacatgttgaaggttggtcgaatagatggttgcaaaatagaaccatagcggagctggcccctaatctagtaaatatgatccctaaaaagattagcaagcatcctaccatagcacaaactttagaaaatcatgggtggactgctgatatcaaaggagcactcattgtctaagtcattgttgagtacttgcgagtttgggacttggtggacggggtaatcttgtaggatggcatcccagaccaacatcattggatgttcatgaggtctgaa

SEQ ID NO: 55351 - DNA, 1489 bp, Oryza sativa
agcgaatgccacatgggtgacacagctgtggtgtggttggtcgcggcagtgaaaggagaaagaagcgagcgcatggagttcatcgggtgagcgttcttggtagtaggagattcttctccaatccgtgggagaagagctaggaggagcggaggaatccgtgtcccctcccgcggacctgcttctccggctgcccgtaagttggatttttctctgcttcgctccctcccctcctcgcgccattgtttttttcttggtcctttggctctcgggtgcgtcgccaccgcgattcgatctggggggagagggaggaggcgcaggcggagcgcacgagggaggtgggtggaggagagggtggggggcggcggcttagctgctgtggacggcagaaggggtttcttgtgttccagacaagaatcctgaggagtgagagcattacattgacatcctcatcagggctttgggtgtggaaagaagcgtataatgatgtattccttgttcagaatttactgttggttaaaaagtatatgtgcttcaacttttgaggacagggccatagggggtgaaaataagatataagtaaataacttacaaggaaacatggatgagagtgtgtaccataagcacaatttcgttttgtttcaataccaaatattttcttttaactaaatggattcattgacaataaggtatttgcttcaatatgcgttcttattacttcatatcataccacattttgtgattggggaatttcatatagtttcagatgctatgttagtttgagccatatcgtccaaccctgctcactccccctcctaaatttccattttccatgttttgttgtgcaggaaacatgctttctccctatcagcctttgtgatgcattgaacaggggttgagaagtactgtaatttttgtaatggctgggtgttccttggcaacactgagaggacaacatcgagggagatggatccaatctcacagcaagctccccacaaggattatgtctattaatctgccaaagaggtaaaaaagttttccgtactctgttgatattagtcatcttgagttcttcaatggtaatttaatgtttgattttcttcatttgcagtaatcacagtcacaagattcagcttccatgccagtccaatttaggaagaaaacagaaaactggtgcatttgctcctttgggttttcatggaaggtgttgccggatcgaaacatcagttaaatgttatttcttgcagtcgcttgtggattctgagagtatgatctcaccaaatttgttattgctttctgatgaagctctactaactatcagtatagtttttgcatatttggctggagttgtaccctctggccatgcatttcctcatgctagaaaccatagtcaaaaccaacatcttggagctccaggtccatctgattctggtaggtaagagtagctgcttaagtatgacttctagatctcaaaacaaaggcttgacaataa

SEQ ID NO: 55352 - DNA, 1194 bp, Oryza sativa
  unsure (1)..(1194): unsure at all n locations
atttgacaagcgccgtgagctatttccttgtcaacttgttcttgcttgttcttcgattgcttgtaggttcaaggttgttcttggcacggcaagaacaacaacaacgtggagtcggtgcaccggttgctaaggcgtagcacccccgtggtagttgtagtcggaccaccaacgtcgtgtcctcctccaaatcgaagtttatcctcgtctcatcgaaagatcgagaacccccgttgctgcatcaagtggtatcagagctcaagttgctcggtgagagatttttcaatcctttgtnntntntntancnctnanncnangncncncnantnanananananannancnncntncnacnananaagtnnangnngnntnnncgacngnnnaattnncccnccnacnannaaanaannttnccaacnncccacaaacacagnttgagcctttgttgttctacttagtttttgcttgctgagttttcggttgcatcgattggttgagttactggttctggtagtttagtcctttagagtttcatgttctgttgacaatttcgtcaccacaaacacttccaccatcacctctttcatcttcatcccgctgccaccatcatcaccatattcaccacgaatccaccttcatccgcaccaaattttcgtccaccacaaccaacagcaccctcatcactacatcagccacccccaaatgcatttattgctacctccaccaatagccaacccttttgcaactttgtaaagtgaattagcccttccaaagaaagcatttaagtgccctcacttttgacttgttggctgaaccaagtaactccaaccagcccatcattactccattgtgttgacatgttggctgaatgaaaagagaagaagttgttcctgttcctgctgttttgagtaatttcgaaattcattgggaaaaattttcagctttgaactagtttaaaaaaaggaagaagaaaaaggaaagaaaaaaaatcagaagtgaaaaacaaggagaagaagaaaagaaaaaaatagagaagaagttgttgctgttattttccttgtgttcttttggtgcaattttgagtggctacacttgtgagtaggttcgtctctctaacagggttttacctaggaccaacacaataccatcattgagcgattattcaacttgcttgattaatgtggttctagctg

SEQ ID NO: 55353 - DNA, 1122 bp, Oryza sativa
aacgaagcattcctgtttgcaaagcttgataatactcttctacatatttgattccatgtctaagttgttgcaatttatgcagcaaatcacatgcatgatatgaaggaacaaatctagctcgcatgactcttttcattgcatcgcaggtttgtggagtgttatttggattggaacgaacaaattcactccaccaaatggatgcaaaatcagtgaacttactagtagcagccctaacacatttattctcaggaaaatcataacaagcaaatttctgatcaatggctaactcccaagtaagatatgcatcagggtcatattttccatcaaagcaaggaatggtaaacttgatcttgcctaaagaatcgtcattatcatgtacctcctgccgtggtggagcgcccattccatggcgctgttggcgctgttgtcgttgtggacgaccaagtacctcctcatcaagctcggtgtcagcagcgtagtccacttcttcccttgctgcgacgctgctattagcttcatggccaatgtggttgcgcctagccggtccatcatgaccatcttggctcattctcttcaacgtattcaagatacctgcaagagaagtgttcacagccacaaggggtgtctccaatgaggaaagcttggagttggtgtcaatttgagtagcctccaattgaccaaggcgatcattggcgaccctaacatcctcatcaaggccttcagcatgctccctcacttggtgctcaaaatgttgtatgatgcccctcgtacgtggtgaatgttgaggatgctcccctgatcctcctgtcatggttaatactccctccattctaaaatataaggcacaaccacccttaacccaaagaccaaaaataattattatcatcttgtagtttgaatcatcctaataaatataatgcatgcatccaataggattagataacatgagagtggaggatttaaaaaataataatttaatggagaagatgtcatagttaattgcatgcttgcatgcatgccttatattatggaacatctaaggaaagtggttgtgccttatattatggaatggagggagtaggaagcaacattcacaagagatatgtacctatcaactattgg

SEQ ID NO: 55354 - DNA, 4295 bp, Oryza sativa
tcgtatttcccaagaaggcgagcgagaacgggcgggcgcgtggggcttacgtgtgacaccgcgaatcggaacagcagctcaccgcgacgcgtcgccacaccgttggctcttctgtttcgcccgcgggcggcggcgagcgctcgctacgctacgcggcgcccccactcctctgccctccatggcgctgacgcgtcgccatcgaggagaggaagccggcgacccgtcccatcacccaggtgaacgtgaacccatctccccatctgcctctcttcctttccttttccttgattggtctcgctttttcgtctcgaacgcccacggggacccccaaatttagcacgagcagctcaaccccacccaggttaccgctatgacggatggatggacatggatggacggatgatgaagaattttttttcgttacctggacgtcgaactcgacgtagtcgacggggaatcgggcggcctcgttgaacgacctgagcgagttctccttcacctcctgcatccgccggtcgggcgacgccagcgcgttcatccccttcccgcggtgcccgatcaccgcgaacctctgccccccgccgccgccgccgccgcccgccgcggcgctccgagcacccgccgcgtccacctctgctgcataaccaaggaaataactaacgccgccgcggcacggtgtctcgacgccacgcaatgaatattgaataatccgtacgtaccgaggatggcggaggtggcgggggcgccggcggcgaggacgtcgagcgccatggggacgtcggcgacgcgcgcggccttgagctgggccattatattcggaggatgtcctagctgcgcgcgtataggaggatcgtgggcgcaatgcaatgcaacaacgagacgtgacgcgacgcgacgcgacgcgaggaagcgggagccgagcctaatttataacaaggcgggggaaggggaaagggatcgagtgttgggtgtgggtcgttggagaaaggaaggaagcgggaatggggaatattcggggtggggatgcgttcgccatggccagccatcgcgcgcatttgccaatttgctgccaccgtccccgcggatcggatggtttatcctccaggatattccggtccaaaggcacgcacccgacgcagacagacgcttccctctgctgctacaactacgagaacgaaccaacgaacgaacacatcaggacagcgctgtttccgttttttcacctgtcctttctgccacgatttttccccttttccttttttaccctccgtgcctcgttttttctctttgaccgaggctgtgttctgtgttcatacagatgttaggtgaaaatttttgacgtgtcacatcagatatatgaacatatatttgaagtattaaatatagactaataataaaataaattatagattccgtctgtaaactgcgagataaatttattaagtctaattaatccatcattagcaaatgtttactgtagcaccacattgtcaaatcatggagcaattaggcttaaaaaatccgtctcgcaatttacacacaatctatgtaattatgtcttttttatattgaatactctatgcatgtgtctaaacattcaatgtcacatagtgaaaagtttttacgtgaaaactaacagagcccgagtcgacgttgtgcgttcgcgtacgtgcaatcgttcaaagccgccatcgtggcaatacaacttgacaagtggtgtcgtccagatggtttggaacagctggtgggtagtactagcttttaccacggcttcgcccgcccaatctgcagcgaactcctgcagcatccgcccgcgcaacgcgtgcgtgcgtctgtgccgttgcttgcgcgcgctcgtcgatcgccgctcgctgcctagctagccgttggtcgagtgtgtcaagtgatatcattcgtatcagccacatcatgcggatgcatcgatcgttctggtggttccgcttttcgtcgtcacttcgtatgcgattctgtttgtccaataaagaagaaatcgtgattctgttccacgacgggttaaaggataagacgattggtttattcctgctatacgtgatggacacgacagattcatcacgagagcacaaaggagcaccttcttttctcggttttatttaggctgaaccctgagaatatgtgcagaggagattgcaagtttcagtttatatatatatatatatatatatatatatatatatatatatatatatatataaaggggaagggttaattaagggagaaggaattaaagcttgcaagttgctactagagtagatattttcttctttcgtgtgtagctgaattcggtatttcagtgccgttttaatttgtttattgtccatgtggtagcaggagtgatcctcctttagtttagtgattatgtccaattgtccattgttggtagttgcatccgattctttatataaaaaaactgcattatactgaggggtcaatgctgctgtcagatcaacacgcgcgagaacgcaatatctcttggaaatagaatcacgagttcatttcatataaaagacgtgaattaatagcagcttattcctcaaaacagccatagcacgtacaaacagcactatttattttgaaaaaaaaaaaggagaaaaaggactagctggctgagaatggcttgggctaacactcgactaagtacagccgggttaattaatttgattaattaacgaggaaaattctttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcagaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggccttagaagacaagaactgctgatgacatggttgatttggttcgacacactaattgatcaacacttgcaactccccttcatttcatgactaatcctgtatatccagcatagcaacaacaaccttcctttttttctgaaaccacgtacggcaggacggagagagagacagagatcgactgataaagattacagaaaaggcagtttacagtaataattttacacgtcaacttaacaataaatcatcgtcaagtagtccaataatgggagacgcgtcacgcataaattcaggcaactaggccacaaatctcctgttactagtacttgtttaatccattattgcgcacacggccggttggttaactcgcatgactaagtggaatcacatgcatcagcgcattgtccattgcccctgatcgatatactgatctgaatatctgatgcccttgcttgtttggttggatctgatagtagtagaagatgaaatgcaggtgattgcaaattaggacgacggctcatgctgaggtgctcgtcttatcctgcatttgtttagcgacttggtcgatctcttaactttgactctctttttttttttagaactcttaactctgactcaccaccagcacagcagattgatccaacaagggggtgtttcgccaagacgccaagctagcaaggtataggtagcttcctgggctcctgtcctgtggtgtgccagtgccaggtcgatgcgcgctcgtgtctgtcgcctcctggcgtcgcattgactttggataaatggattatggatggatgccatcgcaaaaagcaaggacactagtaaaaggatggccttttctttagggagaggagagaaggtaagagatggcttttgattctgactgttcggtggtgagttggtcgatatcgatctagacatttggtgcgtgttttttcacatctacggtgtcgatgcatagctggtaactagttagatggcgccaaataatctacccatttcgtcatttcgctaaattaatcatgtctaatgttcaccattattgcttatccacgctacaaatgcaatgatagggctgtttttttttaagaacatgatagggctgttgagcctgtcttaatcttccagttggcacgacgaaaatgctg

SEQ ID NO: 55355 - DNA, 3673 bp, Oryza sativa
  unsure (1)..(3673): unsure at all n locations
agtgttctacagccaattatacattttttgtagcgtccatcagccgtgtcatgttttcgcggtgtctcccagctaattacacgttttttgtgtgtcctatggcaaattttgccataaacttttgacttataaacattcgcttcacaaactttaggtggataaactttagatgtgtaaactttaggtgtataaacttactaaaagaggaaaaaacgatcgctggcaacgatcgatcgcccgttagccttttcgatttagaaatgtaattattttggaacggaggtaagtaattttttttatgttgacccttatgtaaaagggaaatttaactatttgacactattaggtttgtcaattatccaaatacctcttttagatttagatttgctctctttttttttttttgcctctctaagatggtggcttcttatctttttaccacttctgcccatctgggatgccaacgtggcaatgtagtgtaaaaagcgacgtgggatgcacttgtcagtctcacaagtctcccttcctctctgcctccggcagtattaaaaatcgacgcggcaaccctctctttcccagcggcggcggcggtgcgacggctcgcggcagaggtaaaggaggagccaagtgacgccgcggtcaaggacgagcatttacacgctggatcggacgtgcgaagccgtgctcgcatcgtttgcgccaacggtggtcaaagtcctcgacgagtgcctctacagctacgagttggtgggtggcgccgccgtcgagacagagcagcgcaacgcggcctccctcgccagcacaccatgggaggaggagccaagcgccgccgcaaatccgacctccgcctcgccatgctccatggcaaccacggactccagtcggccgacgcggcgttcctccctccccagccaccctaagatgacgtgggcggctccgctgctgctgacaactctatcgctggaggcgctgagctcgccacgctcttccttggagaatccgctggtcggtactgacctacgccatctccgtctcccgtacttggctccctttcctactcctccgccgctgcagccaggaaagagagggctgccgcgtcaattttaattggcaaacctaatagtagcgaatagttaaatttccctatgtaaaaacttccatactagttaagtatcacataatactttcccattgtactaagacatagtatcatacttatatatcaaattatcaacaaagaattataagcaatattcaggttttatttggaactatactttcacaactttcacactctcgacttttgtgcgtatgcttctcaaactactcaacggtacttaattaatactgcgttaatatgttttctatgtggaaggtgaggttctcatccccttgattcgaaaatagtctaaggtacaattatgatggtgccccaataatatcacagtgctcacccgcatctcagacaactcagatgtgcaagcaaaacagttttaaaaaaagatgtgcaagcaaaagaaatatgaaaattatcctcaaaagagggggcaataacacatatgaaagaagcccgatactctcccatcaacgggctcactcataacgctatcatacggcctatccgtctcgctgacatgcagcccaaaccagcctacaagacctaatataccacgtgcgcgcgggagcctctcgcggagagggcttgcggcggcacggcccgtccagcgttcatgttcatggaagcacatcccgtccttattctgcgactgattaggattccgaaatccgagtcatctcaaattaatcaggctgccgggaaccctacaaaatcaaacgcccgaaattcgccgattattattcgtttattcgcggcacggcccgtccagcgttcatgttcatgtaagcacatcacatcttaattccgcgactgattaggattctgaaatccgagtcatctcaaggttaaccaggctgccgtgaaccctccaaaatcaaatgctcgaaatccaccaattattattcatttattcgcacgcaaatagggcaggtaggatgttagtaagtctgaacaagtgggataaatattgtgggtcaggaactggacacaaaaaaaaagtattttgggaactaaacaggttataagacagggactgagggtgagggacatagaagtgccggtgcaattgaaagctgaattgagaaaatctgaagtcaatttgaacacaggtatgtctaactcttttgccattttcaattcagttaatagagatgttttacgntctgnatnantntngtcncacactcatnanangntcacatnatnntgtnngtnntgngnangnagannanactganngtgtnnngangatnntganngacncacacantttnngacncacgtnncggtctctcgtncgctctcangcacgananganangccaaanngnctatgttnngtttgctnngccggaacacgagtaagtgcaatgagcatctgagtttgttgagattagtgatgatgttgaagggatggttaaagaggaaggaggcaaggagaggattctgcagggaaggtggagtgatccaataaaaatcaaagactaaagaatacataggatctgagcagaaaaagaaggggaggaaaaaaaaagtaaatcatgagatttttttagaatgtgagagggattagggcgacaaagaaagcttagggagttaatttttgaacaaagaattgatatgatatgtttgcaagaaacaataaagggtttagggtttttgaggagatggctgaggggatggagtgctaatgtaaatagtgtccaaaagaagaggaagaaggaattggagaatgctttggtacagctggataagcagatgacagtggactttttgaaattgaatgaaaaatcagatatgagatggaaaagaagctggaaaacatttacattcagtagcagatctggtgacagagaagaggaggggaaacttggattttacaaggagatgctaatacaaccttttccataaggctgcaaatcaagaaaaaggaaaagccatatcttctctctgcaagaagggatgttaatatcatagagctctcacaaattaaacagcacatctatgcatattataaggggttgtttggaaaagaaaaaagtagggaagttcatctaagtcctgaaatctggcaagataagctgagattgactggggaggaaaaagtttggatggttagacccttctctttagattaagtggaccatgtgatgaagactatgaaaaacaatacaactcctggccttgatggattccctatgggtttttataaacaagtgtggcctcatataagggttttagttaaagagatgtcagatgacttacacatggatgagctggacatagataggatcaattatggggtgatttctcttttgccaaaaatcagggatgcaaacacaatcaaacagtatagacccatcagtctaaaaaatgtgattcttaaaattcttacaaaggctatgaattttaggatgactgaagtggcaaacaaagtgattagttggtctcaaactgcctttatacctggaaggaatattttagaaggttgtgttattttacatgaggtgatgcttgagctgaaaattaaaagggatactgggattatcctcaaaa

SEQ ID NO: 55356 - DNA, 1031 bp, Oryza sativa
ttatgctgctgctgttcatttccaaactgccaggctggtgcatcctcaacatttggatcgacaggcccctcaccatgtggcaaatcatcatcaggtggtaaaatatcagcaaattcaccatttaaaatataaacataatggtccaagactgaccatttggagcattaggctgctcccaaacaacaaattggggcactgagtatagatccttgtaccaaaccttagctaaaccaccagtcaagctccccaaaagtagacaccacttgattgatgttataaaaattgacatagtccaaaggaaaatcaagcatcattatccaccctctatgatcataaggaacattacgccagtttggaccctaatcatgcctaacaaatctaacctcatggtttccatcatagttaataggcagcccaagaacaagtgcatctctttgatccggagaatcaatctgaaacagggcaacaacatttgggtgtggaaaagaagcagcaactcgaacatggctgacttgttcaaaaaacccactaatctcagccctatgttcatcccaaaggtcttcaggtaaagcaggatgaacaatagctagcacaaaatcctcatgccgcattggagtaggaatgaagtttactgtgtcaacccttcgacggtgatttggaccagccggatgcaagtgctgccccggcgggatgaaccagagaggatgaggttgaaggttcgccattggtgaactcgagttcgtcgccggagaaagaggggggtttactgtggagtcgggtgaagagagaggatgcgacacagtggggattacagagtttataggagattttgcacccaaattttccgcgaattggttgcggcttccacgaaactggttgtggcttaactcccttgggctgatccatgggctttttctcatggcccaaaaaggggtggatagaatattttttttaaaataattatgcttggaagtcggatcaggcttatcggtcttctgatgagagactaagtcaatgggggatccactagt

SEQ ID NO: 55357 - DNA, 6431 bp, Oryza sativa
  unsure (1)..(6431): unsure at all n locations
ttccgtttccgaaagtttccgaaaaaattctgaccgacatttttcattcctgaaaacatgtccggaattgggaaactttccaaaccattttcatccctaaatacgaactggcgcgaatacggcaacgaaaatttatgggaagaaaaaacccctcaaacttagcttcgaactttgtcaagtccaattactgtctcaggtctcaacggtcaacagtatatcacaaaacacaatcaattaggatgctaacttgaatttgactggagtattattatggtatatggactatggtatgggcctttgtaacttcgaaaattctgagaaattgtttgcaaacctattctgagttccgacggaaactgcctttatcatatttgttttcgtttccgaaaaaatttcgaccgacagtttgtgtttccgaacataggttaggaatccaaaaagttttcatccctagatgtatgtcatacacctagtgatgtgactataagtatactccacagattagttactgtaaataagtttagtaaattaacagcattctctactaaaggtgtctcacgtgattatgaatggtaggtgttgaaaacaaaatataagcaataatatggtgctatggagattatcgtggtagtttttttttcttttaaaaaaatcactttgtctaggtttcatataaattctcattggtttgggacaaaatttgactctttatgtcaccgagggtgtataagtaatataagtctatatttaattagataaaatagtcatattagctatatttttaacagaaactatctttcattaatatatcataaaaattatctatagcatacaggaaaaaatattacttaaaatttagaaaatccaaaaataaggtatggtaaatattgcataggaaagaatgagacgtagtacaaatagatacgaacaaactctactatcgtgacaatttttgtgttttaagtaatatgcccaaaccaattatttacaaaaacatgtttaacatagagtcaaagaatatttcgaaaatattatcaacataatcatttgtagtaaaaattaaacaaggttcctgtgcatatgcgtgggctaccctcctagttatagtaaaaagcgtaaaatttagaagattgagaagcgtgcccataataatttagtgctattagtgtttatttgttgcatggtgattggtgaagagattctagtgttataacttgtttttttaaatgctctataataattatcggctaatatatagccttttacacatcaagaagattaaattttagaaaattataactagttttgtcaaagctattatttttctacaagtctagctcgtcatttacaaagctgcaacaataatacacgatattataatcaggggcggagctagagcgaaacagagcgtagtgccacttgtttaatttactttactttagatcaagtttaagctgatacgggtgtctaagtttgtattgagggggtgcatacatggtgaaaatagatgaggtatagctaaaaaattttcttgaccgagttcctgggcaccccctaacatatactagctccgctcctgattataataaaattgtaactttgtctccctcagaaatttggatccacctgtcacacatatatacttccaatactctcattgtttctacttagccccacctgtcaaatatgcatatagggacactatggtaaggctatagtataagtgatagttaaattaaataattacacttttctcaagtaaacaacaaagtcaaatcatatgattatgcttgaaacgtgaacggagagggacttagctcatatacagtactgctgctgccgtagaaggcctccaccttttgctctatataaatcatttgtcgctaaaatttaaattttgaaaattttcatcgaagttttttttaaatcgctgctaaatttgacatttatatcactaaaaccatctatataaaaaattactcataaattatttttttaataagccatacgatatattattagcttaattatggccaaatgatgtgagccgtagtcgcaatcatatgagccacggtactgcagaacagaagatctcattctaacaaagaggtttatcagcatcgtcctcgacgcgggacacaacgtgccaaaagcattgcctattggcttcctttcttaagagcacccgaaaaaaactcatctgctcgggcgtttgatagtcggtccatttttatccgtctctttttacatccaaaacgtcacatcaacactattactaatattcatgtccaactttaacaaagcttttagcacttttttctcctaaactatttattcaatatacgatccgatcataccattgctatttgttgcaattgaatatttataacaggatctcatatgattatatttcgataaaaatatttgttttccaattttttgttgcagtagattttttaaatgttgcagtaagtatattacgatgtttcactacatcatttgtaatgttgcatgtggtgttctttgggtgttccagaaagtattttgtgatgtttcagaaggtatttcactagctctataaaaaaattagaatattgcatgtggtgttctttgtatatttcaacagatattttatgatgtttcattaagttattaaaatgttgcaagtggtgttatttggatgtttcactaaatcatttataacgttgcacgtgttgttctcgatgtttcagcatgtattctgtaatgtttcaacaactacaacttaatgtttcatatataatataaaaatatttcaattagtaatataattatgtcatttttgttcatcctaataatgtgagatctctttgttaagatttaattgcaacaaatccaacggtgcaattggatcacacatcaaataagtattttgtgaaaaaaatgatttaaaatttgctattaagggaatatgaggagagagaaaggggtgcgnnnnnnnnnnnnnnnnnnnnnacgtggaagagataaatagttccatgcctgtgaaggttcccggagagaaatagttacatacatgcttactgacggcgcctgtttttttttaataaaaaacaaatgcttgatatgtagtcttgtcaagggtgagaggctaaatggtaagaaagaaaagaaggaaggaaacaatcacaaaaagggagaaaagaaaaagaaaagacaaaagcaataaaattcgcaaaaagccaccacctccaccttgtttgagcagatcaacacaccacatgcgagtacgtgacgatgtcccctctcccctccttcacctccggtgaatggcgtcccgtatcgccgcccgccacctcctccgccgccctgcgacggtaatccggcatccctcccccctcttcttacgcatgacgcgtaaaatgtatatgggggatttaatgcgatggggcctgactcgttatgagtctcgttgttggggttgattttggggctggatttaatttgttgtcccgatggtggtttggtgctctttccatcgcctctccgttcatttttcttctgtgttattaggatggtaagaatgcgattttttctagttggttgttgttgatcaggacggtagaggatgcttaaactgtgaaattcgaggagattgcaaattttattttttgtttgctcgatcatgcggtttggtctgattgtgtcgttgccatgctgtagaaaaaaaaactggagagagcatggtagcttctggagtcgattcagaattttttcacgcggacagttagcgatagcaaaagcacaggaacttttgtgtgcaatcatgttgaggtgatatgctggctcccttgatcattgattacctgttgatttttttaaaataaattaaggaatatagatttattccggccaccgcataagaaatggattgcctgttgatgattgcctcaactgcatgatcattacatattaatttaaacattttgtgaattagaatgtgattctagtaaatcttcacgcgagtttaatcttcctactcgatgaacagggacaatgggaacaagtcttggtgtgtgtcactgtgtctgttgaacatcttcatattagtttgtcatttggtttcagtcgcgctagctaccaccgcatcaccaaatatgagctaattagatccatgtcatcgtaaatatgccatattgaaaaaaataccactactatttataaaatcggatagataccactgcaatcttctaaaattagaaccataccactccattacaattcccgtcgtctctgtcacattttctgttagatcgagcagcagctggctgtctcccggccctccggcgccgtccgccgcggccaacggagcggcagttcacgtgggcgcagagctaggcgtcgatgcaggggacgtggaacgcgaggccgcactcggggagtaggcggaggagctcgccgtcgcggaactcgccgaggcagacggggcagtcggtggcaccgagcatgccggcgccgtacgtcgcggtaccgcgtgagggcaatggattcgatcgcggcctcatcgagctgctgctgctggtgctggtgcctacggtggatgaagcagtagattttttgaacgatgatgaagcagtagatggacgtgttcggggtgcggcgacacgacggcgccgcccttgccgttgctggccgtcgtaagcagctgcatcgtcgccgcctctactgcgccccgccgcggcggccgccggcgtccaccgtgcgcatcatccaccgcccaggaagcccttcgcccagcgccggaggcaccatcccccggacgcgcgtgagcagctcgaccaccggagtcgaagccgatgaggcgcacgcgacaaaacggagaagatgatggggagctggcgcgacggccggcacgggcggaggacaggccggcggcagtcgtggctgggcctggcggggttcgcggtggaacggagtcgtcggacgcgcgcgcggaagcgaggggggagggcggcagacgcggacgcctccgtgccggcgacgacgaggagcaggagaaggcgccggcgccgcccgtcgccgtcgccgagctatgccgccgaggaagtgcccgccgcctccggccaaggcgccggaagccccaccgtcaccaagttccctcaccgccgagctccttcgccgccgccgagctccctcgtcgtcatcgtgcttgtcttaggagagatcgatctcgatctcttcggccaggccgttcgtcatcgtcgtcgtcaagcagcacagcagccgccgatcttgggccatcttcctcgccatcaggtcatgtccctggtcccggtcttgagctcctcgtcgccggcgtccccgacatctgctccggccccgccgtcctcaccggctgggccaccaccgccagggctcgactccgacgcgaccgtgtgggctcgcctccgccggcacggcgcccgccacccgcctggacacctgctcgggctgctcctccgccgctgccatcacctccagtttgctccttgttacggttgcgtggtctcggagatggcacaggagtacaggacggcaacgatagaaataacgggggatgaccggaaaaatggatggaaaatacgacggattggcacggttctaattttcctaaattctagtggcatctagccgatatcgcgaatagtagtgatatttttttaatttgacatatttgtattggcatggatccaattaacccatcaaatattgttcttcaaacctgagttttccacttgtaagtagtatagcatactaccttgattatttttcactagcatattacctgtacattgcaatgggattttaattatttaaaattatcattaaaatattattagcatatcttaattgttattgttaatcacatgttgaccttttctttatcatactaatattttttcttccaaaaaagtagagtgatggtgggagtagttaacatgtcggccctttagccccatatgtttttttccttaaaagaaaaattaagagttggtagtaggagtgatggctcttttataagtaagaatagataataggcttaaatggttcgaactgaaaaatcagccaaccagccagcccatacgtagagagagaaacaacccaatctaatctaatcctaatctaatccccatccgggcaggcatccacggatgtttggttgatgcctaaccttgctataactaagtataggctagttaaggcatggtggcacaagtgtggcttagaaatagttggccataagtgtagcatgcttagctcaaaatttgagagtatgacatgtgggtcccaaggctaagaaattgtggcatggcataattgcggtagcgaaagaaacacatacctaagatattgtggcataactaaagtgtggcgtgccaatgtgtggcaaccaaccaaacacgcttgctgct

SEQ ID NO: 55358 - DNA, 941 bp, Oryza sativa
cttttgcttatacttggtttgtctttctaacggatctggttcacttgcagacattatgcttcttacggagttataaacatgtcagacatttcagcactaagctacttgaaggttagaaactcaacatttgttagtttggaatcctgacaacctcttagtttgttcaaacctttattttaggtgttcatggatgctcactgccaacttggtaatgatcagagcgagcaaacttcattgtcattgtgtgcctgtgctgtaaaagttgattatttggcacatccttgctctctatggtttggaattgtcactacactttactaaattcatagttcttaacaaaaatgtggcatgtaattcatatgtagcggacgatatttcctttcaaatgcttctccttatcaaccttggactagatcatttgcttcaaagaatggtaaggtacagaaaccctatagatgatataatgtttacaaatttctaccagttaaatgcttaatcaatttttttcttcctttaaggtgacttggttgatgctgttgttcccttcatgggtgaatccataaccgatggaacccttgccaccttcttaaagagtacgcatctatctatatgcaatttgagtggtcaaacttctttgtattcacatgctatctgatacagaacctggtgatagagttgaagctgatgaacccatagctcagatcgaaactgataaggtgattctgtgcactgtttattcttgttttcaacttctaagctattgttgctatcttttgcaaaattgttttcagaaaatgaaatacccttttatttcaggttacgatggatgttgctagtccagaagctgggataattgaaaaggtaacaaagagccttcccctgatttgttatttccatatttgctaaatatgattctttagtagattacttttctaaccaca

SEQ ID NO: 55359 - DNA, 3142 bp, Oryza sativa
cgcctctaccgttgtgcctgtgcgccggccgtccgtgccgtcgccacccgcggcatcttagccgcctcctctcccccgggctgtcccccgtttagcggagagagcaccggaggcgcgttcccgccggcgtccagtggcattgccgccactacaccgtctccggccggctgctgttcgtcgccagagcgccagctgacgtcgccgtctcctcccacgacgtcgccgcatcgacctccaccccggcttgccctcggattcgccggaatgccgtcgtccacgctgcccctccttcggtcacgtcggcacccactttggtagccccttccaccgtgccagtgcgccagccgacgtcgccatctccaccttcggcatcgcagtgggaaggtcgtcctcggcctcgcctcctctccatccgaaccccgccggtcttcgtcgtcgtcctctcgtcgttcccggtcgcgctcgtcgtggcgttcgtcctccgtcaagtcgttctcgtccgccgtccgcgttccgtcaagtgagctgctgcagccccgttgtcatcctcgtcctcggctccgcgtcgtcaagccctatgccggtcgtgtctcgtcttcatccaaggatcgccgccgaagtcgttccctcgccgttctcctccatcgtccccgagccgtctccgccgcgcccgttcgtcgtcgtcgttcccatgccacgtcgcatggtggtaaggatccctccttcgctgtccgcccttgtcctttcggtgttgccaccgtgcccgttgtgcggttgtcggccccggtacccgtgcatcggtgtcggcagttgttcgcgtgcgcgggtggtgaccgtgtagtgttcgtgttagtgtgcccgctcggtagccgcgtggtttccacgtgtgcagcccgcgtggtgtctagtggagtccgtttgtcggccactcgcctcggttgacacatggggtccgcttccgtcgacccgtgaaccgtctctatgtacccggtccaccatggtcctttaggttgacatgtggggtccacatgtcaacggcgcagccttcctatcttttctaggctagcgcttacacatgttttatagttgcaaagcctaattataataatccgcaaatctccatataacaacattaaacttcggatgaccatgtcttggtcatacgaaccccgaatcgacctgttcaagtctcttaatgtttgttataacctaaagaaccctgtgctttccttttatgtattgttattgcttctttataggcttgtagctttgcttgtgtgcttcgcgtagcttctgttgtttcaaaggttcccgaagcatggttcgcggtcgtcgctgaaggttcggaaggccattctctctgagcaaggcaagtcgcatcatccttgagcatattgaatcccagtttataaaattattttgatttaaattattgcattattgctttatttaaattcccgcgttatcactgttttatttagcaatacctattaatccttgttatagctttatcattactattgtttattatcacctcgcttaccctagaaaaaacaaaaccccaactagtgggtactgtattaatggttccactagtatgaatttaggtagatgcttcgctgattaattaggccacactagatggttttataactttagactttgggagttctcatatcatttggacattatggaatggttggcttgtgatggaattgaacacacacctccccctctattcaaactcccaaatggttttaggctgggctcgaggtgcatggttttgctaggagcacctcgaccaccataaggaccggtcttcgggcctctgttgcaaagcactaccgtactaaccacatgtctaatgggtaaggcttaactcggtgctcagtctagtcctgaacaaaaggacacaaatagagatagatgaagtcgttacgacgatggatatctctgaggcaaatgaaggctacgcgagctacggcttggtaatcgagatgtctaggcaaatgaaggctacacgggtcgttgcccgttagtcgagatgccatggcactggactagtacgcgggtggtctcacccctatgtgtgtggcgcacccggtctagatcctgttgctaggggctcaatcctggcctgtctgtccgggataacggccgtaggcagggttgggtcggtacttttgttcacagctaggatgggtgaagggttatgtcacatgtttacgacgggttccaaggccatggaatgcggagtaaagatgtgtcttgtgggtaaagatgtacacctctgatcagagtaaaatctattcgaatagccgtgccctcggatatgggcaagcctagcaatgtacccaagttagtggtttaattcttaaaatttgcttaacaactaaaatatggaaaggttggcctgggttggcttgggacgagctgggactcaggtcgggttgccagttcggtctgaattatcgtaggccttgggttaaggcaggttcgtgtgggtccacggccttgattaataatattgtgtagctctaggatcgtgtttacaaaatagctttgggcaactaagtgacttttaaatgctgttttctgcaaagcttaacccctatactatttccccttgtacccccttgcattaatcatgcatctgccagtgtggcttgctgagtactgtggttgtgctcattcttgctctacctcccccccctcagtaagtggagctttggagaagaagtattaggtggagtcctggcttattccccagttgagcgcctatgaatatggagccgtaggcccgctagtccgctgctgtttattttttttgtcaggcctgaagtgcctttgtaataatgtaaatattatcgatataataatgatgtgtcttttatatcatgtttgtgtggtgtaccccggcttttcctgggacggggattaatacactagcgttctggaaaaggtatttttccgggcgtgacagggttgacagaattgggatgagagacatatctccaatctttcagaaagttgagaagagactttagtcttggaagagtggttacatgacttatggtggcagggagatcaagattaactcatgtttgtctagtgcacccatgtatgctatgggtttctacct

SEQ ID NO: 55360 - DNA, 3185 bp, Oryza sativa
tacttactcagtaaatgggttatgaaaattggaaagtggagcacctgatgtttgcttggaggtactgagaaggaaatattagagaaattgtaattttttcacaaggaatgggagtggtggctctcaaattttggatgggtttgttgaaatgcaaagagtggctttccaggctagtcacaaaggaagtgcacaatggaagagatgtgagtttttggaatgatgtttggtgttataatgtacctttgaaagttagatttcctgatctctttgaaattattcatgatcaaaatgctactgtcaaggatatggtggtacaaggagaatggagcttggagtttagaagaaatttagaggttggggaacttgtagagttaattggggaagctcagatggggactgataaagacaatgtctgttggcctcatactgaaaaagaggtgttcaccacaaaatcaatgtacaaaattttaacttttggggtattaaatgggggcagtttggaaaggtagaattcctctaaatataaaacatttttttgtatctagttgggagagggagactcccctgtgctgagcaattggtgaaaaggaattggaaggaggaaatgagttctgtaaactctgtttacaaactaaaaatactaaccatgctatctttcgttgctctttagctgttttttcctggtgtgtgcttaaggtggctataaacttgaattccttaccaggatctttgtgggattgttttgggctagtgaggtgtgacaaggaatctagggtttagttgctgatgatggctagcttctgttgggctatttggctaactaggaatgattgggtttttaacaatatcttggtgaaatcacacttgcaggtggcttacaaagctctgtctttctctcagaagtggagtgtgctgttaagagaggaagaaagagcaatcttgggtgggtggcatgaagctgtgctagggaagttggttcaactgaaaccacaacatctaccatcgtctatctaagttgttttgcttgtatctagtttggtccaactccagaagggttctatttggatgatgttcctgtagtgtgctgtgtctagaaagctggatgttcctagcaagagaaaagtacgaattaccccccctcccaactatcgcggtagtccgaattacccccctaaccacaaaaccggacattcttcacccccaactatgcaaactggatgaattaccctcctcgacccaatcagcggtggttttggtctacgtggcgtacgcgtggcaatccagtcagcaatttatttattaaaaaatagttgggccccatctgtcgtactcttattgcacttttcccctttctctctcttctctctctcactcttcctctctctctctcctctccctctccgtctcatgtacacagcggcaggcggggggcggcgagcgccagcgagggatgaggcggcgagctgcggcggggtgcagcggcggcggcgaggcaaggcggcggtgggagctcgcactgctcgagcgaggcgaggcggcagcggaggaggcgaggcggcggagaggggacgaggtgatcggtcagtgtgtgtccgtgttcgatcgatgcgttgctttcgatcgatctacatgtacagatgatcgatcagtcgatcggatcgattgccgtatttttgttgtgtttggtgatgagatggaggttaagtggtatggttagtgtgcgctaatggcggtggtttggtttgggggtggttgtgtgcgtgtggttgcagggtggagagcttcatagagcaccaggatgcgtgtaactctggacgggtgcgcggcgaggtcgtgcccgtggtgacgacgctgccggtcatccgtcccgcggcgctgcggcatcatcatcatcatccgccgctgccgcctgagctgcagctcctcccggcgtccaccacggcgtcgttggccaccgcgttctcgtccaactccacgaccaccggctcctcctcccacgagcaacacgcgacgacgatgacgacgacgaagctgcagctcttcatcggccccgccgtcgtcgtcgtcgcggcatccgacggcggcgccgtggccgcggcagcaggaggggaggaggaggagcagcgggaagaggtgaggcgcgcgctggagaaggcggacgcggcgcggaagcgggcgcgcgaggaagccgcggcgacggagcgcgcgctggacgatgcccgccgccgcctcgcttcgctcgagcagcgcgagctccctctccctcgccgccgcttgccgcctcatcccccaacgctcgcctccgtccttcccgccgctcgcctcctccgccgtcgccgcctagcctcgctcgagcagcgcgagctcccgccgccgccgccgctcgccgccccccgcctgccgctgtgcgcgtgagacagagtgagagaagagagagagaggaagagtgagagagagggaagagagagaaaaaaagtgaaataggagtatgacaagtgggtcccatattttttaaataaataaattgctgactggactgccacgcgtacgccacgtagaccaaaaccaccgtggattgggttgaggggggtaattcgtccggtttgcatagttaggggtgaagaatgtccggttttgtgattcaggggggtaattcggatgaccacgatagtttgggggggataattcgtactttttcctcacagcaataatgtagtatgttcgtgtttttcttttcgttttgtgtaagactctgttcctgtagtcctttcggctttctcccaaaagccggatcaatgcaagttgatatgttctaaaaaatatagggcatgcagaggaagatacgatgttgagctccaagcgatcgttgtgggatcaacacagcagcaacatcgccacgtccagtaaaaggtcgcggtggagggacgatgataaacacctctacatggtgcttgattgggacatgggatacgtcatccacaagctggacatcgacgagttcaccgattccggcgccggcactggcgtagccatgttccaccacctttcttagccagtcgccgtccacatagaggtgccggtggaccgctccttcctggccatggtcgcggtcggcagcaagatcgtcatcgccacgcatgccttccatgaggattctcccgtcttcatgtacgacacagggacgt

SEQ ID NO: 55361 - DNA, 1111 bp, Oryza sativa
ccccctagcgaaccattagagcccccataatacctaatcctaagaaggggctgagatagactttgtctgagatttttagaaggccctaaaggcttagaagtcccataatatccccaacaatcccacccaaccctaatctccttcctcctaccgaagagaggcggagactcacggagtggcggcggcatacaagcgcgagtgcgcgtgcgacggccgacggcttccagttccagccttccaggcgaagttgcggcgaccggcgacactgcagcagttagggcacgcggcgcgccggccgctggccgctggggcctgggggccccgagcggcaacaagggggtgggtcgacgaggggacgcggcggcgcggcgcggcaacaagcagggaagggggcaagggggcaaagggcagctgccggcagcagcaaggggcaaggcaggaactcagcaattgaggatttgaggaagtgaggtatataaaatttctaatttgtcatttaaaatcaatttcaattgtcaagtctagttgttattaatagttcaagttttcaagaaatcagagatattgaattgaaaattttgtttgtgattcctagtttgctacttgttatattgctagattgtgaagatgtcaaaaagaactgatgaggacatcccttccaacgatacatccatgcctaagcacagcaaggaccaatgactagagctcgagcttgtgaacgtaattatcaggtaaagtcattcctagctactcatataagttcttctcagaattgggtgctactaagtggttgttatgatctacttgttgttaggaatatgggagaagatctagatcacaaacaacactagcagcgctgatttgatgaagtcaatgctcttcacttcgatggccaattggggcaaatgagtacttgttggaaagatcttgtcgtctactttcagctatgtgtggtctcaccatcagattcgacccaagctgctcagaatgacgaaaatagttttcacatcagaaacttgggcttgggccttgtatctttacagcccattaggggtccacaaaaactagggtttgctcccacctcctctcctagtcattcctccacctatat

SEQ ID NO: 55362 - DNA, 869 bp, Oryza sativa
gaatgggccaagaactcagaattgacacgatgaattgggcaaaaattcacaagtcttcgcagagaagcaatagaggaggccacctgccgagtttgggttaggtcggtccagcccatggttcggccgaacctcccgtggcaccaatggatgtagggttttgatggatggctgggattggtccccaatgacagttggagggtattactgacctttccaaccgtcataatcgtcattacatgcctataaaaggagctcctcttctcacttcactcacacacctcaagcaaagctctctcatattctctcaagtttagtttagtgttcttaagctagtagagcaggaatagagtagaaatcggagtccggaagccttcgggtatggctctagtagctttcctttcctcttttgtaagctttgtacatttattagaatactcttctttatacatttctggtattgaaatactttccgagtatatgaatgccaactttactttatattcatgttatactgattgtactgctagcttatttgggagatgcataggtacaagtatagtgtttgcttatgcaattgctctatgtcatgacgatgatattagagtagtatctggtagtttaggagtggtgtctagattacgggatatcattatttggggttatatgctgcggatgagaggtggaccgctgatggtgacagctcagtacgtgtattcctccacgcgtgtatatagtcctaagttaatttccaggggagggtactcctctgtatttagccccggttgtatggtcatgacgggctgtcgtaaggaactcggcagtcaggggtggcttcttgaagtactaggaggacatcggatagagggtat

SEQ ID NO: 55363 - DNA, 1722 bp, Oryza sativa
gtctcctaaagttattttaaaggatgaacttgctagagctagcaagcaaaaacttcaggagcatactaggagtgagcatcatattgtggctaatgaacttgagaagcataagaagaaatgcaccaactctgttcaaaataataaaaatgagattaagctgaagggatcttgtttcattgcaacaaagtcagatttggacgaagtgatcctgacacttctatttgcaatgcttcggtttgcaaagaaactttattttcactcgaggatacttctatttctttgcctcctccggtcactaaccttttgcaggaatacgccgatgttttcccaaaggaggttccaccggggctgccaccaattcgagggattgagcaccagattgacctcattcctggggcctctttgccaaactgtgtgccatacaggaccaacccaaaggaaacaaaggagatacaacatcaagtgcaagaattactcgacaaggggtatgcgcgtgagtctcttagtccttgtgttgtccccatgcttttagttcatggctcatggcgcatgtgtgtggattgtagagcaattaacaacatcacaatcagatatcgtcatcctatccctaggctaggtgatatgcttgatgaactgggtggttcacttgtgttttctaaaattgatatgcgtagtggttaccaccagattcgcatgaagttaggagatgaatggaaaacaacttttaaaactaaattcggcttatatgagtggttagtcatgccctttggtctcactaatgcgcccagtactttcatgagattaatgaatgaagttctacgtgctttcattggcagatttgtgatggtatattttgatgacattctcatatatagcagatcaatagaggatcatcatgataatttgcgtgttgttttttatgctctacgtgatgcacctttatttggtaaccttgagaagtgcatattttgcacagatcaagtctcttttcttggctatgttgtgactccgcaggaaattgaagtggatcaagccaaggttgaagccatacatagttggctggttccaacaacgatcacacaagtgagaagctttctatgacttgctgggttctaccgccactttgtgaagtattttagcaccattgcagccccactacatgagcttaccaagaggaatgtgatattcacttgggctgcagcacaaaggaatgcattcgagactttgaaagataagttaacatacgcaccattactccaacttcctgatttcaataaaacttttgagcttgaatgtaatgctagtgagattggattgggtggtgtgttgttacaagaaggcaaacctgtagcatatttcagcgagaaattgagtgggcctagtttgaattattctatttatgataaggaattgtttgctctagtacgaattttggaaacatggcagcattatttatggcccaaagaatttgttatacactttgatcatgagtctttgaaacacattcgaagtcaagcaaaacttaaccgtaggcatgctaaatgggttgaatttattgaatcttttccatatgtcatcaaacataagaagggaaaagaaaatttcattgctgatttgttctttcgtgagattgttcgcttgcatggagtgccaaacaccatagtttctgacatttttggaaactatagtgccaaacaccatgcaaaaattagaaactatagg

SEQ ID NO: 55364 - DNA, 4005 bp, Oryza sativa
ttttgaaaaagaatattaaaatgtgggaagaatgtttgtctcatgttgagtttgcttataatcgttcgcaacattctactactaagaagtgccattttgagattatttatggccttctaccccgtgctcctattgatcttttgcccctcccaacttcagagagggtgaactttgatgcaaaacaatgtgatgaactgatgttaaaactgcatgagaccactaaggagaacatagagcacatgaatactaggtgtaaacttgctggaagcaaaggaaagaaacatgttccttttgaatctggtgatttagtttggctggctgttgttgcactcggcctcaaagtagggagacaaggtgaaaacaagcttgtcatcgccactggagagcttcgggaagtgtccacttggccttcttgctcttagaggaggctagctcgataagagtgatggagcgtaccttaggaggccagccgcgtttgacgggggcaactgcggcatagggcgtagggcgtggtcttgcctttttgcaagcagtcgtgagccttgggcatgctagaggtagctacgtggacagcttagtgcaatcgactgtgcgggcataaggaggaagatgagcgtgcgtgtcggccatggcgatacagcgatggaggacgaaggagataacaaaagatagaaaggggtgagaattttatttcccatgttagcatgccacgtcatcaaaagtggcaaatagttaataattcacctctcttgtaagtccaaatctaagagagctatttggttatttgctaaggtggtgtttggatctagggactaaacttcaagtccatgtcacatcggatgtttggactttaatttagaatattaactatagactacttacaaaactaattatataaataagagctaattcacgtgataattttttaagcctaattaattcataattagcacatatttacttagcatcatataggctaatcatggattaattaggctcaataaattcgtctcgggaattagtccaggctaatcatggaatgagttttgctaatagtctatatttattacttctaattagtgttcaaacatataatgtgacagggacttaaaaaataattttgtgacagggacttaaaaaataatttttagtactgtccaaacagcccctaaacctaatagtgataaatagttaaattcccctaaaaggggcaaacttttttttagaattaaaaggggtaaactggaaaaatgccaggtccctacccctatcagctactccatctcacgaatcagaactactttcacctttatagataagcctcttgcctttcaagaattaaaagaaacaacctccacacatttctggtccgccccctctcataattgggatctagcaaatcagcccctccgcccttcccacaagtttttcccgtccgcgtggatggcgtccgcgtcgaacccaccaaaagacgaaaccgatccatgggcgcgggggactaggattcggtgacattctccgtgacattctcggaatgtcagtgactcaatgtaatatcaccgggaatatcaccgaatcccgatccgggcgcgggcgacgcgagtcccactcccaggagtccagctcccgcgccaccgcagcccagggcggcgccgttgtctctgggccggcgcggccgccgcgctcgcctcctcgctcgcccaccgagcgcttcacccaggggcgggcccgtgagcagcccggaggcggaggccgcggcatcgacggtttgagcgccgccgctgcattggtggaccgcaaaggaaagagaaagatcggagaaggatcttttacagtctctgatgatcgggaacaggtaatggttcccatcttgcatttgtgctgtcatggcgtttgtgttgggtaccttggagtattttggatttgttcttgagcatttcttgggttcttgcaggcacgaaggaaggaggagaggacatctgattcccccaaagtgaagcttctcaggagtagcattcgtgcgtatcatggcgacgccgaggagaaggtaaggagaagtttacttgtcattcttgattggtctggggctgggcatttttgtcgttcgtgtgaaatcttgggatcatctttcaccgttgcgaacgtgctatcctgttccttagatgcggttcttgtgccatcttgtattcttgtgttgcaatgtggagctaggatcttggcaatctttgatttcttgattttactgtacctggggcggagaactctgggttcaaatgatgtggcatcctataacagagttgaaatcaactaggccttatgaccaaaaaaaaaagaaagaaaaaaaaaagaatcaactgggcaaatgttggggggcaattcagctttctgtattgccagtattgggaataaactctttctgactactattaggtcttcttgctatcttctatcgaaattgtcgacacttattagttgcccctgcttgatctaatgtaatttgatgtttaacgtgatgcacttttaatcacactgtaaaattgtgggggacttattgggtgatgtcatgtctagtgtgattttttgctcagaaatcctaaagctgaatttatgagctttcattgtcattgaatggttcatccggatgtgtatttggaattggcattgcattaccgtgttcaatttctctacataattgaccaacttacatgcgaaatcacttggtgtactctaccgttgggtctaaaatattcaacctttggctggttgctacccaaaattggctatgaaggctcgaagtgtaatcagcaatagtaggaaaattgtggaagcaccagttttgtgacatttctagtctgtaattgaaaagtttcatgtatcccctattccttgtttcttagtgtgaaatgtttgatcctgatattactatcctgtaatcgatcttgttgtggaatagcttttgaacatgaaagcaaggtgaacgcattgtccaatcaaaattccacaaaaaaaagtacctatcctcactttatgaggatcaccagattcgactccttttaacctgtgatgatgttgaaaatgggcatataaaattagggtcagaatcctagacctcatgatctagtgtatattcacaagttcctttacggcgaaaatatgaggaactgtcacaccatattattactaatgtgataatttggtaagaaatcttgcagctgcatgtatgtgctttcagtcttaggacagtgatatatgaaaaaaattgtcttggtgtgtatttgggattcataactggacatgatttctccaaatcataggccttgtatatgcaaactcactgagcatactctaatgtttggtctaaaagattccgtgtcttgctgggttgctgcctagaattttctcagaatacccatagcatgattggaaaagagttgacaaaattgtcaaagcactagttttccaatcttgctagcctgttttttaaatgttccatatattcccttgtttcctagtctgtagtgtttattctttgtactaattctctgagattgctgccaagtctggtgagaatatatgatgctaacctgttctcttgtaaacagctttcagatagaaaaggagaaccagtgaactacccgtttcataattgcggggcaagcacatcaaaactgcctgctcatgtgtatcacaaggtttgattcctttaaccttagataatgttgaaaacggaagtgcaccatttatcaaatgtcaggatgatagatcacatgacactgtacattcaattgttcatgtacaacagaatatctcttttgtatgcatactaaatcataagttaaatctggttatgttttgcaagcaattaaaggattggattgtgatggcttctggaataggcctgctactgaatttaggaaatcttgtgcatatattccgtcttttatgactttacaacaaccaatcaataaaaacgaagtgataattctaattatttctaagcatttt

SEQ ID NO: 55365 - DNA, 2158 bp, Oryza sativa
ttcccctatattggtttttctgacataaacatgcttgtaatggatgattcctctaatctaaatttgtattgtacaaaccaatctgtatccatcattttacttcctttgttttatcatttgcaggagatacacaccattgtttcacaatagtggcatgacatcgcagtcttttaccctgttgacattaattctaattataaatttgtgaagttaacttcctgattgaacaatattcaaccttgcaagaaattttgcagttggacattaatagtgataaaatataatggggaagaacaaatattataggtgtcttatgttcaagactgaaatgctgcacacatgctgcttcatggtttggccatcttgatcctaaatcacaaatgtcttccttactactatctcatcaaatgttctttctaatgattatctccatacttgatgtttaactatggaagcttgtccgacaagttatgctagtcatgttttattgatgatcatcattctgtaagcgccattgtaacacgctggttaaactctctgggtgctagatgccagcggtatgttatgatttattgtatcattgattcttgcaggcatttgagaggctgatagagaaaataaagggatggaagcgcatgcaggagcacccaatatcaataatcaggttttgaaatgtttggttttctgcaattccggaagagtgttgtttctaaatgtactatcccatctcactgactgaacatgcgccttttttcatctcatgacagggggaagattcttgagttcttcagcagttatgatacaacggatgacagtgagaaaacaccttgagccttcattccttccatctgatccactttcctgattctgacatgctttcttctgtatcagtttttgctttcctcagattagtagcagctacctggatgtgcacgcgcatatggaattatgaatggtgtgcaactaattgtggagaaaatcagaatctggaagatgttagtatcagcatcacttcccttagagacctgacctgttacaaactgaatgcaactatatattcttcacactcatttcacctgactgacctgttgctctggatgcatgcagtggtgctcgaagcacgtaattgctcctcgtgtgtacgcaacctctgctgcagtaaaagcttgtgcagaagctctcagggtgaccgtccaagtggagaacgttcatgatggaacttgcgaaagtacgcactacattgtccgcggcgctccttgcgtgaccttgctgcgcatagagtctcactatgacatcatctacccactccctcctagttctattaatagttcaaatccacatgaggagaagttactcccaatcccaagtagcattcttgcgtatgacaggagaaaggtaaggagacgtttacttatcattcttggctggtctgggcattctagtctgttgtttaaaagtcgcatatattcccctttttttacaataccatgtattccctatctaacttgtttgctagtctgaattattaaatctttatatcaattctctgcggttactgccaagtctggtaagatgtgtggctttaaccggttctctcgtaaacagattttcgatagaaaacaaaagcatctggaccgctccaatcaaatactagagcaagcacctcaaaatcaccgcctcatgaggatcaaaaggtttgattgcttttaaccttcaataatgttgaaaatgaaagtgtatgaattatgaaatgtcaggatgatagatcacatgatatatatatatattcacaagcttttgtacagctagctgttcagagcaatatttcttgtgtgcacagtaaatcataagttaactcttgtgccatcttttgtgttaggaacatggggagttcttctgtttgctttacagtaaaaaaaagttttttttttagggaatcagcttgtgtattagaatgtggaactaggatcttggcattctttatttgtatttaccagtgtgaaagtcttggctgatttttgctgtacttgagtgaagaaatcttggttgaaatgttgtgacatcttagaatagaatcaaaatcgactgggcaaattaggggggcaaatttggctttctgcattgcgaaatacttcctaactacttgtaggtcttcttt

SEQ ID NO: 55366 - DNA, 17255 bp, Oryza sativa
tttaatagtgccatgtattcccttgtttttagaatacattaattcccaattcaaccttgtttcctaggttgaatgaaatgtttgattgttatattgattctcgacattgctaccaagtctggttagatatatgattttaaccagttctcttgtaaacagcgttcaggtagaaaaagaaagcgacctggctgctccaatcaaaatcctagagcaagcatgtcaaaatcatcgcttcgcaaggatcataaggtttgattccctttaacattcaacaatgttgaaatatggaagtatatgaattatgaaattcagggtgtagatcatcagataatactgtgtacatgcacgcacaagttcttgtacagctagctgttcagcagaatatcttttcttgtacgcgcgtactaaatcataagttaatagtggattgtagttatgttttgcatgcaattgacactattggatcgtgacggcctctgtaattgtcctactgttttttgctgaacttaggaaacttttgtgtatctatcctgccttgtgactgaacaaccaacaaaaatgaagcgattacttgctgctgttaagctttagagttaagttattactacctctgtcccagcatataaggatttttacggttggatacagtcattaagaaagtaggtataatttaatggggttggatgagaagtggaggaaggtggaaaaattgaatgatgtagggttgtcattggttgggaaaggaatgcttgtgaagttgttattttgggacaaattttgaaggttaaaagttatattttgggatggagggtgtagtttttatctgcctgctcctcaataatatcaccgtgcatctactgcatatattgttcttttcgcctatgatccgtgcatctactgcatatattgttcttttcgcctatgatcgttcttgtgttttcagtaagatactaatgcggtcactaagttttaatttctttgtggcatattcttgttgatatgaaatcttccattctcagttttctgttttagattttttttttcttatagtgtattttcatcaacttagttcctggtttgggcgtgatagtagatagtgtcctggaatcaatctggtcatacccctaatttactgaattctgcagtcctcagctcttgcaactttagttgatactagaagaagaagaacgaggttaacagatactatcattcctcctggatgcggaaggacaaggaaatatgaaatcacaagaatgagcactcgacttgtgttacgaagaagtgttaggtccctttacaagttgcacagtcagccaaactcactcgctggtcgattctcattgagaaattttctgataagtgacgagatgaccattgaaatggatgagtttcaagctgatgatttagacccctatacaaaggccaatgcagaggttgacttttatcaatatgtgaagactattgaagaactctttgaatctttaccagttcctgaagatattcacagatggctaagtatgattatgagagatccaactgcttatcagtatctgatatgctatcactactgtttgatggaagagcaccaaatgatgcatgtctttacatcattgtacaataaactgctagtattgccaacaacagacccagcaggatacaattttgtgcttgaacgtctcaagatattctctggttggagcccgatggatcttcacaacgtttatttcattgagaccttttactggaaagatcccatcacgggcgtaccaatcatctacggagatgatgttctctccttgctgagattggtaagaaatacttatcagcatttcatgtcgaaggtggtagagggcaggaaactactcttctctgaaaaagatttcgggaatatggtcaacgaacaattttctgggcttcttgatgaattttttgaagcgatgttcattgccacgtattatgctgacttacaacttgagcatacaatggtgtaaattgataaggagaagaagtgacctgctgctgatttctgacgggcgtgagctaaaccagttaagagtacgcatggtgtaaatgatgagagaagtggacagtagctgattgttaacagccaatgagctaaacagagctgtgttttagttgaacctgtgcagtaacgagatccttattgtttttttgttaaatgtgacatgctgtgcatgtggaattgttcagtatgtgagctcatatatagtatgaaagtgttctttgatctaacattatctgtgagttctaaaatcacttccaaaattcatgtgttctttgccaccatacacttgtgagagcatataagagcttcagccttctatgttatgcattttttattttgctccagtactaataggctatttatagatcaatgcatgcaattatcaggtatcaattgtgcccatttttctcgtacaaaaatatgcacatgtgtcatgtgtgtagccttcagctgcagtattagcaaaacgaagcattattttcttgcagcacaagatcagattcacatatacagacagaactgaaatctcactgaaaagaaaggcatacagcaaactgataccatcataattgaaactgtacatgtggatactgaattccaatctccataagacaatatcaaaaagggattactgacagatagccaaaatccaaaaataattcaaattaatttgaaaggtccttgcaacgtagaacttaagagaccttatggaatcctattgagtgcaatgcagtccatattaaatactatggaggcggagaaagggaaggaggaaaagccacagacccagctgatttggcctatgtcattaggggtggacaggaagctcgtgactcgttagctcgctcggctcgtgataaacttggttcggctcgtttaaatttcgtaacgagccgagccagcattttagctcgttagacataacgagccagctcgagctgcacgtgagccaaaacaagctgaagcccaccggtggatagcccatcaaacaaggcctatagtagcagcttaatcatccacgaggcccaccacagcccttaatatgccaaaccctaggctaggctaaaacaagcggaaaaagtacatccaaggtctctcaacttgtcatcgagatacaaaatcgtcctcaaaccgcaaaaccagatactgggcatccctcaactaacaaaaccgtccgctttaggtctctcggtggttttgacctcggttttagcctacgtgacggctgagtcatcgtggaacccacgtggaccccacgtgtcagcgtgccacgtcagctctctcttttattgcagcagcaatagcaaacagcagctaatctcgccggaagaaaaaccaaagccggaggcgacgcaggagctgtcgtgcttcggcgacagctcggtaggcatcgccgccgccgccgccgctgccgccgccggtgactctgggtgcggcggcgcgctggatcgcaagctacaggcggcgaccacggcggtgtacggtgcctcgctgcactccgggaaggagctcctcatccgggtcacgtggacgcggaacgctgccggagccacctgcctcgccgtcgccttcgacgacgcgctctcgccgtcgtcgaggtgcgcccaacatgtgctgcacaagaagcgcgggagcaggtccctcgccaccgccgccgacacggccgtgggcatccactgggacaccgccgaggccacgtacgcgtcggattcgtcgtcccccgagcctaccggcgaggcggcgactactacctcgccgtcgtcgctgacgcggaggtcgcgctgctcctcagcgaggggtggcttggcttcttcctgcatgtgcaatgtgttactaacaaaacagttcagcttctctaattcgagttggtgattttattacagtgtaaatcatggtgtacacgaaagatactagataggttaaaccccgcgcattgctgcgggaatttagtatgataataataaaaaaaataacgtgtaagatagctatataatatcagattaagtaaattaatatggtttatgataatttaaatttaaatagtatgtagaatggtgattcaaacgtaaaaagtaagttggtatgattttatggaagaagaaaactagggagatagtttggaccgtagattaatcatctaaaggataaaaacaattgatatgatgacttaattagaggaaaaaacgagaaagataatttggaccatagtttaatcatttaagcactaactaagtgaggatgaactatataagtaataggatatcataaaacataataaagatatatattgaaacattatgtgaattatgttggatgataatttaacatgtttgtatttgaaaagctctcttaaattataaaaactataaagatatagcaagtttgtataatgtttaaatgtgatgattgttagcggatgatgatgtggcatcttattaattagtagatgattatgtgacatcttgttagtggataatgatgtggtatctttatatgttaagcttaattagttagtgggaataactttatagtaagataggataagtatgacttcagcctgacattgtatgaacatgggtacatgcatgctgatgtgagtgttttctggttttctgaatcgcaatcaaatggcatagatagactatgaagcactgatacggcaaagcaggcgcgtgtctgtgtccgacacgcgatcggatacggacatgtatcggacacgggcggatacgtgtccaggacgtatcggtatttatcctgattttaaaataaataaaataattcctaatacgtttccgatacgttctgatacggtcccgatacgtttaaccctaatattccgccggtaccaaaacccgcgcgcgcgtggggagcatatccacccagcctgcgccgcctctcaactctcactctcgcctctcttccccaacgctccagcgccgccgccgccccatcagccattgccgccgacgggctgcgccggcaccgccacgctgctctccacctccgatgctggcccaacagcgtcaccaccaacgcccctcacgtgctccagtgccgtcgctgctgccgggctgcctcgtcaaccgtcgccgccgccgagctgcgccggcgccgcgcactgggctgcgcctcgccgcctcctactgtgacgtcggcacaacactgtcgtcgccgatctgttttcctgttcgttcccttgttgaggtgaataataaatcccctcttttagcattctatgcactgcagcagagcaatactgcaatgctcttcttatttcgtttagagttttagtggatctgcaagaatgcaatgcccttcatcttttcttagtataagtactatctttttttttgttagatcccatggattatcgaactggaagctcaagtgctagtgctagtgcatctagccatcctagtggtagtccggctcctaattctgctactgatttatcaagaggaactagtggtccagcaagggcaagcaacctcttgaatgcttgccgtgtgattcctcccaatgacaatgaaaacaagccattgtggaggtatgttgagttaatggagaaaacaggtaaaggccagggagggaatgtaaggtttagatgcaggctttgtggtaatattatgcatgggagctactcaagagttaaagcacatctcttgaaggtgggatctaatggtgtagctccctgtccaaaggtaacatcgatgttcttagtcaacttcatgatgaaatggctagagctgcagcagttgctgaaaggaacttgcctaaggacatcccactgccagcagagggcgcgagtagggggaagagaagggctgtttcagctattgagtctagcttcaattcagatactcgttccaaccttgatgctttgattgcgagaatgttctacacagcaggttagactagagtttagtacgttttattaactcatacattctcatatttgtgttacaaatgtgactaatatttggacatttggtttggtctgtaggcattcctttcaatgttgcaagaaacccatatttcaggaaggcttttatgtttgcttgcaacaatgcgcttgggggctattcccctccaagttacaacaagctacgaactactcttcttgttcaagagaagacacatgttgagcggttgttaaatccccttaagtcgacatggcctgtaaaaggtgtgagcattgtgtccgatgggtggtctgatgctcaaaggcgcccactcttgaattttctagcagtgacagaagatgggccaatgtttttaagagcaatcaacactgaaggagaaattaagaggaaggaatatattgctgagaagatgattgcagtcattgaggatgttggaccaaagaatgtggtacaggttatcactgacaatgcagctaattgcagggctgctgggttgatagttgaacagaggtacagccacattttttggacgccgtgtgttgtccataccttgaacctggccttgaagaacatatgtgcagccaagagttcaagtggggatgcttatgaagaatttcagtggatcactgaggtagcagcagattcttctttcataaaaaacttcatcatgaaccactcaatgaggctctccatgttcaatgagttcagtaagctaaaatttcttgccattgttgatacaagatttgcttctaccattgtaatgttaaagaggttccgtgctatcaaagaatctctaatcttgatggtagtgagtgaaaaatggaattcttattagggaagacaatcaagttcaagcacagcaagtcaaagagaaggttctaaatgatgtgtggtgggataaggtgcagtatatcctagatttcactgatcctatctattccatgattcgtgcagctgacaccgacaaaccttgcctccatttggtttatgagatgtgggattcaatgatagataaggtgaaaaaaatagtttatcgtcatgaagggaaagaactaaatgagcattcctcctttttctttcatgtgcaagagatcttgtactctcgatgggcaaaaagtaatacccccctgcattgcttggcacactcactgaaccccaagtaatgttctgcttctacttttaaatgtttgtttccataatttgtagtcgttgttagcctattaattgtttttataaaatgtaggtactactgcgaaagctggttggctgaggttccaacccgtgaagctcctcacatggatgcagaaatttcagaaatgagaaacaaatgcttcagaaggtattttgctggtgatgaattaaggaagatcaagcagcagtttgcagatttctcgctgtttggaaatgggtttaattcctttgactcaatcaaggatagagctcatttggatgcaaagcaatggtggggaatttatggtaactctgcccctgagttaaaaaaattggcgctaaaattacttggacaaccaacatcatcatcttgtgctgaaagaaattggagcacctatggtttgatccataattcaatgagaaacaagttctgttccttctcttacttagtaaatttcttgtatgtttgaaatgcatggaactgatcagtgactacaattgctttattgtaggctaaaccctggacgtgctgaagatttggtgtttgtgcaccagaatttgcgtcttctttccaggaaatctgaagagtactgtactggtccatcaagaatgtgggatgttggaggagacagctttgagatgttcgagggtggtgctgattttcttcaagaagctgctctttcacttgatgagcctgaccttgagagggtgctagaagatcttggtgcattggatctgtctgctgatgctgaaccttcagccacttcagttaccatgattgatacaagcagcaattaaattgatctacctatctagttattattgaattgaacttagagtactgaacaagtttatcggtctatcctaattattctatttgtggctgtgaacttgttatttataaactagttgtgtgcccgtgccctgtgggctggatgtgaacttctatggtcattgcgagtttggatgtaccgttgaactattaatttgtggtctatgcactatttgtggtctagcacttattcacaatctatttttgccctgttcaatttactacttttctgtatttttaatttatatatatatatatattagcgtatccccgtatcctcaatttttggaaaatgtcgtatccccgtgtcgccgtgtcgcgtatccgtgtccgtatccccgtatcggggtaacatagtagatagatactgaacatggttacatggaaaaatgatgcttacattgcctccagatagcttcattcagatcgagcagaaacgctttgcattctctgcaacgatgctgtcaagtaatgactcgcatgcgtcttccagcagatccagcaccagaaaaacattgtgcaacgatagctgtcccctccctccccgccgcctgccttctctttccccaccgccgccgccctctcgcgcgccggccgccgcctgccttctctttccccgtcgccgcctgcactacgacgcctggccgacggactggttggtggggatggcggcgagggacggcgcggcgctgaagccggtgctgagcgggttgtcgatgaagccggtgccgagcggcgagcgactccgagaggcgcgcgccaccgccaagacggagggcgatgaccccgcggcggtcgacgtcaacctcgtcctcaccttcctcgccgcccgagacagggacttaaacgaagcgagacggcctcgcctccgcctccgcgcccaacgccgcggcgcccggccgcgcggggccgcttcaccgacggcggcgacacagcgtcgccgacgccattcgcgaccggccgccgccgccgccgcctcgcccagtggcctgctcctcaactgccggccggctagccaaaagaagagaagaggagagaagagagagagaggggggggagaagagaatggaggggaaagagggagaggctcacttggccacgctgacatgtggagctcacgtgggtcctacgcctattcaaccgccaagtaggttaaaaccagggtcaaaatcaccgaaagacccattttgccggttttgattagttaagagaccccgaatatctggttttgcggttggagcgttttctaactcggtgacaagttgagggaccttcggtgtactttctccaaaacaagcacatagcaaattacgcaacgccgccgcaaagcgccgccgcgcttcccttgcgtacgcggtagagcgctagcgatgcgtcgtcgtccttcccatcccgcggcgctccctcgcccatcggccgaccggacgcttgcctgcgcacgcttgtgctgatgccggccgcccgcccgcatatgcataggtcctgttggccggccgcatgcttccattgttgccgtcgacccgacgagctcgtgagctgcgccggcgagcgtggccacgacgctggcgaagaaggaccgaatgtaccgccaaaagccgtcgaaaccgaagctgatgccggcgccagcgtcggtgatggctgtctggatccacttccaaaacgcttgaaacgggtggacaagctcgtgagcaatgctgttttcttccccgtcctatgcttgtgagtcccctcccctctccttgttgttcacgcgcactgctagccgccggccgcgacgaaatcgctttccgtccccatttgctcgcgagctaaacgagctagctcgagctttctaacgagccaagtctgagctgcacttttaggcttttagctcgttgagataatgagccgagccgagtcagctcgttaacataccgagccagaacgagccgagccgagctggctcagtatccaatgaaggttagcgagaggaatatttaaagttgaatcggaaagaggggaagatgaaggagaggagaatacggtttcaaaaaaaaaaaagatgaaggagaggagaacggcaaaatggagaaaacccattcctgatgtcctgaagatcaattcggatggggctttccactgcagcaccaaacaaggtggatggggatatgttatctgggatcataatggagtggtggttcaggccggagctggcggagctaatcacctgatggatgctttccattctgaggttcttgcttgcgcagcggctgtaggagcggcaagtgaaagggggatgatgaagattgagcttgaaacagactcgatgctgctgaaatctgcactccaggagaactctttcaatctttccgccatggggggtgtgattttggagatcaagaatgtcatttctagcagtttcatttctttctcggttcattactgtctcagggaatgtaataaggtagcgcatgagttggcaaaattgggttgtaatttactagacccctgtagctgggccggtactccacctggccttgagcgtttggtgaccagcgatttggctggaccacctcagtaataaagtttcggttcctatcaaaaaaaaaaaaagagtatgtggtagcttttgtacacttgcatagatgtgacccaaatggcctattcctctccagccacaggcaaatcacacataagaaagcccacacgagaagtgagaacaactcttttttttaaaaaaaaaaggaccaaattctcctaaaatgtttacaattttaaactgaaaagtaaaaataaaattaactaaattctaaaaatttcaacccaaatttcaaatacttttgactcaaatttcaaaagctttcggcttatattttgaaaactttgatgctaagatttgaaaacttttcaactcgcatttgaaaactgttgacttaagatttgaaagttttttactcaaatttataaactttcaatctagattgaaacgttttaacttgtatttgaaaactcttgactcaagttgaaaactttcgactcaaattttaaaacttttgacttagaatagaaaaatttcaaatcaagatttcaaaacttttaggtcaagattagcattagctcaagttttgaatttgcaaatgaaagttttaaaatttaagttgaaagtttttgaaatttgagttcaaagtttaagttgaaagtcattaaaaataaataaaataaaacaaaaacgcaaaaaaaaaaacatgtctggggctgacattgccagctcccgcggacgcgctcaccgcctcgcctggaatggagctggcgtgtttgcgcggggggcgctagctgggcctcctcccgcggccttttttttctttctgttcacactttttttttttattttagcgcctccggacgcgtttttctttttttttcgccattcctttcctatttttcttttaatctttcacgcacctctttgcaaatgtataattgaaagttttcaaattttgtgttgaaagttttcaaattttgtgatgaaagttttcaaatttgagttgaaaattttcaaattttgagttgaaagtttttaaatttgaactgaaagttttcaaacctaggttaaaagtttttaaaatttgagatgaaaagttgaaagttttcaaattttgagttgaaagtttttaaatttgagttgaaagttttcaaatctaggttgaaagtttttcaaatttgagatgaaaagttgaaagtttttaaattttgacctaaaaatttcaaaaatcaagtcaaaaattttcaaaatcccacttgaaattttcaaaatctgacttaaatgttttcaaattgacttaaaaatttaaatttgtagttgaaagtttttaaaattcaagttgataggtttcaaatctttagtaaaaaagaaaaacaatgttacgtgagaaaaaaagaaagtataggaccgtgattatcggatctaatcaggtaaaggttcacgttgttacggaatattatctcctggggagataaagatcctttcttgtggaccaatccgaaccggagtagagataagatctatctcctcctaagacccctatatatacagagggagggtgtgacatctatggctaatggttggcttgtactccagataagatctataatgaagagagagctccaccctatatctgtgttcattgtctacttctgcaatattcttgagggcaaagggatgggcgcaggtgttctacatcatctcacgcctatactattgtgggagggatatggaacggatccggtgatccgctaataggcgcgttggtttacaacacgttatcagcagctctccgttcaccggtttgtcgttccaatctgttgattttgttttgtcaacagattgatctattgttttgtcctggtttcctttgcgagatcacgcgactgcggagacatcgcaatgggaaaccgagcaggtagccgggaaaccgtggagacgccgcgagcagcgtgcactactcctgtcgtccgatgtggccgccggcccgccgccctcgcacgatcgagcgcgcccgtagggagtgtcggtgctcgatctcctagtgcaccggcccgttcttcgtcggttcgtccccacgcgatccgccacgcggctgcggctacactggacgccgcacctccacgcgatggcatgtgctggccacacgcaagcatggatggacctggctcctggcgtccatgcacaagattgatggcaaatcaaccaatacgcatgctgcatgcatgcatcgacacatgcacttacatcagtagattgatttctgattacaaattaattaattaatggttgatggttgttttgcttgcatacatgtatgccgccggtcgacgaggtctgaatcatcgtcgcgcctccttgcgagacgagcaccaggtgctgtgcgtgctaagcagctagcgtatcttgcgagacgacctgtcgtcatcgttgtcgtacacatgcacgtacagatgcgtgcgatataccgatcgacgccgcgccgttcctgaggcgacctgcgacgcagcaggaggcggcatgcacgtgaaagatttttgtgagcatgcgaacctgggtaattagtaagattggtttctaaactaatttactaattcatagatacatatatccaggcatgtgtctattaagatatgctgtttttatagattgattatattttctcgtttttatcatattatggatgctttgcttgcagtagatttttgatcctgctcttgatctagcggtagattaatttcctgcttttgatctatatgcatctattttatttgatgaaaactagagaaaaccgtgtgagagaaatcattaaaattgatgggaaaccctggactggagacgtacctaattcggctgggccgaatcggccgtctcgcccgcctcccttgcatctctgtttctctctttcttttgatgacgccacaccgggaatacggtgacatattctcagcctgtgtagtcggacttagagacatgttggccatcgttcgccgtcgctgttgggtacgccgtcggccttacgtcaatgccgtcgcgggaaaccgccgtctcagaaaaagccctaaacccatatcgccgttgccgccggagttaatgccgaagcgaggcgccgccgccgttgacctcccatcgacgctgccgtcgagccgtggtgggaggatgatgggtcgtcggctgtctgctaccggattaacctccgccgagacgatatggccggatgcaatttggttgccgttgttggggtcacagttgccgtcgttgagttcgcctcgccgccgtcatgaggatgcgcgggtcgacgcggagctccgtcgtgtgccaccgagccgccgccgcaccaaattgccacacaggagtgatgtcatcatagccgtcctgccaatcggtgtagtggatgggtcgtcgatgacctcctcgccgtgcaccgccctaaatcccttcaaagtcgacagtcaatggcctccaatgccgccgccgtgcctgaggggccggtgcgccgggcggtggacgtcgttgcggacaatgaatgggaaaggggaaaccctaattccccccctccccttccctctctcggtcacttaggcgaaccggctgggccggtctgcctccgcccgaccgaataaagcccaacagtaacaagacaacccaaacaaattaataaaaataataaacctggaaatcctcatgggcctagagtttgggaaattcggcccattaggcattttgggctacactgtgcttgctagcccaaataagatcgtggcctgaacggtaattcggcctgattaatttcggtttattggtaacttgcgtttaagcccctggagtgttgggtttttacgctatagttcactgtttaatggaattttatagtttgaaccttgtaattaataagagattatattaattttgtttgtgtgtctatgtcttgttgcttaggccctatatagttcggctttgcatgtgggtctccggactcgtaaataaccatgtaatggtgttttttaagcattgctttgcttttaaaattaatgcaattccaactaaataatctagagatggttctctaggttatgatgtttctataaattgtgttcacatagtgtagaatccccccttggaagcattatgatgggtttattttcatgcatctatgtgtgatggttttctgtgtggtataaatattgggaatataatgccaaataagaccaagtaaatattagaaaatcacctaatgcatggaaattctgggaaattaaatatccatggctatggataagaccactctttactgatacactcctccatacataaatggtgatatcgatgtgtctacaagatggagtcacgtatacttgttgtacgagatccatgcttttgccgatttcactgcgcatatcatccgtttgcgtgttgcgttctctgagaaccgcatgaaacgattcggatgatagtgtgggtgatttcacgtaaaggccttcaatgactattgtatggctttgggcattaatgtagatcactctatccctatgatcacactcaagaatgggattctgagtcgttgaaatgtgtggaattagacaatgtgtttgggattcattgtgcctttcccctaatggcttaacatctcaatcagagtatggtcggactacggtcgacatttttttgctttcccaatggttgagagcacgcttttctgatttggagataaacgattatacctcaattttctggcaacgtggagttgcgaggttcaataatttgagatatttttcacctagcccggtgaaagatataaagtgttttccatgtggtggaatgacactgttcgtatggttgcccttggtgtgcacatatcttctcaatattatttggaacctgatgtcttgcgaggacaccggaaaagagaaggcaaatctagaggaataaacccaagggtagatgctgagaataggtatgattcccacttcaccatagcgccaacagcttgacttgggtgttgacccagtctcggtcctcgggtggatctagcgctaaatggccacctctggttgttgaccaattgttgctagtgtttgtctaataaagttgttttgacaacgggagttgtatggctagtttagagcatgtcctaggaggacattggtcgactatactgttgccaagcagtttatcatttgcttagtttggaactttgcattagatcgatatttctcagataaataaagttcttggtctttcctgttctattctaaagcttatctttatgctggaattgataaaatgctttagtttagaagaacaattagtgtataatccgaggagttacaaccactcacacagttcgacgtaactgtatttcagacaaatgttggctatgcactattgcgtgttatcgcgctctcgtagtcgataactactcccaggttgtgttgtttgatcacccacgggttgatgaccatgtttgtcgcacactggcgtttttcgcgtgtggacttgtgccggccatgcaaaggttcgtcgtgttgcatgcgttgagctcgttatgccaacgacggttgcaccgacacattccactatttttgtggatatgtctgaatataatggttttattgtgaatattaccattgtcggaggtatggattatctctcgatggctatgtccaggggacattagcaaatgtggtttgataattcgctcgtggatcgtacctaatacatgctacttaactatgacccaattctagagtttggtatgagtaattggggtcaaacttgggcattagacgagctggactttaacacaactctgcaccacaaaaatctgcttggcagagcaggctagtggccgcgcactttgctatcatactccttgttgagcgcatcggaatgcgttttgccaccataggttgccttcttaagcatatgacatgcgatgtctaatgcacgtcgatccagaatcgattgtgagtttgaatggcactaggtgagcattaatccatggcgagtgcatttggctaaagtatttgcatgttggttgcatatacatttggtagcaatggtggtttttgcagacttgtatatcctaactaggaggttgaggataacccttcggaagaaggaagaatacaatattcatgccactgtattggtatatgtccaggctcactgcatataatgaaaaatctctcctattaaagtgcgtaaatatttcccaaatatatcaccaccgtagcatacattcgtgggagaacatttgtgatcgaggtgaaattccttaatcctatgccacgataaagggattggtagtatgctattgaaacacatctcggcattagggggagagaaatgcccattttggaatgcctggagatttctttgagtgaacacactaaatgagctgaacttgtatgtttagttcatactcctggttgcttggtgcacggagtttttgccaacaaaatcatatgaggaacaattggataattgttaaatagagtaatgctccaaattgtggtaaatgtggatagacccgggaataatatcgtatccacataagacttatggcatttgatcatgttctgcggggacgcctgctaacacggtccgtgggtcttagtcaaagcataagagttctcacaagatgtgagcatactcctctgattctcctggtggagaattcacctttggaaggtgatatacctcataatgatggtcgtcgtggagacgacattcctagcgatgcgcgcatatgatggtgctaggaatacggaacaaccatgg

SEQ ID NO: 55367 - DNA, 1450 bp, Oryza sativa
agttagtcgcggataggtctaagggggagtgttatggaatattatctcccggggagataaagatcctttcttggggaccaatccgaaccggagtagagataagatctatctcctactaagacccctatatatacagggggagggtgtgacatctatggctaatggttggcttgtactccagataagatctataatgaagagagagttccaccctatatctgtattaattgtctacttctgcaatgttcttgacggcaaagggatgggcgcgggtgttctacatcatctcacgcctatactgttgtgggaaggacagggaacggatccggtgatccgctaataggcgcgttgatttacaacacatctaatcacgttttttcctgatttttgtgcaggtgtggcagcttcgcgacgcgaaaaaagacagttgccacgggaaaaaaggaaatgggctgtgcgtgaggacatgggccgcagagctgtgggccaaaaaaaaatgcgcgcgacttaagttaatggcgcgtctgtgctaattagcaatcccgtgtttgcactgcaccccatccaatagcccgacccataacgctgtcatgcagcccagaccaacctgccaggcctagtgggccacgtgcgcacgcaggagcctctcgcgaagagggctcacggcggcacagcccatccaacatttagcaattaccttcgtagactttgttgatctcaaataaataaataaataaatatatatatatatatatatatatacatatatacatatatatatacatatatacatatacatatatatacatatatacatatatatacatatatatatacatatatacatatatatatacatatatatatatacatatatatatatatataccggtatggttttttgaggtgctcataaagttagggcgtaagtttacacgtttatagaaatgaatgtgtatgtgttatgagcgtacaacttttttaaaagaaaaaaggaaaaaacaacatacgtatataggtacttgcaaagttggtcgatgaagttgcattaaggaaatatatattctactagaaaaagtgtccgtgcattacaccgggtgattacggagtgtgtatattgaccaaaagtgttggttggtttagcaaaagtgcccgtgcgttgcaacgggaagcgtacatatcagaaaaatatgcaattaattaaaatacaaattctctgaaatatttggtatttttaagtaggtatatgtgtataattaaataaatttacaagtagagcaagtatgagaaataaaatgacatggttaaatttaattttttttaaaattccccatgattagttacgctctttgaaattatatgggaattttcagagcttaattgctaattttattaatacaaacatcatttaacaattatttaattggaaaaagaaaggaaatacttcctt

SEQ ID NO: 55368 - DNA, 2311 bp, Oryza sativa
gtacatgcatcatgatttgtgtgattgaactccgattgtgattgtgatttttttacgaggtttgattggattcggattgggattttgggggatgaggggcgacgaagcgggacgaaaaaccggtgtgacgaccggaaaaatacgaatatttatattaagttatagatatacataggagcaatatatgcaatatgcatagaactgatttttagcaagagtaggacctccaactgtcaacggtgccaaaactgagagtgctaatccaaaattaacagcctctcatgactaatccaaaaatcccactttacagtgccactgattttgtgggcctaacgttgggtcttgccgtcttgggtgcctgtgcaccagtgcgaggatagagcaagcaggaccgtaggatggaatggacggtggatattgtagaactgcacgctcatgacgttactatgcaaagtcagacgatccggttccgggggtgggagcgactccgaagcgggccagtctcggaatcccaaccaaacgggccgtgtgggaatgttgcaatccactcggacttccgaaacggaattggaattagtcacggcgaatccgtcggcgaggaagcctataaatcctattccgaaatccaccgattattcgtttactcgcgcgcgcgaagcaggcagaggaagatacgatgttgagctcaaagcgggcgttgcaggatcagcacagcagcaacaccgccatgtccagtaaaaggtcacgtcggagggacgacgataaacacatctacgtggtgcttgattgggacatgggatacgtcatccacaagctggacgtcgacgagttcaccgattccggcaccggcgccgccatgttccaccacctccctgagcacgccgccgtccgcatagaggcgccggtggacctctccttcccggccgtggccgcggtcggcagcaagatcgtcatcgccacgcatgctctccttgaggatgctcccgtcttcatgtacgacacggggacgtcgtcgctggccgccggccctcgcccgacggcgccgctgatgccgggcatcatggtgcccgtccacggccagcggctgtacgcgctggaccctcgcagcgcgtcgaagcactacctccaggtgatgtcgccggcgccccgcgacgacgactaccccgcgcgcgactcgttcaggttttccgggcgggccgagcggtggtcatgggagagcgtcccctcgccgtcgccgccgccgttcgccggcgccggccgcgaccccatgttcgtcaccgcctacgccgtgcacccggacggccgcaccgtcttcgtgtcggcgcacaaccggcgcgccggggacgacgaacgccggaggcagggcacctacgccctcgacatcgcccgccgccgtccggccgcggcagcgtggacgccgctcggcgactggctgctgccgttccagggccagggacactacgtcgacgatctggacgcgtgggtcgggctcgacgacgacggccgcctctgctcctgcgacgtcgcgtctcgcggcgccgcggcatcggccgccgcgctcggttccaagatcaccgaggagacgctgcttcgcgaggaccccaagaggcacgtagggcatccctcgggcgccacgctcgcgtacatgggcgacggcgtgttctgcctcgtcgagtgcgcgcttcgccgtggcctcgacatggcggacgccctgtgcgcggaggatggatgcgtgctccacgtgaccgtgtttgggctcagctacgacaaggcgggggagctgcggatttcacctcgccgccgtggtcgcacgtacctggtgtctaggtataaccacgtagtcgcaccaaaagtattctggatgtaaaagttcaatccgttttttgttgaaataaaagtgtttctttacaatttttcaactaggtctggtcctaataagattttttttttgaaattgctaaataacagttgcaagtttttttttagtgaaaaacgttaatatgttttttttgcggggaataacgtataataatatgttaataaaagtataataatctgttgtcaagcaccgagaccttttcttttttttttaggaaaacactgtaggggaagcccccacagttaaaacattttattaaaaaatagaattacaaaagttacaaattgtctagccaggaacaaaaaaaacttatctatcatctaatcttagacggaaaaacaagaagggacatatcattctttaagaacgacatccaggaaggaacagaaggcacaacattctcaaaaatgaacctatttcgttacttccaaa

SEQ ID NO: 55369 - DNA, 712 bp, Oryza sativa
gcacgagcagtcagcaggcgcaccagaagcatcttcagtggtagacccttcctcaaaatccgagtcttgcagatcacaaccagagaacagaagacctacctccttggccacttgcttcaatttcttaactgatttacctctaggtttcccaatgccctgatttggatctggctgagtgagaaattcatctttgtgcccatcatttaaagcagacaatctagaactccttcttaacccaacagttgtgattggagtgtcaatccgtatttttggactcttaactggagcaggaagcacatggaccacaggtgggactataaccaaatgagtaagcataagtactggcaattccgattccattccctgactatagcccagatgctgcctagaagaagatgattcaccaggcatatatggtccaatactgagagcagcccaaaaggaagaatcttgagtaaagtgtttatcaaacatggtatggggaaacctctcacaaagataattatataagtcagcatgaacagaatccttatgaaccacaatactcttgtctggagaggttaaagcctgttcatcagtagatatgctgactgccgaatccgcaatacttgcagagctagcagaagggtaagtagatagagagcttgcagagcttgcttgcaaatcaatcaacaactgtgggacaagaggcataagatgttcatcgacctga

SEQ ID NO: 55370 - DNA, 702 bp, Oryza sativa
agaaataccaacatatggctagattcatgggtgggctaaatcgagaaatttagaacattctagcctacaaagaatataattcaattaaccgtttgtttcatcttgcttgtaaagctgaaagggaagtgcagggacgaagagctagcttcaggactaacatttctgcaggtcgtactagctcttggacaccttccaacgctgttgcaccgtcaactcgagcagcagcaccatcgtcctcaagcaacaagctacgttcctccacgacaaactctacaccatgcctgagtgaaccagcaagaggggttgctgctacaccttccaagagttcatcattagtggcatcatcaggaaggacaagcgatattcagtgcctacactacaagggctttggtcacatgtgcaaggactgcccaagcactcgtgtaatgatcgtgagagctgatggtgggtactcctccgctggtgatttagatgaagaaacctatgctttgcttgcaactaacaatgcaggggaaggtgacacgccccaccaagatgaagaacacattggggccgaagctgcagagcactatgagagcctcgtggtgcagcgagtgctaagtgcacaaatggaaagggctgaagaaaatcaacgccacaccttgtttcaaaccaagtgtgtgatcaacaaacgctcttgccgcgtgatcatagatggaggaa

SEQ ID NO: 55371 - DNA, 1761 bp, Oryza sativa
tagggaaatctgaactctatttggatctgctttatttcctgagatttggttctgcaaggtactatttatcttcacttcttgatccatatggtaccacttttttccatctgaactccatctcctgtttaagagtttaagatggcactattggttgtttattgtctgtacttatatccatatatagctatttaccaaacagtaatccttccataaggtaaatgagttcattcttatccttcatttcctgatggcaggtcttatagctattttgatgctaaatttctggctgaacatggagcgagaattttggaggacctggttattttcttagctgacgcggtcgctagtatttacatagagcttatatcagttgatggtgatatgccgactgatgttgttggttccagcttagctctatgctcgctgtcaaccagagaacttcaaagaatgcgtaacgaggtaatagttgtggataattcaaggtgttgcttgtgcttttactgttcaaatgtgcttttcaaaacttgcttgtatatacaccaaaaaataagcactttttatgctcacagtttggatttggtaagttgatgatttatagttggctttgcatgaagttagtagtctccttggagacaagccaacaaatatttaaatcctacccaagctggaaaccatatcaacagactaacagatcttgaaatattttttcttcaagtactcttattgttctcgtatggtattgtagtgttatatcatcactaattaactacgaccagccttctcaagttctcatcatgatttacgtgtaagaaatgaactgtgaacagagacgatgctgcgattctaatatactacattttgtccacatgtgtaccttctgtgtcattttctcttaaccttataagacattttgattgccaaacaaatatttttaagtgaatatcacagtacatgttacgtgaataatctaattgggcaaatatttgcactttgaactctcctctttttggttaatatttttaagtttttaggaaacatctctattccagttttttcttacttccagatttgataatccagtgctaaatttttttaaggtggcaattaatgggtggctgcaccagtattttgagtcagttgtctcaatgtacgaggacaggtttgagttatatgttttatccagaaaactttgtgaaaaaccagcagataatcaagctgaagtgacaaactggtggaggcttggatttggaaagccttccaccgttactcttctagagtacgttcacataagctcattttctcttccggtgagaaggacgaaagaattgagagctctggctggatggtattcgcaatttccttttctaccattcttttcatgaataattcatggaaacatttctgtgcgacttggggcaagatgaacataactttactctgttctgttgcaggaggtattatttcagcctattattagaaatgtcagatattgccatgcctttcataagggctgttgtcaccaaagttagtgctgcagtgtcgtacttctgggtgtccatgataggaaggtctctgggattgattttctcagggataaggcaatcacttggttggagatgatcagatgtttctttggtttttgattgtgagatcttgtgaactgagcgatatttgcctcgcagtcatgtccagttttgtcaatttatataggcttttcgttgacctttttttttactgttgagatggctgacttcggtcctc

SEQ ID NO: 55372 - DNA, 4017 bp, Oryza sativa
actgctggataggttgttaagatcagcagcagtgtacgtcatacaaaaatagataaatcaaaggaaatcagtgtaggcttatagactttggaccatgactctgcttcaggagtgaaggaatggaagtttaacaaatcatctcaagtagactagtgtgtctcaagtggccaagtgtatggataaatatactttttaagtgcaagtatttccgtcaaacaatgtgagtctaacacatcatgctgaaagcaaataatagatcgaatttacaaaccatacctaagcatagcactaagccagtgagaggcagcagtagcaaacgcgtaggtcaacattccatcagcttattgttcttcgcctgtttggtgcgtttaggcaatgctattctttctctctgcaaggaatttagcaatgttattcgacaatatatagctcaaggactgtattttttttgcacaggataccagcttatattggcaaaccatgctcagtagcctgccagtttctgacagaaatactgaccaagaagccaaatcacatccttcatgcaaacaaagccagcagttttcgcatgaatttctttcaccttgcgcttgtgctactgccgctgagcttcatctgtcctcccgtcggttcatgcattgagcaggagaggctaaccctcctccggttcctcgcggagctgtcaccgccacatgataatggcctcgctgcgtcatggaggaataggaccgactgctgtacctgggaagggatcatctgtgatgtggatggtgcagtaaccaagatcttgctggcctcaagaggccttgaagggcgcatctcgtcatccctgagcgagctcaccagcttgtcgcggctcaacctgtcatacaactcactctccggtgggcttccgccagagctgatattctctggcagcatcgttgtcctcgatgtcagcttcaaccgcctcggcggggaactacaagaggtagactcatcatcatctgattggccactccaggtactgaatatctcaagtaatctgtttactggagcatttccatccaccacatgggagaaaatgagcaacctagtagcgatcaatgcaagcaacaacagcttcactgggcacataccttcctctttctgcatcagctcactatcctttgctgctcttgacctttgctacaaccaattcagtggcgaaatccccgctgggataggtaaatgctctgcacttagaatgctcaaagctggccacaacaacattagtggggccctcccggatgatctcttccatgccacatcattggagtacctctcttttcctaacaatggtttgcaaggaacaattaagcttgtgataaagctcagtaatctagtttttcttgatcttggggggaacagtttcagtggcaaggtcccagaatctataggcgagctcaagaaactggaggagcttcgcatggaccataactacatatctggggagctgccatcaaccttggccaattgcacaaatctagcagccatcgtcctcgtgagcaacaaattcacaggagaccttgctaaggttaacttctccaacctaccaaatctgaaaactttagatctttgcacgaattacttcaccggcacaattccagcaagtatctactcatgcagtaatttaacttggttgcggttatctttcaataagcttcacggtcagttgccagaggagacagaaaagttgaaatcccttacctttgtatctctttcgtacaactactttaccaatatcacaggtgcacttcatatactcaagagcttaaggaacctcactaccttgctaattgggggcaatttcatgcatgaaactattcacaggatgaaacaattcatggtcttgagaatcttcaggttcttggcataaatgattgtgcactgactggaaaaatacctagttggctctcaaagctaaaaaaattggaacttctacttttatacaacaatcaacttagtggaccaataccaacctggatcaagagcctaaactaccttaagtatgtagacttatccaataatagccttataggggaaataccaacatcactaacagagatgccaatgctaagatcagacaagattgcggatcactcaaacccaagactctttcggatgccagtttttgtggctccatctcttcagtaccatacggctaatgcattccctaaaatgttgaatctaggtaacaacaaattcagtggtgtgatccccatggagattggtcagttgaaagcgctcctctcactcaacttgagcttcaacaacttacatggggagatcccgcaatcggccagcaacctcaagaatctgatggtgctagacctgtcttccaaccatctgacaggtgcaatcccttcgtcactggcgaacttgcactttctttctaacttcaacatttcttacaatgaccttgaagggcctgtaccaactataggccagttcagcacatttccaacttccagttttgctgggaacccgaagctatgcagccctatgcttttgcaccgctgcaattcagcaggagcagctccagtctccacaatccccacaaagcagtacattgacaagtttgtcttcgcaattgcatttggcatgttctttggagtaggagtgctatatgatcaaattgttgtgtccagattctttggctaaaccagacaataatttgtgctggcttgtactgttgtacattacgcaatgggtcacagaattgaaataagcaaccaacagccgactttctaattaatataaccatctccaggattccaaccgtgtaggatatggtcgatgagtcggtggaaacatagtaaactgaaatcatagattccaactgtgtcatatggactatggtcgacgagtttgtggaagcatagtaaactgaaatcatagttaaaagaactgtgtccatattgtgtggggatgtcaatgcttaccgatataatctatactaaatactatatacggaatattttttctgcaatttgcaacaaggtatagttaattaggaaaaactgggtgatggttccttttttacttaaaataggacacttcttttttatataaaacgtcagtaacagcctgaccgattgaaaaaaaattacaattaattatggaaaattggggttacgttttctcattaaaatgagacacttctctatataaaacgttgataacgcactgaccgttcgaaaaaaaattgcaacaaggtgaccgtaaatctgcaactgacaactagatctctgcaaaactagagaacaaaaaaacatgtaagtggaaactaccgaagctcacacgagcacaatcccaagatcggtaaaacgaacatgatgattctttcacaagagctttgcagctagccttgattgatttacctcaggagaagagcgagcgagcatagcccacgaactcacaggagtcgcaggatgcgaccctcgggccttggccctgcgccgatccgatcccatcccatccgatcgccatgcctgccgagcgccgccgagcgccggccgcccgcttcctttcgttggacggtgggagcggcggctactggcgaggatgccggagttccaggagatcggcataggtgggccttcaacatgtgggcctaagcagtctgggctgggcaacgggtggacaagaatgaatgaagtgcattttgattccctacccagtggattcgtatccctgaagcgtaagaaatctttttcagaaattattttatggtgttttaacgctctcaactgaattttcatatatgatatgaacacgcttaagtaatgtcaagtatttttgaaatattttttcatatgatttctttgtgatgtttcattcgttggggcttaattatacagtggttgttgttgttgcagtcagtattttctaaatgttacatttttctccccttcaaaaaaaaatgttatatttttctaaaacattttagaaacttaattgaaacatttgagtaagtaatgaaacattttttatagg

SEQ ID NO: 55373 - DNA, 2281 bp, Oryza sativa
aaaaaaaaaaaaaagcgttaaagaatgtgttacatacttacattgctttgccacctttatttctttttatttacaaggcaggtggcaaaacgaaagaatattatgaacacaaaaacctacaatacaccactaacttacaaacaaaattgtccagcaatggttcgaatttgacgggtgtatcacaaggtttctgcaacgaacagaaaaacgatggttagatggttcacaaaatcttctgagaaagaactaacaaaaacaagactgaaaatctacaagatctgtgacaactatagcatatatatatacttgccaaggactgcacataacattgaaaatgtcggaattcttgatggcatgcagaaacacatgaaactacagaaactaaattataatatttcaatatgtatataaagcagcctaaatctcctttcttagcacattgggaaacaaataaaagtaccaaaagattatggtaccatttctcatttagtagtacaaggtgatgcaattctccagtttcaatatattattctattttctgcacgtcaatctgttacatgtttattttcagggaaaagaacaaaggtgcatcgctaatactagttcataaaccagaaggatagctgatgacaaacaaagagaagcccatgcaaactaatgtcagtgctaaatgtccatgtccttcataaaactcaatgaagaattgaagatacaggcttttgtctaaactctaatatcgaggaaatatgtataaaaacaaaaaaaaatcctgtgtgacgaagcaattcaactattcaagcaatacaattttgcaaaaggaaaacaaaaaaaaggcatcatgagttgctagtcacttaccctttctccttgtgttgcctgcagctgccttccctgccttctcctggtggcacaaatcagacaatgacaatggagtcagtggtggggaagaagcatcactgccctccctgctatgcttagcctccaagagcttattcacagtgatgatgggcgtcctctggctgttggaaggtatggagtagctccttgccaaggccgcaggcggcctaggcagcggcgacgccgttcttgacgccttcggggaggcacgggccggcgtcggcgcgcgcttcgacaccagagggccggagtagccgaccagaccagaaggccggacaggatccacattggctggaggcagcggcagcaggtggagctcgctgatcttcagcgacgatgctggtggcaccggtgacatctttggggaaaccttgggtgacacagacgacgacgacgcgtgccggacgtgcggcttggccgcaggcattgcaccagggtaagccatggtgggcgatggcctgtggtcagcctgagagaagggcttgccgcctgacccggccttgatcgggatcggacctgaccatgactccctcttcagcttcttcagatcatcggtgcttgatgatgacgacggcttggtagcggcgttgtgcatggcgccattgtagtcttttgtcagaggagacgagtgccacagattcgtcggggcatggggctttgtttcgaagaattgcgcggaatgatgcagcctgtgtgaacctgatggtacggggttgtcagcaccaactggggtagggagcctgtacgagtgtttggttgaggatggcctcatttgccgaagcctgtcagtttcatcaagcaaattgccagcaaaaagtggagctgaatgtgtagcgaactcgggcttcaattgcgggaacactatttcggcctctgcttgttttgcctcttcctgcttattatgagataccaatcagaatttcagaatataaatatatgtactagcattttgttaacttggtacaaaactggagatagaggggtagaggctggtgaaggtgcatcatacatatatatttttttcgcttgaataattgctctttgagtagtgatagatttgggtgtaaacactcatatcaaccaccacattgaaaaataatagtttttccaaactcagtgagtgcatcaaaataaaacgtagtgaaatttggataagagaaataactaactaacgaaatcatattagtcgacccagttagaacacttctaatatgagtattatggagtggcagcacacctgcttgttttctttgattggctttggtgaagtagtctgatcacttttatcaactggaccaaataaaagaacataaattagataaaaatataaaagacagatcatcagtattctcagtagaattttatgaataaaaatgaacagaaa

SEQ ID NO: 55374 - DNA, 1154 bp, Oryza sativa
aggaccaatcagacagccttcgccaatcttggcactctcgtgaactagcacattcccaacaatgtgtgctccagtggctaacctgttggttgatctcttcctaagtgaatccagataaaggcgcaagcctgtaatgtaatcccttggttggccaacatccatccaaaaacctggaaggaccagagcaaagagctttgcatcagatgcaattcgaggaaagacctctttctcaattgaagttggcttcagctcgatgcggtccaggacagatggattcaacaagtaaattcccgcattgatcttgttgcctacaaatatttttggtttctcaacaaatttttccaccattccagtgacctcctccataaccacaacaccatattttgatggttcgtccacctatattgaaataatagtcagtatacacagtacacaagtttacaattcaagagagtggtcaaagaaaggatctaccttggtgaccataatcgttgcctcaccaccatggctcttgtgaaattttatgagctcagcaaaagggtattcacttatgacgtcactgttgaggacaaagaatggctcaccagatccatccacaagcttgtcccttgctagagcaagagggccagcagttcccaagggctcagtctcttgggaacacgtgattgtgatgccaagcttatcctcaaagtccttcaggaaattgagcattacctaaaagacggatcagagcaaaccaattagaatgtgaagttagttatacttataccatgagacaacagtaaaagattatctcctttttacctccggtcggtagttgatggctaaaacaacttctgttactccaacttctttcaaggcctcaatctgcataaatcggaaaacttttaattcagagctcattactctcctcaatcctcatgctcatgtttgctggagccaacattttggatataaatcaagtactcttgataaccgattggaattttcgaggacagagaaaatttggtgtgataccaaaagagttttccaaaatcatgtaaccaaattgataactaaggaaagaaacaattgaatagtaaaaaggtgcattcaatcacatccaagtgcaacctaccatggatttttagttgttacaccatgtttatgtggga

SEQ ID NO: 55375 - DNA, 9864 bp, Oryza sativa
tcatgggcttgttcgcgaaatcaacaagaggctttgggaaactgagcgtcaaaggccgaaggcgagtgccgaagcctccaacaagaatgagcgccttcatggtgaatcgccgcctcctgttctcccctccctaatccctactccggcggggatcctcaagcgggctcgggaaggagaaagctgccattgcaacagtcaaaatcaaatccgacactaggttggagcatcaaagaacaaagaaagaaagatttcgatttgatcgctcgcggccgcggcaaagctccgatgagtttagggcttccgtaccaataggagggatcagcctggaagatctctcttccttctccacgaccagcggaccagccctcttggaggtaggtagcgcagctgcggtggaaggaggagggctttgtgctgcgctggattgggaatcgagaattgggtgggactttatagagacgaagtggagaggcgacgcgaggggaggggaacgagagtacgagacacgacgagaggttcaggctttcagaattcagataactacagtagagatgtggtttctgtcaacggaagagattttcttttaatccccttctaatcatgggagaatattattaaaataaataaattttagaaaacgctatgtttgctttgtttgaatgagaagtcgaggggaaatctttgaatgaggaaaaaaacatgcacgttagtacgttacatacgccttttcttcttgtccagtttatttccgcctggccttctgttccagtttatgctttccactttccctgatccaagaaaccaaagattgcttcttcttttttgtcacaatgaagccgcttcggactgtcatctgtccagactgtagatgcaggcaaccaaccaaggcgaggcattgcgctgcccattgtaatcacgcataacataggatattccatgtgctaatcctgatgcgtccggaaacccggcagatctgatgatcttggctcctctttctagggtcaaccggctctccggtatccaagatatctgcaccttgcttcgactaatctttctttggttgcgagtgacgggacccaaatgcgcactcactgatacgcaaacgcgcatgcgagagaaatgccgtgtcggtgctcttttctttttcttccttgcttccaagctgatcttgtgattacttaatctcgtattctcgtgtatggtgccgccagaatctgtttatgatctgaaaacgctgcagtaatacactagtaatactgtgtgatcctgtgatacaaccgtcagaaaaaacctcccagtcgatattttattccccttttgagttcaatggtttttgggattagggtgtataccttattgtccgtttcgtgataagcttcggaattttggataaggcttagccgttcttacgactttttgggccataaggcctagtcgggttacatttcgttacgtgatgatgggcctctctgtggccagatgaactgggcctgaaaaaacagaatcttggaaaagctactggctgtctaaggaaaaagtacaccggagatccctcgtcttgtaaccgaattataaatcgtccctaaaaaaaaacccagttacaactcatccatcaacttacaaaaacagtgcaaatgaggtcctccggtggtattgtccccagttttgattgacgtgacacctacgtagcttcttttactagttcttcatcccacgtgagattgacgtggggcttacgtggcagtttctggggaaataataaaataataaaaggtaggacccgcatgttagatccctctttctctcttcttcctctctttcctgcgcacagggaggaaggccagaggagggcgcacgactccaatggctatgggcgacctcgacggcgacggaggtggcccaagatgcggtggcactggagattcgagtgcggtcggcggcgggtggctcccaagaatgctggcggcggtgacagtggagagagagagagagagtggaggaagctcgaaggctgtgcggcgacagcgcggcattggggaagagtggctgccggcgtagatgagctctgcggcggcggcgtcgctgagcccgtgaatcaggagctcgagagtcggtcggctgggagccaccaccgcgctcttcccccgccagccaccagctgcgcctgctcgccggccctcctccctgccgtgtcagtgacaccaccgctgccaatgcccaacttctctctatcagcccctccttcctgctacatcgttgacgccaccgccctgctctcgtttgccggccgccgtctgtcgcgctggccctcctctccgccgcattcctcccatgtcgcgctggccctccttcccgccgcatcggtgacgccacagccgcccatgccagctcattagcggaaaggctgcaatggcgggtgggcagtggaaaggtggcagtggcacttgccaacagctgccgcgcaccgtctctgcaacactggcaactatagtgccccgaacctcgcaagtccggaggccacgatactgtacttgtgtaacatgtaccagtcccaggatacacaagctgatacacacggaacatcggtgatccaaaacagtctaatattattacatcactagggtagtccttacataggttgccatcgtggacagatcccatatagacaactttggaacacaaaagacagcaacataacgcgaaaacaacatagcgggagctaacggcggaaggcgacttaacgactaagcgctaggctaagcgcctaagcgactaacttatttcataggcacggttttggaactaggctcggaaccctaaaaatcttcatagttgacgtgctcctgaagatactcctcggcggaggggtcatctcctccatcttagtcaaatgcttcgtgtcgaggagaaagagtagagagggaaatatgaagagaaagagaggaggggaaatagtcgctgacatgtggggcccatgtgagtcccatgttgattcaactgctacgttggataaaatcggggtcaaaaccatctaaggatctaaagtaattccttttttaagttgagagatattacatagtttggtttttcggttgagcgacgattttgtaattcaacgacaagacaaaggacttttagtgtactttttccactgtctaattacgcccagcaaagcccaacccaaacaaacggcagtcctgcatcaggtaacaggagaattttttcttcagaggcaaatcaatcacagtgaccgagatagcacttgcatatgcgtacctctctgcatacagaacctatcaccaaatttatacagttacacgcacagtattgttttacaaattcgtttttctcaagatacaaagcgtttcgcccttcgacgcacaaatcttccctttggagacctgcacctcgttacagagcataaacagctaaaaaaaaaaagtaaaggtcgcttatagatgctataggctgaaaagcccaaactagctaaagtactaggctccttacatctctcactgtctgcactgcacaagcacagcaccacaaacctcaaattgtctgaacgactggcacctgcagtttgatcggcgtagcagttcacggcatcctaagctcgccggcgcagcgtggagcaccggaggtgcgacgcccgggcggtgcaggtggtgacctcctcctcggagccggtggaagcctgaagacgaagtggctgggtcttgtcatcggcgtgtcggccgtcagagtcccccggcaggagcacgtacgacgccggcgacggcctgtcggagatcatgtcgctgagggatacgtgccctccctccttgtactgcgctaccgccttgaagatgaacgggatgatgccttccatgggagagattcagaggattttccttgcgagttgtagggagatcgagctgggactgatgctggattaggatgagtgaggcttgaactgatgggggctataaaaagagcaggtaaagttgccgagaaagtgacacgagctactgtaacagacgcagcaaaatgacgttgaaacaagatcgatcggaatcccaaatactactagttaactgtattaggttgaaatggcaatcttgatcggctttactctgacgtggatgtatcatataccggcagctagccccgtggtttttctcttcagccaacggattaatttttggataattaatccagtgtaatccatgaagacttggagggaatgaggggttagccagtcttacaaggcgcgttcccgattggacggcaatcatatcaggatgcaaacctgtggatgaccttttcagctcttgaagttgatgatgctataatctagcgtacctgctacgggaggagaaataagacagcgtttttaaaccttgatcttgacaatgccggtacgccgttgtcccgttgaaactttcagcttcgttcactgtagtattattgcactaatccactggaaaatataaagcaatcaacctgatcgatcagcgctatgtagataccccacacactcccgcagcctaaccctgttgatcagcacaggaatggacgtttcttctctgcgtctgcgtgcctaggtgccattcgtccactggaactgaaagtctgaaactgatcatgtgcttttgaacttgacagcagcgtaggaatataggtgtatagcagcaagaactgaccgcggaaagcatagagagatatcccgcgtgcgggcgcgggtaattcgtaggcagaagggtgttctctgttggcgtatgtgcggacgagtttggccagcgggagtggaatggagaaaggcgtagtcgcaggttgcagactcgcagccactggaacgcgaaatatttcggctcctcgcgacccataggataagcgcgcggcgactgcgaacgccaagacgcgcgcgcgcgcgagcgagacggttgccccgtcgagtcggagccgggcggtgtttggcttgtctcccacggccacgcgcaatcgcgcatgcgcgttgccccccgctgctgttgatgtcagcgcgagccgcgagagtttcggcgagcgggcgtcgctgcctcggcaaagagcaagaaagacggcaagcgctagctgggcggagcgcgtcgactcggagccggtcgggtcacggaaaggatcaaagagaaatcgaaggcgagactgccggtctccaggaggtaagctgctgagacacggccatgcgagcgtgccgtgctttgctcgttggcagcggccagcaggcacgtgtaacggcgagtgattaccgtctcttgttaatttagtctccaatcgcccagacagcattggtttctcctgcgtctgggcttattttttcgacggtcactgcacctgaatatgattgttttttttttttttgcagggaacctgaatatgattgttacacctcaaatgcctcgaacatgttcctagatcaacccaggagagtacaagcaagcatagtgatggcaacgagaagcaaactctgagcggattcttcttatccgctaaatgatcccgtggggccaacctggcagtgaccctaaagacagcaaccacccccctcctgactcaaccacgaaaagactacgcgcacacgtcaaactaccccacaggacccgtacctgcccccgcaccccccgacgcaatcgtccaccccgcgtcgtctccggccgccgcccaccgccgccggagccccgccgcccccagcccgccatggcggatccgccgtccgcggccgccaccgcctcgccgcagcccgatcagctcgccgccgccgccgtctccaccccgcaaaaccccaaccctaaccccctcctctccccccaaatcccaccgtcgcccaccgtctccgacctgtccgccatctcgtccccgcagctcgacccgtccgcggcgggcggcggggccatggactaccccccgcggccgccgcagatgcaggctccttcgcccggccaggcggcggccggggctggaggcttcggccagatccaccgctcgggctcgggctcccgcctcgccgctgtcggccagcttccacagtacgctgctgctgcggccaggatgtacggcagtcaggtgaacttctcgggaggtggaggacaggtgggacaacagcagcagcagcagcagcagctggctgctcgcgcggccatgcttagtcaaggccagattgggatgctgcaagggcaggggaacgcagcatctgcggcgcactatggtctccagtcacagatgatggcgcaggtaaatttggggtctcaggcacgctttgagttagctgaattttgcatctaatcatcatgaattccacttttaacggaagtgggaaacacagactcttttaattgtagacttgtttacttgtggttagagtttttctatcagcttaacagggtagcgtatcgtatatggtaacagttttgtaacatggcttagtgaattggtgactcaaatatctatgctgaatatttttaggagggtacgcacacaaaattagatcaatttgatcagaatgccaggtccggctgaaactttgcatttaccagttgattgtgaatcaaaaggaaatgaatcgtggatccagaatcttgaaatttcttaaacagttttgacttttttttcttgtagcatcatggtatttaagtagtggagataactccttgggtgtgatggtgcataccacaagaaagaaaaactagaaatctacatttctcgtactatgttccattggtaaaatatttgtgatttcttttagaatcaaatataagctctgataagaagccttctgttgttggaatctttgcaggcgcaaccacaattgttcgaatatctgtattatatttagaattgcttaatgaaacaccctctgcttttttttattggaaaccacattaagaggagtgattcgtactagttttgcctatgttaagaaattattattattggggaaaataattcagttgaaggtaactagtaactatcaccatctgattgtattactagcataattggtttttcttgttgctgcagccaaggcagaagggtatggtgcaaggtgcacaatttaatactgccaatgcagctcaagcattacaaggtatgcagtccatgggagtcatgggtggtatgagaggaaatggaactattccatataatcagcaacgttttgcccatgcacaagcacaattgaggccgcagcagacatcacagcaaggcacactgtctccacaggtacttgacttccgtaagcaaaagaattatctttggttatcaagcacccacctccttagtccttaccttaccatatgtatctttcatggccttattgttattatatgtgaatgcatgccgcagcaaatagccaaggtcctttttaaagaacatatattaacaggtactgatcaaagaagctaatattaatctcttggcagctttctgatgtatctttacacacagttactaaaattatgcttttacccactaaaactgcatgagagttaagcatttgtgtgtccttttccctttttcttttaggattaatcagaactatgcttattaactttgcaccatggatattctatttttaacttgtgacagttgcgtgcatcaatttttctagcacctctcatgtttatgcggataacttctatcttggtttatttatcagaaggttgtgggtcaaggcttgacaagaacagcatcgattgctgcattaaatccacagctacctggatcgtcgacaaatgggccgatggcacaaatgtcccttcctcagaaacagcagcaggcagcatggttaaaacaaatgcaatcatcgctgggatcacctgtttctccacaacaatttcagcatcaacaaaggatgctattaatacatcaacttcaacagcagtcaggattgaatcaacaccaaatcgcacaaacccaacaacagcatcctcatctcaatacccagcttttacagcagcaacacattctacagcaacttcagcaacaacaacaatctccaaggatatcagcatctggttcccagaagtccatgaacctgacaggatcacaaccgggcactcctttatcaggtggaactatgactggtggaagtgcaagtcaaggagcagaagtaactaatcaacttcttgggaagagaaaaatacaagatttggtttcacaggtaacaaataaccttctgggttcattcttatgagcttctgtatcactggtatgatgtgatcgtatcatgatctttgagatttttcttgaaatattagaatcgcattcccatttttcagaagcatattctctttgttggttgaataataatattttgctcttttggtcgaataatactttactcttttggttgaataatactttgctttgtctttgaattgtgaactcctatttacaggtagatcccctgggcaaggttgatccagaagtggaagatttgcttttggagattgctgatgacttcattgattcggtaatgtgtttgttgtttgtaaatcatgcttttacagcacacttgctcttagtgaatttctatttggttgaaaaatgtgattccgtgtgattcagaatctgagtaccttgagcttctgattttgcttcttttatctgatggacaaaacttgtatcaactgaccttttttatttgttactaggtgactgcatttgcgtgtacccttgcgaagcataggaaatcatcagtcctggaagccaaggatgtattgctgcacctaggttgataaccctcctctctgatgtgatagaatcaactttatttgcttattaaatctgaatatattttcatgcagaaaaaaattggcacttatctgttcctggtttcttaagggaggacaagaatccgcaaagacatcctgtaagactaagaaatgccattctattacttattatattttgtgaaactgtttttcttaatcttcgttcatgtgcactcatgttatgcaatatgccaactggacatctggacccaacttctgagggaattgacctggctattgtagccattttgttgtttttgggttttaggttttatgactttgaatgtatgggggtaatcgctatcaaagtaccatagtctagtgctttctagtagaatttacttagtaaagggaacattaattcagcaattttccctgtttcctttgtttgtttggttataaaagtttagaatgcaatgttgtctgtttgttattttgaaatagaactagcacttatatttttgccattgcctttattctcatcatctgggcatcttgcattgcatgtactgctgctgtgctattcagcaataagctcaaacaaaagtttgattggattatttaaaacaataaactgcaacaggtaaaggtatcagtggaccctcaacaaccagaatgtgatgctgctggtattagaagcacaggaaataaattggtaattaacaattcagttgccaaccatcaaacaagacctccggttactgagccttcaccaatgcccacaatggggcctctgtcaaaagtgccccgtttctaagcatcatgcctcctcatcagtgcaagggaaaagggaaattacatgtaagtctgttcagcagatagaatcattccttttcttactttaacattgcttcatcagaattgtgatgatactacagttggaatttgcatgtcttttagtaataaacataataatagttttgcacaattgccttgggatgtttattaacaatgcatagaccttagtcaactttctggtatacccttcagtcagctgacagtgattatgtaaactgggcattatttacgggcactcgagctatcaggctttgcccgtccatggtgaagccatttttcc

SEQ ID NO: 55376 - DNA, 1641 bp, Oryza sativa
attcctgcagccctgtaccttcatttggaccatccagtaaagttctcaaccctgcaccaagaggaccagaagaaactctttttcctataaaagaagaggatcagccttgtactttgttctttttgaaacaaatatatactgctatatggaacagacccatgatgtattgcacaatttgtagcaaatgatgcaaagtggataataataaggatcaggcagatccatataaactataggccaattatttgtacaagctcatcgcaaaaactagaaaaagaaaaaataaaagtagaactactggtatgtaagtatgaaacggcaatttgctcatgctgctgtgctgagcttcgcagttgcggttgtgatttgtggtggtgatttcgatctgtactggcaattcaagccttgtcattttctgtataccgatgagtgatggtttatggatctgaagttcttcagtatctcaatcaataaaccaaatgagctagtggagcaactgaagccaacgagatgagaaaccatcctaggccatgcttcttgttcttccatcagcctcagtcttgcaagccattgtgaggacgagagtgttccatattattttctactccacaaaatagctccctgaaatgggtagccatatacatatggccaagagaaacgttggaagcgaatatgcatcggaccttttcttggttgggacaagacacaagtacctaccatgttgtcctctcaaaaagaaagaaaaaaaactatcatgtgttgcaataagggctgggatgactcaaaatcatgtggactggaggcttagtgaattaaaaaccacgtcactctcggatacagtccttgtcgttgggtcatttagatagaacatgtttcatctcaatgcgcctatctgatgacattacaagtttacccgtccttaattcagttaaccattgtttcggtagagaaaatttcgtttgtttggtgaaaattatgcagtaaaaagcttcatctgtatcgtttagtaattaatgtagaagtacaagtttaagaggttatagtgcctcattgcattaaattcagagaggggttggaaacaatcgacgataactttgcaccaatggaaacaaaaaaaaacaaacccaaaagaaaaatgacgatgagaaggaaacgtgcttgagcatatggaacataaattttctgcagatgttccattcaattagtttctcggaaacagagttcatggagcttgtatgacatttcagaacttctgttgtgttgtcgtcttcaaaaattagttcgtatacagagaagggatcaaacagaggggagctacagacagaggttgtacaaatttattcacaatgaagcgaggagccaaaacattacgagagcagatgtggcactaaacgcccaagaaagaaaagcacatgctatggctagttcaaatcttccacaagggagttggggattcctgcaagcgtatatgtccctatcgaagagaacaactacacctgctgctgagcatgatgccgcgaacgacaggattgctgttacctgcatcatgtacaactgttgctttagtacatcagaaaacacactttaaatgtttagatatggcacaaaatggtttttgttctttatgccccaaattcaaat

SEQ ID NO: 55377 - DNA, 6419 bp, Oryza sativa
tttatttgatttagttggtaagtggagaactaggacaagtcaagagttggtctcgccccacctggatcctaattctacctacaatcagaatgtactaaatgaaaattatgacaaattcgatctcaacaacatccagctaatattaatatttgataccatgtagctcaagctttactagcctgcatcatgcgaacggaagtcgattaattctgttgcctgtctcttaacatgtgatgcaattacaaatcctaaaacagaatgatccaggaatgctaaatgtggttcaaaatactgcagaatatggttttgatgtgctaaagcaaatcatttctaagtggatatttttataatgagttctatctgagtataatacttatgctttgacaggcctggcagagaaattttcagaaatttaaatttttacttgatttgtttctaaatatttatccatttcaatggttgtgggaactactgaggtgaataatacatgagatgaaaaaaaatcattaataattacccagtcgccaacaacaaataagctcaggagaacagcactgtggagatctttcttgaatttcaaggcatagcaatcaaggcaagcaagtcccaagctccagagtgcctgtagtcccatcgatgcaatcaagtaactgaaattgagagttcaccaaaaactggttacttaacaggatactattcaatctgcaagttctgtcatagtgcagatcaaatggttttgctttgatggatgcatagacgaatgttcacatatgcaaacgactgccagattccttccacaaaatgaacacaccaatcttaacagcacagacaacactgagacttcctatgtcactcatcaaattaaatagagtaataaataggacaaacaaacaaagaacagattatcatgaatgattggcatgcctaccctacttaaacaatgaatgttggatatgagtaaagttgctcaatgttccagcaacataaaaattttaaatttcattatattgactacctttggtctctcctagtgcttcaaacatttagataacggaataacaacatccccggctgctgcacccgaagatgaacaaagccattctactgcttgaaacagatgcctcagtcactgaatagttttaactgattgtcaattttgaaggagtgtctattcaaatcttacagctatcagtggctacaaacttagaccaaaagcctaaggccaacttatattcaaagcaacagtgacaatatatttactttgatgatccaaattgcacaaacttgaattacgaaatgaatcgttctgtcaatgaaattgtgaataatataatgcacaaaggaaacctcattgccacaaaacttccatccccaattacagtagcagacggctccaggaagcaagcagtcggatatagaataaagccacaacaatgattatccagcaacaaagctgcatatcaatcagcaaattgcagggcggcgtgacatgccggccaaattttaataagctactctatcaatcagcaaattggccgactcaatcatgattgttcaagcgtgtatgatactatgatgcctatgatccgcactaaatcactctgcccaagcacgcgaaacgccgtcaccagagcatccccaatcgatttgcaaacgcataaggcacgcagcgagggttgctcgtagcaatcgagcgacagactactcgtctactcgtacgggatgacgtcgagacaagggtggggagaagagggggcgggacggcacgcaccagaaggcggtgtatgcggcgaagccgagggcggaggccgtggcgcagacggacgcggcggcgaagacgagctgccccacccgcagcgagaggccgctccacgtcccggggctgccggcgagctccctcatctcgatcgccctcctccgcttccgacccgcgccgcgcgccgcgcgggcgccctctcagacgccgccccggcgaccggcggccatgcggcgaaagttggtgggcggtttccgtgctgggagttgaactggcgtttcggtttttcaaagaagcgttgggggcgatgggtggacggcgaaaggtggcgcgcgctctctgacgagagaatttttggtggaattggtgcgcggtgacgacgccgggttggggttggggtcgcgttgcgcggcgtcgggtgcggtggggcaagccaggacgcggtcgcttgcgtgcgtttgcttgcaaagacggcgaaaattggtgggctttggtgttggtgggcactgcacacagaaatttgtgattattgattaaggccaagttttttttctcaactccaaattttaactttctctttttttttcattagcatgatttttaagcggtacgtttttttaagataataatagaagttgtttgaaaaattcaaataaactatttttaaaattttaattgttaatgcttaattaatcatatgttaatgaggtttctcgttttaggtgtattaaaaatatgccttcaaaattgacgatcgatcgcagcgagtcgtgcttctatgcttctaaagaaaagaacgcacgaaaattgaagtgcataaatggctcggattaaaagttactccagtttacatgacaaacatcattagagaggggcattttcgtccatggaaaattttttcgcgaacacaaatgagaccaatctagaaaggactagattgattttgaattaagaagggggtgaggctcaaacccggaccggctagctcgcagcttgtgttgctagtcgggaagaccccggacctttctccatgggaaaattcagtccatctccagccatgcccgtcctggcgccgggagctcgcgctgctcgaggcgacgcgagcggcggtgggagctcgaggcgaggcgaggcggcagtggcggcgaaggaggaggcgagcgcggcgggcgacgccatgcgcgacaaccagccccagcccgcggccgcgcccgcgatgaagcggaggaacagatgggaccaatcgcgtcgcttgtcgtcttcgctcgcgccccgcgccgtctccatgtcccctcgagccctgcccgtgccgcgcgccgtcgttcgtcgcccgtcgccgtcgtcgcctcgagcctcgttcgcgcgccgtcaccccgcgccgccgcctcgcctcacctcgagcagcgcgaactcccgctgccgctcgcctcctccactgccttgccccgccgccctaccacctagtcctcgcgcgccgccgaccaccgcgcgcccacgacgaggaggagcccgcggtggcggtggtgtcccaccacgtgtccccatgcgcccacgatgaggaggcacccgccgcgtgtccccgcgcgcccggtcagcctccgcctctgtcgccactcccctccgtcgcctctgccgcctccgcctccgcgtcgacattcgagccgtcctcgctaaccatcctcgctgtgcacgctgcatgagccgcgagagagaaaagagcaagagagagaatagaaagagagaggaagaagagtatggcaggcgggtctcacaattttttattaaaaaaacgctgactggattgtcacgtgtgcgccacgttggacaaaaccgctctgaattggtttgagggggataattcgcccggtttgcatagttaggggtgaagaatatccatttttttggtttaggggtaattcggatgactgcaaaagtttaggaaggtaattcgtgctttttttccctacaaactatgccccgtccactcgacacaacctgccaccataacggtgaacctgaagcctcccgtagtctcgtggccgcgccggactgccgggacaacctagccgagcgctcccgctggccgctgcctacagtaaagcagcgcgctgcgcccgcctcgccgccgcctccgcagggtccccgtgccttctcgcaccggcggcaccgctcgatctctgcgtgacggcgtgtgaggctgtggggtggtagtaggggcgggcggagatggcgaagcatttcgtgctcaacaccggcgccaagatcccctcggtggggctcggcacctggcagtccgacccgggcgtcgtcggcgacgccgtctacgccgctgtcaaggtcccccactcgcggcgtctcctcctctcctcttcatcacctttttcgtttcgtttttttttctctctctactttgtgatggatgatgatggcaaaccgatataaggttgttttcggattgtgcaggcggggtaccggcacatcgattgcgccagaatgtacaaaaatgaaaatgaggtaacttggttggtccaaaactttgaatcattcccgcattactggggtatcactgcagaattctgtaggcatggtcctcctagttctcgtctatgtttttgtttgaaacgattcgtgtatcaattttgcattaacagcattagtgaaaacagatcagcggcacaaaacagatgatttccgttcttgattcaattgggcaacctactgttatggaaacttgtatgatattcctccattttatatggactgatagtgaactactcgtttagataataagttgatgatcttccaccttctcaaaaaaagaaaaaagaaaaaaagtttacatagtaaaagacaaatctgcactactcagggccatgcgctggcaatcagaactcaaaactagcacttacctgtctttcttactactatatgctttacactagaccccaattttatcttgtttcaagacgagtaataattaataaacgcattttgggttttcaggtggggatagctctgaagaagctatttgaagaaggtgttgtcaagcgtgaagatttatttatcacatctaagctatggtaaccttttgcgtgattgtcctgtaaatatgtcttgtctttgcagttgaattggattacctagtgcctgcttgagcttttacttaaactgattggtgctgatgggtatgtttgtcaggtgtgattgtcatgccccagaggatgtgcctgagtcactagacaaaactctgagtgacttacagcttgagtacctggatctttaccttgtatttatcttattttcttaagaatttggatcaatacgtgacttgctagattctgtactttccatcgtcaaagtcttgctttggaaccattggcatcaatctatacaactatctctacatgctgcagaataagcctcctgatcagtcgatgcacattgataaactgttacattatccagcaaaatttctgcgagcttttatggattagccctgagacatccaatcataatcatcatgtgctagactgtagtccattgcacgagaacttccttttatcattcattgggtctgtaggaagatattcctttagtcctgccacgcaaccacaataaataaattaatatagaattatgttgttcatatcagttcaccttctttccttgaattatggtggatttttttttcatcctaaggtttcttctgggatcattacatatacctatatggttaatgactttgataaccttgacaatattattcagacaaatttgcaatagtaacataatatattgaacttgaataagtcttttctccacataaatgggaggatacctatggttaacctttgacttaataggttccttgttaaaatagtttcagcatgttgttacactaataataaaaaattctgatcaccattacgtttatgcagattcattggccattcagagtcaagaagggctcaggcattagtaacactgaagactacataccacctgacatcccatctacctggggagcaatggagaagctatatgattctggtaaatctcgtgccattggtgtaagtaacttctcatcaaaaaaactgggtgacctgcttgctgtagcctgtgtacctccagctgttgatcaggtagaatgccatcctggttggcagcaaacgaagctacataacttctgccagtcaactggcgttcatctttctgtaagtctgtggtacttatataattactctgagtcaatgctcttgttaatgagtcccgtggtttttaattttctgaatactgctaatccttttcttcctcttctttttaggcatactcgcctctaggttcacctggttcaacatggatgaacagtaacgtccttaaggaatccgtcatcatctcaattgcagagaagctcggcaaaactcctgcacaagtggcactgcactggaacattcagatgggtcacagtgtactcccaaaaagtgtgaccgaagaaaggataaagcagaacatagatgtttatgactggtctattccagaggacttgcttgttaagttctctgagattaagcaggttagttcaacatcctttgatcacctatatttaattgtcaatgttttcaaacatctctacagactttttcttaacagggctgcaggaatt

SEQ ID NO: 55378 - DNA, 18899 bp, Oryza sativa
ggtctaataagggataaaaataatgtttctatgagatccctggtattgacgttccaaaccaagtactccctatgtcccaaaatcccttatattttgggacatagggagtacttggtttggaacgtcaataccaggatactcatagaaacattattttatcccttattagacctgttcagggaagcacgtgcgcagcaacaaacatccattatataggtcaagaatataacatcacactttgtggttgtatacacccccgttggtgtagaaaccgggttttataaattcccattatctaaaataataataatataacaacacacagtataatgaaatggatatgtaggttcaaggctattgtaatttgtaatatctcagcaatgctattattcacctttgatctctggttattatgttgcctgtctcatttctcattacatgtgctataattatattcatctattgtcacgtgatcttgtttggtttttatgtcgcaaccactggccttatcaggacaattttgtacatcttatgccatgagctattttatttgccatcaaggcatcaatcaagtatctcattatcttgaaccccttctactaactcataacagtgcaccagttatttctgatgttcttgttttatgatgttcaggttaggcttctcaggggcgacgtcattgttaatccccacagcgtttataagacccatgaggagctctgggacggcgaaatttagatgcagtcagcttacgttagtgccagtcactctcactgaacattattttttcacgaatttacgcttatctaatgtatggtgtttgagtctcttgagctcctattcaatgtaatgaacctgcttgatcagcagcatcatgttcccttagaattcgtattagcgctcctctgaataatactggatcatgtcatttgtatgcttcgcctctggcatcatttatcccatgctacttgtttgtctatttgtcctttggcatcatcattttttcttgtaccgaggcgttagtttgatactcatgttcctcactgaaattagtcaaattacttagcaggctaacagacatttgatagtcaccctgaattattgttggtagtaggtattcagccatgccttttgctttgatttgcaccttattcacgaaagatttcttgcaacattttttctctgtgagaaacaggtcaattctagctttgttcaggaatactatttttttccatagcaccaaaggcgtgccacaggcatagtatgattgtgctatttccttatcttttgagccatgatatggatgtccgtatgctctacaaacatggcgagaatcgttacccatcgcttgtgtttgtgttgcggggcattcctgcagaaattgataccagcaactaattaatggtactcctgtggagtcctggttcagtaagtgtttaactggcactcctgttaagtcctggttcagtaagtgtttaactgctaagggtatgactttaagtacacagggagattaagtgattaacaccgactagtttcagctgaggtgatggtggaggtaggatctatccaatgggatcaattatgacttgttatttacttgacgctatttttctattttgtttatagtttcccataaaattgaagatctatagattgtttgtcccttcagataagcgatgatgctactggaattctacatttgcctcgacgccggtgactctcgaactctggcagagaacccatgaattaatgttttaggggttggaggggatgggaggctgtgggtggcggtaagagcaactttagaagaatgactggagtgacgaaagaccgacgttgagcgacagagatggacggatggtgagacgctgacggcaaaatcaaagctacggggatgaaagaaagcggtggtcgggatcaacgacgggagcgagggaggcctactcccaccgtcccataataaataaataaactagatgcggcatattatactacaacgaatctgaacaaacgtatatctagatttatagtagtaggatatgttacatccagtattaggttagttttttatgggacggagggggtatgtggttaggaagttgggacaatgataagatagaagagtggaggcgtggcgaggggaaatgacgttagactgaaagacgtactccctccgtcaaaaaaagctaacctaggcaaggatgtgacgtccagatttcgttataccatgtgctcgatttgttacaccatgtagtatccaattcttacttaggatggttttttttggatggagggggtagtggaagtagacgagctactatgtatctagctagggaaaaagaaggaataagttaggggacgaaagatgtagaaggcaacgacaacgatgtggttggtcggaagaagtgaggaggggtaaggattagaattataaagggtagcacagatcttggagtaatctcaaccgttaaaacaagtggctacattttttaagaaaatcaggtgatcaataaacaacaagaagccccttagaatccagtatgagaatttactatttatcattcttccaaatatacatgtctaaataacactctcttaaaattttattctcatttaccatcgactcgagtggcgaatgagaatgaaaatagtaaattcggcattgcaaggaatgccaatggacgggtggagtcattattttcagctgctgcccagcctacggttccagcttccaacagctcgagaagagtgaagagatggcaacacagacacaggaaacggtcgcgcgcgccacagcgacagcgatagagccgctccgcgtcacggcttacgcttccgttgcgacaagctcgcagcctcgcacggacacaacgctatcgacgtggtgtcgcgtcggcctcagcctcgacccgaactcgtggagcgcggagcggaagcgcgggcagtgacaccacggggcggccggcggcggatgctgagagtgtgtccccatgcgttcggcatctcgcgctgcgcggggcggcgggggtcaaaactacaccgtgtgcgatgtggacaaaaaaggtttctccgttttctcctttaggccggagattcccccggccgaatccggcgaatcggcaaaagcggccacatgcggccaacagttggtgcacgttattgtcaaaaaccagtccttacgcaagacgccacgaggtcaacccggagaggaactacatgaatgaataacaaagacgtgattgaaacaaatacggagtagtacgtggttaggacctctattatcgagtaatgatactcgttaggacaagagacaattgaagcaagtagacgcaaaaacgtactcctcctagaggtcacgctagtactccctccattccataatataaggcaccctttgattcaaagaaaattcataggaattttaaagaattttatttctatagaaatttttactatatagccctgtgaatcaaatgaatgaatgaatcctatagaatcctatgaaattcctatggaatgcctcttcccatgcaagttttggagaaaatttagcatgaggtaaaacctcatgttaagaattctttgagtctttatatctcctcaaattcctgtgttttttctacagctcaatcaaatggtcattcctatgttttttaaatggttattcctatgtttttcctgtgttttgtaattctctgttttacacttgtattcctatgagaatcctatgtttttcctattcctccgtttttttcattcctatgattcaaagggggcacaaccactttttttaaagatgtttctaatataagacatgcatgtaagcatgcaattaactatgacatctaatcctattggatgcatacattatatttattaggataatccaaattacaagatgataataattatttcttggtctttgggttaagggtggttgtgccttatattttgtaatggaggaagtatctactacctccgtcccaaaataaacacaaccatgagtttctgcgctcaactttgatcgtccgtcttatttaaattttttttatgattagtatttttattgttatgagatgataaaacataaatagtactttactcgtggcatattttttttagttttttttaaaaaattaaataaaacaaacgattaaaattggacacgaaaagtcatggctgttagacggagggagtactaataatgcgcccataatgggctgtccttgtcacgggctaagctatccacacgatggcacatctaagccaaagcccccgctattaatttgccaaaccacgtccacctggcgcagacaccacaccaccaccgcaacggaaacacggtgaacgcctcgtcccgaaaccccggaaagccggcgagagctcgagaagtcgagaccaacctcgccgagcggatcactcgcactactcccacctcgccgcccgccgccgccgccgccgggttcccgtgctgcgcgcgcttcgatctccttctccttctccttctcgcggccgttcttgtgcgtgagtgagagacagtgaggtggtgggagacccgtgggaagggagaggggggcggaaatggcgaagcacttcgtgctcaacaccggcgccaagatcccctccgtgggcctcggcacctggcagtccgaccccggcgtcgtcggcaacgccgtctacgccgccgtcaaggtttcccccattcacccgcgcttcctcctcctcctcccctttttcgtttcttcccccatttggcttattatgtctggcaaatcaatgtaatactgttctcggatcgtgcaggcggggtatcggcacatcgattgcgccagtgcgtacaacaacgaaaaggaggtaacttggtttctccaaagctctgaatcgttcacgaattactggggcatcactctgcgtgttcttgtttgaaacgattggcgtatgaattttgcattagtaacatgggtgataataacagaagaaaggcacaaaaaaaagtatttggaaacttctactccttcatttttatatttggcaaagaagattcatccattttatatatatggacagtgaactattagtactttagaagggagtacctatacatctttcgaaagatttttataatcgtatcacacagatttttaatctttggattaaaatccgatagatataataaaaagcaaaaagcaattaagaaacactataatggacactaaattaccatatcctcaagaaaaagaccaaatccaatacaaaatttaaaatttacatgcgaagattcaaaaattacagtgtaacttacaaaagttacagtgtaagtttcataaattacactataacttacaagaaaatgcactgtaaatttgagtgagaaaatcgagtgagagataagaaaaaatctttcgagtgagatatagcaaaatcgctttagaaaggttgatgacaccttcacaaaaaagaaggaagaaagtaggggcagatccgctctacttttagggcatgtataatccgcactactcaaaactaagtagcacttacccttcttgcttactaccacgtgctttacacctggtccaatattatctcgtttcaagacaagtaatataacaaacaattaacaaacacattttgggttttcaggtagggttggctctgaagaagctatttgaagagggtgtggtcaaacgcgaagatctgtttatcacgtctaagctatggtaacctcaaatttatgtgtgattggcctgtaattatgtctttgcagttgaattggaattccagtgcttgcttggagctttacttcaactgatcagaggtgatgggtatgtttgtcaggtgtgatcatcatgccccagaggatgtgcctgaggcactagatgctaccttgaatgacttacagcttgagtacctggatctttacctcgtacgtatcttcttttattaagaatttggttcaatatgtgacttgcttgattctgttctctccaccatcaaggtcttgctttggaatcattggcatcatcaacctatagcaactagctctatttctatatgctgcagaataggtctccccatttgtcagtgcgcattgatagctaatgttacattgtccagcaaaatttctgcaatctgctatggaatacacctgagccatccatatcagaatcatcagcattctgttatatgtgctagactgctagtccattgcatatttgcatgacaatttccttttatcattcatccatgcaaccacaataaacaaagtactccttgttttggtatcagttcgattgttcaccttgaatgacttacattgaagtatactctccacataaattggggcatatacctgtggttaacttttaatttagcagattcctttgttaaaatgtttcagcatcttgttacactaatcagaatttctaatcaccattatatttatgcagattcattggccattcagaaccaagaagggatccagcattggcaaacctgaaagctacttaccacctgacatcccatctacctgggcagcaatggagaagttatatgattctggcaaaagtcgtgccattggtgtgagtaacttctcatcgaaaaaattgggtgacctgcttgctgcagcccgtgtacctccagctgttgaccaggtggagtgccatcctggttggcagcagatgaagctgcataacttttgccagtcaacgggcattcatctttctgtaagtctacatactaaaaaactgagtcaatcctctgactgatattagtaatgaacaaatgacacctgtggtttttccttttctgaaacctactgatccttttcttcctccttttttaggcatactcgccgctaggttcacctggttcaacatttatgaacggcaatgtccttaaggaacccatcattatctcgattgcagagaagcttggcaaaactcctgcacaagtggcgctgcgctggaacattcagatgggtcacagtgtactcccaaaaagtgtgagtgaagaaaggataaagcagaacttagatgtttatgactggtctattccagaggacttgcttgctaagttctcggagattaagcaggttagttcaactttctttgagcacctatatttgtcatctatgttttcacttttcatacatgtgaacagactgtttcttaacagcgagtgtttgcttcatatgattgggataaaattacattgatacttggtaacaattgataccgggctatatatagagagcaagctgatgttgcaaaagttctccataaaatgtttcttaattctatatgacaacctttatccttggaaacaaatttgcttgtaaatactctccaaagaaatttgtttacctcgaagcatactagattgtagaaacttagtgtattgtttgttagcatctgcttgttttggaacatcagtgccaggatactcttaggaacattcttttatcccttattacacctgttcagggaaacatatgcgcagcaacaagcatcaattatatagttcagagatcacacatgataatgcagtgacgtgtatgctcaaggctactctttgtaatttgtaatatctgagcaattttttactcagcttcgatctctgatgattatgttacttgtttcatttctcattacatttgctgcttttctattgtaatgtcatgtgacatgacaaactgtctgttcaggtttggctttatgttgccagtactcactagtggccgcaggacaattttgtaggtcttgcgcagtgtggtagtattttgtttgccatcaatctagtacagctcactcattaattcaatatcttgcaccccttccagtaactcatatagcagtacaccagttatttctgacgttaattgttttatggtgttcaggttaggctgctcaggggcaacttcattgtcaatccacagagcgtttacaagacccatgaggagctctgggacagggaaatttaggagttccgtcagtgccaatcacgcttattgaacattgattgtattagcaaatttacgcatatttaatgtttggtggttcagtgctctcgagctcctctgtcctatgtaatgaagtgcttgatcagcagcatcatgttcccttggaaatcctttttactgctcctctgaataaaactggaatgccattttggtgcttgtgcttcgcatctggcatcatttatcccgttattcccgtgctacttgtttgactatgtccttggatcatcaaattccctcgctgaaattacttagcagcctagcaggctaatcaacaaaaagaaattatatatgtaccctgaattgctgctggtagctggtattcagccatgcctcaccaacgattatagcttctttctgtttttattcttagcaccgaaggtgtgccgtcgtttgtgcacttcccttttctattgagccatgatattgactgtatttcttctgtctcataaaaaacaaatctaagatagaatatgactatcttaatactacaaatctaaacagctcctaaaactatgaatttgaatctgattgtctagattcgtaataatagaatatgttccatcatatctaggtttatttttaagagtacatttattaaattcccatgttttaggtgtaattgtgattttacccctacttaagtagactttacaattttacccttaattttctcgaactgaataatctgtttacccctggtttagatgtccagtcccacataaagtgagttcaagaaattagaaaattgactaagaaaatatgtaaatactctactaaccctcacctattcaaacaaatccactgcccccactctaaatcccctcacaaccaaaatcgacatcccgatcccctcccgtacttggcggtggcccgtgggccatggcggagcaagcggtgatggcggaagcggcgcacgggagcggggcggagcaggccgaagaggggcacttcacatcttctaacctgttcccccatccaaaaccataaccaaggggtggtgctgccgtgatgcgttgccctggggcgacgggagttgtatgtcataaaggaagaagcttaatagtaagatagcaagtaagatgtaaaatgtggtgaagaagacaccatataaagataagaatcgactttgctacaattaccgatcaaaaatacatattggtaaaaaatctatcttctattatataataaaagtccatgaaacttcctacaaacgctctcaagccgccacgtggcgctctaataaaatagagaaaatcctagaaattctaagaaaaaaacaaaacatctatcccttgattttcaattaaattggtgggtccaatattacacaccgttagataaaattgatcttaaaacaaactaaataccatgggttccacctatcctcctcccgcgcattggcaggtggagtatatacgtacgtactgtacgtatgcttcctcccctttttttccttttttcttcttttttcaatttatatatataatggatatattttttaaataataataattttacaaacaaagaatctaccatcatataatttaaaccggtgtactctttactttgtactattattttcaaataatgcactattttaaaataaattttacaaaattatattgtgtacctatcaaataaacaatatcatattaacaaatttatacgtgcacttaaactgatggccccattatataaattatcggatctacttttttacattggtctattattctcaggtaatgcactgtttcaaaataaggtctacaccattatattgtgtatccattatattaacaatttaaaatctatattaactaatttacacttacagtagaactggtggacatattattataatcattggatctattgtttgctaataaataaagcgtccgaaattctctttttgcctgctgcacaacgcacgtctgcaccttggcctttcgcacgtgtgacaaagcgtagtgtctaagacatctaaggtgatcacaaccgctgtagcgctaccgctttgccacatatcaaatcatatatgaagatgattaattttgttaataacataaaaataaaattaaaggtgatgcagcgagagaataattaagcaccatgggttgtgtttttctcaacactaattagctctgtttaagttgaaaccgagagttgattacataataattataatgtatttgtgttatgtcgtatttggattttgtactatttatccgtacaggtgaaaggaatcattatgttataaatgtgagtgcaatattgacgaatatcaatagaactcttagtacgacaagggtgataaagggagtttaaggccctctctttttttcccgattccatattttggattttttttgcacgctttccaagtttctaaatggtgtcttctttaaacaacattataactttttagaagtcaattcattcgtttataccctcaaatagctatcacataaattatataattcatcaatttcagctatcctaaaccttaagtactacatatttttttcatgcgagtcatggtgatcagtaaattggtgatcaacggatcatcgaagtcgtaagatgaatatgtaagagttactctgaacaattgtaaataggtgtcaaaattaattgctattaattagacatctaatggcttgctagccacaaaattaatttctctctacatatatataaacatggacgaagttggaacaaatattaccatacgtcccatacatatatattgcgcagttaatattctaattagtcatttaaaattccttaaaatgctctcaagctgccacgtgatactctaataaattagggcaaatattagaaattctaagaaaaaaaagacaaagtatcagttacttgattttcacttaaatcggtaggtccaatattataaaccgttagattaaattgatcttagaacaaactaaatactacgaggtcccacctcatcataggtatgcacctacgtgcatgggtacgtatgcctcccctcccttttttatttttctctttcttctttttttttcccatgcatatgcttccctccctttattactatatcatgcgtcttcatgagatgatttaatcaaaattctagaattttgagtatcatgcactcacattttttatttattacacgtatgtatatagatggactgtatgataattaactagcaatacttttttatttactcgagaaaaaaaacatgattcaaaagttgtaattacttaatccatcccctattcaaaagtttgtgaatggttttctaagatacctcgagaaaaacagaacctttaatttattataaaataacattatccaaactttagtttgccctaaatttatgagacaaaatttctgaacaaacaataatcttatcttttaaaaatataagtgcacacgcgggccaccttcctagttatcctaatagtaacattcttaagccgaacctttcatttgataattgtcacttgttcttgattgcaattttagcatcgcggaaagcaattctcttgcaggtggcaggtgggatccgccggctgacatacgctgtcactgacatgcgggacccctggttgagcacctcaatgtgcttcggatttcatttcacactataatcgcgacaggtcctcgcctcctcggtcgtttgcgcagcctctgttgaagagcttgttccgttttttaaaagacatggcatctcaacaatactcctgattttctactactgattttcccttcgtcaagcgactccaaaacgtgccccatatctaatctgtctcgcacgcggccggcggcggaagagcagagcatcaggcgcgtgtggatagccggaggacatggccacccacttcacgctcaacaccggagcacgcatcccctcggtgggcctcggcacctacaaggccggcaccggcgtcgtcgccgacgtggtctccgccgccgtcaaggtcggtctctctgaacacttgctgtttacttgtacgcccgtatccatatgcatatattgttctaagtttacttgctgagttgctgtggcaggcagggtaccggcacatagactgcgcgccgctgtacaagaacgagcaggaggtagtaaggctattccctgcaaatctttgaagtgttgagtgttctatcctcgattggcatgaattgcaccggtttaacttgtgagagtgatttttgtgtgtgctcctagattggtggtgctctgaagaagctcttcgatgatggggttgtcaagcgggaagacctcttcatcacctccaagatatggtgctgactgctgctgtcttgttccttctattgaccgacctcaacttctgaacgctactagtagtgcaagtttattctgctatttcgaattatgttctatcccttcctcttgaagacgtcccaaactctgcaggtgcagcgacctcgcacctgaagatgtcccactcgcaatggatagtacactgaaagatctgcagctggattacgttgatctgtatctggtaagctcatcatgatcagcgtaaacgtagacagtgaaaggtttgccattttgctctgcttctgacaggtgcccaacggtgcaatctctgcagattcattggccgtttcagatcaagaaaggcacggagctcagtccagagaacttcgtcaagcctgacatacccagcacctggcgagcgatggagcagctgtacgattcaggcaaagctcgcgcgatcggcgtgagcaatttctcctccaagaagcttggcgatctgctctgcgtcgcccgcgtccctccggccgttgatcaggtcgagtgccacccgggctggcagcaggcgaagctcagagcgttctgccacaccagtggcgttcatctctctgtaagtcctgcatgtttctgagctcatcgatcacttgatatgtagtagtagcattgtgctgtggttcactgctcacatgattcttgcaggcgtatgctccattgggcaggatgaagggcatcgccgttgattcggtgttgccatcggtagccgagatgctaggaagaactccggctcaggttgctctgcgctggggtcttcagcagggtcagagtgtgcttcccaagagcgtcagtgaggcgaggttgaaggagaacatggatctgtttggttggtctattcctgaggaactgtgtgccaagctctctgaaatcgaacaggcaagtgcatccaacctttcagctgtctcaagtgcagaaaacagtttcacttctgtcttcatatcttatgcaattccggatgaataaacttcatacagttctgaacttccgataagttagtaaccagtacagaaaaaagtactattgaacaaaatgcaagtatagtggatacgccaagggtttcttgtagttgtaggccttgtattggaattgtaataactgaaaatgcattgttcatgttggacaggttaagcaaatcagaggagatggatttgctcaccccgagagtgtctacaaaacctacgaggagctttttgatggagaaatctaaaagaatggaaatcacctatgtgaaacaaaatgtgccattactgtaaaagaacgatgaaaaataacaggcatttcacaacaatatcttttttcttctcttcaggatagctgtctcttttacatgctgttccttccccaatgtatcaaaatacagtagaagttttggaccagaagctaaaactatggagatccatgtggtgggggactagaataatccacaatctaaagccaaatccataaactggagaaaatagcatgcctatttttaatctcccacaattaaagagtcgcaagaggcagcagagatatggaacttggtaacatttttaccacataaatctgcagagaaaatcaagaaattcgaaagcacactgaagtaggtccttctacattgcaccaccgcagagacatccaataagcagctccacaatgatgcactgacagaacaggtagcactttaagcccttcgctagattcaattttcgaccataagacagcgatgaaggcactcacatggggtagacaaaaagggcgtttaaaactcgctataattccgccatactgctcgaaattcctccctgaatgtgttcaggcgtgctttcagattaggtgttctgaaactggcgtgaagcaaggttgctgcaaggcacaaacttatatattaggcacacatgcacaattttaaaattttaaacctcaagtttggccttaccaagcagaccaacaattagtgcccacagaaccgtaaggagactacatgaggtcatccagaggaagcagcttactgcaaaaataaaataaattatatgttgagttcattatttatttagttgttttttttataaaaaaaaaactatggtctagaatagtatgtatggaggtcagtgctttatactaaccgacagaaaataatacaacaaaaacccatcgaggccggccacaaatatgaattgatctttttgagcttggtcggccacgaatgacaggtctgcaaatatcagcaatgttgttagcccgttcttctgagactctttaaaaaaagaagaatgttatagaagaaatagggggagaggatccccaccttaagggtggcctcatctttgctgctaaatgtggtgaaaattgtctgactgtccttgtgactttctcattgaatgtaactgcaaaactgcatatcaaacatgaatcatttgaaaaagcagttctagtgggagtatcactatttctagtggagtggacaaacataggaattgactacagaaatacacatatgagcataaaatctgtcagttatctaatgagtgttaagtttttttttctcaaaaacatagaagaacagcgtatcatttcattaaggggaagaaaaaacaaagtgttaagttgttaacatataactggtgcaagagtgctgatatgagcccttaagctaaaatatgaaatgcagatgtctcccaatctatatccattgataataataacagcagatgcttagcagattcaaaatcaaacaacatttatgtgttggaaggaatgcgacatgcgaaataggggttaatgtcacatttgcaggttaaaggaagaacagcttgtaaagtgcaaaatatctttcttcccaagagcactaacggtgccttcaattgaatccaaacttacctgtcattgagaaatgcaatgctgaggcctgttgaaaaagctgcaaggatggaaactggtttccggagaaagcccatccctgcaaaaagagagacacaagatgactatatgaaagtcaaaaaaatagtagggatgggggggttgggggagtacagcacatagaggtctctctgcctaccaagaatgaacatgatcaagatgaagtagttcgtcctgtagctgcaaaccagcaaaaacgttggaaattaactttgttgaaagatgtaacatggtacaaaacaaatatgtatttacaatataagttctaatgtaaaatggtagaggaacttccaggttctattcctaaataatatcgatatgctgccttcctatttacacgttaaaatcaaagtacctgttcacatattctatgattataggttactgttgatcatcggttccatacaaaatattgtatcacactcagaggataaccgtgtggtttactataatatggaaacatcacggaagttttgattatgcaccttttatactcccctaagtctcacatataaaattccatgatgtagccaagctaccaataaatttcaagtcacgatttagtgagctacacctaactagaattatcagcaaacgtacacctcacagaacaagttataatcaaatctagattccacgtttaactccaaaagtagaattcagatcgatgccctacacacattaaatgtgaaacatctctgcagcagctaacgtatcgttccaaatgaatctaaacagttggcacctcatgcatcgccccctattccaacccgatttaacccaaatcacagtgggccaaccaatctagctcactcattcttcgattcgtgaggagaggcacagaggtgggaggtagattcgagatagaagccgtactacttactagtagaggttgcacttgaggcggctggtccacttggagtaggatcgcggggcggtgaagcgggagaagaactcggagacggggcgcggcggcgtcgaccagtccacctcccgcagcgcgtccaccagatcctccgcagtcacggagctccagtccatcgccgccgccgccgccgcctgagccgacgagctcgccgccggctaggaaatccggtgacctacagaggagatggcgagtcggcggcgacgcttctagatggttcgaaaccgacgaggaaagggcgtgaggaggggcaagtggttcgtggaagagctgtccggattcggcgacgtgtggcttggtcggatcggaaccgatcggacaggcgcagttggcacttgggacgaagggttggtacatgactggagtactggacccgttttttgaccgcccattctatagatcaacgggtcagatcgagtaatatgatcacccgagatgatagccattttttggttgattcccgcaatccagcattggttcctggcagcggggaactggagattgtctgtagcactactgatgtattgtgagacactgacacgcaagtttagatgtaagggtttaattcaatccatgtcattgaaaatataacattttagataaatattattacagtgcgtctatttgtagccgtgtcactgaaattttacaaaattataatcgtgccactgccgttatgttttctatcttctttctctataagtgagacccacccgtcaaatacatttttttcttcatcatctctttctcttcttttttttttcatcaatctccaccacttgttgagccaaattcggcggatggcaaggagggcgcctgcgagggaggcgacgccggacagcagcgggcagcatgtgtcgctggccttggtgccgactaccgtgtgcaccagcccgttcagcatgttcacttacgccagctgttgtatttgtcttttacacaagtcatgtacgtgtctcaattttttggagaggcagatgaaagcatgaattatgctgtcattatccttgacaactttacacgatcaagatatatttttttccactttactaagtcattgtacttagtatcttgctaaatacttatattttaaggattaggcggcatcggaggcttaggcgtcgggcagtaggagaaagcaacagccggtgctgtgatttcgatcgggcctaacaggtgcgagctgcgcggacagggccaacgccataatgaggaggatgacgacgtcaatgcagctgttcttggcagcggtgcccatggcgccgatgagtgaggagctatcgccacctcccttaccagcggtgaagggagataggaaaataaggacatgttcagattgtagccaaaataaatcttaccaaattttggcattgtcaattttagcaggatttcttatggacaaagtatttgttaaatttagcagcaaactaaatgtagacattttttaagtaactttgacaaaaaaaaatggtatggttgaaaatgacatcaatctaaacagaccccaagaaaagaggggagaaagaagattaatctaacgggtgggtcccacttataggaaagaaaaaaaagatgaaaaatgtgacggtagtggcacggttctaattttataaaatttcaatgacatgactacgatttgaataaacgaattgtaatgacatttatctgaaataacatatttgtaagggaaaagtctgaattacccttgaactattgtgtgcgtatgaattactctcttagatccgaaaactagaaatctttcaccctcaagtattaataccagacgaattaccccctaactcaatatggagtggttttggtcctacgtggtagtccagtcagcatttttttcttaaaaaagggtgacacccacatgtcatattctcttcctcgcccctcgccccgctctcttctccctccgattctctcccaaattggtggctgggggcggtgagctacgagtggcggggtggaggcggctccacaagcagcgagccggaggtggagggcgacgaggaacggcgtggggtcctaggcggtcaacggcatggcccaccagatagacaacgagggatacctccgccactcgctgcctgaagccgcatccgccactcgtcgtgtcccctttccatccgccgatgaggaacgccgcctggcggtgtcccctctccatcctttcagtcgtctctgctggaggccgaggaggaggcgcctccaccgcttgccacttgccaccggcggtggttcgactggaaaaaaagggaaccagagcccccgccagtccagtccccttaaaagatcgggcatgcaatcaggccggagaaaaccagttaacttgggtagtttttatataaaccggggattaaaataccaagaaaattggtggagaaaccagttaacttgggcggtttttatataaaccagggattaaaataggagaaaaccggttaacatgggcagtttttatataaaccggggattaaaatcctaagaaaattggtggagaaaccggttaacttgggcggtttttatataaaccgaggattaaaatctcaagaaaattgaccgattaacttgggcagtttttatataaaccagggattaaaatcggagaaaaccggttaacttgagcggtttttatataaaccggagattaaaatcccaagaaaattggtggagatgaggattcaacctcaagtcataggattgagagcaccacacggtagccatg

SEQ ID NO: 55379 - DNA, 8691 bp, Oryza sativa
tagtagaataacttcgtagccatttcttcaatgaggctcctttctgttgcattttggtttagctagactattgcacgttgagtagcatcaccatctaccacatgctcctactccctcatgtcaatatatttaaagtttgagacaacaaaatcatattaaatcactcactaattttatgtcctaaaagctatgtaaaagtgaccatagggagcatctgttaggcggagctgtgtggcacattgattctaggcttctagcatatctattgtcgtcagattatgctaagtgccccaaccactgattaggaggaaaaaaatatgcggaagttttaaaattttgattgggataacaaccgtcacaaaagataaacaagtctcttgaattgataatggggaatacccactgaaaaaacatcaaatatgtgaatacccgtgaaaaccggatttaaaagttctctaaattcatgaaaaaaaattactagaaatagttgtaggcgtaaaatacattcacaccaaatcaaagttcaaactcaactttgtttagaagtaacaaaagagacaaaatttggatgaatgacaatgtagaaaagattaagaaaaatgaatttgcttgagaaaagaaataaatgaattgccaatgtataaaagagaaaaacacactggcaatttggtgaagagagacaattggtaatatacaaaactcatagctatagagaggaaagaagaaaaaaaatcattttttttgccaatgtacttgaactcaccctccgtcgagcaaagaatgtaattctaaaatttgtccaacaaagagtgcagaaactcatatgagaaaatttgtcagttttgccaacgtacaaaactcacgaaaaaacaattacaaaactcagcaaaaaaaagttatcaattttgcccgtgcacaaaactcaatcagtaaaatatttatcagttttgccaataaactcgccctatgtccaacaaagaatgtaattctaaaatttaaaatttgtcctacaaagcagtggcgaagccaccgcccagataccacaggcagccgccccgctcgctgtcaaacgttccattgaatttttagctcttgaaaggattgaccatagaactggatatagtttgagttttgctcagggttaaaaatctttctggctcagctatactatagagactgcagaaacttataggagaattttaactcagcaataaattttgaaagagtgcaaaaactcatagcaaaatttcaacttagcaaaaaaaaaaaagaattgtcaatgtctcaccctctgtccaacaaagaatgcaattctaaaatttaaaattagtcctacaaagcaacggcaaagccaccatccggctaccacgggcagctgcccatgctcgccgtcaaatgttccattgaattttcagctcttgaaaggattgaccatatttgaaagagttcaaaaactcatagcaaaatttcaactcagcaaaaaaaaattgtcaatgtaaaaaactgcaatgtctgagcgtgcaaaaactcatgggagaagttttaactcagtgaaaaaaatgtcaatgcaaaaaataagagaaattttgcaaatacaaagaagagaatttttgcaaaaactcataggataaattttaactcagcaaaaaaaaaattgtcaatgccagaagagaaattttgcaaaaactcataggataaattttaactcagtaaaaaaaaagtcaatgccaaaaaactcataggctaaattttaactcgagaaaactcatatcattggataaattttaaatctcaactcaaaaaaaaaatcataggctgaattttaactcgagaaaactcataactcttctcataggataaattttaaagtttaactcaacaaaaaaataatgtaattgcaatgtctgagcccataggataaattttataaagtttaactcaataaataattgcaatgtctgagccaataggatgaattttttaattgtgtctgagccaataggatgaattttataaagtttaactaaaaaaacattgtaactgtgtctaagtccaggttcgaactggagacctttagtgtgtgagactaacgtgatcaccaactacaccacccagacctttttgtttatataagcatgcacattttaaatcaatgttaaatcaacaaattgcagaaagcaaagatcacggatacaacgcagacgctgtcaacagtcaaaatctgttttcatcgttcatctaacagccgcacttttgccggagtgcatcggccagttgcttaccttttctttgagacccagcggagagcatgctccatccataaatatctggattgcaacagtaattgaagtctgcaacttcctcccaaccatgcatgtgcatcgatctctgcacgatctgcgcgccgcgacctgacaagcaatcggtgcatgcatgcgcacgcatctcggtaagagcaggacctaaatacaaggccacaatagaagaaaacaaacgggaatgcgtcttttgtgcatctgaggctggtccgtgcatgttaggggcttgctattggtgcagtagctattttgcctatttgatgtgttatcacacacgtctctataactgtcatgtagtagtagtagtagtagtattcatttttatacagatcgactgggcaaatacagtgcagaaaagttcgaatcaagcagcgaaagtatggtactccggccgtatacatactactgaaactgactcaacactttggacacagatcgcctaccttcaccctgcacatgttgcagcgtgcaaacgcaatatccattgtgctgaactgctgatctccgttgtctcagctaagatgccatacatactagtaggaactactgtatcaatctgaagtgcatagggggcaacatcatttacatctggtgaacacaaggcgacaactcaatcacatgaaaacttatcaggtctttaaaaaacttggcgatactgtgacggtgtgaccggagtaggagtaccacctggagtacatagctgtacatgtattcccgtaccaaaagaacacagctgtagcttttcttttttggcaaaaaaaacatgccatgtataaagcgatacttgtcacaacttcatatacaatttttaaatctagtatctttagctcaaattttgttttttttagaagtaatcgggaatatactaggttaccctattttatgcaagaatctaataatcccatcatttcacttatgtttatacttatataagccaaattttgataatttttttacttaattttgtgatatttttgtttcatcgtagtttattttataacatctacttttgaatcgctaagaacatgtctgtaaaacatttagctatagattattatttttagttaatgataagccaagtgaataagcataaacataaataaaatgatggggatgttattattggagatttaaagccatgccaaacagatcattaaaaattgttgattgttgaaatgcccagacttcaaactatgtatgcgctaccatttatttttctatcaagagggtaaacactaatgcactttacacgctcatgaacttctggcccataataaccttacacttcgtaccacgatggtcttaatccaattctttcaaattactcatctggttagtaaaatggattatttattttattctttaaaaaaatgcatttttaaaaaaaacctttattttatcgcaatgctaagattattgttttacactatttatcaagtttatttcttaaaatatttaacataacttataatcaaatcgagcaatataatccactcaaatcaaaatcaataaaactatagtattttccctatttctcttgggattcatctcgggattaatctcagatgtagatcgaaatgctatacaagctaggacgtgtgtgattttagtgcgaccgtgtgttaaccgtgtattggaggtcgatctgcggctatccaattttcttaccgtggagcacgtgtgctatgaaacgactggctgtacacgtttcaacattttgtcttctaccctgaaaatgtcccaagtattacagtatttgatattgatttttttgtgggaagtgcgtgttatggactaatgattgcattgtggagacaacaagcaccatccgtcgtccccgtccatggctgatcagataggacacacctacgtgacacgtatggttccaatgatagacggcagcagcaagtcaggaacgtttgatcctctgcacgcagagggtcttacgaatggtacggtgtacgtgtgtgtgggagaaacagagaggagacgaggacagactggagcaatggagtggatgaatggagggtagacaagtgtgtatttatgtggaacacacgatttgtcaatatccacgttagctagcaaaagcaccacgaaataaacaccttaaaatctgtcatcgtcgtatcatgcatgtcgaatgttttggttgcaaccgattgaagtaaatgaatttaggaatttgtacgtgaaaacggtaggaataatcttgttaagtatatctccatgaaacattctttatgtccactatctcgaaaataagtatatttttcattcgtgctatacatatcaaataaaaaatattatcatcattttatcaaatttcaatataattatttcatattttatctactcccaatgctttgccccatgcttttataaactctaatacaacgattgtttaaaaataaacttattttagaataaacaggagcgaataaaaataatcttatttcgaaacagtgatgtactagtttttaggaatttggtcagtatttcagttcacagtttatccacaattaaaataagtggttactgtggctgggcctgcgtgagctgggctgactagagagagggagagaccgcaacacagaagatggcgatatttttgggagcaaaccgctgattccacagatccgggagcccatgtggaaagcgcccgttggcggttcggcgatggttacgggccatcacggggtccgctcgccgcagacgatcgcggcggcgggcgggatctcgccacacacgtaatccgacgcccgcgcgacgggacgggacgcggctacgggctaccaccacccatccccaccaccaccaccacctcccttcctctcccccttttaaagccgtcgcaccctggcggtgtgtaagcctccgcccctccccgtatctctcgcgtttctggtctaagttccacgccacttgttgccgcattccttctccctccctgcaaatccaatccaatccaatcccaccccaagctcgcggaggaggaggaggaggagatggggagaggagggatcggcggcgcggggctggtggcggcggtcgcgaaggcggacgtggagaacaccgactccacccgcggcttcgtcaaggacgtgaagcgcatcatcatcaaggtgagtgaacgagggcgacgtgatgcgcgggttgacgatcccgtcagcggcgtccggcatgcgactgtgtcctcccttcctgtgaaacctgccgttctgccgttgttgttgtttgttgtttcctttttttttcagtgacgatagtttgtttgcgcgatctgtgatcggtgaaactcgaggctctctcgatctgatttgcgaaggatcggagaacctgacaaaaaaaatggccttacaaactgcaatagatttatttcattttttgtttttgggagctgcagcatgcgttccaaaggagtggttctaatctattcttgtgtgctgttcatgttcgtacttacgtttgatagattcatacaacgcgtgaccataagaagaacagcagtagtaggtaatttttagtgaatttttatgagctccattatgacagcatatgctgtcacccgtgatttgtcctttttttctattttttttaatttaaaatcactatggctatatttttatgtttaactctttaccattcatacgttttttaggtttaactatttaccataaatatgtttttaggtttaactatttaccactcattaattagtaccattctctaatgaaggatattattttttttccctctaaatatatgttctgttggctggcttaattcgacaggtcggcaccgctgttgtgactgggccgaatggccggttggctatgggcaggctcggtgctctgtgtgaacaggtaaactttccccccaaatttttttaccagaggttaatgctctgaccaaccgagcttgtgctaatcagtgtcagttaaccggtgtgataaatttcccaggtgaagcagctaaattttgaggggtacgaggtgattctggtcacctctggtgctgttggtgttgggaggcagaggctcaagtaccggaagctcgtcaatagcaggttgcagagagttaattggctctgaacagtaaacagtgttctgctgtagcattcatttctgatctctctcttgcttgcagtttcgctgatctgcagaacccacagatggacatggacgggaaggcctgcgctgccgtcggtcagagtgtgctgatggcgatctatgacacgttatttagccaggttggcgtgccattcctgatggatttttgtgtaaaaaatatgatttttttgcatatattttgacacgttaaacttccttcgctgcagcttgacgtaacatcatctcagcttcttgttacggatcgtgattttatggatccaagttttgggaaccagctccgcgagactgttaattctctgttagatctcaaggttataccagtatttaatgagaatgacgccatcagtaccaggaggcaaccatacgaggtgtgtttcctaatgtgatttgtgtgcactgggagcttcactgatatatacgtattccaaattccattaacaacaaacactaaccttttacactttactgattgtaatgatcaaccgtgtgtaggattcatctggcatattctgggataacgatagtttggccagactgttagcgcaagaacttaaagctgatctccttatcatgctcagtgatgtggaggggctctatagcggtccacctagcgatccacaatcgaagattatccacacatacgtccatgaacaacatgggaagttaattagctttggggagaaatctcgtgtgggaagaggtggaatgcaagctaaagtagcagctgcttttactgcttcatcaaaaggaatacctgttgtaattgccaggtgagtaaagcttgttttcttctatcgttgcatgaattgtagcacaaatgttaaccaataaatatatgtctaaaagataatatactgcaactgcaacaacgatttatattatttttcagtgtataagaactatatgttctacttatgatggttagttacactgtcacgtggtgttgtatttgtacacaagtgtttacacattgactaagacggtaatattttgatattttggaagcactttcctgataataatagttgagaatggagagcagctgcatgcctgcatcacaattttgttttagaaaactcgtggactgctttagttgctactattaaccacctgtacgaggctctggtagagacagtattcaatagtatcaaagtgctgcatcttaattcctacatttggtgtgttattatgaaactagctgggtagcccgcgcaattgcgcggctagcacctaaataaaatcatataattttttagtatgattttacttaaaatttattaaatagctatctcatgtcttaagagtttgaaagattaaaccttatcatccccgtgtttctaattatatatattttttaaaagtcacaccagttgctaccccttatgacatctccttctttatttgcttgctcgatataccactatttctattcattctccttgaaacctttaaaaattagatcttatagtttttagagtttattgtcatgttgggtttcgtttttataatttctagacgtcccgtcaaacgttgccattatactcctctatggcccgtctactgtctcttttctttattgtcattgagattttaaaaatcgaacataattatcgtttcggttcatttttactttctagaaatcccgccaaaccatcagcggcttttccattgtacttctctacggctcgcccgctgagtcccttctttattgtcattgagattttaaaatcgaacatgattatcattgtttttttttaccttttcgaagttcggaacctttaaaaattgaaccttgtagtttttagagtttattgtcttgttgggttttattttttataatttttagaagtctcgtcaaacaatgccactatgctcctttatggcccgtccgccgcctactctttctttattatcattgtgattctaaaaattaagcacaactatcgttgcaattcattttttattttctagaagtcacgtcaaacatcaccggctctaaaactatactactatacaccccgcccactgcttctttttattgtcattgagattttaaaaattgaatatgattatcaatggggttttttttttactttctagtagtcccggcaatcacattgctcgtttgcttcacggcctgcctatcgtccctccttttaatcgttattaggattctatttggtgttttattaacagtttttatatgtcgtatcaaccgccaccactctactcctttatag

SEQ ID NO: 55380 - DNA, 11493 bp, Oryza sativa
cccccccccccccccccccccactcgagctgcctatctccaggtaacaacgctggatacacatacaaaattcatccattcacataataatcaaatgatgctgcagaaccaaagatgcatggagccaagacagccaggctccattggagagcttctgcctgcagatccagacaaattgtttactactaatgcatcgatcgaaaaagatgagccaatctactgcacagaccccaacgaaaattattagtgtaacagaggccagttagaggttaacaaatggtcaaatcatggtttgtccaagctttaggaggctacccccgtctaaggatacaagacatacttagaaaaaagtctactaacttagtttaatactgctcacccaaagaaggcagaaaggctaacaaaacaggctgaaagataaatcctagcaggtcttattctacagcgacaaattgaagcttcagctactttagtacatttggtaggatcacctcactttttggccataacatcagcttctttttctctgccagctaagcccatttcgtcatcacagtacaaggattaatctaagcatataacaaatggtacacaactttactgccttgggaaggtattgtcaatctctctatagcccgcaaggtgtcaaatatttgacagcatacctggatctacatgaagggaagatcaatgttttttcaccctccgaacaaattgattcagactgatcatcaagccatgtcgccaagtgattgacttatataccatcctaacatcatactagcagtacattacaagtgcatcaccagcaacctgaggcagcagccacaatcacccgacaaaatcatgcagcaagtgaccaccaatctccttcccgaaatgccggtcctgacctccaaatgagctcatcacataggcgtcactgacttcctccagtccgaaacggtgagctaggttggccggagagcagccgggagaggctcggcgatgcagaccctgttgttctggtgaagaccaagggtgagggagacaccgccattgccgcctccgataccaacaccgccgacctgctggtgctgatgatgtggtgatgcaatgttgtgctgcgaggtcagcccgttgtatgcgaagctcacctgtccctggatggactgggacatctgggagagctcatccgggaagccctgggaggcagcggtgttgtggttccgagttatgctgctgctctgtccaggatgggagtccgaaggaacggagggattcccgctgcactgcgaagaatgctgggcctgatgatgcacgctatgctggcccttgtcaaccaccgagtgcttgtgcatttgcctcatctctaggttgtgaatttcttccaccattggcttccacaacctaacccttgcgttgataaaccagttcgatacctgcaccagcatcacaaattcaatcaaaatgtcctgaaaacaaaacaatctagcctgatatactgtgcaatctattcttgaacacacctagaagcatttctatttacctggttgcgtgtcaagcctgtttgttttgctagcatttgcttatcaccatcggtaggatacctgcacgattggaatctgaaaatgtcactgatgcaaaattatagtgttttctaaaagaacaaagtaccagatatagcgcaaaatcaaataatcaagaaatttccgctattacaaaagacacttgtgatgtgcatgcttaacgatggtttacaggatcacaacaaatattttacatggcgaatatccaagcaaagatgtaggcaaacacatcttccaagtcgaaccttacaaaggatttgatcaatacgggaactaataacactaggaccaacatctgacaaataatggatttcagtgactttttttaaagatgatgactgatcctttttttaaagtaataaacagacagacaaaccccttactggatgaaaatggctagcactaaactactgtactaattatctcaaactgaatatctcgagcacatgtcaatcaacttgatgtaaccaccagtagggcttagctacagcctttagatcatatatataatgcaaaatgatcatactacaaaaactaaaaagaatatgccaaacaaactacattatgatgatgcttattatagcctaaggtatgtacttttaagatttagttcgaagtaatgcccatctggcaagttaattccagcattaacgtgttctaaaagccactctacttatgagaagccgggccaccacattcatacattacagccagaaacaacaaatccaggaagttaatacgtgattaagaatgcatcaaacaagcagcaggaatgccactatttagatcaccaagtcgaaagtatgatctctagtagtacagctcaacacacagttaggtacaggtttaaaagttatgttaatgatggattggaagccatgcctgcatgaggccatagccttctatcagacaggcagggtcgcttgctatcaccaaaccatcaacggatcaaccccacggttccagtgtcacgtactactgatcatatcaaaaaggaacaaccacactcaccacaaatgcttagggactactgttatcctcatctaaagcaagcaactgtagcatcatcatcattgtcttggaatgcgtgcagctaatgaacccagagttaaccataaagcaataagaagatcaaagggcttacgggtgcaggaagtgttcgaacagccacgcgcgtaaaacggacacagcgcgctcggggagccccctctgtgggcgccaaatattgtgcggctggccgaacgcgctcgcgctgttcgctcgctggaggccggcgccgccgctgctacccccggcgagcccgaacacggcgatctccttgtttagcccgtccttcacagcgaccttgttgctcgtgttgcgcagctggttcagaatcatgctcttcaagcacttgaagtgcttcgccatcgccctcagcgccaatgccgcgaacggcgcggcgttgctgaacccggcgacggtctcgaacgaggccatcacagcctgaacctgctggtagtactgccggtacctcttgcaaacctaaaaaaagatattgctgttgggttagaattcgatgagagataatctaccaacaaagaatgattagataaaaagatatccatgttaggaaaaggaagcagtgtgcttttgttttcatgtggatatgacacgaacaaagcaagcgtagctcccaattatgggagagagatgttattgaagaacacaggcaaacaaaattgccttacagagggttccaaaaatagaagctttctacattgtactcctacgtagatgctcatgtagtatactcctaattgccatgctccgacatcgtagaggagagcgcatttcaaagctcgaagcttttagcagcgccactattctcaccagaggacaccaacaagagagaattaatggcatctggcatcgcccatgggtcatgtctcaagactttgaaaggacggttagttctaatttcatgtggaggactatcttttcaagcactcacagtagtgctaaacagccgatcaaaatacaatctttggtgataagacgcggaggaacactactattcatcatgaacagtgcagaactgtacaagctcaaaccactcgaggaaaaagaagagagagaacaaatcaaaagatgtatcagcagcaaaggaaatcatcatcaaatcaaaagcacatgcaaccacagtaaataaaagcaatccgcaactgcatcggtgacatgaccactatgtgcaagattcttctccacccaggagtagcgataattgtaacgccgaaacaaggtgaaaaagatggtcgccacaagaaacctggaaggaggaattgaggcggctagcggagctcactcacctcttccatcatggagatgagcttcgtcttcttccactgctgctcggcccccgagatggggccagcgtcggccgctgcgcggtcagcgccgccgaggtcgtgatcaacgacgtcatgatcgacgccgtccatcggatccgcgtcgagcaggccctcgtcggagatggtgcggtcgacgtgcgaagcagcgccgccgacgtcgcagatctcctcgaacagcttctctgccgggccgaggaaacgggaccggccgagcacggcggcgtagccggtgaagggaccgaacggccccgtggcctgcgcgaggccgccgagctgcctcctcggctgcgcctgcggtggtggaggattcgacgacgcggaggagagcgacagcgagaagttctgcgtcgggatctgcgggagcggcggcgccagcccgtgcgccaccagctgcgcctgcgctagagtagggctgtgcggggagtacgacgacgacgaggacgcgtacgagtagaacgccgggggcggaggccacgacccgtgctgctgctgctgctgcggggcatgaccatgaccatgaccatgaggcggtggcgagtccccggcgtccggcgggaaccggagcttctcgcgccggctgtgctggggcacgtggtacatctgcccgcccgccgccgcggccgctgccgcaacggccgcgccggccacgtgctgcggatggtggtggagcaggaggtgaccggcgtgcccgtggtggtggtggtggtgctccgcgcctccaccctggccgccgccgtacccgccgcccccagcggcggacgacatggcgcgcacgcacgtacggtcgtgggtctcttctcctcggcgcgcgcgcgggtgggcacgtagtacgggtggtgcgtgcgaagaggcgcagcgcagtgagcacctggccctggagagagtggagatagaggggaaacggctccgcactttccgagcgcccgggcctggcttggctggcctggtctcactccctcatcactctcccgctctgcttctgctgctgctgtagtgtagcctccctctcccaccccgacccctcgcgtcctcttgttgttttcctcctctttttccccgtttcgcctttgtgctgggtgttgttgctgggttcgtggcgcctttctttctgcaaaggcgagacacggagggggagaaagaggggggtggcgggagggagagatgggaaggaaatggtaagccgtgaaactgtgaaagcgaaagcagaaaggccgagcgcgacgggggagaggagtggagactggagagcgcgcatcgcgtgtaaaaataggtgcagccgcgcttgtcatccgagtgggtgggtgggctgtttggctgccaggacgtgtccgggcctgcagcgtacttgcccttggcgcggcgcgatcagcccttggctggctcgttacgagggaaaaaaaaatgattttcatcttcccttgttttactgcggctgcccgcggttggtactcccacctgtgggggtttgaccattccaagctacgagtagaaaacattccatgtgcagtgcgattaagtcccccattataaatgttgtcctaactggctttcgtacaaacacccatctccctgctttcgaattccacctctgctgcagcaacaatttttgcgtgttaaccccagtactctgtacagggctgtcaaacgacaccaaaatacggtttttatcgcaagcgtgtccacatcactacatctacatgacccaatcccttggctgcttgtgtatagtgtagtactggggtagtacaatactggtcgacccgcactagtagaagcggcaaatcatacgcgccctttaatgcgctgccctccccagagcaagccctccattgggcgagtcctgacgcccgggcccacgactggtcaccacccgtaactgggcccgcaagtaagcaatcacccctctgggccccacccatgacaagacctaacatagcacaccctctggcccacggcccgtctcttcctccctccgctccgagtcccccacgcgcagctccacaccgtcgtcgacgcaccaccgacaagcgggacccacgtcccctacccggttttccatacagcggcgcgcaaccagggatacgggggagagaatcccacctctctttcgccgcggctgttggctgttgcgtcgcgtgggacgtcaccgggggacacgtgccggctcctccttgggcgcggcatgattagcaaagctacgctacggcggagcccgtgacgtggctgccgctgccattaacttcaaatccacccgtccattcatctagccgtagtgcacagagagagaataagtgagcaaaagatacgaggagtacgagcagagtactggggtgtgaaggaactacacctccgggcttatgcctttgttgttactgcagggaccccctctgtagactatagtgcagctaagcacggctaagctactgcctagtgacctctctctacatggatcaacagaacaggtgaaagtgattctcactcggtcagaacagtggcaggacagtgccgccctatcgccgcgggtcccacctcgcagtgtcgacgcgcactgctttgctcaacatttcgtgcatgtgagcacatgaacaggtgaaccgaggcagctgctaagctttggctacctatccccacgttaaatatcttcacgtttccaccgcttccgcctcttctgcaaacgcgatctcacagcgttgcatgcgaccgagcggggctcacgctaagccaacgtgtgcacagcgaacccacgaagcactgctagcacgtactactactacgctccgcccgcgcggtgtttgccacagaccgtcctataccactacacatattttcccgtcgccacagcgcgttggaaatcgtttcacgggggcagacgctgtgtattggcagcggcgcagcgctgtggcgctgtgctaatcaggcaggcagagacacagaacagaggcaggagtacgcacaccgtgccgatgacacgccgcatgcacgcgtgggcaagggccacgggcgcatgcacaccgcaacgtgtatcttctccccagctcgtgcattaggccgtcgcccaagctggatggaccagcttatcaacttgtttatccgagctttccgccttgccgcgagagtcgagacgaagctgcccttggcgccttggcccctcgccgtcctcaccttttcgcgtgtcgatggtacgcacaagtgtgcgaccggctggagtggctggaccggggacccgcctgtattttcgcgcagttcctgtttcgctggatcgcatgtggacacgccgcgttttccctgtttctcgcagcgcacgtgttggctgctgcctgccatggctgccgcacacgccaaaaacgtacgtgcgtttcgtttcgtgcgaccctgctgctagctcatgtgtcccgcccgggctcccgggtgcgttctaaagccaaaagcaattatttttgacgtaaaaagaaggggtagaaccagggaattacacggagcgaccttccagctgctgtaccatagcatatttacagtggagtgaaataaggagaccgaacttttaccagtgaactgtgtgaccttgagattctttagcattaatcaacaacggataacactacttaaaaaatcttcatagggaccggtattataagagccaatttatttaaaatcgacatctatgatctttttctcaccttcccacgatgaaaaaaatatagaaccggcatatttaagcactatagatatcgattctgtttaaaaaaaactcaatacatgcactatagatgcatatttttaatagaactgacatctataaaatgaatatggatgctgatttttttaaaaaaactgacacctgttaaaaaaaacttaatccgtatatgtttgaccacccacagcacccttatcttatctatccatcccgcttgccatccatgcatctctcgtccctcctctccctttgccttcctctctctggtggagcggcggcggccctctcctaacccgggggccctccccccttctctcctcctctagggcagcgtggcgatggagaaagccgaccgatcgggcagggtgcggccggtgcggtggctgacagatagatcttatcagccccgtcctcaagtgcggcgagatggcggtggtggtggaggaggcctggatcttgctagccctctctctcctaggggacctccccccttccccttctcctcctctagcatggcgtggggtggcggccgggtggcaaggtggcggcgtggtcatcagatctcgtcggctccctctcacccaagggacctccgcccccctcccccctccaccaatgcggcattgggtggcggccaccggcgtggaagccagcgttgcgttttttttaataaaccgacatgtataggattggagcaaacgtaccgaccatagctagttcataaccgttacttatggggttttctgtcttagtgtaaaaggctcgttttaccgtccagttctagctgggctatgccaaattttcaataaaactagaaagacttaattaaaaaaatattattaattaaattattactactaattacgtatcatcttgataattgaatatttaataattaattttaatagatactaaattaaaaaaactacttccttttacatttattctactccctctgtcccataatataaagaattttaggtggatgtgatacatcccaatacaataaatcttaacaaacggtctatcctggatttattgcatgtgtcacatccacctaaaatttcttatattataacggagggagtatataacgataatgtaaaagaaagttccttttacatttcaacatcataatgtcgaagcaagaaaaaaaagaaactggtttacttcctctatctcataaaataaccaatacttagatgtggcacattctattactatgaatctggacagagaatctatcactgtccagattcattgtactaaaatgtgtcacattcaatatggaacggaaggagtaccgcgaggtactgtagaacttgggagtatgtttgaatgacacttcgacagcatccgtgccaacgtatacgatgatgcgtatacacgaggtttttgcccttttggacatccatgatatactacgcgcctcgtagtccgcaagaaatgagtgcggagtagatcgctgatcgcgtcttcccgtcgaaattttttctcatcatacggccactcgacgaccagctgcagtaccaggtaccgaatcactctactcctactagcaacgacagtaaggtcaattcagagaagcctgcatgccaccgtttctttccctctctctatcttttctgactgatggatgcttgtcgttgtacgtatctgttcggttccttctctcttcaaagacgttggctaatcacgccctgcttaggggtgttttagatccacgggcgtaaagtggatactattaggatattgcatgaggtgttcggtactagaaaaaaactaattatataatccattagtaaatcatgagatgaatttattaagtctaattaatttatcattagcaaatatttactgtagcaccaaattgcctaaccatgaagcaattaggcttaaaagattcgtctcgaaaattagtcgcagtctatgcaattagttattttttagtatttatttaatactttatgcaggtgtttaaacattcgatgtgatatggtgtaaaattttagggtgggatctaaatacccctttaccacattccatcaaaaactttacaccctgtcacatcgaacgtttgaatacctgcattaagtattaaatataggctaaaaaaagaaattacataaattgtgactgtcgacgtttgatgtcgcgattgcggtatttgtatagtatgtggatcgttggtactaggatatacgcgagactgaggtaaaagagacggagacgaggattttatacaggttcgggcccttgaatcgtcaggtaataaccctacatcatgttggtcgaagccggtcgttacttttattcatcataatcacaccagtacaatatttggggtagcctatctaactgttatcgacatggcggtttgaaagtctgactcgtagtcgacaacagggtagtcttcctcctcgagttcgtgcccggcgagatcagagacagcactagatccctatggccggcctttgtaggtaccaaatagggctgatccaggcatatctctgatgtcgatatccggcggcttgtcttggcgtatgttggcttgtatgttgtgccttctattgttccgtgttgtctatcgtaggtgtcttccatggtgggtgtgtcccctctcctcctaggaggtcttctatttatactcataggtgtctccttgtccaagtagaaatagggaaaccaatatggatacaatccgagtagtcattgtcgttttcatatagaactctggttatctttccttatccggaactccttctgtatccgcaggttatttccgtatagaacatggtatatggtgagtcctgccgagatttagttaacaactattatgtatgtggtatccataaccctgacagtgactaatttgcgagacaaatcttatgagcttaggccctgtttaggctgtgtttagttcacactgaagtttagaagtttggttgaaattggtacgatgtgatagaaaagttgtgtatatgaaaggtttgatgtgatggaaagttgtaagtttgagaaaaaaagctttggaacaggtctccaaacttcaaccaatttcaattaaactttcaaacttcagtgtgaactaaacacaaccttaattgcttgctccatgatttgacagtgctacagtaaacatttgctaatgatggattaattagtcttaataaatttgtctcgtattttgctaacgaattctgtaattagtttttttattagtatacgtacactctatacgacaccctatataatattcgatattacacgctaaaactttacatatgaatttaaacacccctcagtctcatccatgttaagagtataggattaggaatttaggagtactccacgtacctgtatgtaattggagtgtactgtagtatctccggatacggtggatggcgtggctctcagtcagctgggactactggcattcaaagcacaaagcgactcccaagtctgaaccctctcagatcagagtatcagacgctagctgctcctacccctactcctagattacgtgaagtacttctacgtcggcctcctctggagctagccgacgcagcggtagtagtagtagcatctgattgacgtgcgtcagggagcaccagatagcttgggttaacgtggagtacaggctccaaaatctctttgcttactgcctcactccttccgcatcatccccttgtcattagaccagtgatttgacaccgccctgcatgaattctcgttctccctccgatttgaacaacatcggtttcagcaatcggtgcatacagatacaataggacacggcacatactgtaggggtacgcaattgcagtatccgaaacggatgc

SEQ ID NO: 55381 - DNA, 2918 bp, Oryza sativa
cttctcctctcaaccaatcacaaccattctttttcacctactttctcttttcaaacaatcacacaccttcttcaatcattctcatctactttcttaatacccatgccaacataaaaaatgcttacattttgggacgaaggaagtatgtcatatttttagaatatgggatatgatacggacgtattgtcgacgagtgatactcgtgaaccggatgagttgagtactagggtatgttggtaggagggtctacgtaatacgacatcaagcagacaaaggacaacgattatactggtttaggccccttatcaggtaatagccatagtccagtttatatgggatttatgacgagaacatattacaaagagagtagtcgaaatagataataccgacgagaccgtagtcgaaggtttcgacgaaatctcccggcgacttggctccgcgtactccgacttcgtaaactatggtgggtgtgttggtgattgaattggatgatccttcagccctccctcaggggttccttttatatcgtggatcagctcaacttgacctccaagaaaggtttgagtatgttggatctggtacggaataacagaaactatatcccttccgagtaggattttgaaaataacttgactcgtagtcaaacaatgcaagcaaaattttaaaatcgacggagagagtattataaaaaattgaacatgtttttgccggtattttgatacgtcatccgtgtatgagtcagtttttaagttcgtttgtttttgaaaaatacaaatctgtatttgagtcgatttttaagatcgttaactttcggtaatacagaagcaatcatataaaaaatctgtttaaaaaaactcgcatgctaacttgagatgatcggactccaaactgcagctcatgattttctaaaaatatatatatctaagcgaacacccacagtgaatttcatcttaactaaactatataacaataataagattaaaatagacttcatccgttgtaacgtacgggcattttttctattaaaaataaaaggctgaggttttacatataaaggagactcggctactgatcaattcgatcaataagacgttagcatattatttccatagtaaaaataattttctcgctccatatcgaaataaagcaacctacagtatcggatgcgacatatcatagaacatatacgaattcgttctactaggatatgttatatccggtataggttcttatatcgtggggacgggccaggttagtccgtcataaaaatataaattatattagtttttgcatgatctactttgaaaatcttttttttcataatataacattaacaactacactctccgtttaaaaatatactaacctaaaaccggattaaacctaacctaatactaacgaatctagatatgtgatgtatctatacaatccatgtctagaatcgtggtactagatcagatctaatcttaatcctagatttctatattttgagtcgtgtgttgctgaggagtatattcatagtactagcatcacttgaaggtattttcgaatatgaatttatgccattacttgtgtctcattaaacaaatgctcttacattagcagctcaataattagtcaaaattacaaatattaattaatcgaaatacaaacctatgatagaatgtgatatattctagtaatacaaatttggacagatggccgtctaaattcgtataactaaaatatatcatatactattttaagtttttttagacgaaggaagtacatctcttctatatatactattataaaaattgagaatgtttttgtcggtattttcgtacgtcatccgtatttaagtcggttcgcttttgggaatatttattcgtgtttgagttggattttaagcttgtttacttttgaaaatacaaaaggagtctgacggagcgtggggctcctcaccgggagaccgcgcgggcccccctttgccggttcggccgggggcgctgggtgaggttctaagcccttgatctgtggaatggttcgcgagagagcaaatgcgcaagacacgggcgatgtagacaggttcgggccgctgagaagcgtaataccctactcctgtgttctggtggatctgtgtatgaaggagttacagagagctggagagcaagaaagttcaaactctagagaccctctcactcctcttttctccagtcccccctttttggtaggcatggtcctccttttatatctcaaggggataccacatacaccatttctacctacccttcttttgggtggggacccatcctactttgaccaaaacttggctcgtaccttcgcctgacaccgggataaccctgtcctccctcattaatgggcgatttgcaatggctgctgtccgaatgaccctccgatgggatgggtcataccaacctccactccgccggaagcaggtgcaacatggaagcacggttgtttgctgatgacgtgaccggcgtcagtccagtcacaaactggtcattcttgtctaccacgtgtcagtttagcatgccacacgtcagcccttcttcataaaatgacttccttgtaatggttgcgatgaagcctggtatgaatctagtcgggaccgacgtgctaactccaggagttcccacgccggctccgtctagggacgagtgcctagaggctctcatcattctgacgggacggggcgaggcgtgcgaaaggccgcctgttgccacctaacccgcgatctgaccggtctgtgaccggtcacacactgtgacctgtcacggaccgaacgagtgtgctgcgctgcattaaatgcggcgtggggcgctcgtcaacccgcaataaacgcggttaggtgagcgccgctgtgctcacctaacccacacacgtggcgccaaatcctcagggggtcggggcgcccc

SEQ ID NO: 55382 - DNA, 22915 bp, Oryza sativa
  unsure (1)..(22915): unsure at all n locations
ccgacccctcggggagatagagggaggggcagcctcatcactctcgggcccgaccccccccgagggggtcaggccacgtgggtgaccgcggctgccccaaacctctagtcaagatatccccggtcccatgtcaccgacagagtcgtataagaatctatttaaaaaaagctcgcatgctaacttgagatgaagtacagactcctaattgaaactcatgattttataaaaaaaatatccaagcgaatttccacggtgaattttaccctacctaaaccctataacaataataaaattaatatagcatttacatgttacaatgtacgggcatttttctagtgatttaataaatttgtgctcacatggtgagaaacccgaccttttaaattcttaccaattctctctcaaaaagtccggtttcccaaacagtagtaaaccatctctgctgttgttttcttgatttaatttactccggtacccaagatagcacttaccccattttaaaatatagtaaattagtatcgatacggacataggagtattatactatcacgaatatggacggacaaggttaaggttatgtcaaattagtacaggttgctactcccttcaattagttccagaatttcactcatctcacacatactaaaacaaaaatagaaaaaagacaaatacatctagtgcatcaaatcctaaaaaaaatattctttattttacctatttcgaatgcaattattttctcattcacaaacttgatacaactattacttaaaaataaacttattataggataaatgagaagccagaaaacttgtcagaattgaatatttttttacatataaaggtatattttacttctttgtccgtcttaaaatataataacctttaaacggtaaaatacgttctaatattataaattttgatagatgttatattttgggatgaaaagagtatgagtgggcaagtgctccttccatcttattttaaacgcagtcacgagtttgtgtctaactttaatcgtccattttattttaaaaaataaaagttaaaaaagtaaaataatgtataaattaatataatattttatcatttaataagaaaaatatattaatcataattttttttaaataagacgataataaaaaataaacacagaaacacgttacctcttttaaaatgggagggagggagtatatataagtcaaggagtaattgctgttggtgacgttaacctacgcggtagtacgtgcgtgtgagcagctggagcattcaagtagttttggcttgtggcagcgcctctcgagcccatgcaacgcggagacagcaagctgccgcgcgacacggcacgccgagcgagaactcgagtctattcaatgcgctagctgcagcgtccgtcggttgcattggctacgagtaaaaatttacctctttccttgacttcgccaatagagagaaaggaaaaaaaaaaggcgagagatggtccgggagcggcgagctatcggcgcgcgctgtagcggcacagggcgagcagtagtcgtcgtatgcgcggtggtagtgatggccctgaatctgagcatgcttgttggtcgcgtcacgcacgctcgctcgctgcctacatacatgggctctcatcatgccgcacgcccccgatcaattggctacaggctcctactatacacagcgtcctcgtgacggctcgtcacacacgtacgctacgccaagcagcgcatgcacgtgccatgtttgacatgggcgcccgcatgcattttggtaccatatctagcggacggcgttgtgtccgcgctgctacagtcgtcggtgcaggagctgctttgcaatatgtgtagttttctagcgaatccgatcaatacatgcatggatgcgtacagatttagtggttcatctttttttttcttttcctctgctcgactcgaccatggctttactacatgtgataggctttttagttcgtgcatgtagcagcggtagcacactagcatgacatgtctggataaccaccggtcgggagtggcccaccgggttaggccgccggccggcatggggcgtacatgcatgcatggcttttctcgggaattataatcgtgtgatggtccgctgatcggatggatcgggccgtgcgcgcgtgagcctattatggttggattgggacgatgcgtactactactacgtacactacgtacgggtagggttcggcgatgatggtattgatgtatactggacatttcatgatacacgtaccaccaaatgctaaggatctttggacgagatggctagtgtttggtgcaaagatctagtgactgatccggccggtatttaggaccgtggatacttcaaagccgccaagtaacaggaggggcgcctatccgtgacaggagctgtctccacatttcgattgattattgcatggcgaaggcgtgatcagcagggattgacaggatgcgagtagcgcgtgctgtgccaggaaaggttacacaagttccccgcacaaaaaaaaaaaaaagaaagaaaaaaagagagaagggttacacaagttgtccgcgccgggtcctacacacatatggaaaaatgaaacagtatgtattgtttcacaaatgttcctggcttaagttagatatagtatataggaacaaattaatgtcgtgccccttaaaatacatgataaaaaaacacagagaatatgaaataaaccacataaatgaaagtaacatgtttttttaatccagtaatagttaaaagcacaggtaataggaatatactcgctccgtcccattttaagtgcaatcataaattttcacgtccaactttgatcatccgttttatttgaattttttttataattagtatttttattattatgagatgataatacatgaatagtactttatatgtaactcatgtttttaatttgttcagaaatttttcaaataaaacgaacaataaaaattgtgcacggaaaatcatggttgtacttcaaatgagacagagggggtatgttcttcgattgcaccataggacggaattgaccataggaatacaatcctataaaaattcacatccttttcataggaaaaatccgtgtccttttcaaatgaatcaaaggagcatatgagaaaaaaatattaagggaattgaattatcaaaaattatttgtcaatcctccattttaaagggaccctcattgtagagatgtgcatgtgttcaatatacacagggagcacatatatatagcctttcatagtctacttgcagatttatcgctcgtagccaaaatttaaattttggaaaataaattttagagttgatttcttttacccgtactctatattttaatttttcttttaaactgtaagtaaacatatataaataaattgtttctcctactttgtttgtttttctatggcatatcaactacttcgtacagctcaagcgacaagaggcataaagcaaattaaccataagtgtttcccacaatatacccctaatagacgacacgcatgataaaatttatgaaaaaatttatgatgatctctacggtaatataatcaatatatactaccaccaacaatcttaaactatctttcattgatagtataagtcataaatcaatgggttatattatttaactaataaatatcagtagatatcaccgtaaaaatacttttcagattttttttacgaattacacgtgtgtaaatacatgcgtgaattttaatgggtacaattacacaataaaaatatacaaattactgaatctgtctcagaaaaaaaaaacaagcacatcagagctactccctttatctcaaaataaactaacatatgaatggatttgacacaatctagtataacaatttagacaacaatcgtcttctaagttggtttattctgattcggatggagtacaacctttttgtcatgggaaaggccatgtttacccctccagctgaagttaattaaatatcatcccaaacattaaagagtaaaatacagttactcctatttgctagccattacaaattcatatgaatataatatcctgatatttattaaatgctggcccgttgacatgacagcgctttcacgaacagcggtttctcattggcgctgagaaacctttggctgatctaacgtgaactttcggtgaaaactattggcataagtaaattcacgctgtgtttagatgcaaagtttggatccaaacttcagtccttttccatcacatcaacctgtcatacacacacaactttttagtcacatcatctcaaatttcaaccaaaatctaaactttacgctgaactctcgtaccaaagttaatctacagggtgatcccaacagttttgggctaggtgggcctgagtccctgttccgttggctaaaccctttataaaatgttgagttaatagaggaaaaaagcactagtttgatagaagaaaaacgatgaataattgaaaggtaattacttttacttcttttttaaataggtagttgtataaaaatataataatgtttgtttttttcttatatttagtcttgtcatgttacgcactatattattctacgttcaccgtcactgttaatatatccccatgtagaaattaaggatgaaaaatatatactttttactatctttttaaaggaattataaccctggcctctaaactacaaatgcacatcattatttgaacttggagtaaacctctagaggaaaatttgcaaaaaataaatagaccaagactcgtattggttgagctatatatcctagaaataggaatggagcaacaataaataatttgtcagaaaaaccttttgtggtttaaaaaccaatgttgaaacaaatcaggatacccccccccctacaaaatttagtactccctccgtcctataatatatgtattttaataatttgcttacactgtttaagcactcgtcttattaaaaaaatctgtgcaaatataaaaaacaaaaatttgtgcttaaagtactttggataataaagtaagtcaaaaaaataataattctaaattttttttgaataagacaaatggttaaacagtgcaagtaaaatatcaaaatcccttatcaagagacggatggagtaggcaacaagcaaacaacaagacactaaaatatctatataacctaaaagcatagtaattaagtgcacaaccatcaccggttagtttgaaaatatagagaaaaccaagcgattatatatatactttataaaaccagtcgactttataaaaccggtcggttctgatcaatacttcatccccggtagtatgatgccgtgcagtctatccccagttgtaggagcgttaagtaccagcatgtcaacggtaaaaggaacaacgatacaaagagctcaagattttgagaaatagttgtttggtagctatgtttcctaagttctggtttttatttcatctcctagattctataactacaaattttaaatctggttaaaaatctactaaactgatggtagaatctaaggacccctttgaatcacgcgaatggaaaaacaaagcaatagaaaaaatataagattctgataggattgtaaatccaaaacgagaacgcaagaaaaacacatcaatgatcgtttgattggatcgtataaaaacgcaggattcatataagaaagatagactccaaggatattttccaagatgttagttcttattaaatttcctctaaaatctctataggatcgtttatttcatagaaatttcaaataatatgatatgatttaatctattatttcaaagaccttcataggaaatttttaaatagaattgaaatcctccaaagtttccatgtttttcttccaaaagttgttgctgatagaatctctctcgaacaggacatctcgcgaagtgtatactggcccactccacccgtttcggccctagttacatcaacgataggtacgtgctaataagatcagtacggaaaatagttgcggaggcaggtaatcttacatactgccctctattagttgaaaacggagaacatgtactaatggcacccaatcatcaaattcgctattagctgctcttatcctcttttgcctacctacaagtactccacaacaggaacaatctccccgctgttaccagctgtgttgcttttgttactactgctagttttttagagtagctagggagagtgcaggcagaggcagggcaggggtggtgaatcggtagaggtcggcagcgtggtaggccacggagcagctgctcatagtcacatctgcatttccaatccaaaagcaggaagcgtgaacgaccgtgcaaaaatgaatggagtcaggaggcttggcgtcccgtagatgcagaacgcctttgatggatggttgcagcgaaggtgcgtagtttgcactttgcaggtggttgatgggaggccatcagctgatgtgaagtccattagtatgacacggctggggcttcatgtatgccatgcatgtcaagcaacagagggctggggctcatgtatgccatgcatgtcaagcaagcaacagaggccgagccaaacagccaatggtagccaaacagccattttattgacaacaagggtactggagcgatcaataaaattggaacagaaggagcatggcactcaggctgatggagtcatgaatggatcagaaagcaaccaaccgaagaaaatttgtttggtgatagagtggaacggatgggctgtttcagagttcactgtaactccggaccagaatacaagaacggctcccatcaattatttcttcaccagacagaagaacactgcaaatatggttgttagttcccgctactaggagcaaagtcaataatatagcccgctgtcggctcttaaaaaatagccacatcatttatagcatagctcatgcttacaatagaactactataacacaattattttattatctttgtgggacccgccatcttgccttatctcattctctttcttcctcctaccccttctgtttctgtgttcgtcttgcctgtggcctgagcgtgcggtagttggagatgggcacttgggcttgggcagatggccatgcgacggatacggaactacgggagacgccggtggccgtgtagaacgagggcatcatgcgacggacgcgggagacgacgacggctcaacgaccgcggcggcgcggccacggtcgtggctggtgagggccacgaccaaggctgaagcaagtgatggtgacaacgtgatggcagtggccggatgatggtcacagctgcggcgaacgcagcgacgacgactgctgcggccgcgatggacgagagccacggttgaggatgcaagcgatggcaacggcgacggccggggtagacgagggccacagttgcggcggacgcggcgacgacgacggctgcggccgcggtggacgagagccacggcagaggatgcaagcgatggcggcggcacgacggcgacggaggcggccacagggggatgaggacgcctgcggacgcaggtgagggtggcggcgtcggcggacgcaggcggacgacagcggcggcgccgacggacgcaggtgagggcgacggcgccgagagatgcatttgacggtggcggcgccggcagatgtaggcggatgacagcggcgacgccgagagacgcaggcggacgacagtggcggcgtcggcggacgcaggtgaggcggcgacgtcgagagacgcaggtgagggcggcggcgccagcggacgacatcgacggacgcaggcaacagctgtggcaacgagggcggcatatcccgacggatgcggtcccacgaccttgggccgtgcgtagagccgggcgactaattagtcacccgttcgttctctctcttcccccctctctcctccacgtcaccgaaaaatccgacgtggacatcctatcgtcgtttattgtaccgctataagggcatccaaaatgtactacaaaatagtccatagggaataatctattccattcagccatctagtaatattgtgcaactagtccattaaaggaaatagcaaaagatatccatatgcatatggactacctatatgacataaataatattatccatctttacctctctctcttctcctaatgttacattgtatccatatacattgtgattgctatagttaaagtttatttatatgaatcctatctatatagaccatttttgccatatacattggtgatgcactaacaccggcaatgctgatatgttgcggcttgtagctagcctaggcttctagactacccatctaacagcacatctagactgtagtataaatgagtacaatgaatacagacgaaactagtgctgttccattcggacggaactggaaagcaaaattgtgctggaaagaatattttgttactaggaaagaatcagtgttacatagtacaatgctcttcaattcccccaaagtatacaagcggatgccatggtaagttaattcataaatacaaaatggaaatgttttgattcaggcaggttatagtgtacggtagaaatgttccttgtgataaggagtaccagtcatgggcttcggtatgagaagacagattatgtgaaaccagtattagcctatttggttctgcagttctgcaaaaacaaacgcttcgaaagatcttttcctttagaaaagtcttttttaactagaacagcaagaaccttttgtggcggctggagcttcagcaacgttgatcgtagttccttgcatggaacgcccatttgtagacgcggattcctgagctgcaagtgctttcttgcttacaatctggtgaatttcactcaatacagtatggaatgctttctccacattaatcgcttccagagcagacgtctcaaggaaggagagaccttctttctcagagaacgcatggccatcttcctcggggactgatcgtagatggtttaagtcagacttgtttccgaccatcatgacaacaatgttggcgtctgcatggtcccggagctcccgcagccacctctgaacattgtcgaaggtttgcctctttgttatgtcgaatacaagaagtgctccaactgcacccctgtaataagcactcgtgattgcacggtatctctcttgacctgccgtgtcccatatctgagccttgatagtcttcccttctatctgtctcaagacaatagtagacttttactgagatgaactgtagacacgtatggcttcagcataatcataaacagagaaaaatggatagcattccagatctatgattggcaataacaattatggtgactttaacatgatgaaaatgtcttcatgacaatatacaaacaaatcagtactaagaacaatatatttttttctttgattggacatgggaagatctatggttgaagggtatatatcaattgattaatcaacaaatatagttataccacactaacattggtggcaactacaaactgcactgcaatcccaattactgaatgctgattgaagaattgtgtcacaggcttacaagattctttaaaaatttgggttaaagtttaacccatgttattcttttccatttactgatgtatatgtattaaaagctgaaatgctgcaaaaagaaagtgatggcgtgctagaaacaaaaaaaaatcacttaaaatgtttgatcaaacaaaaagtaatagatataaccttctttgtctaattattgatactctcagaagaggatcaggaaggacaaaacagagcataatgacatggttgtgctcaaggaatgtaaggactgagaaaaaaaaaacaaaaaagacatttccagccttataataactgcacataaatggtatggaagtgatgaagtcatctgaatgcaattaattcagagacaatacaatgatcagtgctatgccaaccaaacggagaagatggtcatactagtcaatctatgttgcccacaacagctattatgcattaggattatgaatccggcagggattgacataacctctttgacgaaattgacgttggaaggccagcatattggtgcggtagcatttttcctccaatgtagtataaaagtatgatgaatctactcgtatttttggcatttcttaacataatgtacttttggcatataatctactctcgtatttgcattgctaggaaggaccaagagggaacaaaatgcctgcatgaataggattgctcgaaagaattgacaatctagtgttaacctagaaatgacacgtatatccgttctctaatctctatcatctccaacacaaggaactcgcgaaaacataaaagaaatatgcgcggcattaccaccggtaccatcaccgcgatatcatgcaaacaaacaaagtgccgtattgccattgtcagcccaatcacgcgaccataaaaatcctgtgggtgtccgagtctgcagtcatggatccgggatctcaattcctaacgcacaagaacccgacgcgacatcacgacgcgcgccaatcgcaaaattgtacaagcaagcaaggggatcagggggggggggggggcgggtgggcgttgcgtacgcgggtacctgcagggtgcgggtggcgaactcgacgccgatggtggacttggactcgaggaagaactcgttgcgggtgaagcgggagaggatgttggacttgccgacgccggaatcgccgatgaggacgatcttgaacaggtagtcgtactcgttgtccacccggtgcgccatgatctccccctcccgcctcccctcacgtcccgaatctggaacgaacgaaaatctcccctccgatcctcgcctcctgaccctctcggttcgtgcgcctgggggaatggaggtttgaaacggtgggggcagagggcaggcagatccgagggggaggagagagagagagggggggggggacgaggctcgcgctcgctctgcgctggcgcggcttgttgttgttggtggtcgcgtctcggccagccaatcgacggctggcgcggcgttttgtccctggctggggcgggcttgccagatctggggaatgtggccatgtggtgtgcgtggtcgccgtggtcggtggccgcgtgtatcacctgcctcgtcggtttggttcgtgggcttgatgagttggttatgtgggcttatctatgggtcaccacctcggcctcgacggcctgctcgtgcggaaagtatggggtcggggcggcttcacggctcggcccaatgcaagcatttcacaccatgcagatatatacagtttcgtttttttcgatagatgaatactttctggaacacaatattttctttcccacatatgcaagcattcacacatactgacatgcaaacactattacactgtcaccactaacgttacatacacgtggccacgtgggtgcaacctagcagtagcaacacgtctaaacgtgagaggttagcctcatgcatgtagcaaatagcataggtaccctcttttttcactaacacgctaaaagaaatacacgtcaatataatagaagaagacggagtttagttacacaatgcaaaacgtctagaagggtgttgcaggggggacaggggaagaaaaaatcgaaaaaggaaaaaagtgacaaggggaaaggttacttaaaaacaaaaaactcctatagcgagggatggtagaggagtagccccactatattcctagaaagcccccaaaagcagtaccactagcagatgatcacagacggccttcctaaaagacagactccaacactactgaaaccaacgagagagagagagagagagagagagagagagagagagagagaaatcgaacaccccagagtttcactccttccacagctgccaagatatcgggagtacaagggagctgaaacccttatgaggtgctctgacaagcaggccctagtagtcggccaccagacctagagtgagcaaccacgggaggggacaaggtcaggctagccaggaggagacagaacatgatgccagacctggtgagcgaaaacacaatcaagtaggatgtgattcaccgtctccatttcttgggcacggaggggacagactgagtggctgtcaataccacgctttagaagaaggttggtcatccagcggcacttttggaacgcaagctacaggaaaagcttacacttagcagggcctttagcctgacaaagtagattggcgcaagcaaaggagtgttggccgaggaaaaatgtctggtaagccaagtaacaccaatcgcttgtccaacgctaagagctggacacaaaacaccgtgtcccagatcacgaggaattgggaaatgatagggaccgtgagaacgccacggatgtcccccacccataagttgttagagagagcagaggtgattgtgcgcgatgcccggagatgtggtggcacggcaaggaggaggccaggcaccaaggaggccaccgagcgaccctcaatccattggtttctctaaaagagagacgtgtcgttccctggcacgaagaagatgaacgacgcagacatatctctcgagggggccttcaggtcagcccaatagaggtggcctgagcgctgaagccagagctagcgaaggtgaagaatgaagccacaagtccacaatacccaaaccaccgatagctctggggcgacaaacactcgtccaagacataatgcatcgtcctccctgaactgcatccatacccgtccactggaaagcgcgacatttcttatctatggcattgacaacccagcctggcgaactaactgccatagacacatggaccggaatagaagatagcatggactgaatcagcacagaacgatcccgacccatctagggagaaagtcggtgagaaatggcatcacatatttaaaaattggagacagagcagagtaggggaaggaactctggaccagggaaatatgtgatgccatttgacgttttatagacgttcgattattcatcatattaaaagaattgtgaaaaatatgtaaaaacacgggttatgcttcagcatgtacctttactgataaaataaatcacaataaaataaatagtagacatatagtttttttaataaggtgatatgtccaatactcaatagcgtttgtattactacctccatttcatattacagttagttttgattttttttctaagtcataattctttacgttgaccatatttatagaaaaatataaaaatattatggacataaaacaaagaaactatcaaaatatattcattgttagatttagtaaaattaatttggtgctataaatattgttgcatttctactttcaaaaagtttgacttaaaaaaagtcacatcgacttataatatgaactcggaggaagtatgtatcaaaatgggcatgaatattgatttagcttcgaaccaacccaatgactattacttcctctgtctcaaaatgttgctatctaagataggatttgacctattctaggacaatgaatctggacataacctctgtctagatttgttgttttaggatatgtcaaattccatccaagatagaacatttttggatggaggaagtactattcaaactgtcaatggattgataattttttatcaatccaaaacagtcattaatccccttaaaacttcacatccttatcccatctacactcctggtcatgtttaaagataacacttatcagcctctccttctaaattatcttttcgtccggataattcagcccatccagatagaccgtcgctctcagacagactcaatctaagcctagctagaaaaactaggcagagccctcagcctgctattgattaccacttaccagcccgatttgggccaacaacgccccgaatcggttcgaacaggtggcacctttccacgacaccttgctgctgcttatccagttatcccaaacccagattagacgggccgaaaaagaggtttctaccccattcatccaacacgccgcacatcgaacttcttatctagctttccgagtacttccaagttccaagtccaaccccttctatcatgctccatgccgcgcgcatgcatcatgcacgctggacgcaaactacgtgtcgaccatggatgcgacgcgacgcgacgcgaggcttgcgtatgtgctcctcctccctctccgcggtgaaagtgaaaccgatcgatccctgcaaataattcaccgcgcgcgcactcctcctcgggcgccgatgggtggatacgtccacgacgcgttggttactttcgcggagtgcaaatctccggcttggctttccccccgtgcgagccccgcggacagggacggggtttcggccccgcgcccttggcggcatcgtcatccgcatcgccttttccgtctcgtcgccaccgagccgtccccgtccacggcaaacaggatagaaagcgggagcgagcgaggcagcagcgcccgcgcgcatcgggcgtgcgtggacctaccagcccgccgtcgcgcgtcccgccggccactggactgcggccgcgatcgagagcgctagccaacgccttccggatcacgcgctgacacttgtagaccctaagacccggacggccggatcgatctccgcgaattattgagcggaccggctatatacgtcctagttaccagtaaaggcatcgatctttcgggtgggtctcgtcgtatcgtcgcgtgcgggaggaggagagaaaaatcgggagagcgaatcgggggccgtgtggatgtgcgcgcgggggctgccggtttcacgtcgattctcggcgtcggcggccccgccgccgtgccctggccttccggtgcgtggctaatttcggcccggccggagcagatcggtcgatatccgcggccgaatcctgaggaggctatcgagataaggatgaaccgcgcgagccaggactgcaggagcacatcaatgttctggctggtgttctcgctcgcgccaaaaaaggcgggcatctttttcgacgaacccaaatccacttcagataatatctccactactcgctcgccgctctgatatggcacgggcatatttagccgtgacatgatggcgtgcatggtgacctgttacggtgtttttctctgggcccctgttacagtgaaccttggcttgatcgcttcatcatcagctcgacccctgtggaccgatggagttgacgacgactttgcatctctcgacgtacgtacaaccagccaatggcggcacgacaggatcggcatggaggatgggcaaaaaaacgcatgtcgcgtcgcgtgagccgccacgccagtgacggccgagaagcaagaacagttcagccaacttccttggaacgggctgactaacacgcacgcagaggttcctttcccatcataacctgaatcagtctcggtcattctggaccagctcgatcgctcggggccaatcaagttcggccgtgtgcattgccgcattcgggcagtttgtgccgtcgcaaactgcaactctgaaaagtacacgcccgatttaagcaagtgatagtgatccactgatcctgggttaaatccagtcgaaaaccgcaactaactctggaaagcgacgccgcccgatctaataccgggatcctttggttaaatccaatactccgtatacgtcgcaaacacacagccgttctgacaactgttgactcgtgcactgcagaaagctgatggaatcgtggagattaagaaacaaagaagctggaggtgcgtgcagggggagtagtggatattccgggtggcaaatggcctggggtaggaggcgaccagcgagaggaaaagaagaggcgacgataaggccatggctcaacatcgtccttgggacagggaatggaatcatcctcgtaggaggtgaggtcaaagtgtgagaggttggaggtatatgctacggccccatcgattcctcccgagtgcaaagtcaaataggatgcagtgcattatgctatccagaatctatctatctatctgctggtcagttcctgcacagagccggggacctccctgcgagtacacttgttgatcctctgtaaaataaaaaacgagaacgaattcaggggatcgaaatgaacaccccctatcagattggttctcgcacaaggtacaggccgctaaaacaaggctttgcacgtggtaaattttcaagtgccaatcactttcggtgaattcgatcattatagcttaaagcctgaaacctgttttttggggacggcgaactaccgtgtgtgttctagtaatcgccctgaatgcgaggttatccgcatatgatatctcctgttgattcgagagaggagaatgaaagattacatctttgactggctcaacagctgaagcacgaaacgaccttgttgtgtttgttgttcccttggattgatttgctaagatcttcacagttggcttatcatttcactaccacttgcacacgtgttgcctttgacaagacagattgttctaaggtcccaacgtggatgctatgggccccaacatgcaccatcttatccaaagcataccatatcaatttcgcatatactcctacagtcctacgttgatcagttagtcgtacaagctagcctgcatcagactgatatataagtcaccaagggttatacttcctccatctaaaattctcacccgtattacgttttctaatttttctatataaattgtatgcattcgtaatctacatgtatgcaagccttaaatgaacagcgtgatcgttcgtttagcgcgcggcgctggattaaattgatcttgtgtcccgagcagccatcgtcccactcttttttttttatttagaaacaccaaggggtttttcggctagcttcacaaggtggtgggctatacgacctggattcgaagcctcatcatttttaattatttaatattaggttcttccttaatattcgtgtctttttttagcagagacgatgaactcatgcattacgcagccaaccaaaccaacgtgcatatgaatcgatgcggatgtttaattgaatgaacgagtatttcgattcttgttggtttcagtgataaaatatgttgtagaaaacttttggacgaaggaagtaatactaacgtaacatagcacaaagggtatataaccaacacaataggtatttaatactctcatcgattcagatataaataataagagacacaagtctaattgtcaaatccatttcatataacggttttcaagatatattgatactcctataaatttatacaaatgaattgatacacttggatagtcagtcttagcatgcaccttactattattgtctctaagctccatgtgttgttgatggctaccttttgtctgggttatggataccacatacctaatagtcatcgactaagttcagcggggtccaccatatactaagtcttatacggaatcatattttttatatagaaagagttccgaataaggaaggacaagaagtgttttatatggaaactataaagactgctcggattatatttatattggtcgttctacttggacaatgagacttctatgggtataaatacaagccccctaggaggagaggagacacaacacacaagtcaagacaagctaaacatcgatattggagatagcctagatggactcaatccggtgcctgcggaggctgacaagagagatctagtgctatctctgatctcgccaagtacgtattcgacgaggaggactactctgtcgtcgactacatgttgatgatctattctgccaagtcgatgacagctagataggttatcccaattattatacttgtgtgatccatataaataaagaataacaccggccttcggccaacaggagtagggtcgttaccttcctgtgaaggggcctaaacctgtataaaaatccttctctctatcttttttaccttgatctcgcatacaccctggtaccaacgatctccataccatgtaaataccatagtcatgacctcaaacgtcgacacctatcaagggttagggatttcgtaccggtgaacaattacggacaatataagtggcaacaataaccaccatacgcacaattcttaattggcactagcattaattagggatgtagcgtccaatttctatccctaagtagaataaagtcaccatgtggtatctaacatgtaggatcgaacacaagtaaccaagcctaccaggggggtgaatggtagggaaaactaaaaacccaaaaaattttagcggaaataaaagttaccctcaaattgatggaaatctcgacgtagtcctgtcgccgccggtcggaccgctcgcacgccgccggttagatcgcctccctgtcgcctgaactcgaagaaacacaaattgaagaactctcaaagtagatgacaactttattgcttctctctatatttacaaagtgcaacaacaacactccttacaaaaatctcgactaaactcgaaaccctaactaaactatcaacttaattgctctcaaagcgatatcgggaggcctcaccctccctctctatttataccacaaaaaccccctactcaaagtaggtgtagaactcctattcataataggactcaatcccataatttcctttttctccaaaactacagccgcacagaagtcggactcctcctgccgtcgctgctgctgcttgctgcctgagccgactcggcttgcctctgcatggatcaagcctgccatcactgaagctgcttgaccacgcaacaaagccaaagtcagtcaccaccatgcatacatacatgcatcacacatgcatgcacgtactgcatgtataccacacatatatgcacgctgcacaccagcacgcatacatatatgcacgctacagtacaccacagtactgtagcaccatacataagcctcttccaatttcttccaattccctttgcgaacaccgatgcttgcacgcacacctcgtgaagcccgttgcgaagatctctcccacacggtatccatccaccgtatgccatctcgtatccaacttcgtcacccggtatccttgacagtctggacctcaactccttcctgagtctagtcctgatctccaccgttgaccgaagttgacctccaagaattctaactctagtcaccttctcacatggtatcccgaccgcactagacctctgtttttctctgaacatagtcccggtcctcgccattgaccaaggctgacctcaagtcacctacacacaatcagacaaaacaaccgtttctgggcacagatatcacaacctgacccacattagtcacacgcactcacatcaacatccacacatcttttcaaaccaattcattgattaaattatttgcatagccaattgttcatcacaaatattaatcatgacaatgatttcacataacatacctcatccgttcctcaatacaatgactcatatgtatcgtcatccatcgcttcccggtcccacactctatcaacctccggtctttcttttaaaaccctcacacaagtacaccgaagctagtatgtcgtccccatgaagctagtttggttgcgcataagttttctatgccaccgcctatcgttgccattacatccaaaaagaagtcgtcatcctactattctaacaatgtgccaaccgcttctacccatggtcagcaatctcttagcaacccgacaacatggactattctacttgcataactatgtttagtcatgtgggacaagttaacgagtgtttgtgcaactccttgttggagacacaccattgttttactatgtcttatacaacaacccgtataacttttttagatgttctgattaaaaatcctagttttttacattattagaaatgaattaaatgcagatacacaaaatcaaataaattccatgctttcaataaatgcatttgttctatatatatatacaccatatatacatttatggaagcagatttattgaataagatattcagctggaagttattaaataaagatatctttaggctgcacattttttcatatatgccctttaagcaatatgaaattaccatttatagtcttcatcatgtgcctttaaatactgccaagttggagacacttatcagtcaagtgttcttgagaatcctcatctccaccctcaccatagaaacaggactagagtcctttcacgtgtcctagatttgggcacctttcttttgatcaccgaaatggaacgcaagaatccgctccctcagcaagagtctgagcctcacgtcgaaggcaacaagtcccctgctcccaccagcatcgtcgacgacgccactaacactaccgaggacgactccgcgttgagggacctcctctacccgcaatctctcgaggtaccattcaatatcttttgtaagcatgccgttattcttttaattacgttatttgtgttcgatgcgttcttatttatttattaacttaaaaatattcacctataaatttatttttatcgattacatagaaaaccttatgtctaacatgagttttcacttgattccatggcttcaaattttatattacttttatataaatgaataaaaattataactatgcaccaagacaagaatatgtctagatgcaattgtattctagaatgtactggatgtacaaggggcaagtgggtccgtgtttcagtagtaacccacttgtccccgtttgaccgcttcgtctcgtactagtactaccgtctacagcgtcccgctgatgctccatcaaaccggtggacgtagacgatcggaggatctcgccgtgcatcgcgtgctttttcggccatgcacctctcgtcgtcttcctgatttcgccgccacttgtagcatctgcccgtggggtccatcggtcgatcgatccccgtagccagcacatgttgtcgtctagctcaagatttgttggctcgccttcccttcttttcggttcactcttgctagcgatcgagacgacttgagaacaaccaacggagatagctagccgtctcgtcaaagctgtgtcatcagccgaccagcgaaggcaaactcgcagaagccatcgtgtcataggtgtggtgtgtggagaagcggtggaccgaccgacgacggcggcaacccgcacggcgaggcgaggcgaggccgacggcggcggcgcgcgtccacgaaaagcgggggggtatctacctgtttttcgtataagccctcaagatctaggaaatcgcggggcgtggtcctcggcccggggcctttaaatgcgggggcacccatgtaggccggagcagagcgccacgaggcgagttgttgggtgttccctagactagccgtctcttcctcctctccctctcctcctcctcccgccgccgcctgcaaccgcttcacgtggcctgatcctcctccggagctctccctttcgaccccaacaaatggagcccaagaggtcccctgcgctgccgcagcccaacgtggagaccaagaagtcccctccccgcgctgccgccggaggaggcggcggcggcacagctgccgtcggtggcgagtcgccgttgagcagcctgttccaccagccgtcgcatggggtactgattcctgacgccttttgcatgtttgatgttatgcctgtgttcaggcccgacgtgaatctttcctccgaacaagacgaaattcgagggtgttctttcgttgtttgtttgttttttttgttttatttttttttgttacggtgacgcggatgacacgggatgagtccccctccgtctgcgaggcgttgatacatgctgaatttgcctttcattccatcgctgttgcacacgcataaatttagtatgcttttaatgtagatatgcccccccccctcctctttctatttgcgaaaattagtaattttcaatgtacaggcgcctgtctttccaagtggatacgcgatagtttgtagaatacttttggaaatcaaccttagagattgtttatatagtttgatggtgatggtatttatccaatcccaaagtattgttttgccggcgctttgtttacacttagtgaattcctttacatttttccattttcaggcaaaaggcaaagaagacatatactccattttctacaaagggcagaacgggactgcacaagctgggactgcaggtagttgtggtcttgtggattgacccaatctcttccttgctcttatgtaggaaggacattcttattccttggtgccattaaagacactgttgcgaaaatggaacataataataagcacaactatatataaacgaattcaaataaacccaaagaataccagttccatataaagcttgaaaattagtagcctccttttcatctgtatttactatttgcctcctttcttctgtaattaccatttgcatctgttggatatctctagagttaaccaacgagaaattactttccatctgttactcttgtctgcaccatcatgttttttttttcttttgtggagtgtcgttgactgttattcatctttgtgatcatcttactcggttcagactttagagcactgagatgtttcacgatagcaaactaactgcatataaacattgatttgtatgccagatggtaaatcccagtggactcctcctaaaagtcgcaccgtgtacaccaaggataacaaacagtcaaatcagtatgattcggttgatacgtcctgttttggttcttctgtgaactatggtggtcgagactattatggaatctctggacacaagcaatccacagaatccaatgatgtaagaaattgccaaacccaaaactgcaaattatgtttgcaattactttttttaaaaaaagtatcatgaactggtctatacaactataccacaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 55383 - DNA, 4707 bp, Oryza sativa
tttttttttggaagtatgcagtttttctccttactatatccccatcatttcttttttttttttttgaactaaacttgattgtgttaaatatatgttcatttcagtgcacacacagattgcattatcactactgatggaaaggcagcagagacttttctacagcaagttgataggtgtttaactaatttcctttgcacactattatgtttgccgcttttagtacataccttaattaatggagttattcttctataaattgcaacagtgctgcggtattccataatgcaagcacacggttctgtgatggggctcgctttggtctaggtgctgaggtatgtcctttaaatttgtatcactttataacttggacattttcgttaactagttatcaaaaaaaaatagttatcgaaaatatatgttgttactattgaatggtcagcgtttcattcagtcccctattttctttcctttatcaaatataggttggcataagcacagggcgcatacatgctcgggggcctgttggcgttgatggactcctaacaactcgatggtagggttatcatgccatattgtcttcatgtccaaacattaaggacaatactattgtgcaagatgttttctgcatctagcattttatcatcatacaatattttttcagctaaatgttattatcatactaaacagatggaaaaaatcagtagttttgtatttactactagtatcttcatgtaatatgtgtgcattggtttttcgttatatatagcattttacgaggaagtggacaagtagtgaacggcgacaagggagttgtttacacccacagggagctccctttgcagtgaggtaggtagtgttcttttattttgaaagatggcatactactgattactaaccttcaacatctctggtttcaggtgaagtggcttgtgaaggagctgttgtagagcaattttttgcagacgctcaccgtgctcctccttgagagctgcttctcttcatgacatgcaatgggagcacgaaagcatgtcaaagcaggaagtaatgaagggcgaagtaggtcagaaacttatagtactatgtactatggtgttgctacgtagttgtgtggtattccttattattcattgtaccatgaataatttatgccaatgtcgtagtagctacatgtaactatattggctttcatggacacgtctatggtactagatgtaaaactgctagatggctttagatgaacatctcagatttattttccatagaatgcacatatgaaagtacctgagcgtggcgacgctggtgctttccatgataaagatctggctggtgtagggcggtctgctgctgaagccggagacatgcacatcgcagaagcctaatcatcagactggagcctcaactgaaccatcccgtatctgatctgtttagataaagacagttatattagaaatcgccaataagtctcggacgaaaattcccagcatttcacaacttaagaagttcagaattctagcagctattcgtaatgcatcccattgcagtattgcataacaaattacagagatgaatatcaatctcccagctcagggcctctaaccatgacagatggtagatactctcgtatcagtgtcaacattaggtggggatattacaatattacatccatgtctggtatccacagtaccatcaccattccaaatgtgtcaggataccgttactactactgatgtgttaaacagggatccatcacaaatgtatcaaaattgtctggcagagattccaattctctccaaacaaacaactcagcaatcttttgaggtacctcctgaaagactgagtcatgatggctagtctaatcaatatgttaggctatacaacaattcctacgtcttcagtggttattctgtataaatcagtaaagctcccaaaaaacattaatagagtccgcagcatcttcaccaataatccccacatgaacaaattccatccctgaagtggtgaaaccgattcacatccctcacaataatctctcgctctgcatatttggagatgaacttggtgacggaatgacagtcctcacatagcctgaggttcttggtgatcctgatgacttctcccctgccagtgttgataagcccgaaggcaacagctagcttctcactgtgcccaagcaaaatcttctccttctcttcttcttcaatatcatacaaaacagctcctgtgtcaggcacatagccatcattcttcatctgtgtcacaaactcacctatcagagcttggagctcctcaatctgaggattcttgttgtccacagagacaaacatgtgcaatctcttcttcacctctatccagctgcatccaggcaccttctccaacgcatgctcctcaagaagatcctttagcacaccaacttcactatgcaacttagctcgagcatagatatcagcaaggagtacataatttccagcatttctaggctcaagatcaaagagttgtgagcaagccatctccgcatactccacatggcgatgaatcctgcaagcaccaagaagtgagccccacacttgaggactcggcctaatgtgcattccctgtatgagctcaacggcttcgtccaaatgcccggcacgaccaaggagatctaccatgcaggcatagtgctctgcacgaggggtgacattataatccaccatcgactcaaacagcctcttcccctcatccacgagtccagcatggctacaagccccaaggacactgataaatgtgatgatattgggtgaaacgcccatttgggtcatgtcttcaaacacctgaaccgcttcatggccaaatccatgcatcccatatccagatatgagtgtattccatgacacaacatccttccggtgtcctattaaatcaaagatatgccgcccagcttcaagacatccacatttcatgtacatcgccatcaatgcgttcagaactgaaacaagtgagtcaaaacccctccggaggatatacgcatgcaacaatttgccctgcccgagagcgttaactccagcaaaagcatgcaagatgcatactattgtgactgaattgggtacaaggtcttcatcagaagccaccatctcctggaatagcaaaatggcatcacctggtctctcgttcttggcatagcacccaatcatggcagtccacgacacaacattcctctctggcattgtagcaaacacactctcagcatagctgacgattccaagctttgcgtagcagtcaataagagtggtggcgacatgtgtgtgcaatccgtagccacgacggacagcatgcgcatgtatctcgcgtacgagggccgacgccggcacatgagacgttgatgcggcaatgcaggccttgagtccgtgcgcgtagctgtagctgtcgaccggaacgcggagccgccccatgtcagccaggcgcgcgagggcctcctcgccatggtcggcgagcgcgagcgccttgagcagcgcgttccacacgaagatgctcttcacgggcgcctcgtcgaacacctggcgtgcggccgggagctcgccgagcgacgcgtaggcgtcgatgaggcgggtggagaggaacgggtcggagcggaagacggggtccgccttgagccgccggtgcacggccgcggcgagcgccgcgtccccggcccgcgcggcggcgaggaggaccgacttgtaggtgcgctgcgtgggcgcggggaggccctggaggagcgccgcggcgcgcgcgaggcggccgctggcgcacagcgtctgcacgaggtggttcgcgttcgcgggcggcggcgtcggcggctgggacgcgagcgacgccacgcacctggaccgcgacaccctcgggcgcgccctgggcccggccgccgggcgggagaggtggaagagggaggcgggcggcgaggcgggcgcgggggcggacatggggtggaggaggcggaggcggagcgtgcgcggcgcgagtggcttcaccgtgttcgggatatttttccggtgcggtgtggtcggagttcgggcagcggatggggagagaggcggaggcgcgccgcggcggtggagaagcgtggggatttttgctgtggtagtgacaggccgaccgttgatgggctacgcaatcttttgcagtttgttgggctgacggattgtggcatgggccggaatggtgataggccgcttttgcaccgtgttttccaaataaacaggtccaaacagaaaacacctcggcaatgatagataggatcatagtagtaggagagaagaagtctggaccgctggtgattaggcaagtactataacgatgccgatagcttttgccactgtcatcgattaatcattattcctatttacaggttctagttttggtggctggctgtctcttgtacaagaggtactgtctacggattttttttttttagtgccatgtcaatgctagtagtaacagaaactgtactgaacatgggcatagagcagcatgaattgataaaaagggttgtgcctgacgggaaagccagggtgccgcttcccatgaccaatccccctttgatgctctcgcactgcgctgtgtgtcatttccgagaaaagcaattattctatgcagcaaacagtatgtacatgtcatttccgagacaaaagcagcagatgtgccactgccactgccactgcaattgttggatagtggtgggagcagctgcag

SEQ ID NO: 55384 - DNA, 824 bp, Oryza sativa
cccctgtgcccatcctcacaagaaaaaagtaaagttagaaacaaaattgaagctttgctttcaacaggcatgtacctggagaaggaagcaagcagaaggcctgtgtaccgaagctttctacagtgccagggtgagaactcagaagaggccatactatctgcagagcttattgaattgggataccatagctaattttataaaaaaaaataaaccagtagtactatatagttgtatttttgtcatgaagtagtaacagtgagtaaattagcaggagcaaagttgcagcataacaggaggaacaaagtagatattactattccgtaatgcattctttgtccaaaacatatattccgaaattgacttgtgctgatctaaagttgacacgcacacacattccgggcttttccggcttgctttgatttcgttgcgagatgagaagtgtaatactctctcctgtttcataaattttgacgttttagatgagattaagataaaacttttatttgatcatcaatatctttaaaaatatttagtttaaaagcactataacatcgtagatagatctgtctttaaaaaaaatgtaattttttttgttatatatatattgtaacaaaaaggtaaaaaaaacataatcaaggacatacttctaaaaccgtattatatattgtccaaaaatatcaaaagttaattggagggatactagtacgaatactggtagctttgagttactccatgcctcacacgccacacatgtgtagttacagtggtcattgcatgacatatcgaaagaacaattatgcgcctcatccacgggctgcaggaat

SEQ ID NO: 55385 - DNA, 2688 bp, Oryza sativa
  unsure (1)..(2688): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagacgttggccacaaagcgtcgcatcgcacgcaacctggcccccgccacgaagtgggccgatggcgtcttggcgcatcggctggctggcggccgccgctcgtgagtctcgtggcccctcgagcggtcaagccacggagggagataagaaactcatgatgcgtagacgaggttcgtcaccggagcgttcagggccgaataataaacgagcgcgcaccaaagccggtgcacggctgcacgctggtcacacgttctcaccgcgagcctgtgtgtttaccattcgatcgggtcatgtgtggagccaaaaaatggtttcgatatttagaatattattttaaggattagttttacataagcagctatcttttacattctaaccctttcgaaaaacatatttcagaaatggacgcaaaactctacactagatattgttgacgccgaagttaaaccgcccacgagacaacccaccctagtctgattggcatgggtgaaaaatgttgtgcgcataacgaactacagtatcgtgtggatttctattaaaaatatcatgaaatttatgtattccagacatataaatcgcacattagtgcatatgcctttcagataaaacatggtgttatcaatcggtgaatctactgcacgccacaattacgctactaaaagtactcttttatgtattcattttttttttttgcaactggatatagttgaactatttaagttttttttatgacaaaacctactttctccgtttcatattataagactttatagtatttttcacattcatatatatatgttaataaacctagacatatatgtgtgtttagattcattaatatctatataaatatggacaatgctaaaaagtcttataacctgaaacagaggtagtactaactagatctaaattttaggcttagcacgaatgctcatgtatacatcagtagagagacaggtatggtaacttcttcagccttaagatatcccaaccgtcttcctcgtacgggtaaggtaaggtgtacgtacgtgcgtctatagggatgagaggtaactctgttaatttcaatcattttttaaatatgttggtccaatttttagagatgctcatatgcgtagaacgtgtgtgcatgtttatagagatgagtgtgtacatgtgtgtccgtatataggcctggtttagttctcaattttttcttcaaactttcaacttttctaccacatcaaaactttcatacacacacaaatttccaaattttccatcatatcatttcaatttcaatcaaacttccaattttagcgtgtactaaacacgccctctcccttatgccttttgtttttttttcgtacggtgtttaaaatcacgatggtccaatggtccaggatgttcgagctaccaacatattacatataagcatttactccattcaataaccagctttagatgatattgcattcttaaaaactgcgaaataaaactccctactaaaactatccttataattattttcaacatttattctatcatatactcaaccaatcacaataattttgtatttgatttatgtatataacttttaacctcaaattaatcactattatttattatttataattttttacctcaaacaatcacaactactcgtatgtttttcttattttattttttttgaaaattgataaaagtagctagtataatatactcccaccgtttcacagtgtaagtcattctagcatttcccacattcatattgatggaagtagacatacagttgtactccatcatataggaaaacaaattgccattccatcgggaaaaggcggtttagagcatgtacaatagtcggctataagccagctataaacatatttaaaagagacaaaggaagagagagaagagcagcgggctgcagtacggactccaaatcgtacaatgtgtatgacaggtaggaccatgtattaatagtgtagtaagcaactattgtatgaattggctataaatgatatggagctagttgttggctatactattaaacttgctcttagagcaggtacaatagcaggctataagctagctataaacatattttaaagagataaaggaagagacagaaaagtagcgggctacagatctgtagctggctgtagcacggactccaagacgtaatgtgtgtatgacacaggtgggaccagatattaatattatagtaagcaactattatatgaattggctattacattggctatatatgatttgaagatagtagtggcctgtactattaaacttgagcaattctacggttcttaagaaggtaccatgaggtatcatttttttctattgtaaatttagtacctcttggtacctagatactatgagataccaaaaatttagtataaaatctgatatctcatattacctcctcaaaaactgtagaattgctcattaaacttactcttaggaaggctaccagcaaatttaattggtggatgcggcgccggggagtcaa

SEQ ID NO: 55386 - DNA, 3511 bp, Oryza sativa
caagtgggcgccgcttccccaccccaaccaaaccaacgccttctcctcctcctcccccccgtggccgccgcgaggcgagagcgatcgagacggaggcggcgacgacggcgacggagaaggtagcggaggaatcggcggcggatacggggaggacgggtgctcccgaggagatgaacggccgcggcggcggcggaggcggaggcgtgggggtggtgggagcgggaggcgaggagcagatggagatggaggaggacggcgccgggcttcgcgcgcgggtttctgcggggaggaaggagcgggtggtgcttatgtgggggtacctccccggcgtctcgccgcagcgctccccgctgctcgggcccgtacccgtgaggctaccggccgcggcgggcggcgatgggtggagggacgtatgcggaggcggctgcggcttcgccatggccatctcaggtgacgtcccgtgactctccttctcattgctgttccgctcgtgctccgttgctctcgattcgttgggtttttcggggtgggctgtggtagatctactggagttgtcgactcttacaattaccgtggtggattgatgatagtaataggtagtgaatttggcgaaaatttgcgaacagatagtataggacgggtttacggggcattaatactcgtgacgatttttttttacagcttgcatttattgggcacatttgaattagttgattgtgatgtacttacatttcaagtggaggtccagttttgcacgacttggtgcggcaagtttgagctcggacttgtcctcttgttccgattgtgctttagttacaaccatttcatagctgtgggtgaatgtgtgaaatggggatttgtttgtcgagagctatatagtgaaagaagatgaatacacagctgaaatttgttaaattaagtgtatttctgaattttctgagaccttattcgtgtgatacccagaaacaacgataaaaaatcgtgtgatcgaggagaggtgaaagaagaacgtcatatcatgttcttagttgcctctaacatgatcacacgagtgaccttttaattcattttgttcggttgaccgtgatggggaatttgcattcttgttggccggccccacgaattaatttgatgtaccaaatcagagtgttcgaattaaaactattagttcaggagattgtatgtgttcagactcaacaatatgccaatagaaacgagctttctctgaaaatttctgtaatcggttgctcaccatgttcaagataaatttgatactaaactggggtttttatttggatcagagtctggtaaactcctcacttggggttctgctgatgatatgggccaaagctatgtgactgccgggaagcatgaggtaaaaatgctacccgtatctgtattgatgctttatgctctcatcactcggagatatttctaaggacaattttgtacttctcaggaaactccagaagcttttccacttcctagtgacgtggcaatagtgagagctgatgctggatgggctcattgtgttgcaataactggtatactactagttgaacacacatagcgtactttaggacagcaagagctcataatttttgtgttactagtaatttcgtaaatgtcatactggaccagatgaaggggatgtctatacatggggttggaaagaatgtgttccaacaggaagggtcatttctgaccaatcttctggtggaactttggaaaaagatgaaagacagagtgcgattgccgctgaccaaggtggtgatgattactgcctaccttgtttcatttgtgcctaaaaagtataagcttctctacatcaattgttttcagatataacaaaggcaactccattacagtgagccccaggtcgcaggtgtctaggacaagtagcggagcagcatctggtccttctgaaagtagaggtactgatgatagcacgaagagacgaaggttgtcttcaaccaaacatgcacccgaaagttcaacgtccagtgatgaaaacctttcagcacccccttgtgtagtgacatttaatacaggagttaaaataatggcagtagctgctggtggtcgtcatacattagcactatcaggtagcctacattttgcactaacactatggcactacatttgctgggctagggaactttgctgattaaaactaaatgttttctcgaagcttcagatttaggccaagtatggggttggggctatggaggagaagggcaactaggcctgggttctagaatccggactgtttcctctccacatcctatcccgtgcattgaatcagcattgtacagcaaagatcggccagcagctatgaaaggaaaccaaagtgctgaagtgcagattagcaaagtcatgggaaattgcgtgaaggccattgcatgtgggggtcgccacagtgctgtagtaacaggtaagccctttctttcaagctcactctgggaaccttttatcctacttatttaaagttgatgtcgatcatatatgatcttaaggtggtatgtgtgaatacctcagttgggtcggtttttttcttgtggatgacaatacatactttcaaattggtagttcagtttgctttggtacagtataaagtaatgttttgtgatgtagtattacgaatttacaagaatggacaacatgctttttttcatgtttgttttcacatagaaaatagttggtgattagaggcaacaaggtgcattgcttgattggaccatatattgtagttaacttttaagtaactacgatattatgtatatgagattttctgtgtaaaatcaccaaagaacatgttccaaagaagttactttaaatccaaggatgtgcacaaaagtctaataatcaaaactgcagatctagacgagttacatctaggaggaatttcaattcaaaccaaaatattagcaactgttcagctctgttcatatcttctagtgaattccaacctgcttttacaacacatggaaccctaaattctagtaaaaattttggccctgcacttttaacagctagttcttttgcagattcaggagcactacttacatttggatggggactgtacggacaggttagtgcttctaccatagcatatcagttggaccaagcttgtgtgagatttcaaagcatcatttgcatgactaaacacatccaagtagctaggaaaagaaatatgtattcaagggatggagaagtgtatgatttgttttgggtaatccatctatgtattcaacaagattaggcattgaagagttgtttgtacttgctttccgactgaacaagtacacagcaaacttatgctacaatttaatttggtttacatgtgatatgtagtttcattgaaagtctctctctctctctctctctctctctctctgttttcaactttgacatcttccataacaatggtgatgacagttcttgctcactcacttgacactattttggcatggtatatattagatttttcccccattttgaaacctatgag

SEQ ID NO: 55387 - DNA, 1430 bp, Oryza sativa
ctacaagtttaaggaccgcccgtacactttactcaattctattcttttcgatgttaatggaggttaattacataaagtaagtttagggaaaataactacagttaacataatgattgcctcccaaaatggagttagctgtatgtgaggtgcatgtttactcagtaagtgataaccataagtatattgcttttttttttatgcagactgtaccaaaactggtagatgcctcaagcttggagaataagaatgcacgagctgtttcttgtggagctcgtcatagtgcaataataactggtacctttgactgtactagtatttttcccctagaaggaatttgctatcctatctgtctaatataactgcatattaataaaatgctcttctcatgctcatttaaatcaaggaaatatttctggcaagggtttgttgaataaacccaattatccaaacaagacctttagggtttgttgaagaggtagagattatactcgatcccttagaaagccatgagtattttagtttaatctgtctgccaaccgaacgtactgagcctaatccccatataagcaagccctattgaatcttcctagatattctgatgtgtaatcatattatgagtcactgtagttattagcgtattatcagtaacttgtgcttggaaagttggaattctacaataagctgttccatgtgtgattgaagtacttaaattcttgttaatctttggcctccctgacaatttgtttaaacatgcccgtagaaagtgctgttcctggtctaacatctactgacaaaatgtggtgacatttatgcagatgaaggcgaggtcttctgctggggatggaacaagtacggacaggtgcgtatttcagctctgcacttggagaagaaaaacattcaccgttgcagttctttttataacttttgagttgcgcgtgcagctcggtctcggcgattccatggacagaaacgtgccttgcagtgttcctgtcgacgcataccacccactgaatgtgtcgtgcggttggtggcacaccttggtgctcgcggagtcccctacttaaaacctgacggcgaacaaacttccctagttgacaattttgttaggagtttggtaggctttcatcaaggtgcggccgtgttgcatttcgtgtatatacatggcagtgcatgcagatatggtgtattcattctttccggtgcgctcttcaacgggcaacgtacacaagcttgtatcgcaccgcgtatacattgggtaggaatggctgtaaggcctgtgcttgaaagtgcatgcggtgatgactgtgtccatgcttcgtcttgcattttccagttgctatatgcagacgaaattaaccggttgctatatgcagacgaaattaaccggaacgctgattacgctagaacagggacgatcatgtatggggctg

SEQ ID NO: 55388 - DNA, 2762 bp, Oryza sativa
  unsure (1)..(2762): unsure at all n locations
ctttatatgtattataaaatccaagaagcattttaagctcacacagctcactagttgatactacgagtatttaagtattattagcattcatgtgatggcacagttacatggaacttaatagatgaaagaagataaccagatatccactaaataatcgaacagaaatgcacaaactggaccatataagtcattagttgattattatacacagccatccttcatgtgtaaggaaagcagccattaagacaactatacgtcctacatctattatcagtgtcactaactaatttcatcaaaatttatcattagataatcattaatcaagtgacaatcatttcacatgacatttttgcaagttagctaagttaatttgttttcgtgacaataaaccacaaggacaactttacttttttttttactgaaatgaatggctttcggtatgattatttaaacagttaaatcaaggaccgtgcactagaatctactagtgtaggcatgtaacactaacaaaacaagctcaaggattaaaaaactaaacaggagaacatgcaaaaaaaaaagaaaaagaaaaagaagaagaagaagaagatagatgagtacattttgtatactttgaactctagaaaatggtaaagatggcatataactataaggtgagctcacctcaatcattgcctggcaaggactccttagaaaccctaaaaaagctgttttcagggaataccgcagacttgcaggatgagctccttttgcaacctccaaactagggtcaaaaccaagtagcactggcagtatgcgttcgtagtaaacaggtctattctttgcaatagctgcaagactggaaagtgacaaacatttatatttccaaaagataacaacatagtttgcaaggttgtactgatagtaagataacttccaacaggaaaaagacattccgaacattaaaatcttaaagtagcaggcaaccacatggacatagtacagttgcaagctttgctcattggtaaacctcatcactgcccatgtctgttgcggccaattatataactgaagtaaagaacacaaaagcctaaataaatgttacggtacccacttcacaaagtacaacactatggggatatcactatagatgtgtgacaggtcagagacaacataagaaatagctactgtgcataaaatgaaactgaatcagaaacaacagtttataaatgacacaaatagctatccgccaatccatatatggaggcgacaactcaaaacgagcagaaggtagagggaactggtacagagtcttacgaattaatggtgccaactaggaaggatccttgatgagcacaagctgactgcagtatatccacaaggaggatgagagccctgtttgcatcagcttcgagaacagcagggttaaggctgggatggaattgagataatcttgaactatcaaacaacctcctgttccttcctgtttgtacagcgaaaatacatttcattactttgattgcaggaccacattatgcccattaattctttgcaaaaatctgccttaaaataccttcagttggctgcatccggtcacttttggattgaggtgcgaaacacaggatccatgtttcaatgaactttacagcaaacagtttagtagcaactgggacagactgttgtatatcacatgaagaatagcattagtcttggattgagcagaaacaaagaactaaaccatcaattcaagtttcaaagtagtcatttttttttttgcgaggaaagtagtcattagttacaaagctgtgtattttcagtaggatgagcaaagaagaggtagtctggctccttttcttcatatcatatcacaagggcagggatgggattactgtggaataattcccactttcgtagtgctctgtgctcaacatagtgacaaatacactccacaaaagaaagtttttccagagcactagatcatagttttacataaaataaagagaaacagtataataaaaaacctgatatatgtaggttttgtactttcattttatctgctaaatagtgcttgcaaatacacaacagaacaaccacagtatcaacgtattattgaaattacgcaacgcatgaacttgtatgctactaacctcatggatcagattatggactgcatctttaaactgcttcgtccaagcccacatctcttcaagccaagcatcaacccttccacacttattaatctacattcagcattaaaatggaaagtgagtaccaagagcaagctatcagtaatatcttagtgataacactttaagtagcatcaattcaatcaggagaaaattttgaaagggagacattacttcatagtgattctacataacgttttgcattttcagaactaaatgaaaacatatgggttttctctgaccctactgtgtaaaatactaccttaaatcttcacgggtataatcacaaaaccattgcttgtaaaatagtcaaaacaaatagctaacaaacaaatctatgagcattgtatggctcaattagtttttaactactgaaagaagcttcaagttgttcttgatcacatagagtcctattaggatagtaatattttttttataattacagtacaaatgtaagtttaatgttttaacatgtgatccagtggataacattttcctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 55389 - DNA, 10148 bp, Oryza sativa
cacttatttggtcgcacgcccttgtgtttgctaatgagaaaaaacttggcatttgccttggtcctgaagatgtaaatactgttgatgcaaatacttctgtaaggcttatatgacatctagttattttccggacgtgaacgcatcatatccttttttttttacagaacatcaatttatatactccctccgttttttaatagatgacgccgttgactttttctcacatgtttgaccattcgtcttattcaaaaaatttatgtaattataatttattttgctatgagttattttatcactcatagtattttaagtgtgatttatatcttatacatctacataaaatttttaaataagacgaatggttaaacatgtaagaaaaggtcaacagcgtcatctatttaaaaaacggttatctaaggtagtataaatcagtgacatcagaattatgctgatgaggtgagatgcaggttgctacacacaagtagtctggtgaggtgttagtactgcatcgtcgtccgttgacaatttcttgctgctcttctttttttaaaatgtttcctatttcttttcttaggacaaagatgttatgaatggaccggtttaaaacagactattgacaagattattttatcttacatggttatagatataaattaaatattttaataaataaacttcacagatagctcataacaagggattggaagaaagttcggactttaaagcaaagtgagtttagatcaactgactaggttgcttgtggtagaaccagatcaccccgttcaagttataaagttgacacatgtgtttgtatttacagctaattattatttcagtgatagacggtgtacctgttgatagtgaggcgttcgtagtgactttcggtagtgaggcgtcgttgtattgtgtttctgaaaaaaattctttctttaaaaagacgtcgagcaaataatttacgataataatctacttgagtagttaaaaataatacgagggccagttacccctttgatcgctaaatttttctgttccacgtgaataaagccactactcggacgccaaagggcctgtagcctagtggttataaaagcctcagaaagatgtcgagcaactaatttacgataataatctactggagtagttaaaaataacatggggcccagttacccctttgaacgctagattttttttccatgtgaataaaggcattactaagatgcgaaaaaggatatagcccctagtgattacaagagtctcagtagcccctgtttccatttgaggtttcataacgagcctgaaaggacgtaaatacggttgtgtttagatttaggggtgtaaagttttggtgtgtcacatcggatatgccggtacacatttaaagtattaaatatagactaataaaagaactaattacataatccgttagtaaaccacgagatgaatttattaaacctaattaatccgtcattagcaaatatttactgtagcaccacattgtcaaatcatgtactaattaggcttaaaagattcgtctcgcaaattagtcgcaatctgtgcacttaattattttttagcctatatttaatacttcatactccctccgtcccataatataagggattttgagtttttatttgtactgtttgaccgctagtcatattcaaaaaaatttgaaattattatttatattttttgtgacttactttattatccagagtactttaagtacaacttttcgggttttatatttgcacaaaatttttgaataagacgagtgatcaaacagtgcaagtaaaaactcaaaatcccttatattatgggatggagggagtacatgtgtacaaacattatacgtgactgcgtgctgctcttgaagcgagagcgggtctgcgtgctgctcctgaggctcgcacggctctgattcgcaggggggctaataaggtggctcatgagcttgctcagctagctattcggaatagggaggcagtggttttgcgcctgcaggcgccggtgtgtgttgctaagcaacttgctaagaattgtaatccttattctgaagtttaataaaacctctatcttaaaaaaaacattagacgtgatagagtgtaaagttttacaggatctaaacagtgcctacatcctaatcgaattcaaaatctcaaaataaaaagacaaaagagtcaggttctgcatcaatcagagccgcacgtccaccctaaacgccgtcccgtctcccgtgtggtcgcgaggccgtgtgtgaggcagcgagccagccagccagccaagccaaggcactcgagatttcttcctgctccagcgcccaaagcccggcgcaaatcacaaccttagtattatttcctcctctctcttcccctccctcccttccctcttcgtccctcctcccctcccccccgccgcgatcgagacggcggcgaaaacaacaccggaattcgaggggggatccgccgcggcttcgctaccctagccaccgccctttctcgaatccgcgccctaaaatcccctttgcctccccaccccacccccgggcgcgccgccatccccccccgcccccgcgagcccctcccgatggatttggatctgtggatctctaaggtgaaggagggccagcacctcgccgagcacgagctccagtccctctgcgaatacgtgagctttcctcccccccgccctgtcccccgattggttcggttattagggtttttgccatgccccgtgctctcgcgcggcggcggcggcggcggcgcgcgtgcggttgctagggttcgttggtagggggtggacgtggggggaaaccgttgccttttgctttccgtactgaacttgagttttgttatgtatatggggtcgcgtgtaaccgcggctgattttccgctgatccttccaggtgaaggagatcctcatcgaggagtccaacgtgcagccagtgaacagcccggtgaccgtgtgcggagacatccatgggcagttccatgacctgatgaagctcttcgcgactggggggcatgtgcccgagacgaattatattttcatggtgtggcttctggagcattttgtgtttatgtgtttctgtgtgtgtgagcttgttggttgagatggttctggatgatgctgtgttcctgaattcagctgtgcttcacgtgcagggtgattttgtagaccgcggcttcaacagtctggaggtcttcaccattctgttgctactaaaagcgaggtatttgcctacctttttgtttgggatcgtgaatgttctgtttgtttgttcgaaagctttgacctttctggcacatagctgcagctgcttcactgttccgtttggtattacagtacttcgatgttatattacctttttctacagggacattacatgaaaaaatatgtgaatggttgcagcagtagtttaccttccttagatgtgaatcatgttgttgtatggtcctgcctgtcgtttgattatatgccaaatcctgttgtcttttcattactgccttctccccttattttgcctggataaccttgagcaatgtatggggtcaatgtgttgttctatacttctatataatacaaatagctcccaggagttgaactgaaatgctgaatagttgtaggatgagacacactgtgatctaattgtggctcgtgcaattgagcctagttggctgaattttgaaattggtattcctgttgttgtttcacaacttggactgctaatttgagtagaatggttgcactgttaagtagtgaacaattcctgtaagactccctagtccttgctagtttcatttgttcttggttgcactcattttctcaaggattctgatttatagtttgtacccaagtgttactatctgtggctcattcttgctattgggtttcctgattgtgattaggtaccctgcacacataacgcttctgcgtggaaatcatgaaagcagacagttgacacaggtatttcctggtgcggacaatgttttcatttattatccaatttatttcttttcttgagatttgagatacttatgttgcacttttaagtgttgtatctcaactgctctgatgatttatatgttgtatctcaactgttgcatccaagaggtcctgttttagttgtttgttggcctgtacatgcatgtatgctcatatcaaacatttgtaggttttgtattaattatctatgagggtatcatgcgttggacataaatatgcatagctccattacatacaattctgattctggagatgtattaactcgtattgcttttctgcctgagcaatgtcaaataatccggtcattatatctatgattttcccttggtttcatgttcgtttcagtgtatgcacattggaatgaaatacacgcacatgttgcatactagtgtatctttagttcctaatcagcaccatatgatgagcaacctgtgttgtcatccttagattttgtttaatgagttggaatatgttttttacatggttccttacgtttcctttatttgtacagttcatcctcctgacagactttgtgctcatatatctgcactacacatgtatttggtgcttatgatgcagtaacacatagtatttttctaattttaggtgtatggtttctacgatgagtgccaaaggaagtatgggaatgggaatgcatggcggtattgcaccgatgtttttgactaccttactctttcagcaatcattaatggcacggtaagtttgtttggacattttgtaagttgtcggtttataatttttgtgccaaataatcatcaaaccatatgctaaaaatccaggttctttgtgttcatggtggactttctcctgatgtgcgcactgttgatcaggtttgctgaactttttttcttgaagtttcataagcatcattaagtctaagtgttgtttatcaaactctaattaattgtaatactaacattattattttgagttactgtactacaccttgtcgatgcaacaattagtaggtctggcactaagttcaaaagaattagataattctgccttttaagtatgaatatcctcagttgatcaggtgatatccgttgaaccttttgaaggggtaaacaactgggtgttgccattttagataatttgttgaaatagtgtatgctattttcagtgacacatatatctctgacccatcctttaaagaaaaaataaatggttgttcgctaacttagttgtggtatacttttctttgtcgttaaaatatatactttatatctgactgtgtactattagaaattagttggttcatagctttgcatgttcacaattttttagtaagacatgattctgtgatttgttttatcttaagatatattgttgtcagataagaattaaaaaccgtctcaacgcaatattacaatgaaattaatcatgtgattgaatatccttgttaattctattgaccagattcggacgattgatcgcaattgtgaaattcctcatgaaggtcctttctgtgatctaatgtggagtgaccctgaagaaatagagacatgggctgttagccctcgtggagctggttggctttttggatcacgagtgacagctgaggtatgtacagtcatttgatgatttcttactctatttttcagagagtgtgtacagtcactacattctggatcatctattaattgtttccttgtaaatgtttttcatctaccttttgcagttcaaccatattaacaatctcgatctagtttgccgagctcaccagctggttcaggaaggcttaaagtacatgtttcacgacaaaggccttgtaactgtaagtttctgttcacatgtcagtccagataatcatagcattgtactaagcttgtatgtcttttttcaatactgttatattgatgctcacataccctgcaataccttttttccaggtgtggtccgctcctaattattgctacagatgtggaaatgttgcttctatactaagcttcagtgagacaatggtatgttgtgcacctgtggtggaagcattatgtaattgcatcaaacttcatataggagtactaggatttgctagtgcacttgtgcacacacaatacagagatgaaacagcgctaggcacccaactgcttttgtgtgctcaacaataacaaatgccaccccatgctatctataatctactcagcaatgaattaacgatacacagcactttggtttgactactgattgggggaaacttaagttggactcaagagcaactagcatattcgtttctagttgtgtaactgtggccacctcaataaaccattcctcagggaatagaagttccaattgaacttagctcatctacaagtactggaagatttcttgctactagtgtgaaattgttatcttatctgtggtctgactcttgcattagttgatctgaatatgttaacatgtcttcttttgcaaatactgctgtgaagtatctgatttgtttcatgagctctaaggctcgcagctgattctgatcttttatatcctttgtctaaaacatcaggaaagagaggtcaaattcttcacagagacagaggagaataaccagatgcgaggaccgaggactgctgtcccatatttcctctgacttcatcaattgtacaattttagaagtcatgtttttatctgtaagggttaaagatgaagcagacctatttattgttgtaggtccaggtcatagtgcaatctaatgcgtatgatttttctgttcttttaaccacatgtacaatagaccatttggagtgtcatcactcctgtattccttctgtggcgttgtcaagttttgtttctgatttatttcgggtcgacacagtttgccacacaggaggtttgggccgttattgtgttatatttgcagctacagcttcccactcacgtgatcagataggcctgccccgtgacttcaaaatttgcatgcgatttgcgcgtaggtcgtatcatgtactactttaatattataagttattttgacttttttagtttagcattttaagttttattaaatttatagataaatttagtaacattgagaacactaaattagattcaatgaatatacattggtaatatgtttgttctgtgttggaaatgctactttatctataaactcaatcaaactttaaaaatttttattagaaaaaagtcaaaatgatttatgaaatgaaacggagtacactatcctatctcgtcgattatgtaagattgaccacttacattcggacacgtttatctcattgaacttgttaacggatgatgaaataagttgcatttgtgcaagtcacgttgattctctacatgatttatagtacgatagtacattatttgcacggtaaacttgtggcaaatccaaatattttctcaatctcaaaatataaagctctaaacacaaataccataagagaattattatcatttcttcgctttggtcacctcaaggctcaagcacccaatggtattagaaatattaagagtgaaggatttaaaaaaaaaatcacctaatggtatcaaaggtactaaaggattaaaaaaacaaatttacagtagagggatgtgctagttaattatacgtgtatataccatatgttatgagacattgtgaaaaggttattcgtcttatattttgagatgaagggagaagaagcgcctcatcttttcgcttacacttatccttatcatccaaaatttgaattttcaaccttaaaatttgaaggtgattttaaagtttctttatcaaagtttatttttcagcatttgcttttagatcactaagaacacgtatataaaagttttattcacgtattatttttcgtttgtaaatatgtcgttggtcttattctgtaggccacaaaactttaaaataacctggttgctattgctatcaccgttagcaatccaccaacgaaataatcatggctttctcttgaaatgacgttccctcgttgtttgcgtgtaaactcaaatagttatggaatggaaaattttgagaagatctattaatatatgatatatcactcctccacaaatatgtaagttaaaattttacttttacaagttgaaaaaaaattaaactacaaatattcaccgtaaaatttgtttttttcattgtaatacataaaagttaaattttaccttgtatatttttgattgatttactacgtattaacctatccttttttttcatgaccattactttgagtgatatgtagataatgagagatgtctcctggagagttccctttttctcattcgagccgaagcccacttcccattgcctcccgtggaggaagcggtggagccactcagccatgggatgacgggaagccgctgccgccgcctccgacgtcgcgctcgcattcttcaggttcgggggcatcgccttccctaccgctcgtgtgtctttctgttcttgattacacgtgatatcgctgaagattttacagtacaaccaccgtatatatagctcccacgtaccatattctcctgtgctggttccactgcaatctggtataggatggagccgagcatctggaagtggcagtcttggtcgcggcgggcggtggcggcaagcctgataactatagtggtatacctggtagtagtagttgcttgttcgcaacaaaaccagcgcatatgcccggggcgacgcgaccctccattgcgccggtcgcgggctcgcggcaacgaaaagatccctcacgacgcacgtgacgtgagccatcgcccgtgcccgtgccgcttttccaacggcgcggagaaggcatgcccttccgccgccggtctccctcgtccacccgtaacgaacaaaagaatctcgcacgcacgcacgggcggaggtgcaacgagtgcattgtggggggttggcacgcggccgcctcgttgccgcccgcgcgcaccgtagagtcaccgagccgacagctaccgcgtgcggctgcgtgactgcgtccccgccctgccgtgattccgcagcgttcgctgcttcgcccatcctctgcctgtgcctggttggggtggtttggccggcgcgcccgcgggcagcggcctcggatcatcctcacgtgatctcacatccgtggtgctggttcgctgctgagcctgatctcacgtcgcttacctgtctgtcagggtcgggtcgcgccggctgcccggttgctcacgacaagtcaaacaccatgtgttaggctgtgtttagatttaaaatttggatccaaacttcaaacttcagttcttttccatcacattaacctgtcatgcacacataacttttcaatcatatcattttcaattttaatcaaaatccaaactttgcgctgaaagccttagtaccgctgtgccaaccatcggttcggttgccatcatattccaggttcgagcattttttttgcaaaggacattctcctttgcaaccgttcaaaactctcaaatcatgcaaactcgaaccgtgccagacatattcctcctgatattgattcctgaagaaggggggcatcgcatctttcggcaccctgatttttttccctcgatactcatgatcattcaggtaggggcggcggtaggaaactatttcactgttcggcttgtctgctccccatgatttaattattcattggtctttgattaaaaacgaattaaaagctcaccatgttcgcaactgcccaaagtgcacgtatgtttgactagcaacggattactctgaacggtaagcagtttaacccgctgttttccaatttccagcctgtaatcaagagagagaaagaaaaccagtgatccactgttcttacggaacagttacatccagcgaaatattggggatcagttatgatggaagaagcagccgataatgcagtgctatcgtctcgtacgatccgcttgtgtgcgcgcgcgcgcgcgtgtgcaacgatcgaacaatctggaaccagaggaaaatgatgacaatcggatgtgcattgattagcaacctggccttgtttgattggggtgtgatacattgggggtggccctcttccttggcaaaaaatcatcttcttttttttctcctaatcatgagcttaggcactaaccaaagatcgatccacttggtggacgatctggtgatagttgcagcaaaattggtgcgaaatgatggg

SEQ ID NO: 55390 - DNA, 2751 bp, Oryza sativa
gtgcgaaatgatgggagaaataaaaatgctaactaacttgcactatcttctccgatcatgagggggtggttgctgctgctgcggatgcggtggcgccggcgacggggatcggcggctgccgcttggagttggagacgtcccccgtggccggaactcctggtccgccattgcgcgcctgggccgtccgggccggaagtcaccgagctcggcgtcggagaacgacgacgaccccccgggcgcgaggcgccgctgcggcctccgcctcctccaccgccaccgccagcaccgccgcgcgacgcggacgggcgcgcgcgccacgcagcagagcgccgccaggggcaggcacgcgcacagcacgcagcacgccgccgcgcactccgcgagcgccgcgtccttccctccaccggcgcccacgggtggcgccgccggagacaggtcgcgcccgcgcccgcgcccgcgctcccgctcgtcccctcccccccgccgcttcttcgccgccgccgccttcttcttcctccgcggcgagccggctgcgtccatgcctttgccctgccctctctgccagtctactaccacctcgcgctcccttccctctgccttcgtcgtggggagattcgattgggttgtgagttgggacgaggcgtgggaggtggagacgagaggagggagtgcttctcgcctcggttgccaatactcctccacgtttgaacgacaaacgcctccacgcaagttttttttttctttaaaaacttttttaaactgatcttaacaacactggtcagagatagaatgggatatcggtctctttttaattgagcaaccgaaagcctcacttaagtgagaatagacctggatatcttttctcaaagtagtctcattttgaagaatctggtttattaatacgaccatgggtatgtgtatgtcacttgtttaattaggtttggcttgtttatgccgaacaatttggagtttggtattttcctgcctgcagtggatcgatcggttatagatatccggtcaaaacgcagtcacctttcagaacggcacaagtgcggttactatttgcaggaccgcgtgacgactggctgccacgctactaggcgctccacttggccggcccccggcgctttgctttaaggcagtgtcagtgtgtcacagggtggttagttcaggggtcctatcttttcttttccagctgcaacaaaagtagggttgcacacttgcactagcttcagagaaaagctgatagcgatcagcaactagcaacttgagcgaggtgttaccgtgttaacactttgataattgatagagaagcaaaatggcttcgctaacgagaaaggaggtccattacgaagatccatggtccgatggccaacaaaattcgattggcctaaaattagaaaccagagctactcacatctattttacgtaatatttgtgagaaccatgatttaaatccttgtgaaggtagtcatacatcaaggtatagtccgtaacaaatcatgttgagaaatggccacgtctagataggaatggccaatggcccaactggcccaattaatttttagttttctactccgaacgttgtattctagcatgtgttggtttggagataagatggaataggttagactcatccttgttctgacggtctcatctattcgtttggcatgagggatgagattatcctactttttaaggaacgatccacatgtctgtgagagagaaaaaatgggtgggattgatccattagtttttaggtaccagatcaaccttaggggaatattctctgttagggatcatcccatcccacatgtccctaacctaaacagtctaaaaaataggttcaacccaatctgacccatcccaacctttgaaccaaatgcatagtaactaaattgatccactacttaaaaatcctaatatgatatcctcatatgtgccatcggttcatctaaaatcagcacatatggggtttttcacgtcctattgatcccttatatgggtctaaaattaaaaacctgcaccaacaacacttgtaaatgccattttttaaaagaagacatttatacgtgtgatatcattgccttttccttaaaagaaaaactaacacattcgagggagttgaaccaacgaaccaagcctggcactagtttttatgcctcggaatctccccctccgcctcattctctctcttaactgccgcgagctcaggagcagccccctccctttcccctagcctagctgtgccgcacttccatctccctgtcgagcaattgtggcctccttgatgtccccacgcctccctcgctcccttggcctccttatcaccatgggttgctggttcctgtgagctcggcgctagattcgatcaccgagaacttggggatggctagatccacgcgcaagtgggtcactcgatgtcagtgagcgagcgggcagacttcacctatagcgagtggcggcacggatgggaccacgactacggaggtgaccactagcagaatcggtggctccctcccccatacccttggcaagttgattttttatggattcggtaatgatttgttggtttttccgatctcccttgttgatgttgttttctcctttgatgctgaaatggataggtaatacttggatattagatggattctgatttgagtagtaatgcatttgtgccaaaaatttgtgattcactttctgtgatttgcgatgttgataaataatttgtgattgatgggctgcaggaat

SEQ ID NO: 55391 - DNA, 10684 bp, Oryza sativa
tcttcatcgtcaaagcaggcgagcaaggcagatagattgccattaggtagaaccagctggcgaagccaatttagccagaaatcccttgtagtgctccaggagcttcccggcgtcgggcatcgcctcccggacggcgtccaccgccaagaaccgctccgcccacgccgccaggcccgggaacttggcctcgtcgaggaggctggagccggccacctcgtccaccaccttgaaccacaccacgaagccgccgaccacgacgtcgacgagcccgacggcgtcgccgccgaagaacgccttccccttggagcactccacgaacgctcgctccagcacctccacctgaggtacggcgttcatgaaggcctccgctctctgctccgccgtcgtcgccctcatcagcgccctccacggcgggaagaacttaatacagtatcaaaacaaaaatgtcgatctctctaatattgatttctcaatcaccgacatgaacgttgctatctatctaaggttgatttcttcaggaagatgccatcgattaccgtgctgtcgaagtaggtcgcccagaagcgagcggtggcgcggtcgtgggggtcggccgggaggagcggcggcgcggccccgggccaggcctcgtcgacgtactcgagaaccacgcgcgactcgcacaccggccggccggcatggatgaggacggggaccttcttgtgcaccgggttgctcttgagcaggagctcgctcttgccgaagaggtcctgctcgatgtactcgtagctcaggcccttgagccccagcgcgattttcgcgcgcatagcgtacgggctgtaccatgtgcccagcagctgcagctcgcctcctcctcctcctcctcctcttcccgccattgctgccgcgaactgtgtgagtatgatgctgttgttgtctggatcggttttacggtttgtgtacaagatgggtataactgtatgtctttataaggacatggcgaatttgttaagttcatctatcaggtgattagtgtgaggtttgagtgtttgactgattttagttaagctgtgtaagcaaagttggaatcggccggcgagtgcgcggcgataggagattgctccgtgccgttgctggcttggagaaggggccacaggccacttgattccgtcagtgttgattgcgatgttgtacatgcgtcgaccaaacgtgacagcagatgatggagttggtatggccttgactagtggatgaatgattgagcttgacgaggtgattagttgaagtttatttttactgttgtagcagtagtagctacgtacttactccgtcccattttaattgcaaccatagtttttcgcgttcaactttcaccattcgtcttatttaaatttttttaaaaaaatttaaaaacataagtcacgagtaaaatactatttatattttattatctcataaaatttatttaaataagacagatgatcaaagttagggcgtcctatctgcggcagcgctgcggctgcaaaccttgtgttgtgcggctgcagctgtgctgcttgcagctgcagctcgctgtcgtgtggcttcaaaaagggcagccgagcaggcccttggacgcagaaatttatggttgcgctcaaaatagaacggagggagtaagataatacagtatatatcgtatattggtgtctgtaactacttccagtccacgatttcaaacatggagaaccattttgtcatcctccaaaaatgtcttcggacgcttaaaaggaacaggaagtggatttttatctcttaacagaagacatacgctcgttttgtacgtgtcatcaaaaaagttttaaaatttttgacatgatagatcaatctgtcataccaattctttttttaagactttagatgattttttgggtgacatgcaaagcgaggggatgtaccttaaggatgaaatatagttttccaaaagaatgcaacttaatggaacgatacgaatttcgtgacaaggaagaacgatatttgccgtttaaaagtgtgcttagcaaatcaactaagtggttcgtctagaaacactaaagtagttcactgaacagcgtgtcaacatttccctccttttatgaaacaaaaaagaaaactgttattcatcacgcgtgtcaacgtactcctcaaagtacagatccccgaagcagaaagtattttctacacctagaaaatccacgaagacgaaagcaggcaacgccgttgtgttcaggttcagctcgaaccagcgcctgcagtccatttggccaggaaccccttgtactgcttcagaacatcgccggcgtcgggcatcacctgcctgacagcgtcgacggccaagaaccgctccgcccacgccgccaagcccgggaacttggcctcgtcgagcaggttggcgccggccacctcgtccaccaccttgatccacaccagatggctcccgagcgcgacgtcgacgagccccgcgtcgtccccgccgaagaaggccttccccttggagcactccccgaacgctcgctccagcgcctccacgcgagggacgacgttcttgaacgcctcagctctctgctccgccgccgtcgacctgaacagcactttccacgacgggaaaaactgcagaaaaaattgcaaaggaaatcaaccaatcaaacagaattcctatctgccgttctgatgtccagtcattataccgtgtcgttgacgtagttggtccagaaacgcgcggtggcgcggtcgtagggatcggcagggaggagctgcggcgtcccggtggctccccaggtctcgtcgatgtactccaggacgacgagcgactcgcacaccggccggccgccgtggatgaggacggggaccttctcgtgcaccgggttggacctgagcaggtggtcgctcttgctggagaggtcctcctcggtgtactcgtagctcagccccttcatccccagcgccactctcacccggatcacccacgggctcgaccacgtccccagcagccgcagctctcctcctccaccacgtcctgccatcgcggactcgtgaatcgtgatcttgcactgaagtctgaagagaacgagtgtatatattggctcagttgatcatcgggtatgagtagcaagttgagtggccagtgagtgattccgtcagcgctgccgtgtgccgtggaaaggaagaagacgagatcgacggagtggaccagctggccagtgggcattgggccactgcatccataggttgattcagctttggtcgcgtcgggctagtagtccaaaggagtaggaagacgagaaacaggttacaggggatcgagagttcgagacggagcacggcagcaggcattgcgcagctgggccaacgggcctgcgttcggagacagagggattgcaggttgaataagttcactttgactgccttgactaaccgggtatcttgaccctccaactattaaaactgatgcaatttgtcttcctcggtggttttgaagagcagtttcgctgtcgtgcgtctacatggtggtgttgaccagttttcgtcctacgtgacattgacgtgatgcttatgtggcatataaaaattaaaaaaacataaatgtgggcccactaacattctctctctactacgtcatggagctcgagctcctccttcgccgcgaccattactccgctttcatctgctccttacccacccctcctctcctcagtgcacctcctccgctgccacggcaatgccccaacccccaacccctagtgctggcggcacgccagttccctagccccctctccgcctctccggcacttgctggtggctatcgccgccacctgccaccccaggcccatgccaccgctccctcgttcgccaatcggcattgtcgatcagggagagcaggagagggaagggagatataaggggtacagtgtcaacgagtatgacaaatgggtcatagttttttctctctctagtcacttacatatgggcccacttctaatttgtgactgggctgccacattatcgtaggggttgaccaagtcaacgagccacgtcagcgaaaacactggttccaatatagtttaagggtcaagaatcaagatatatggtattgtggttgaggggtatgaatcagattggagcagtatttgagggactcaaagtgaacttattccattgcaggttggggacgcccggaagtctggaacgcagagggcatatataaatagatgcataacaccaagatagtacatgtgcaaaacgagtacgcaatgttggttgatgtctggccaccgagccagaaaggagagcgttgggcttagcccaccaaagcccacgcgatccctaacattgaggaacgagtctcacgcattctctcacacgtttctctctttagctttatgatcggaagcgtcattttcctcgagaaggaatcacccctgatcccctcaatacgcataaaaagggaaccttaaccccgtgcacgagcgacgactcatgtacgctaagccaattctccaaaccctcaaactaccgattttaaggcgtgttgaaggggagtgaagggcgaattcccatcgccgtcactgcatggtgatcttcatcaccgtcgcctcacaactactacaccgacgcatctaaggcaaccatatggcttcttcatccggtcagtacaccatcaaattctgtataagagaaattaggtgatcgtgcatagcctaagatcatgattttaagatttaactccaatacgcaaaagtagaagaaatgttacatgatacgacgatattttaacgaagcccctgtgtgaatgtgcaatgaaccgatgattcaatggtcactccgagttcacagttttgatcgatgaatctcatgtactgacgcacgtgatccaatttttgctctaatctatctctgcaaaagacacatgcgtgaacttcaaactacagcatcctcatcgacgaaacgaaatacaaaccactcgcaaggcagtggccggaaaatatctgaaagataccgtttgtcgtactccttttcttctctattcttctcagtacttctaaacttgtactctaatagtattcaacaatccacgtcaaggttcgtttggtaaaactctaattcctaaaatcaggagttagatttaaaggagagttatgaaggagcctaaacctatgagggttttttactgttgaggttgtgcaataccaaatcctgaccgttgatctagcatcattcaacggttagaaatcatccgtacctcatggtactgcacctcctcattgaagtggtaccattggtggaagggtatttctatcctttcctgtttcacgagaggaaaaatcggggagagcagcgagattgcggcgagaggcgcggcggctcggtgcgacggcaatcggcgagaggcgcgacggtggcggcagcggcgggctcgatggccgacgccggcagcagcggcggtggcggcgacggctggatgcacgacgacagcggctggatgcgtgacgcgtgacggcgacggcaacctcgatgggcgacgacggcggagggttcgatgcgtgacggcggcgctggatgcgcgacggcggcggcgggctcgattcgcgacggcggaggtcgatgcgtggcggcggcgatcaatgcgcgacggcggaggtcgatgcgcggcggtggaggtcgatgcccgacggcagcggtcgatgcgcgatggcgggggtcgatgcccgacggtgggctcgatgcgccggcggcggtcgatgcccgacggcggcagcgagctcgatgggcgacgacggcggcggcgagctcgatgggcaacgacggcggcggcggcgagctcgatgggcgatgacggcggcggtcgatgcccgacggcaagggcggcgacgagctcgatgggcgacgacggcgccggcctcgatgcgggacggccctcgatgggcgacgacgacatggaagaatggaagagagacctaatttttgttagcccaattatacccctgttaaatcaacggttagattagattggtacctcatgttacctcgtacctcatggtacttccttaaggatgggaaagatgctctaaacctatttctatctctctagtttattttgtgagagcgttttatccagctccattcctattttggatgagctgaaactatttagctgacctccaactctaagagatgcttttatttggcgtaaattgagcgttgtaagttattggctagtcagtttcaaaataataacaaaaaattattggctagtgaaaaccaacaactgcgaagttcagacaagaacaaggtggataatataacgggatcgacatgttgtgtacttgtgtggtagtgagctcctctagtcatgcaagcaggatagacccgcgagctgctacacttgtcctcatttaccaacacacaagctctcccttgtcttaactgttctccaaacaaataagtacttccaagaatttttcgttcgaaagattcagccttggtgcaattcaccttttctttggtgcgataaaatggaggccgccatcaccatggatgagaacttgggacgaagtgggtcatttcgagctgcgatgagcatctttggcgaaagcatcaacgggaggaaggcagacaagaacagaggaactgttccagcccaagaggtagtgtctgaattcacacgcttttctgattcttgtgaacaaacctcaagttcaacagttctcaatttcattgtatttttatacgatttctgtaaaaacgcactgtatctgtatctttatatccatttcggtatatatatgtgcagaatctgtcttctgaaatgaagcagctagcacaatccggtctggacaagctgaatgaacgcaaggcgtacgtggataaagagagagccggcgccgagtccgagctgtcgagagcgcgagccatggcgaaggagcttgagcgccaaatcgagcagacaacggccaaagccacgtcccagaggtcggagctccaagcaatgtgggcagcgaggacgaggaggaagggcaccgacgcaccgggcgcggagcgcgacgcgcggtacgcggaggtggtgcaggagctggaccaagccaagaaggagctgctccggctgcggctcgaggtgcggtccgcggcggaggccaaggcgaaggccgagcgcgacatcgtggcgtcggcgtgcacgatccagtccagcctccgcgccatcgacgagatgaagcggcgggtggacgaggcgaacgaggagcacgtgctggtggagctggcgcgcatcgaggccgagcgggagcgccgcgagatcgaggcccagcgcggcgccgaggccgagcggttcgccgcggacatcgaggccgcgagggccagggtcagggcgctgcagaaggaggcgagccgcgcgagggagatggaggcgaagctcgccgtgacgaactccgacgtggaggtgcttcaggccgagatggagctggtgcgcgccatggagaagagccacgccaagagcgacgaggcggcggaggacgcagcgaggaggaagaaggaggaggcgcaggacaaggcgctgctgaagaccgcggaggccgagctggacgcggcgaagaaggagctggagacgatcaaggccgggagcttccagttcatgacgtccatggactgcacgcgcaccgagatcatgcgcgtcgccgaggagatccgcctgctcaaggcgaaggaaaagaaagcggacgcgcaggtgcaacagctgaacaccaagctcctcaaggcgaaggcgcggttggaggccgtcacggcggccgacgagaggtcgaaggcgatcgtgtccaacttggcggcggcgatgaagcaactgaaagccgagacggaggcggcgaggatggaggaggacctcaccaagctggagaaacggtgcgtgatcgcggaggccgagaacatcgagaaggagatcgccacgaccgagggacggatcaagcagtcggtgaaggagctggatgcggcgaaagcgttggaggccgaggcgatgaggaagctcagggacaccgtggagagcacgatgcaggccagggcgtcgtcggcggcacggcggcaggggacgatgaccatctcccggttcgagtacgagtacctgaccgggcgcgcggcgctggtccgggtggtgaccgacaagaaggtggccgcggcgcaggcgtgggtgcaggcgctgaaggccagcgagaaggaggccgcggcgcgcgccgaggcggcggagcgggaggtgagggagatggaggccagggcggcgcaggtggcggcggaggcggagaagacggcggcggagcagaaggagctggagcaggagctgtacgacctgaacgcggcggcggagagggacggcctgcagtgcgcgtacccgcggcggcggtcgagcagggtgtcggcgacgtcgaggaggtccaagccccggcggtcgtcggtgtccgcgggcgcatggaacccgcgctcgccgtcgttcaccatcaagaggaagaggaaggtgatgcccaacctcctgaagctgatcaagaataaaagaggcggcaaaaagaacaccaactgatcgagctgcgtagattgtcatgaccgctcgcgacgctgcgaccgtttttcttgttctgatttccggcggcgcagcacaagaatgttttgatcatcagtttcgcgggattaatggcactgatactgtatacttgggctagatgtaagtacatattaagctggccatccgttcactacataatgtaacctgcacgttcctaaatggatggctggacgtcaacaagtgacgagttttgtgtggtctgttggataggatggatggcttggatcagttgttggttattgccctagcagagttaaaattaaactcgtgttcatcagctttaagggggctttgttgaccttgttacccaaatcaaccataccatattttggtaatctatttttttttcacattttggcattatcgaatttcgatagtgttggttttatttactttgttttgatgtatttgttaaattctggagggctgctatacaacggaatcccgttttcgaacgggctgctatacatgtatcgtgtcttgaaacttaaccggtatcaagtgatacatataaagtatcaaatgatttctaccacgtatcggatgatactcgtgatatatcatgtgatacctatcagatatcagacgatttctaccatgtattgggtgatactcgtgaggtatcatgtgatacctatcaggtatcagacgatttctcccacgtatcgagtgatacttgcgaggtatcagatgatacctaccagatatcaggtaattcctactaggtatcaggagctgagcaccgaggcgtcgttgccggcagccccaccctccacgccccatgtcggaggttgtcgccggcggccgcgtcctctgtcgtcgacgccttatgtcagaggtcgtcgccggcagccgtgtccttcgtcatccacgccccacgtcggagctcgtcgccggtagccgcgtctttcgctaccacgccccacaccaggcttgttgctggcggtagcatcctctgccgccacgcgccacgccgggctcgtcgccggtggccacgtcctccgctgtccacgcgctgcaccacgtcggagctcgtcgccggcggccacaccgaagctcgtcactggaggctgcatcttccgccgtccatagccatgcgccggagctcgttgtcggaggttgcatcctccgccgtccacagccatgccacgttgggagctcgtcgccggcggccacgccggagctcgtcgcttgcgaccgtgtcctccgccatccacaccccggggtgtgccgcaccgagctcgtgcagcagtcatgctttgagagagatgtggtaatatggtagaatagataaggtagaagaagatagaatcgatggattggttggttgctaacttatcccatccatcatggttgggacgggatcccgtcatatagcacttctgtaaattctgatagagtttttaagagaggaagcttctagaactgcaaaatttagtaaggactctagcgctagcccgggcgtgcttctttccggaccatgcgtgcagcacgacaggtcgacgacagctgcaaattaggcaaattttgttggcttatttccgcattccttcccgttttaatgacctcacacaaactgttcacacaaagatgctcctcgcgaacacagatttccggcccgatctgtacagctacttcatacgtgttgcttgttaaggcggtgaacgtgtcacgaaattcctttcccgttagatggcgactgccacatagacgagaaaattgacatttagctattgtcaaaacagggtttcgctggaatgctaccctcaaacagggggcaacatgttgcaatgctattccatccatttcttctcagtttaatgttttttattgctgagatgaccaaaatatccttgatcctatctcatctctcctctctgtcttcctcctctccgttcggctcggcgacgcagccagaaacggggatggtggtggcgcggccagggacggggacggcggcggcgcgcccggggacggggaacgcggcggtgtggatggggacggtagcgacgcaactggggatgagaaggcggcgttgcggatggggacggggacggggacggcggcgacgcggctagggacggggac

SEQ ID NO: 55392 - DNA, 11578 bp, Oryza sativa
cctgcagccctttcccctgcaaagtcaacaaaatgactaggggcaaatatgtcagagcacgataaaaaacatttggaaatcagttaaaatggttgaaatggcattctagcaagttggcttcatttgacaatgacattataacaaaaccatattcgggactagcattccagcgaaaccccatcccgaacatggttaaatgtcaattttctccacatagactggcccatcggtcagtgtcaccaccggccttcgatgttgaagcggcgcaaccaaagccggagaacgcagcagaggcggccagagcgcgagggactccaactccaaccgccatgccgctcctccacgcggccaacctccgcgtcctcctcgccggcgccgccttcgcgcacctctcctcccccgccgccaccgcgcgcgcctcctccccgtccgcccctccccctccggctcccccgccgccgccgcgcgtccgggccttcgcctcctaccgcgcctcgccgcctcccccgccgccgccccaaccatcctcgccgtcgccatcccgcgccctcgcctccgcggccgccgcgtgcgagcagggggcgaagcccgcgatctgcacggcggatgagctgcactacgtgcccgtgcccggcacagagtggcggctcgcgctctggcggtaccgcccgccgcctgaggtgcgcgtgcttattcccctcccagcggagagggtggcggctggttagtggttatggttgttgatttggttctagcttggtttgtgcaggcgcccaagaggaatcacccgctgatgctgctctcgggagtggccaccaatgcgattggatttgacctgtctcctggggttagtatatctatatgatcctaacttgtggagttgtgtgcataatcgatcggcaatgagtacttttctattcttttttgacaaaaaaaatatgaggtttagttaatcgctacaaatcgcttaccgcttagttccagataggatgaatgatttaatctgagtataaattagcaattatcttgggaattagggattaaaattcggaaagagctgatcattgttgttacaattttatagttctgtacacttaatgtggagaagtaactatgttttggaacaacagagaatttactccatgctgtaaatacactgaacaaaaataagttggaaaacaaatcgctgcagtaaacagaactttctggaccaactagtgtgacaatgcttccttactttgcaatgtttaggatgcaataaggctccaaatgctgattcaagcatggcacaaagcagatcagcagaactagggaataacgaaaatttaaaaagtttaagtgcatctcttatgtaatttggtggaaaaaaatactccatttttgacagctatgaaatttcatgagaacagaaactggggttttggtgcataaaagatagcattaaagctacaatacagctgggcagaatttcttgagtaagaatctcgcggacatatcacacaattcagaacacgagtttgtgcaagaaaaaaaattgcatagatacattggtaaaattgtacacatcttccagtaaaagttatgctggtgcgccctacttcaggcttcagataaaagatgtagtagttgtgcttttatagcggtaagtttaaaaaaacacatgttttggggcattttgcttactcttattttaaagatacctctgtttatttttttctaaaaaaatgtaaatgtatttcgttttagaagtttgtttactcatgccttggtcactgtctgtttgatattctatattgtttactcataagcaaaaattgtataacgaacttgttattgccggtcatggttatagaattctgtttatattttcccttgattttgactataataattttgtcaggcttcatttgcacgtcatatgtccatgcaagggtttgatacatggattgtcgaagtgcgtggtgcaggcctgagcatgcgtggatctgaactagctgtagctgacaccacatctgacatgtctcgaagttctgcattggatgagattactacacagaaattaaatggcgctggacctgccaaggatgattccacttgtctagctcaaaatttcgaagttccagtagtagaagataaatttgaagttccagtagtagaagataaggatgtaatagagagtaatgcattagaagaaccacagctggtgacaaagttatcaaatactttggcacgattgggtgatacattctcaggttatgtaaaagatagtcgactgagaagtatcgctgatggcttttttaatcaagtgtcagaacttgttcctgatgcctcattaactagtagtcttgaggaagtctcagaaaaaattttgggcttactggaattgccacaaacatcagcaatatcagatcaaataagccatttaagtctacgtcttgtgaatattcttggggaaggtcaacagaatatatcacctcggctatttggttggcaagaacgcctgtctgcaacaatagaagatctacagaaacaattggagctcattattagctatgattgggactttgaccattatttggaggaggatgtacctgccgcggtttgttaacttagccttccatctataaagatcactcgattgatacctgggaaccctggtaaaaagtgttaatcttttctctttttatcatgcagatgaattatattaaacagcaaagcccaacaaaggatggcaaactgcttgccattggtcattcaatggggggaatattattatatgcaatggtttcaaagtgtggtatgtataactggaaatcttcttttgatctgtctcagatagcaagaaaacaacatatttatttaacaatgttgatattccacattttttaggatagtcttaaatatttcttatgctatgaatcagaaatttacattctgttatcaatacatgattcttgttctgtgtttctgcctcaaaaggatgtgaaggtgctgagccagagctggtagcaattgttactttggcctcatcagttgactacacaacatctaactcatcactcaagttgctattgcctcttgtaagttgaccatcgtgcaatttaatttactgtactaatatacatatacaggaacctaatcttcaattttattaggcagacccagctgagatgttacgtgttcctgctatccctgtaggaacattactgtctaccacttaccctatatcgtctcgtgcaccctatattctgtcattgctgcgctctcaaatttcatcaaaggacatgatggatcctgatctgctttcgaagcttgtcttgaataacttctgtaagtttcatatttaagctttgtcatatctgtaagttgtttcataaaaaggtacaacaacctgatattgttcacggaggaacttgccatccaagtgtagtatgatgatatggtcaagcgaacacttctattcctaagaagttgcacattttacaaatatagcctagccaggttaatctttaccttatactgtaagcatatgatagatatacatagcctgaatgttattgcatgatatgctcatatggcactgttccaccatgaagtttctgttaccatctgtaggagtattgattgcactggttcatttttatctgcctgccatctttatgatacatgaatttcaataaggaagcccttgaagttcttgtgatgacttgatgcattattgttcaggcacggtgccagcaaaggttttactacagctgacaactgcattccgtgatggtgggctgcgcaacagggctggtacctttttcttcaagcagcatctgcacaaaatcaaagtgccaatacttgcccttgctggagatgaggatctgatttgccccccggaagctgtttatggtatggtaataagctccatatttgcactgttatttcgcgatgaggacttttttggaattttataaaatgaatacctattcaggttatcatctgaagttagccaagtgaaagtcatttatagtgaactacttaatgcagctgactcttggaccccaaagatctgtagtcacaagattagctcatatcgtactgcctaactgcaattctcaagttctcatctatgggtgtgtttagttcctgaaaaaagttggaagttttaagaaagttgggagtttggaaaaaaagttggaagtttatgtgtgtaggaaagtttttgatgtgatatgatgtgatggaaagttggaaataggggggaaactaaacacggcctatactggtctgggttatatccctagctaaagtaggccatgctattagataatgcatatactatgatctctctttggcttcattgtttgattatgtattttttagtttcttcataaatacatatcacaacaacattttcttgtatttgcagaaacggtgaagttaattcctcagcatttggtgacatataaggtttttggaaagcccgaaggccctcattatgcgcattatgacttggttggagggcgaaaggtatgtttacattaatgagtacttaaaggatataaagctgtttgtttactgtggtatgttttatcatgtaggctgtccacgaagtgtacccttgtataatagagttcctctcccagcatgatgaagtgtcttcctaagttttgttattggcgtaaatgttagatgttagagctccaacacgctattgcacgagtgcacaatttcatcctatattggaactgaaatcatcaaaatggtaatggaatggtgaggtacaaaagtgtgttattcgtttcgctcccttttctatatccaaggtccaagcttgtagtttattaccacaacagttgatttataacctatatatgtaaatgttttattccttcacaaaaagagacaagaggcttacacgggcacggtggcactgatcatcgcctgcagaaatgccagaaacacatatcactattcactagtaatgtcagataaataagaaaaggtctttttgccaggaagatacaagtatttgtaatggcagcaccgcagcagctagtatcttggctagatagctgctaatacagtattgactacttgccgaatcagcttcattggaaacgtaactgaaaacacgattttgttaaaagaaactcgcagagtggtaatattcagacgtgctcatctgattgtttcaagctaaagcaactaacacgtgaaggatcgaatgaggttgcacaagacactagctgccgtcccggactgtgccaatattgacacctgagataagagtaacatatatttgataaaggatgcctcaatatggcatttctatctgcaaatgcaaaagaatggatgatgtgtttatacaataacatatgtaattgactgtacagagcacaaacaaacatgttttgaaagtttgacccaggtatacaatcgtcgttgcccggagtccggacttcaagtcttggtaacggcagtcttgcaaactgggcaaacgttcttctgagaaagccattgcttaatgcagtaaacatggtagctgtggccgcaatccagcctccccatctcttcattggcttcaaactcttcctgcaacacattgacatgagaatgaagtttgttcacatgccagacactggataccctgtataatgactgaagggaagaagataactcaagagaagaggttgtggcatacttgacaaatactgcatttcttttccatttctgttgaataccggaacgaggagtcaaaggctgggtgtttgaccttcctaaggttgcgaactatctcatcctcacgcaatccagtgttgacataacctattttatctccaagctcaagcaactcctgtaaaacgaagcaattgatgatgatggtggtggtggtggtgaaaagtgatgctacaaggcaaagagacaaacctcgtatgtcatgttatcaacatcaaggcgccaatcctggtaccgatcatacatgctcattcctcccaacagaactcttgtctgaaacatcatgatctgccatatcaaaaacagtttcattaagtatttgaactcgctacctttgataaggctgcttattgagctagcaacatgcataattatgtatatgtctgccaggaagatcacagattaacaactgcaccgcttagcacaagttaaccctcaatcactgaccatcgggctggttattcttccaagtagagtacaaagtgtgcagctaaatatgcttctacagctgcactgacgtatctcttatattctttacgattacatagaaaggttagattgaagcaccagataaatatatagtagctttctttacgactgtttggaatgtgcaccaaaatcaaatatgaattcttatgacagtggaaaacctaagtcagaaaacagaggtatagcacagaagtaaaactagatagaaaaaatgtttataggtaaggaaatggacttccctgaactaggcaccaaagcacattaaagcaaatcccctcaaatatatatcttgataggcaatggcagtgcgggaccgacaatccttgtggatcttgatgttgagctattattaaggagtcatcaccaatcacatgcccacatgaaatccagaaggaccagaaggaatgactacaactctagatctgattatgactgaagcaacaggaacatgataaggagcgttggtcccccttaagcaccaaaagaatagttcagtcaagcagcacagccgagcactaatcataaatggtgaactgctaggactctcgatctgccatcggaggcaaccaatcattcacgcaccataccagcatgcccattcctaccaaccgtacgatccaccacagaacagcatgacagtagatagaataaaccatactattgcttggcattcccaggtgtgctccagcactccttgcccgcatcctgaaatactagcaccgttgagacaacaattgaccattaccggcaacatttctgatcagctcagcaagagtatccagcatttatacttgtagttggcacggtgtatacacacaacgagaagcattcatggaagtgtatgaccatggttgagaggtctctttccaaagctgtggccacatcccactgtctcgttccctcccttctcagccgcattaatcctaaacgagtgtacggccactacgctaaccagcgcgcataatgcaggtgccatggcttgcaactgcaaccgcttatacaattattgtgcgcgcctgtgtaaggctgccgattagttaacctccaagaaggccacgatctcacgtcacgtttagcgcacgaaagatgcaagtcaaccacttccaacgcccacccggccagccggccaccccccaggttcactcgcgcaccaccagacaatcaatctactccacttctaatactactactattaatctatatcacgcgttacagctgcttaatacgcatgtcagatcacgcgctaaactaccctacgcacgggaatcttatgcaggcaggcagcgtgtcgcaccaccaaccgctgtcagcatgcgcacttgttgcgggccgtgtccatctccgacttaggagtacgttggaaaaatgtatctaccgatgcatgcaatgcggtggctcaggacaagtgtgcaagcaagcaaaatgcagtgtgggggcaacgaggaaacgaacgaacgtttgttgcagtgtgcgctactgtgccagtactagtactgctgctactaccgtgagcctgtgacgttttttacctcttcctcgaggccgacgggggagtggcggtacccgcgcatccggcggaggcggccggaggggaggaggtcggcgccgaagaagggcgcgacgtcgaggtgcggcggcggcggcgagtccatgaacgacgacgatatctgctcctgcacggtcaccctcctggacaggcacggtctctgcgcaaaggcaaaaaaaaaaaaaaagcgtagcgggtgagatcatcatcaacttggtgaggagggagagagaatttcagagaaacatggcaaagattccgctcgcgcacagcgcgcatcggtacaggggaattcagtacgcccagaagagatacatgtcacatgtttagataacaagaacttaattagactgaccaaacacgacattaaagactggctttaattggttcgtcaggaactcaggactatacaagtggtagaacagtggcaaatgctacggtttttttaaagccgccagaattgattgtgggaggaaaacagcaacagaagaacggaaaaaaagaacagagtattgaatgttgaatttaaatcttttttcgccaacagacaaaaaggagtggaagaaaaggcacaaagaaacacaagtaaatgagagacgaaaactccgaatcgatcgaccacccaccggaaagcaaagaacaagcaaaaccaatcggttccaagagcacgaacagatccgaacatgaggcgaaatcaacaagtagaagcgaaggatcaacggcatccatccatccacgcacgcaagcgacgaacctctctgtgcggcctctccgcgtcgccgccacggcctctccccaccatctggtgccgcgccaccacgcagtccacggacgacgcctccgcggcgaacggtatcccaggcgcgcaccacacgtcggcgccgatccctccacccacgaggtggccgtctccaccggcccctccttctcctcccctctccttcctcttctccttccccctcctccgcctccgcccgtgccagtccgccgacgaccgcacggccgccgccgcggccgccccggccccgggcgcgtacgcctgcgaggccgcggccgacgtgcaacccagcccgcgcagcgccgccgacgcgaaccccttccgcctcccctcctccgcctgcagcggcggcggctgcggcggcgaggacgacgacgacccctcgccgcggggcagcagcaggcgccggatcccccgccgtcgctccccgtcggccgagaagacgccgccgccgccgcggcggtcgccggccatcaggcgcgcagagaggtaggtggaggggcagtaatggcagcgcggaagccgggggtgcgtggaggagagaaggggagaggagcgccgcgcctcccgtccgcgcgtgtgcgcttcagcgtttggctttgttgcgtagtgtactagtagaagagtagagagaaagaagtctgtgcgagacagcggagactagagatgttgtagagagagagagagagagcgcgaacgagtggaagggtggcaaactggcaactggcaaggcgacgagggaggggtggaagcagcacgaggaaatgagatgtggtgactggtgagtgaattcttgtcgcgggttcggtgcatcactggatttgatcgagggatggatacgtacgtactagtagtagttgttaaaagaccggaccggtaaatgaaccggtaaagctcttggttaattggtttagggtccctttgaatcacaggaatgaaaaaatgcaggaataggaaaaatatatgattctgacataaataaaagtgtaaaatagaagattgcaaaacacagaaaaaatataggaatgaccgtttgattagaccacaggaaaaacacaggaatttgaggagatataacgactcaaaggatttcttccataaggttctacctcttattaaaattcctcaaaaacttgtatgagaagaggcattccataggaatttcataggattccataaggttcatttcttttattcaaaagactttgtaggaaaaattcctatagaaataaaatcctctaaaattcctatgaatttcctttgaatcaaagggggccttagtggtcggatcactggtttgcccggtcgaaccgtggtttgattggtaatatagaaagtactatgttttaggccgggtttagttcccaactttttcatcacatcaaaactttcctacacatataaatttctagccttttttcttcaaacatccaactttttttcttcaaacttctaattttagtcaaactttcaattttagtgtggaactaaacacacccttactaatggcacaagctgtacaacggtggcttggctagcgcacggtgctctcaaacccacgaccagaggtcgaatccccatctccggtttataaaaaaaacgcccggattaaccggtttcatctggtctgactgcatgcctgatttgttaaggggaccggaccggtgggggctctggttccggttttttccggtcgaaccgctggtctggtccggtcctaataactatggatggatgtcttgatttaccaggccccctcccaaaataaatgtcaaattaaattctttatgaaacactcctactaatactagaatagggtgcagaaaggggaaaaaagctttgatcacttaggccctcttctaacttgattaagatgaagatttttttctgtcttcgttagcatgcttttcaaactactaattagtatatttcgtgtgaaacttatataggagttgctttatagtaattcaattaatcatgtgttaatggttttcttagttgtgtgccatcacttaatcttcatcgtaatcaaattatttttctacatatggagtatcttcatattacataaaatatgtcaaaatgtatttttatagtataatcaaacatatttcatagtactccagtagactatgaaaatgctcctatattttcacattttgagacaaatacacttcacatttggtttttatggatcccaataacatgtgcctccgcaagcatagccaatgcctcgggacaacaaacgaggatcatgtgtacgcatggattttccgtgtttggttggtgacacaggagaaggaacatcagctcaccaataggccgatacggagtgggcagttattgagcagtagtagtaccactgcaagttttggcatatcaaggaggggtatgtggtgtgccatcaaagaaacacattaggagtcctaaaccacaataactgaaagaacatgtaatatctcgctatcgacgaatactcatgtcaagtttataatctgaatttagatgaacaggtttcaccacgagaaacataaccaagttcataacttagaccgttttagactgatgttaaaaatactcattatcaatattttggtagtttgaatattgcatatgatgattttggttagaagataaactttgattctaccaaaaatttggtttctaatatatcaaatcaaataggaaaaagtatgaattacccccgaactatcgcggtcgaccgaattactcccctaaacctgaaaaccaaacatcattcaccctaaactttcaataccggacaaattaccccctcgacccaatccagagtggttttgtcctacgtggcgtacgcgtggtagtccagtcagcattttatttataaaaaaatatgggacccacctgtcatactcctctctcactcttcctctctctcacttttcctctctctcttctctctcactcttcctctctctttctcgccggttggtggcaggcagaggatacggagcggctgcgggtgacgcggcggcggcggcggcgggggacaaggagac

SEQ ID NO: 55393 - DNA, 11806 bp, Oryza sativa
cctccgtcagtctccacgatgaggggggcagttgctcgtcgtggctgccaccgccgccgcgtctcgcgctaccgcccacacccatctccatccgtccctgcgccgaggggcggctgctcgtcatggccgcagccgccgccgcctcctcgtccccagctgtcaccgccgctgtcgctctgcgtcccctgcctaccgccgaccggcgagaaagagagaggaagagtgagagagtgagagagaagagacagaggaaaagtgagagagaggaagagtgagataggagtatgacagatgagttccatttttttttataaataaaatgctgactggactgccacgtatacgctacgtagaacaaaaccgctttggattgggtcgagaggggtaatttgtctggtagtaaaagttcagggtaaacgatgtctggttttcgagtttaggggggtaattcggtggaccgcgataattcagagggtgggggtgagggggtgtaattcgtactttttccaatcaaatatgaccaatgtaccaaatattggtaatcttaaaacttgccatgtttcaactcttgcaacgttttggcagggtactttgaatcgaaataccctttagggcccctttgaatcgcagggttgaaaaaatagaggaataagaaaaacacaggattctgataggaattgaagtgtaaaacagaggattgcaaaacataggaaaaacatatgaatggtcgtttgattagagcacgagaaaaacgcaggaatcggatgagagagatagactcaaaggaaattttccaagaggttgaagctcttgctatatttcctccaaaaaccacatgcaatgtgccattccataggaatttcataggatttgaaaagcttcaatcatttgaatcaaaggatcaaataggaaaatttcctatagaatttgaatcctataaaatttctacataaatcctttaattcaaaggcccttactcagtttggggatccaccagcacgtaaaaggccttgacaaattcatttcgctccatcactcatccacgttagctaacagcgtgtacgtgaactgttcataggtgtgtacaagcaatcgagtgcacacacgccgcacaggcgcacagcgtcgtttgccttggatcctgccagagtgcgcagggaggagatccccgagtcaaaggggacaagcttgcaagaatacaagataccctgcttcctttttcgtttccatctcgctcttttactcatgcaccgatgcatgcaaagacaagcagaggtccccttgattggggaatttgtactgatcttgtttcttaatcaaacctaaagggaaaaaaagaaaaaccctctccactgccgaatgctgatggaccctctttggatggcttcaaattttggactgtatagtagtagtggattctctactcgatctttctggattctttttttctgtgatggacattgggcagcgtttgctgttgattctactacagaatgaagtgctaacctaaagagattacagtacacagtaatttaccctacatttcctctcttattggagtgggaccgtgggactgatatacttgtacggtcttacggatgggtgtcgttttttggttttgcccatgcaggtttaagcagcagagagaagtcagcaggtcgtcacgttaaagtattcagctgtaccagcatcgctcaatcaaaagtccactattgacgacgagcttgactccaacggagcgctcttctccatgggagaaatattctttgcttttttatctagtgggcgcgcatctaaaacctaaacgatgggaatacagttcgcagccgcttttggcagccaaagagaagcgacgaggcagtagaaagaaagaggagatgcctcctatctcagctatcactcactgtgggcctgtggtcactggtcgcgacctcaagcaagcaagcaagcgacggagggcagggatggagggttaagtatcattcctgcacttgggcttcagctcacctcatctttattcttcacttccttgtcttcagatgcgtggtgtaattgactccctacttctaattatactttggtttgctgtgtgtcctttgcctaaacaaaggtagcacgctgtatggttcaattcatggaggaagattagaaagaaaaaggcagcagtgtccagtggatggtgaccagcaggaagctataggcagtagtgactagtgacgctgagcagcatcggctttctttcttcagactgcgctgtaaaatggactaaattgagctttcacccttctttgtcgaggctgatgttttccgtattctggccgtgctttcaatatgaattgtcaaagacaaaaggtattgtttcccataacaggggaagctgtttcagatttttagttacacaaggaatagaccacacgattacacaagaactggccagctatatatatactcctatatatcttttggctaatctgtccaatagggtgatgtatgtaagcaaatactactagtaccatttaagggcagctttcagtactcacacatgcatgacacatcggtaggacagtaggttactcggtgcatccaaaaatccaaaacactactgatggttgagaggtcatggatcatagatgatcacaaggatggatataaaaccgactgtagaaaatatgcagccgttatcttaatggaattatacaaagaaatttaaagcacaaacccggagccatcaggcattcaggctcatccaaagctagctccttggataaggaggagctgaggattattagcagcagacagagagattggtagctcgggttgagctttccatctcgcatctctccctttcgatggatgaccaaccgaaagaacacgagacgttggacgttgcgagacggcgcatccattaaaacgggctcgatcatttcgctgcagccaattagccatgcatatattgatatatatctcccgtgggaatctcatcatgcaagcgattggaggaaagcaacatttctgtactctatcttaatatcttatggtgtgatgctatatgcattttcaaattttcagtttggcgttttgtagcatgcctactctaacttctgatgatttcatcagcgtacattcttttctttttaaaaaagacatatcattgtgcggacagatattcagatgatgacgctgctagtagaatacctttacattgattaatcatgttaggatgaggctgacgaaatttctctctggcattactagtagaagaaacatgagacactggcaagtggcaacggatactgctacagcatctacctctcacgagcagttcaaacttcattttttttactgaatggtaatgaggctttacaggttggaagcaaagcaacgccgaaaagcccagtcaaactcagaagtgagacatgcatatgaaaatgctctctacacctgaatagtgaacagtgcctgcctgcctacttttttacggtatgggcctgtactgctgtacatgatctacgaaggacaatgcaaccaggcaagcatagcattcggcatcctgagaaaagaaaatatatagggtgaaaaaaatacaatgattaaagatggttgaggaggggtatgtgcaatgaaaacgagttcatgattcatagtctccttgccgaaatgatggggcataattgtacgttgtcctgctccttttacgtaaagatcgacatcttgagagcgtccaaaacgctacacatgctttgatatagattgacacgcatttgtctattcattctttcgtgagaaagaggtgggatattttaatgtgtcgaaacaacatttggcagcatcccggccttcctcaggtgtttctcgtggcacttacaccagtatctctacccttgatctgtcactaataataagtggtggtttactgccggtgagaaaatgcaactatcaatctaccaataggagtgctttttttttttttttaacctggatagagaccgaacattcgctggaagacgagaggtcgacgccacgcagtgatgcagagcggccggtagcacaaaaaaaatgggtactcctccacctccactaaaaacttgccaacgtcctcgcatctgcaaaagccggcggtggaggaggagggaggcctcgttttgtccgcgtctgcgtggcggcgccctcccagaccggtccgcgcgtgccgctgccctgccagacagacagccatccgatccgtggatgggatcgcaaggcagccgcgcgcgcgcccgcgggggcggggcatatgcgcacggctcgagagcccgtgcagtgcagctgccaccggccaccgccgcccgtgcgtgccccggtgcgacgcggcctcttcctttcctcccctcgctggcgccgtggcgcgtggccgggtttgtgctccccgacgagaggcgacgctgcgacgccacgcgatgacgagttgtattgatccggtcagctcaaccgttcttttgccgaggccgcgctttgggccttggtggcgtggcgcctcgacttgttgttgtctagctagcgcgcgcgtgcgtgcgtgctgggcctcgggcttgatggagttgttgccttgtttggtcctggcaatttcatgggctgaatggaggggtacgcttaaaatacataggaatgaactgaaagtggtacaaacactttcagtctacacctttgtactctttattagattttttgcgaacgcttgtactcttgattagattggcgctctaaaaaaactcgaaacaaattgaaagtggtaaaaacacttttggtctaaccctccgtgctcttccctagattaacgctctaaaatggtagaaataaattggaagtggtacaaacactactgctatgagtccacgacggtagcaactagcaccaaagctaacaaaccaagatagtaagactagatttgcatcacttaagctatgaaatgtatatgagtaggggtgggcagaaaaagaccgaaccgaaatgactgagaccgaaaaattcggtcagcactttctactaaccgaatttagtttggtcaattcggttttggggctcggttaatcgaattgaaaaaaaccgaaatataacactggcccattaggcccaatacctcctcagcaaaagcaaaaccttatccactccacgaccttatctaacccactaccaccatcatcctcctctccatccaccgggcccttcccatccctatcccctcctcccccgtgctggtgatgccgatcgcgatggtgaagctcccggatggcctcccgcagccgctccttcgccttccgtaggtcgccgccgccctgtgcgccgcctccgcctccagtgccggcaccacctctgcctccgtcctccgcctccagcaccggcagtgcctctgcctccattgcgctgttgtcgcgggcacccatcgatcatcgcgccgcctctgccttggtgtcgcctccgtctctactctccaacggctgtgaaaaaattcggtctgaccgagaccgagaacgaatttgttggtcctgagtttccaaagaccaaactaaccgaaaaaccgaagaccgagaccgaatttgtcggtccaaccgaacgcccacccctatatacgaggagccaatataagtattgtcctgatgatctaaattctcacaaattgtttggtcaaacgtgaaatgtgagccaagcatgtttttctacaacatgtaaccctcttcgtgcacaaatcaacatcaaacctacaaccatcacaattttatgaaatcttctacataaaaacttagtatgcacccttgtcctgatcgatggactgctggtccgactagtgaaccgtcggacgcaccagttcaatcaccggtatgtttttaataactattcaaaagatcgatatggcatggatatatctaaattagcaaaaaatagaagaaatctagtctatcgttgggaaggaaccaaatccttctacgccagagggacacaccgtctttgtcttaggcccagaagacagattgttcgattcatctcattcgtagatgtccacaacatctaggagctttgaccactagagccaccatgcgtcggggtatgtgataccgtttcaggcttcctgtcgctcttgctggtgttcgtcggcctcagctgttagcctcgtcaaatggtggtgctgccagcaaaaatgccttgagcatgtcaagtgctgcgtggaagcaatccttgtcctttcgcctgcgaagaagtagggaagcgagcatagatgaagcaggaattgtccggcgcgtcgtagtcctttgcaaggtttggacaacctggctccttgttgcctaggttcagtaaagcgttacgactatcgagaaagaagcagacgcaaggcatcgaatgatggctctttatgcagaaaaagaaagagcagggcaatatttcgatgagatccatgtagctattctgagatagcaagacatcgatatgttgtcgacctgcagtagcagcagagatgaagatgaagagtgtggctgggttgcccaatttgaagccaacatcgatgataggaccaacaacaagcattgagatgtcacccctgccatcgctgtcagctgcaccacgtatccctgtgcatggggaatatcaacggcgaatgcgtttcaccagcgagagaggagcttgagcaggtcgagcgacaacttcaacgacagccgttcagggagagtgacatgaagccactagcgtgccacataccctaacaaccgtagatccccaatgatgtggacgactgcaaatgggatgaaccaagcaggcagttgcttttgggccaaagacgaaaaaacaaagttagactaatgctattgttggaaatgcaaaggatgattatctagcgctggacatatgcctgatgttctacatcaaaggatttggttttcattgggttttgtcacttctaaaaccatccaatatagtagttcaatgaacaccgaacattggatcaaagtaaactgctaacaagacccctcaggaaattttactttacattgtagtcctccagcctctcaaaatttgaacgtgtccgtgcttttgagttcaggtatgtggaatgtatttataacacattataactaacggttgatagcaaattagttgttacaacaaaaagaccaacattccaaatgaaccgtgttgaaaattgggcaacatttaaatgcggcttttggggcttgtttggtcatgacccaaatgaatcattccaaaaatttggcagcattcaaagtagtccatttggtgtgtagaagaaagaagggcattgacaaatattttggtttagatgaaatgaaaataatccactagaatgcttttttggtagcaaagcaaataaaacctttgcccacctttatcagtaatttgataagtttactgtttttagttgttacaaaccaaacagagcgtgactgacatgtggaaaaccaaggtctcgctagctccatgcataccgtcttaagcgaaatatgcagcgagactacactagaattagatttttttccctcgtatcccgtgagatcagttgaagatgcgtcattttggtaatagagattgatttaattaaatgcaggcaacatatatggtcagaatgacgtctatactactattttgccacggtttgttatagttttctccacgagacaaggcgtgaccataggtggacgcaaacacacccctgctacttctgtggtatgatatcttgatttgtgttcatgtcgacgcggccaaccatccaatctgcctgtcttgcctctaacatgtccttaaaacctagctcttcaggggttaaggcagcaagcggaacaacaagagaagggatgccatggaggcaacaacgtcgatgatcccctctccctcggatccatctactccagcgtccccacgccacctctctcactgtccctattcgtggaccccgcgctgcttccctcgccaacgccagtggtcatccccacattgtctcatttgccgacgcagctagtggtctcctccacgcagcctcacttcatcatcatccccgctctctcttcctcattatcacaggtgccacaacctccttccccgctctctgtactagctcaagttcttatgtatgaataccaggaatcacctcactgtgtcactggcactaagaaccacgtgttgtactatgcttacattgagatgtgtcggcagctcgacccacaggggctattcaatgtctaatcaatcaatgcatctatgcataatttaattttgacgggtgaacttaacggatgacacaatatgagattatccttccttcattttagtatcaatagttaaaaatattttattggtcttgatgaattacattttgttggaaaattgaaggaccggttatgttcttttatgggacatgcactttttatacacttatcgtgtgttacatttattaccaatatatgttccgtacacttttgttttgtagttttgatgtggcctatttatttcatgattgcattccacattatatatgctcgtaaaacttcactgtgtaaagaccattcatttaattgagccgctctaaactgctcgaaatgggtagtttattttgtgaatcggcaaaataaactgctaaagctatccaatagaacacaaaacattgaattaaggtaaactgctaacaagatccctcagaaaacttttgtttacattgtagtcctcccgccccttgtaagtttgaacgcgtccgtcccgttgagttcggttatgtggaaagtatttattacgcattaatacctggtggttgaatgggctgtttcaacaaagggaaattgacatttcaaatgaaccatgccaaaaatttgacaacatttaaatgcggttattaggacttgttcagttcatgacctaaatgaattacaccgaaaattcagcaacatttaaagtagtccatttggtttgtggaaaaaagaaaggcattgccaaatatgttggtttatatgaattgaaagtaatccattggatggtagcaaaccaaataaaacctttgtgccaaatatgttttgtgttcgttagttgttacaaggtctcaccagttccattcataccatcttcagcgaaatatgtggcaagacttcactcgaattggattgttttccttcgtattcgtgagaccaattgaacatgtaccgtttcggtaatagagattaatttaaatgcatacgagagatatggtcaaaatgccgtctatactattttgtcacggtttgttagaatcttcttcgggagacgaggtgtgaccccgtgtggacgcaagcaaacacctgctatttctgtggtttgatatcttagatttgtgttcatgtggacgcggccaaccttccgatctgcctgcctcggctctaacctgtccttaaaaccctagctctttaggctttaaatgcagcaaataaaataggttagtagctactataggaggggaatggatgggaagggacgccatggtggcggcggcggcggcgaagatcccctcaccctcaccctcggatccatctactctagcgcccccacgccgcctccctcaccgtccctggtggtggcccctacgccgcctccctcatcattcctagttgcggcccccacgttgctttcctcaccaactcctgtggtcgtccccatgctgcttccctcgccaacacggccggtggtcttctcgatgcagcctcactttgacctcgtccccgcgctccctccctcgtcaccgcaggtgccacaatcttctctttcctcgctctctgctccgggttcgactcgccactaccgtaatagtcctcgttcctcgctgcttgctccaccttcgaatcgtcgccgcctcaacaaccccgatgaaggccagtccccacgaggccgcggtgaggaggcgaatggggacaatggagtgctagtcatggcgacatcattcccatgggtgacatcggctgatctgccagtgttgcattgcaccctagagagcatgttgctgaagggcatcacgtctgtggagggcaaagccacctgcaatcgttgcagtgcggaggtgcccatcgcgtacgatctggacgcaaagttccgggaggtgcgcgactatgttgcagccaacatccacatcatggatgaccgtgccccggagcactggatgtgcccgcggctgccagactgcggctcgtgcggcaagaaggcctgcatgtggccacagatcccaaacgagaagcgtgagatcaactggttgttcctcttccttggccagatgctgggctgttgcacactagaaggcctcaagttcttctgcaagaataccaagaatcactgcactggcgccaagacccgcgtgttgtactatgcttacattgagatgtgccggcagctcgacccacaggggccgttcaatatctgattgatccatgcatgcgtgtgcatccgtgtgtctagatatgttggatattatgttattttgtttctgtttgcttgattatccggtacttttaaggggtgaatgtaacagatgaatagatggctaggaaagagataaattttcctttcttttagctctgattgttaagaattcatccatttatcaatttgataattagtttttgcaggaaaaaggactggttatgttcttttgtaggacgtgcacttttcatacaaccattcacatttgttaccaatatgtgttccgtacacttttttctaacacttctgtttaattgtgatgttgcctatttatttcatccgtacatgcaggttccattatactgtacccataaaactttgcctggaatgtaatatcttgaagtacttgcttcccaatgaggtctgtatatcacccacgattttagctaggtattaacctttttgagttcaatcttctatacggttcactctatggaccatcttccaattggtgtatttttttttatgttacaaattacccttcatgattcctaactatacgagaccttgttcggtttggaggggattgaggaggaatgattccacaccagaattgttatgaaataaatctcctccaatatatctctttggccttattcagtttggagggtattaagggagaataaatccacagtacaatagatgtgaaatagatcccctccaatccctcactcttagggataataatcgtacatggttttacaggcattagatgaacacaatttgaaagaacaaaatccttattttttttcatgccaccggaaatttatttttcataaaattcaaagttttaggtgtcaagttaagtttccatagatttaaatggaacatcattgagtctgaactattctttattaatattagtgtgcaatggtttggagaaatcttagataatttagtgactattggatgattggagtcttaataaattgctagtcctttgcatttggattttattgtgttgatactaaaaactctgcctattttgtgtagttgtgtgataaccttaatctcatattaatttttagatgttttgtcaatgggattgactctgataaatctatgaccgacaattgccactatcttagtatgttatgaagtattttgatggatataagtttatataaaattgttcctatatatagggtagtacatcactacattgtactagagcctttgcttcatactgtaacatttgtttttggaaaaagtacgaattactcccccgaactatcgcggtcgaccgacttacctccctgaaccacaaaaccggacattcttcaccccccaactatgcaaaccggacgaattacccccctcgacccaa

SEQ ID NO: 55394 - DNA, 3303 bp, Oryza sativa
ccgatgatggattgagacatccctcttcaagctgaggagtgattcctcaagtatgctataatcaacctcctatttcaatctattcagagacaggaggaactgtgctgctccgaactattctgctcatgatcctacgaaaaggtgcggacttgttagcctgccttgagaaggttcagcacattaagcctccacaagtcaaaccacacgataagctcctatgatttgttaacatccaggtaagtccttaagaaaaactaggtatgtattgctaaatttttcatattctgatattccgtcttgtttcaatcacagattccccacctatcatgtcattgtgctgtacatcaaaaatctcggagtacatagacaagggggtttcatagcatttcaaggagcctattatggttagacttttcgattcaaaatcttattatactttctaattaagttgaatttgttcctgtgaactaataatagaatgtatctgaccaggccttccaagggggaaaaaaagatttatgtatctgactgcgaaagaaagtgagaaggtgaaaaggttgcatcagaatcaacaatcacttagacaggttaaaaatcatgacaaatctatattagctttttccgttgtaacttgcgggcattgtctttagtagttctctccgttgcaactcacaggcattttgctagttaaaaaaagaaaacaaagcaatatcatttttgcatcaaatacttgatatccatgcaaattttagctgcaaacttgtttattttctatgaaaacttattgagtttaactttgataattgttctcgttttttctaaactctagtaataatgaatcccccccctccccccctaaaatgtctaatactacagatattcgaacagattttcaaagtacaaaaacgcacccattatgcccgttttcaaattgcatgatctgtaggacaccttgtatatatatatcaatatcaatgtcaaaattttcacaatcaatactgaaaccgattatattttgaaatagttggctgcaattttttttggtgcccctgttacaggatatgcaccaaactcaaaaccatacctgggatggggggcttggcaattgttctccctcgtgggcttgtggcccggccaacaacccaaccaaactcagccaaatccatctggaagcacgcgctttcccccttccccagataacaaattcaccaaattcccccgcctcgaggaggaagctaacgaccgtccggtcaatttccaaccgccctctacgactgccgatccttcctactaattcctatgcttggacagttggacatccttgaattccaagagtcagccgcgccgccggccggtgccctctcccactcgtcttcaaacgtcccaactaaattatagcagccaagagcgaatcgcctctggcctctgctactttttcatcccccgcacggaaggatatctcaattgtgaatcgtatcgcatggtgtccggggaaaaggagaagtggaagagaagccagaagggagacgacgagagatttgtccgggcggcaagccaaggcggccgttctttccgtcgtgaacgcttcgtgtaaggttcggtgtcccatctctcatgtccgtttcagaagaaaaccgtattgctgtgttgatgctaattactgatgatgctgaggttcggctatcctggatgcatggctagttcttagagttctagggacaagtacaactattgttaaatagcacgaattcaaggttctgagtatgatttctgtacttcttttgatggacaggcaaaacatccatctgatttatcttgcgaattggattgcttaacctaatctgggaattcaagtcagtacgtacgatatgccggcaccatcggcatccatccatctgggagttccaactccgtacataacatctcatggatccaaaattgctcgcctacacatgtatgactggattgtgctgattcttctagtcgtagtagatggaatactgaacataatagaaccattccatcgatttgttggatcggatatgatgacagacctcagataccccatgaaagacaacacagtcccattttgggcggtcccggtaaacatcttacccttctagttctatccaacagatttcctttggcctgtacaggtaattaaagtttcttgaaaattcatgctttcgtagataattggtatcattggaccaatgattatcatcactggaatatacttcaagaagaggaatgtgtatgatttccatcatgccatactaggtgagctcatgttctttctattctgttttgttttgctagtctacacattttgtaatttcttatctgaaacctagcaatgcccttgcaggtctcctattttcagttcttatcacggcggtaataactgatgccattaaagatggggttggtcgaccgcgtccagatttcttttggcgctgttttcctgacggagtacctgtaaatttctagctctcaattggattctctaagcatgattttatcggagccggcctttgttgcatctgtcatgtatgtggaacttatggattttcttggattgcaggcttatgataatttcactacaggagtgctttgtcatggtaaggcgagcgttatcaaagaaggtcacaagagttttccgagtggccatacttcttgtaagtgaattctgtcagttgataatttcgtatgtatttctctaccttgttactacgaaatctcagtggaatttcagttagcattatcaaacacataggattggtcatactctagactgcaagagcttttacgtgctgcctgctcttgtggagtactgtggatcgctgacgaatttatttttgtttcttcagggtcttttgctggccttggtttcctgtcatggtatctggctggtaaaataaaagtttttgacagaagaggccatgttgcaaaactctgcattattattctccctctgctccttgcagccttggttgctgtttctcgggtagatgactattggcatcattggcaagatgtgttcaccggtggaattttgggtaggttaattttatagtgttacctttgcagattatacctcgcaacaagtaaaggaggtactgacaagtgtgctgcatgtaattcttggaaggttctaactttactgttaaaactttgcagggttggtggtttcttcattttgctacctccaattttttccaatgccatctgatgaaaacggtatgcttcatagttcagactacttttcttcatgattattgcagagatgaaaatcacccccaa

SEQ ID NO: 55395 - DNA, 8594 bp, Oryza sativa
gggcatcgcgtgattgataataccatgttctgtacgaaatatctgaagttgtactgtaattttgtatattctcgagcttcagatatctgtctctcctaatgtttctgacggctttacattgttcaaattttcgatgacaggattatggcctcacgcatacgcccggcacattctcaaccctgatcagctggagaacaacgcgcaacccacgtccgtggatcgccctaactctctgccgaacgggtcctttagaagccctaatggattggaaatgggaaacacgggccaaggccaagcattagatttcatggaagctggtcgtagatatcaataacgagataaaaacctgctactgttgtagcagacatacctgacgtactttttgatagactgagaattatacggagacctttcaggttcactttggtacatataccgtgtagaattgttacttgtacatttcaacatgatgatgttagctatttctcatgtaaatctataccagattaaaataatgcacctacatttgggtatccggaagtatgcctgacagtagatggtcacattgtcgcttggcttatcatacagaatagggtttggacctctggccggcttgtgaccagggggttggaaaaataatggcaggtgccctctctgcatataagagaagatgatacggctttgcacctcgtcgccgagtgcaggtatacgagaaggatttgaaacctcgttgcgacatgggtagggtttcaccagctagaactccgacgctgggggtggtgcaaccggtcaaagattggtggaaaatactggcctctgtgtctggcgtccctaagaagggactctgcaccctgattctactcatcgtatgggaagtttggaaggtgcgaaataggaggatatttgattataaggaagccacaacctcgtatctcctttcaaagataaaagaagaggctggcatgtgggccttggcaggcgccaagtgtcttggagagatcatcccgcagtttgtatagtgtacagctttccttattttttgctttttctttacccttaggggttgtattttttttcttgctatattcaatgaataagcacattcttgtgctagttcctttcaaaaaaaatgcttgttttaaaattgagcataacacataagtgtgctaatgtgatgatgtgaaacaaacatcagcttgtgttcttaacataaggatccataagaagggctattgcttggagttacagtgatcataggacatgtttcatgaggatccataaaacaagcagctttgagttacaatgatcataaaaaactggaaatgtttcactttcatgaagatctgaacacgtctcaactctgaatagcctggaacggggttgcggcttaacatgcggcccgttaactctaggggcgtctacggatcgtacgttagggtggttaaagtttttaagcaaactttaaactattttttctcctaaattatatatctaattcatgatccgattgcaccattaaattcgttgcaattaaaattttaaaacaagaccacatatggatatattccgacgaaattttttttagcttattattgaattatttttaaatgttgcacgatgttccaccaagtatatcggaattgttttactaagtagatcgaaaatgtttcaatcatttaaattgggcgttgtttcatcttttataaaaacacaaaagaatgtttcagttcactgcaacatttgatccatacatagtgaaacattatgagtacactaggtgaaacattttttttggaaaaaaataaaacgaattcccttaatagagggtttccaaaatatgtgggtgatttgttgcaaaagaatattccaattaactacaacattagatctatacatagtgaaacattgtgagtacattaggtgaaacattttttgtgaaacaaaaaatgaaacgaaatcccttaatagatggtttccaaaatatgtgggtgatttgttgcaatgcggcacgttccataatatcaaaattcactgcaacatttaatccgtacatagtgaaacatcatgggtacactagctgaaacattgtaaaactactggtttgaaacatcaaaagagaccatatgcaacattaaaaaaatcaataaaaaaactaaaatattttttttcgaaatataatcatgtgtggtattgttgtaaagatttaattgtaacgaatttagtggtgcaatcaaatagtagattagataaataatttacgagaaaaaatcttttgaataaataagagatgtgagcatgtgggggaaagattctttgaatgtaatagcaggccatgtccgatttttctgccctcccgtcggacgtccgacgcccagcattatccgttaactctggatagcgtgtgttctctttttcgttaggccgccgcataattgtggcttacatgcgtgccacgtttattgggccgaaacgggacagtggcttgcgtgcggcccattttaattcgggctgaacgggattgagtgcgaccggcacggcccatttatgcaaacctgctgcctaaaacatccggccgcctgatgcagcgaatcccatcaccggccgccgatggactgagccaggaacgggcagcctcagtcgtcgaagcctgcactgaactgcgatctgttgagcattctgagtttgccgatcaaattgcgactcctgaacaaagtgagttttgggtggataggctatgtcaagctgcaagcatatcaggcttctagcttttgcaagagatttttcattgttccaacatgaacacattctctctgtcgctatgcgtcgtgcaaattccgtgtcacagagcataaaacatgtgataccagtacgtgtaaatgtgagtagaggatcggcatcatatatctaaattatctgtctggtccctgtaatcatgacacgcattttgttttggagcatatatgtgctgatgcagatgcgtcgtctgcagtagtagtactcatgtgacacaaagaaacatgagatcaacatggcctgaacactgaaatgatgcttcattatcttttatcattggtgtcagccaaaagtgccctgatgacctcacccttgaatatgaataatatgattctctgctgtactatatgttcgcctgccatgtgaatcaggtgatgatcatcggaacatttccccctgaatttgcaaggtaatggaggtcgccgacacttgcatttcgtccatctgaatctaccacagtggcacgttgctctgagtttgctcaccttgttccaagaaaaaaccatgttgctctgtctgcctccttggacaggctgtatactttgaataaggtggtaaagtttgaatcaatgaacatattcaggcatcggagcaacatggccaaattgagcctaacctgcccctagttaacttggaacagacaaaaacctgcgagctgaacctgacataccaacgggcaacgggtggctctcgattaatctaagaccgagagatgatcagaaaacttttagtggagatgagccagatatgagctgtttagatgactccgagagaagaattttgttgtgacacgaatgataatgtctttccaacaagatatgggtcgccattatgttgccattactttgactacaccacagctgaaacctactccttttttcctctccacataatcaaccacgttaggcaacaaaaggtggtagattatttcataaatgtaactttcttgtgaacatcacatttgtcttagctctccagaacaccaggtcaaatttgctcaaacttctcacccaagcatgctgttttttttttatatgctggaaccattgaagccgccgcaacagatagatggtccagcgcggggcttcaaattaatcagatttaaatggtggacgatttatggctttttctgacattgagagatttttcttcagcatacttttgaattgtctgtgaccactggatgcacaattcatcaatttctgtggcacccgcccccatcaaaaaattcagtgatgcgtccatctgtggtctgaccagattacagttgatatatggacctgaattaatatatcaacaaccaaatacctgtccccatgctatattgcgaataattcagggatgttgaggagtagtatgtgtcaattctcaggtttcttaggtcgtctccttgccgaaaaacctgggagaacattgtttaattttggtatgaagaaaattgttgattctggtatggattctgtcgtgcatataacagctgattagatggtagtctcactgaactaaagtatgtttgtattgggttctttggtcatctctgctgcacaactgccaaaaacttacgagaagagagaaaagatcactgaccaaattaaagaagcaaaattaggtgaagaaaaaaaaggaatgcagaggggacagtccacaatctagtctcaatctgtgtggcttgaactctttgatctcgtcctccagctgtctgatgcaagctttgtcaaatcacagagcccaccacggaaggcgaagttggcagcaacatgcacatgactttcagagagagtgattattcaatcgatcgatcagccggatgggctacatgatgacaaacgggattgactcggacgctaatccggcgtccaaagtaattaagcctaagtcctaagacaagttgtgttgtgccgatctgtactgtgcacggctgacccaatcgtggcgtgaagtcctcgaattaagccatcgattagattaattactcgtgacttcttgagtctttgtagatgcatttgctgcaaacagtagattgatgtctacgcatgcgtatggttttctgaagtttatagcttttgacggtcaaatgctaaccaccgggacggatgaaaacgctggatagcatagtactcacgggcttgtcggtttgtggtttaatcagcgtggtgcattgtagatgtactattaacttcacgggtagatatgcaaggtttacttgacctaattaatactagtatcaacctgtacgagcccaactatttggtgaaactactttgacagtttgattgagtggaaagactgaccaggtacattgttcagatctagtagacaacttttaattattctgatctaaaaaaattgttatgccaatttgttttggttatgatacaaccatacaaacaactactagcttattgacaatctggtaatatagggctaatcagtactaaaacttaagcggtttaattgttggtgctaaacagagactagcagatgatcgtcgtttttggagcacattttccatctgcagcagcatataaaggtagctagctgactttaaagatttttgtcagttttcatttattctttgcgattatttttgtcacttttctcttttgtacgccaaaactagctacttcctccatttcacaatgtaagtcattttagcattttccacattcatattgatcaatatgaatatgggaaataatagaatgacttacattgtgaaacggagggagtagatcctttggcaattcatacaatccttatctctactttatgtcccttttcttttggaaaaccctcaccatcaccatgtgttgtacttcacttaagtacgttgtatatgtactatagtactactgctaattcattgtcaaattaggacgtcgaacacattatattgtttgattaactgaagatgacggttgatccttgaagatgtgaatggatgggccagcaggttcggccgtcagctctgaacaccaagcactcaaagtaaagtgtaagtactggagtagttgtttaactgaagaaaagtactagtacctatgtgtgcatatctacgtagctttccgttttctcataccatattgtagtataataccacaccattctgactgcttttgatgcgagcatcatttggttactcaaaaattttccggcgatatgtgaatctcaaaacttgtatgcacatcaagtgagaaaacgactggtgatttacgcttcgttgttgtcgtgccgtcatacgtgcaagcctgtaataatgtaatatatgtactctatactccaacatgcatgtgtacagtacagaaaacgcagtgcaagttgtatagtgccttacaactcaacgacgactaaattaaggggaaaagttaactacaaatagctagttaatccggtttgatctctttgctatctaccaagtcagagagagagagagagagagagagagagagagagagatgtgtagctttcagaccggacgtactgaactgggagtgcagctagacacataaaaagaaagataagaaactatccagtgatggtgagctaacctaaacaatgtaaccacttgggcaagttcgcttttgatgcgctacaatagcttatagctacctgcacgttgattaattaggcagcatcagcagcagcaggccggatggcatggcgagatcgacatcgaaatatcgcctgtgaagtttgaccggtgtccaatggccgccaatggcgtcgcaggcgtccatggattacgtataccaaagacgtgcttatccggcccccaatttgcgattaaagtgaaggttgagcacatgtggatgtggcgccatcctcttttgatcccccaagagccacacagaggattaattaactaactaatcgcctaaccggagcagcagcaagcagggcatactgattgatcaattagttggtagttaaatatatcttgcttcttgattcggtaaggggggagaaagagcatgccaatttgtccatttcacaatactactttggtgacaagatagtgtatgtggtagtaggcttggtagctacaaggtgatcttgtaatttagccctaagactttagcataatcccatgttttttttaatttgctccttgtatttatgtacaactcaccagacaagtactccatatgcgggtgtacatttgtacctgcagcaagtacgcatatattttagctgaaattcaggggtagatgccgcgttctacaattcttttatgcatgttgtaagctgctgcaatttggccaacacaccagtacaccaccacacattataatttagctactatagcaaacaacgaacaagacggtaaaaataaaatccccactgtcatttcaggaaaaaaaaccgtagacttgtggactttgaccagtattaccctgactgaacaatttattttttgtgaatcagctggaagaatctacccaggtctactagagtatacacagccacttggccatcgatcgatgtggccagattgtagcccacggtacaccactaggacctgcatttatctacgcaataaacatgcgtatgtatacgtacgtaagcacgaaatgcagcagaaatgcagactattagtactactcgcacattcatgctgaattgctgaagcatcaaccctagctagcggccgggtcttagttttttgtcttcacgtgatcaagtcatacaccacgggaagagtttggctgtcacccaccgtccctttcgcaggtgacattgtagagactttgctgttgctgtatgctgcgacctacgagaaatgaaacgacgatactgtttatgaatcttccaaaagctcaagggcacgcatgcaaaacgccaacgtttggaagacccaggaaaacgacctaaccacagtaggcaatgcaactatgcaagcttcgagatccgagcataaaacattgggttgacttgccataacagccggtcagcaaccatccacatgcatgctagagattgtgcaaaaacccctatctgcgtttagcactagttaatatgtttctcaagcaaggcaaaaagattgtcttgccggtgcatgtttgattgttttccatgattcggcgatcgaccatactaacgcgggagagagagttaaaaaatgagaatcagatgggcagaaacaacacggcaggggctggacctgctgcatgtggccactacgggccctgcattggccagcacgcagcgaggcagcagctacggcgtcagcgagagccgcagggaaagatagaaaaaaagaaaacgattagctgcggcgctgggtcgctggccaccggaaaggagcagctgcttcttgcattgctcgcgtctccactttccacacgcagccgcgtgccggtgatcctgtcgatggatcgatcggtcccccaagtcagacaggctgcctctctggtgtttttgttcctgtgcttgtgtcctttgcgctctctctctctctctctctctctctctctgtctctctgcccaatactgtgcatctgtgtggctgttgagccaaatgactttaaccagaagctagctcgtctaccgcatggtttgcacatttcctgtgtgaccaagtgggaaacttccaggaaggtatgggtgggggctaggcttggggattgaggcagaacgccgatctcaaaagacagctttggttcagggtttcagggcatggagtgcaacaaaagctcttatcacctgcgtacatctatctaacatgaatgcttactggggctgagcagtttagcagcctcgctgctgtgatacgtacagtactgcatacccataactaactg

SEQ ID NO: 55396 - DNA, 4541 bp, Oryza sativa
agacaaattttttaagcctaattaatctataattagagaatgtttactgtagcatcatataggctaatcatggattaattaggctcaatagattcgtctcacgaattagtccaagattatggatgggttttattaagtctatgtttaatatatataattagtgttcaaacattcgatatgataggtacttaaaagttagacccgtataaacaggatctagtggtataatgtcctgtgctagtgtgtagaaatggagtgtacatgcacgtcgtgatttaaggacactttaacgctatgcagcgtatatgcatgcttatgccttcttaagatgatttgacacttgaccacgaacgattgaaccgttgctgtggttggtaatccattttaattatccttcattaattatatatattcgtttaattcttatgatttttttggaattttaaaattatttatattttgggatggagggaatataagtaaaaaagattctaaattttctttcaaacaatgcactattagtagtatcaacaatttactcatgaacaaatatacagtatactctaggcctacagtttgctcgagtgggtgtcgtgtcggttgttcgtgttacctcgctcgtcaatattgtccattggccattgggacatcactcatcactggtctctcctcgctcccacttactatttcccgtccttaaacataaatgtaaatgattttagtgttaataaactttatccacaaatataagagattttgtaatataattttttaatatgtttcaccattactttgtgagtctcactccgatgctctctactagtagtagaaaacaatctgaaccgttaattttattagattaaagaattcagatatattatactaccattctagttagcgatagtagaaacgcgaagcaacattactgtagaaaattagacgcctcatcggttgcccatattccctaacaagccacttattagggaataaaaacaatttataagtaaaacttttgtacatttgttgatttaaaagccaatggtaaaagaaattatgttgaaaatatctcaaaatcaacaaaatcaagttcgacaatttaaattttgacttttgctttgatttattagaccaaccagtgaggctctaggtgcgaaggggtataaccgttatttagccgtaactaaacctttgtttctttgagcgataccaacataatagatgactacatgttgatctaataaaaaaacataaacgacaaaattagccctaaccaatatattagtaaattactaatttacccttaatgataaatagttcggattatttctgctcgttgtataatgttaagtaaaaagcaccggattgtattgttatacgtgatgttcaagtctttaaatatcaaaataattttaatatcataagatttgttataaataatctaaaatggttataaataatctaaaatcccatatattcgtggagtactatcaagcgagccatcgccattcgccagcaaaattcggtggccaggcgagaagagctactacgacttttcgcgactcccttgcttggcttgtccccatgttgccgccgagtgcagattagaacaggaacaatagcaggctagaacctagccgtaaacatattttaagaaaataaatgagagagaaaagcagcggactatatatttgtagtcagctgtagcacggacttcaagatacagtgtgtatgacaggtgagaccagatattagtagtgtagtatgtaactattgtatgaatgagctattagattagctatagatgaattggagcccgtagttggctatatatactattaaacttgctcttagagcaggtacaatagcaggctattagccagctataaacatattttaatgatataaacgacgagagagaagagcagcggtctacagatctgtagccagctgcagcacagactctaagacacactatatgacaggtgggactatatattaatagtacagtaaacaacaactgtataaattagttattagattgactataaatgaattggagctattagtgggctgacttagctcttattgttgctcaggtcggaggcccccctgatctcctcaagagccgtgcctgccagcaactctctttctttcacacacactataatttctctctctctctctctctccgtacgtggcgacgttggagtctactacctgttggtgactagggcctgacccatcaatcaccagtggatcacctcgcatccgtacgtcgtcgtcgctgatattgcaagctcgtagtagcagcatctccatctcatctcccgtagattttgcacggaccgatcaggaccgatcagtgcaacagtactagagagaggcgtatcattgccggcctcctgctccaagctatagtacccgatctgatactactcctactactacaagtctccaccaattattcttccagaaaccccagcgccgtgttccaatcaaagattccaccggctgcctggacgccgttttcgcctggccgggagggccggtcgtcgaaacaacgttgattccgctgggttttcgttttcgcccaggccggccgggtcgtcgtcaagacaacattaaacggtgcggtttaatgtcgtgacatgatgggttctcgtcagtctcctcgtgacatgatggtgtgtgcatatgccgcatcagcgcagcagcttgattccaatggccgtatcaattcgagatcgatcacagcaagattcagatatggccggtaccattgccaacaatcctacctcaggctgagctggaggtagctgctagcctgctagtggtagtgtactcactaccatggctagttactcctagtatcaagcatgatatactggcactctgatcacctctcgacgtcaatgtgttgcacatgccaaaagatcacgccttgcatgcacagctgattaaactaatcaaggcacgaacaggcacctaaccgggctcatctggatagctagagaccaccacccaccataccataccattccttccccccagcttgcgatttgttgcaatgcggcgccaggaccagcaaaagcatgcgcgataagcttagatgccgtgggaacagagcagtagtacttgcaacgcgttgcttttgttcatttccagatctctctctctctctctcactctctctctccttttcttttaaattttcttttttatcttctctattggcgagcatatccctgcaaaagtcactgtttccggcttcccacctgttgctgataagtttagcatatcatgtctacagctacgtgtgtcagtgtgtgcaatttgtgcatgcataccgccatgggcgcgcccatcagatagctccaggccaccacgagctttccctttccaatcaaacaacaaacatagggcaccccccgggacatgcatgcacctggggcaaaggtgcaggtagagagagagatcatcggtctcggcacacaacacgtcacgtctcgcggactgcacaaacgcatcagagaagctaaaggagaaaaagaagctgcagatggggaaatatctccattggttgtggttaattgacatttgacagatatgatgatggataatttcaaatgtttcttcttcttcttgtgtgtcagttggtctagccttctagggctatgcttcattagtgtacacttgggatgaaaagatttacagcaaagcaagcaagaacatgggcgaataaattaacaaaaaaaaccaagtgagattagtagataggatcaacaagggactaagctagctaccacctgaattatgatgcatgggagcaaaaaagacactagctagagaagatcgagctaatagtgctaactctatactagtgccagctctatgcattgcttcttgaacgccgccgcttgtggaggcgtcgtcgccgccaagtccctggctctcttgcacccggccatctgttcgaccggcgccggcgccgtgagcaggtccacgccgaagagcctgacggccttcaccggcgacggcgctggctgatcagcgggcgacgcgagggcggcgccggtcgaccgtactaacttgcagtcgatgaagagcttgccgtcgtcgccggcactggcggcggagcggtagaagccgacgacgtcgccggcgtggagacccttctccttgacgaagcggctccagcccttggttagcacgtagctctggctgctgttccagtacgagtaccggaaccgccacaccttgccggcggcgtcctcgaagttgaggaggacacccttgctctcgccgccggcggacgggagctgtagcgggaagtgcttctcggcgtgctgcttcggtatgacgagcctgttcagcttgcccacgtcgctcggggtgaccgtcttgtcgaacaggtggtcgcgcgccgcggcgggcgcgaagggggagcggggcgacgagaggtggccgttggagagggaggcggtggtggtcgcggccgacggcgtggaggcggcgaaggtgcgcttgctctgcgcgagctc

SEQ ID NO: 55397 - DNA, 6751 bp, Oryza sativa
tgggggcaatgggggctaccatactgcgccccctatacggctataccatgtccgcgtggagggaaggaggaggaagctgatggtttgctatactacttttgttctggtgtgtgtgtgtgtgtgttttttatcttttcctcttttcggtggctggaaccgtataaaaaatgccctgctgttgtgttggactttggatagaacgacgtcacggcacaggggagatgagggagggagtggcaagtgttggtttgtgggggcagtcagctcagcccatggataccgcgggatggcttcatcgagagctggtagctggataaagatggaggatagattgttcttgttgctctggtgatgtgagctggcttggcctggaaaatgtgcccttgggggcagctcgccatgtcacacttggcccctttctgtgttcttttttcttcttctttttattgggtttgctttggcagttgctttgatcaaagcaatggctgcattagtgttgcttaaatatccatggtttattctgttcgggtggatatatattgcgtgtgatgacctgtgcattgtggagtgttctgttgtgccatgcatggactagtatgcgtcttttctggaaattttggaggaatcaggtgggatattgcgtcaacaggggaattctttggtcctagtgagtgtgatagaaacaaggaactggaaagtggaaacaccatgtaaaagtatactgggacatgttttgtaccatatgacagaaagaaaagtatagctttattacatgatgccaaaagaactgaggcacaaatttagcgtggaaaaacttttggaaagtaaaaaccatgaacacaaatatacaattaattgaaatcagttatgcgtatggtgaccaaggtagcaatggtgtatgtagtaataaatcatgaaaaagatgatgccctagtgctatctttggtttcaaatatactttgtccccatatatataaagattatattatgcaaaaaaccttcatatagttagatttttaaaaatataaataggcccacatctagataagtgcaaggtaaagagatggcataggcctccaaaaactagggcccctaaaatttgtgtttcaatcaatgctaatataacattaaagggttctgatccattatttcaagttccactctttctccttcactcagagccccatcagttagcctaatacgccaaagcaaaagtcaagatttgaattttgaacttcattttaaagttgattttaagatattttcaacgtaatttatttttagtattgtcttttaatttgctgcaaataaagatgttttggtttattatgaaatatgagcaactaatgaggctctcattcggttggaaaatgtcttactttccttagctccgactttgatgatatcatctcaaaattgtatccataatggtaatataaacgtgcgttgccagcactggagattttatttttccacttgtaaataaaactaaaatgttcatcatgatgcagttcttggttcacgcacttggtcagagcgccatcgccattatctgagcgtccagccattgttgtacgtccgtgcacgattcctacatgcatcttcagtagcagtgcataatatagctagagagagaagcacgttagatttgattgctaactctgctgttatggatataaccacaaacgacaacaacgcggactcaacaaagagcaatggggatggagctcctctatgttatcttgatacggggatatggatacgcgatacggagatacgaggatacggcatttcctagaaaacactgatacggggatacgtttatatatatttaaaaaataaaaaatatagaaagaaaacataaataactgcaagagtataaatagagaaaaaagagatagcattacagggcatgaactagtcaggatatcaagttcaactgtcaataggtaaataagtttaattggtgtttgtatcattgatagtgccatatcatcgaacaggtccaatgcaccaaaaatcttttagcactctgacaggagatcaggcccatcaggtagctctcccatagataatgtgctatacgtaggagttctagtcttctagagaagcagttgagcccgtcgtcggaggctggggttgacagtcggcagcccgacgaaggagttgctgcgccctggaggctgcggccggcggcgctcggcgctgtggccgggggcggagggcgacggcggcgcggcgcagcggaaggggatggcggtgcggcacggcggcggagggcggcggtgctgtgcggcgttgcggcggcggagggcggcggtgctgcacggcgtggcggcggcggcgctgcgctatgacgcgaggaagaggcgagcagagttggggtcggggaggtggcgctgttggtgggtttttgctcgctgtgtgttggctggggattttgatcgatgattttagggttacagcgtatcggagaagtatcggaaatattttttattatctgaaaatcgtaaaaatggccgatacgtatgggatacgtatcggggcgtatgcaatacgtatccgtatctgtagccgtatccaatatggatacgtggcctaggaggagtatccggtaacgtaggagctccttcccaacgaattgcaaggttcctagcgtcgatggaaaaaacgagtcaacctactcaattgtgcaactttggccaataacatagcgtaaagtgaaatttactcctttatttattgatattttttaaatacatgttttcattgttccttggcgctagatataagatgaagaataacaacaataaaatacattcattggagattatcgatggcctacattgaaagggaagaaaaatgatacttcatctgtttcatattataagactttatagtattatctatatttatatatatatatatatatataaaataataataatgaatctagacatatatgtgtatatatatttattaatatttatatgaatataagcaatgctagaaagtcttataacttgaaatagaggtagtaccattttagcatttgtattgtcaaacttcaacaacccggaggccagctgagctgcagaaatatttgaatttctcgtgttaaaacgatatagattaacctagctaccaacaaaaggtactccctccgtcccacagtataaggtattttgagttttcgattgcaacgtttgaccactcgtcttatttaattttttttttgcaaatataaaaaacaaaaagttgtgcttaaagtactgtagataataaagtaagtcacaaataaaataaataatatttttttaaaaaaaataaataagacgagtggtcaaacgttgcaagcaaaaattcaaaatcccatatattatgggacggaggaggtactaactacgataaaaacgtactctagatgcgtacttcctccgttcacaatgtaagtcattctagtatttttcacattcatattaatgctaataaatataaacatatatatttatatatgtctagatttattaacatcaatataaatatggaaaatgctaaaataatttatattgtaaaacggagggagtaacaaactatcatatgctctacgcgcacacatcttgttggtggcatacccaatccctagtggagtgtggaatgcattaatttgttcactgaactacgccgcgtatatatgtaatcgtaatgaagattagtgggaaacaacacaaagtctagaccttgacaccggggatggacattaatctcaccccttgacgtacgaccactacaaattagtaagaggtaacggtcaaggcacatgttagatcgatatagtgtttatatcctcaacgacaggtaaaaatgaaatgatgtgcgaaacaacgagaactaaacgttgcggtttactggaactattataaaaacgatatttcttttactatcgagatcacgtacgaaaataagtctattttttagacagacttattaagagattgtatgaaaaattaaatagattttttcatgccggcaacttggagcagcaagcaagtgggccctacgcatccccgcactattttttctcccacacctttttttttctcctccttatctccaccgtatcactcttttttttctctcttcttctccaaaaccgcttctcttcgccttcctctcccactccacctcatctcttccccttctctttaccccatctcttctccaccttcaacggctgagacagaggtgacgaccttgcaggtgggcgccggcagtgagcgacgaaagcggtcttgggtgcgggcggtgctgacgcgcggatccagctgcacccgtccgagagagcggcgatggtggccttaacggaggcggaagcaacctttgggggtgaggggatttgattcccccgtcctcgggagcggtggtggtgtgcggatccggctgcccccacccttagaagtggcaccgtgggttgcggcggtggccgctgcaacgacgatgaggagctagggtttcggtagaatggaaatcttggatttatgctaaatttcttttggggaattttattttattttatttttctctaaaactatttttgtatgtggttgatataggttaccgcatataaaaatcatgtttttcacatgcgggtgggctctacgtatgaaaaaagatgattttcgtagacctgtgggtccaggcgggtcgctgagccgcatgaaaaaaacgattttggttgccccctccagtgctgcacccttgcacgtcgatcggttctatcttaaacaaaccggtcgatccgcgtcgaagagataacgttcgcgatggtgagtactgagtagtggtggttgataagtcggcgcgtgccaaacccctgcaagttgccttagaatttctgatgtgggtgtgcgctgtgctttttggccgtacacgccgttcgcccgctggtacccccgcggcccgggccgcgccgcgaaaacaacagcgcgagaaatttggccagatttgttgcgacgcgggcgtactttgagagagaatgcgtatgccaatgccaaagccaagcagcaaccggggcgcgagcgatatggccgccgcgaccgcgacgcgcgcaagtggactcgctacgaaccagtagagtaattgcagcggcgacttgcacgttgcaacttgcgtggcgcatgcgcggcctccgctctccatagtttctctctcacgcgcgcggctgctagtgatgagtgtgttagctgtgctatctctcctctcgtctcgtgggattttaatactcctgtgtaaactgaaaacaacacaacacacaccagatatatgccactgttggatgtataccccgatccagctaggtagtgtgccagtgggggaagcaaggtaccactacaaagttaatgaggcaatttaaaactgcggcgtatgcattactaaaaccggagtgctgttgcgcgggggggaagacttggggggtctaaaccggagacttggtgcgtcttcttgatgggcaacagataaagaatagtagtagtatttttttagactagttatatgtgcatgttttactataagtaaaaaaatatatcttataatattacttaaaataaataaaatatgtattctccatgaaatatgttacctacaacctccgtcccaaaataagtgcatccgtggatatccgtgcccaacgtttgatcgtccgtcttatttgaaaaatttgtgaaaattttaaaaatatttagtcacacataaaatactattcacgttttatcatataatagcaataaaaatactaatcataaaaatttttcaaataagacgaacggtcaaacgttgaacgcgaatagtacaaaactgcacttattttgggacggagggagtatcaataaatcattttgctataagaaatattcatcttaatttgactttatttgtgactatccattaaaatttgattgattttgatactaagagagtttaagcgctaaattaaaaaattaccatgagagtaggtgggggtggcaaattcactaccgccaccactatacccccctccatcccacagaaaacaaatctagaacgagatgtaacatattctagtacaacgaatctagataaagatatatccagatttacagtactatgatgtgtcatatctagtattagtttggttttttagatacagaaggagtagataataaaaataattttgttagaaatgaaattatattcggtctctgcaaacagccaagaaatatcatgatgttatttttacagcaactcacttaaataaaagcaagataatctctactattataaaaattgaagatatttttaccggtattttgataagtcatccatatttaagttggttttttaagtttgttcgattttgaaaatacaaacggattttaagttctattgcttttgaaaatacaaatggagtcgtacaataaatctctttttaaaaaactcacatactaacttgagataaaagtcggactcctaattgtaacctataattttctaaaaaaaatatccaaacgaatttcaacagtgaatttcaccctagctataccgtataacaataataagattaaagtagagttcacccgttgcaatgcacggatatttttctagtaccttaaaaaccaagataatagcataaaacgctagacactccaaaatatttgtccggcactgtcattggaaacatgactagattttcatctaagtaacttaagatgat

SEQ ID NO: 55398 - DNA, 1707 bp, Oryza sativa
gctccctaacctctctaaccctttgttcatctaaatttcttctaaactccaagctccattctctgcctaccaccgtatccttgacagtagcattttgatcatgactaatttcaaagagatcaggaaatttgactttcagaggtacattatcacaccaaacatccttccaaaaactcacatctctcccactgtgcacttcctttgtgaccagcctggaaagccaccctttgcatttcagcaaacccatccaaaattgagagccaccattcccatttcttgtgaaaaaatttcaattcctcaaatatttccttctcagtacctccaggcatacatcaggtgctccactttccaatttcataacccatttactgaacatgccactggaaagtgtaacactctacttatatattcttgtctagattccttgctaaaatgtatataggatattggtgtacttttgttcttaggcactaaagccgatttgttatgtgtggagactatagagatgttctaagactagctcttccttcttttctagtggtattgaccctccttttttaaccgtaaagagatacacggtgcccatgcatgcatatataagtggaacctaacccacaggggttggtatgcttgttcttgtcacacgacagttggcggagcccactatcagccctaaacttgcatgtcgatcatgttggcggagcgtatagagccttctctccgctcctgctccttccttttgacgcgtggttttgggtaggtaacgtggacagtaaggttttgacactgtcaaatttggctccaaatcattggattcatttcaaaatttgtacagataagggagtaggaaacaaattctataatgcgatagtaggaggaatcgaacctacgatcagagctacagctaaatgtgtgccttatcaactgagttagcactttggtttgatatttttacatgctagttatgcattagttataatgtaactaaaatatttatgttgaaattttttagtgttatatagctacaaccttatttttagccattgcctttctaactttcgtgtagcctttgttaggtcctctaacggattagtccaccataactataggaaatgcaccgatctacgtcttgtaagtctatttttttaatagatggagtatgccattgtttaaagtggtaaaaaagagagaaagaaatgatacttttcagatttttgagagcccataactagcacacccttcatccccaataagataatctttatacatgaatctggacatagaaaaatttattttggacaaagagtgtataccaataaagaaaaatacggtcttgcactttaccacaccatgttaccacttcttcccttcaaaatccttccactttatagcgtgacgtgcgtgacgtaacattatccagtacatagatgacatgtatataggaggtgctctctttatgctaaaaataaaccaacacgactgaaggctggattcttggtgaatttgttttgttaagaggagtacatgcacaattccatgcatacctggatcaccaccactacgtacaggagcgtgtgtgaatactcgaccaactgcccgtatctcatctactggagtacgtacatcgtgtttattccaaagtttttcttcaaacttataacttttctatcacatcaaaactttcctacacacaaacttctaactttt

SEQ ID NO: 55399 - DNA, 13342 bp, Oryza sativa
acgagaaagcgtggtggtgcttctttttttaagcagggatggagggagagattctacctgtgattgggctgttggttttggcgattctgccacagataaggttgatgagaacgcaagataacttgcacatcccattggcctatgcttctaattgaccttgtattatcatggaggtgacgtctgtgcacgtttaatactggcagttgctcgcttaaatatcgctctaggcgtcggggtttattgatggaagttttgaaggacatctggttgctaatgcttctgaagttccgagcggattaggccagtcccaaccctctatctaagatggtgcctatggcattaactatattgtcatgtagaactcttagcttatatggcactatattaattaagagagagagtgaagagaggaagaaactgggtctcatacaagacacagcttcaacatgagaacctatccactagatactatcaagttttgcattgggaaagaatagtgtcttcataatagatgaagaataaatatgattagtagagaagtgagatgatgtatttattaatggcccactttaagaaaccatgggttgtagattgtagtttatattgtgatgtcttattgatatggcactatagacattgcttatagacattatgggttgagactgcctttagtgtactgaagcgcttggaattttccaaacagaagagacaatctgttgccttcccttatcagatcagctcacatgaaaacatttgaagtactcccagtgtgtgtgtgtgacggggagagctaggtggcttatcccagcggaggtgcatgaaacttggggttgtcttgttgctagatttggactggagtggagagagtgaaagcctgaaagcgatcgttagccggctgacgaattcattcccctcatagaaaagggtgacaagcaaccgacaacaataccaggtgtgctaaacagccttttgaggttgggcggttggctggcctgcattcacatagaaacagcacacgtctgagtttgaaaaataattaacggtaggagtaactatctagctgctttgcatatttcaattattgtggtaaatactctgattgacagtgatagatgctaaattagagcaaatttattcacagtgtttgacaagttatatcaatatttatattgctgaaacgtgacaaatgataaaacggtgtgatcacgagtagagctatacaacatactagtgagatgggtgatcactgatcaaaataatgaaagttcaatcctaaattacattggaaggtggtacaatattgagggttgataaaaaaaaaagcaaaggatgatatagggcagttaaacagtttagaggccgctgcaccaccttctcatcccaaactttttttaaaacaaaatcatgcaatgttcactgcccgcttaaaaaaacaaagtcaatagatatagcagttaaaaaaaaccacctcatccccacttaccaccaccaataggctcagaaaaagagtggctatgtaaccattcaatagtttgctctctgtgatatttctccctttctcgtggtgcactgtttcatcatttgcttgattcgatccaatccaactctttcgaaaggatttgtcctcctcagccttctttctttggtccccgcacatatggctatgttcataacttacttgtctagcatatatggctatgttcataacttacttatcccgcacagaaaacaatgtaacttattagtgtataaataattaagtattaatttttaaaaaacaaaaaataggttataatatttttaaaataacttttttatatataacacattatttagtagctcgataagtatgcgcgtagagaacgagaaagaaaaggatgtaaattcctagttctgaacgaggtcgtaatcctctttggcttcttctaatgctagtgcattatgttcggcggtatttattcccaacacatctctcgtgttccgtgcgcacacttttcaaactactaaatgatgtattttttgaaaaaaaatacaaaacttgctaagtattttttaaaaaatagattgatataatttttaaaagcaactttcgtatatattttttttagaaaaatacaaaatataagaatttagaatcggatggaacattttatagtagtatgaatatgaatagatccggtcttaggttcttatattttgagggacggagagagtagttaattataagaaaatatgtcgctctgttttgtgtgtgcgggagccgaacatagcctaattaagcaatgcagccatgggtgatgttgatgaactctatttactactatcttatcctagaatataaaaatttgtagagttgaacatgctactatgaaagtaagtagaattaaatgagagaagattgtgattggttgaaaaatggaagtaagtgaagaaattgaacggtggaaggtataattggttcgaaagagaatgttgatagaaaagttattatattttagaacaatttctaaaaaccaaaacttactatattttataacggagggaataattactaccttcttacatgatcattgtcgatgtcattataacctcctaacttaattttatgcgatgtccctaatgttgatgctaattttcggaagtcaccaatcaagaggtgcaaagtatgccctgagacggatgctgggcctagatacttggggtatatttttgtttaaagacgagaatgcatgtggacaacttataaattttgagggtcgttgtcggatatatgggcccggggatatgcaaagtgagggaaatttatcttcccatccagccgcgtggccctacagtctggtcatacccttggacctcgcggatcgcagaagcggccggggggcctcggggtgccacgtcatgcccctcgggccctcgtgccgccttgccccgaggccctcgcccaactgccatgtggcggggggagcgagcagggaggggacctaggctgaaccgctatcaatgcgcgcggcgccccaactgcccctcgccgcatttaatgtggtaggggcagacgtgcggtaccgcccgactgacgcacgtcagtcaggactgtccggtctgtgaccgacctgtccccagacacgaccgattggacgggcggctgtgcccccacgtcgcttctgtctccggcggagtggaggtaggtgtgacccgtcccatcggagtgtcattcggagctccctccacgagaggaccaccccaagtcttcacccatttatgagggaatgacagtgttgtaccccgtgtcacacggggggcggcgctgggtcccgctcaaggacggggtgcggcttagcttccaggcgaaggcacagatcatgattcgttcaaggtagggttggtccccaccccgtagaagagtaggtagaggcggtgcatgtggtatccccttgagctataaaaggaggaccctgtccaccgagaaaggggacgactcccagtaagcctgagctctaggagaagagaagcgggaacgctctccggagtttaggaacccttgtaacactcaaccttaatcccacacacaggagtagggtattacgctccatagcggcccgaacctgtataatcttgtcgcgcacacgctacctagcagccttcagggcggatacgcaatttctagaggcaagctccttcctccggccgaactgacaaaagggagatctcacgatcttccgctagagaggatcactcctcgacagtcgttaacatacgcaacctttgtcctaaaataattactccttccataaaaaaattataatcttaaagatgtatctggacatatataatgtccagatatattctaaaattggaacttttttttaacagaggagtacatttgtatcatttaatctaaaaaatgtagttttattgaggtgaaatactgcatttcttttaatcaagaatagcaattaagttggcttatggtctcaaccttcctttaaccaagtgtacgtatggaatatgcgcatacaatgcggctattaaataggattatcatggtaaattatatttgttgctaatctgtctttaatttattttgaaatgtaattattttgtgatatagtagcacgataacatttttcatactagtgaaagaaaattaaacaggcatatgaattaaaacttgttagcggagggtcagccggcatccatatcgaattatcaatcgggactctattacgagggtttagtgtcccacgggggatggtgcatgccgggatgtcgcactgctagattgaataatgtcccttgcgcagctctagctagatcgatcacgtacgatcggtacgtacgcacgcgccgcggcagctagcgattcaaccgttccccaacctatcacgcttcacgcctaggtacacagatcaacctgcgggctgagggtcgcattggatcagcggttatgtagaaattgcatgttgctactgtagcggctggctgctatctagtcacaccgaacaggcccgtagtaggtgtcgcctcctccgcgcgcgcgcgcgccccactgtgcagcgaaacgtggctagacgcacggcgcacggcacggcacgtacgagaaaggccacagctaaagccattaggtcgaggagaaccgcgctaaaaccccgccgatctcatccgaatccaaccaaaggaaacaccacgcggcgcacggcgcaccgcgcaccggccgtcctgctcctgcactgcaccacgccgatcgagagtaatcccactcgcccggacgtgtacggcgccccgtccccccatccttatctcgtcgtcgcaagccgcgcccgcgcgcaagcacgtttttctactgcgctagtatccctctccgcgtccagtactaggtaccctgcggctagatcgttacatgaggggaagggttttttgggctcatcctgcatgtacaggcagcacgcgcgcgcgagcccagccgcccacgcatgtgttcctccctatcaccaaagcaaatcgtacgcgagctttcgcttttgtcccttttgttagttaatctacctactactacgagctcttccttccatctactgcgtgcacacgtaagcccgtacgttcacatcacatgctggagccgtctgtgaacagattaatccctggagtttatctggctgacatggcggtagttagcgtacagatccatcatctagacgctctagactctagagctcatcggtcctgtgaatgtgagcgatctgctagcagaaaagcgttgggctctagctagctttccgtcatcgtcgtcggcagatgagatcattgggcgcgccttgcatatttaacttgactccggtttggttcagcgatttgtttaagacgcacttttgacccgagagatatgcggggtggtggtggtggtggtggttgccctgcttggagctgtacttgcgccatttcttttctcctttccatgtgaagtttgttttccacagacggattcctaaacaatggggtagtcttacaaattaattctctggtatttggtgtagtatatcatcagcctactgattgacggtagctagaacacctttcagttctgctttgtgcgtgtgtactggatctgtttgtgaatcactttaatttcggagtttcaatagacaatcttggaggagttaattgttcgcacgcatgaacatggagattctcgtgtagtctttttgaccggtgactacagcactgtggctagttgtagtagatagcacactgttcttgtggttgaacataactagtgtagtgatctgatggcctgaaatgtatattctgacttcagttccctgactgtaatctagcgctggcgagctaattaaagaacgcataggctcagctagcatagtttgattaagaagcgctcttctgacttttgacagtggactctgttttcttgtagttaaacgagacttggaacattttttttcctagttttgagatatagcacatgagattagtaggcactagtaaagaaagacaagccaaggatcctaagagataatctgctggtgtttggactttggacagctacacatgatgatatggacatgcaccaaactatacactagtacttgtgcgtgtgaagtacatgtatccgccactaccagctaaactagctagtgagccaagttagtgcgtcacgcgagaaacaatcgaaaacgtgacagtcacaacaatatggtaatgttaatgtactcggaagtgccaatctatggagcaaaatgtagctagctgttgttgcaacgattgcattggacgcatctacctactatcgtagaaccaaagcagttttagttaagatttcccatgacgcattcactcgtccaggtactagtacatgtttatttcctcgtggtgcaactagctagggccaacgaggcgaacgtgaactgtggtaactaaccattaatttgtacatgtgagacggttctcttgataaatcagagtcagattcaaacagtgtaaacactgtaggctcgttcgtcccgtcgtacaacggatcacaataagcttttgtgaagggcgccgacgagacgaagagtggctagtaaacacgtgctttttttaagccttctgcaccggccgcccacatgaaacctgatgatataggagtaacgagtgtaaacgacatggttctcaaaaaaaaaaaagtgtaacgacatagcaagaaccattgtgttgtctcgccaatcaataataatgccatggagatgtacgcagcccctaaccctaagatcacacatgcgcccaccaagtttactgaaaaaacgcaaacacacaggcgcgcgcacacaagtttaattaggatttgtcttttttacaggcctgtagattgaagttagttgtgtacatttgtgaatcgatagatgattccacatatatgtttgttaatgttttgagaaatttccataaatacagtatttgggtagcatgcaaattaaaagatcgacaaggacatgcatgcaccccgaggtgtacagtagcctagcatgtgttcaagatgtgtgaaaataaccaaataataaaaggatgcacttctagaccagctacctaaattatttcaactagaaagaaagaccgctaagatgtgcgaacaatttatttattgattataaaaaaatcaaaaaaagttatatctcattatattcactatacgaataatagattatttatatcatgaaaaagaacatagactctgatatactaaatgataatatctattatattcaaacaaaaaatcactttatcccagttatgtgtaaactcgtctatcaccattcttcgcaaacatataagttaatatatattttttattatacatttgatccacctgtgtatgtacataggtaatatacaaaataatctatattgccaaaattattgtgctaattgttaattaaaagggatataatattgtggctaccacctgagtaacctaggtctcggtgttcaagcatgagcgaagaatgcagcggcagacggcatcgtggttgagcatgagtggagcagatggtagctggcggcatcggatcatgaatgggagggagtagatgaggtgatgaccgttgatgttcgcaagagagctggagaagaggatgcaatggtcgacaccaatgcggcgatgcgctggaggtagcggtcaatggaggaggcagggaggtggtgtacgagcgtacgagggagatcgggaggtcgctcaatcggaatcgggggaaaggttgatgcaaaattataatcttaccctcccacgaccaaaacacgattggtacacttgctctcgcatgggcgcaatatttggacggtaccgggctctttgagctgttagatcacgcgtaattaacggtcaaggatatggtaccttctcccctaaaggattgtaaaaagctcccacacacacatacacacacatatcatctccacaaatttgcacaaatattaaagtacaggtgaagtatgctcacactgcttatttattcatccactttctctaggatttttcatttttgtagtccacgttgtacccatgattctcatccgaactccacaattttaaacaacgaacacgcagcgagcaaattggcacttaaaaaagtagttaaaaacaaggaggtcaggtactcactcgggcacatgcattagaatatgatccatttgtgccgaagccgaaccagcgtgcccatctgcccacaccaccggaaaggcggaaagcatcccaagggcaacacacgcatatcccaccccgaataccgagtaagatcgcttgtcccgttgccttgccagccgcgtacgtggtcctccccggccagccaagcccaagtcgacgtttatctcgacgggcgatgcgcgcgccacaaaatctcggccaccacccggccgctttcaatagcagcaacaaatcaacctgattctgcccatagggagatagagatcgtctcctgtctagtactactcgtactactagtatagttacttcttggtagtacagacgcaaatgcatttggacacttccttcctggaagctgcacgagccactgttctacttgggtgggtcaggactggatcagagataagctgttggcttctgggggcattgtattatctgatttctgccagccaagggtgaagaaacatggtaaaaaaaatcaattctgattatattttttatggaatggaggaagtagtaagcaacaaaatgatacaacagttaaaataaaaagccgcgacagcgtacaactatatggtgatagcttttccattagctcatactttctccgcgtcaaaataaaggaactagtatcaaattaaacacaacctaatactacaaaattttaagatgaagagagtaaggtttatggtgttggtcaatcatcaacacaggatcacaatagaaaggaggttcgactccctcgatctccttgtaacctagcacttgtggctagaaagaaacactcgtatcatcaaggggatacttttcacaatggagacagtggctaatcgcattgtgtaaggagagttttgggttgctgcattatctaatcctctaggagatcttttttggcacttacccttttattccacaaaaatccaatcatagctatgaatatgaacaagattcgtagctagaattagttttttttaatggagtagtggtcattggctctttctccttttctcattttttgcttgttgttcttatgagtctggttccttttcctagtctatttagtgtgtcggtgtgtccttcctctcctttgtaacccatgatctacattagcaggttgcagttacaaaattcttttttatgttaatatgccaatgcgtaaggcttttacgagttcaagaaaaaaaattacgtggttaaagaaaccaaggcccttcaatctttcatttgcccttgcccactaaatttcttcagtgtcggcttattcctaacgcgcaactggtgttgccaatgcagatgtaacaatagttcatgatgtgtatctctctctactccctccgttcttaaaaaaaaaaggtaaatctagaactggatatgacacattatacgtactataataaatctggacagatgtatatccagattcgtagtagtagatgtatcacatccaatactagattgtttttttatgagacggagagagtatttcttagcgtagccgtaagcctttaactacagcaccgtcagccatggagaaattacctgcaattcagcggtaggcctcgcaccacgcgctcgctcacacgatactgcatgcattacattatactccctccatttcagattataaaatattttgactttagttaaagttaaactgtttcaagtttgactaagtttatagacaaatataatgatatttataataataaattagtttcatcgaatcaataattgaatatattttcataataaacttgtcttgattgaaaatgttactatctttttctacaaacttggtcaaaattaaaacattttgattttgaccaaagttaaaacgtcttgtaaccttaaacagagggaatagtattctcttcctaaaactcaacctaaatactccctccgtttcgttttatttgacaccgttgactttttagcacatgtttgacctctcgtctaattcaaaaaaattaaataatgattaatgcttttcctatcatttgatttgttgttaaatatacttttgtgcatatgtatagttttacatatttcacaaaagtttttgaataagacgaacggtcaaacatgtgataaaaagtcaacggcgtcagataaaacgaaacggagggagtatgatgtcacctccccgcaaaaaaaaatgatgtcacctatcttcaggttaagtttttttcctttttttttaaaaaaaaaggaatgaaggaagtaatttgcattgacccgatcatctgtcgcgcgcgtcaacgccgcctcttaactcgaccgatgtgtgccatgcgcacaacggaaaatcggtgaccgcttacaatgcaccagtcgtcgttgccccagccgatcactcgctcggtcacatgactagagtggcacagctgcacgtatgtgtgctgtgtgaagcgagtcaggagtcaaagtcttcgcgatgccacttgttcttcttgagagttcaggaagagcagtttccatgtgatttcgcctctatagtacggtgattcttgacctcggaattcgtgagggtactattcagtctcggtgcacacagcggatgatcgtgggaatgcaaagctagcaaactgctctgtcacatgccagcaatgtcatcccaagtattgcatcaacaaacactcccacatttctttcacgtgatcctagcgtaacgagccgcggaccgtcgtttctggaaccacctgtttaaatatagataaaaaaaaaactaattacacagtttagatgtaaatcacgagacaaatcttttgagtctaaggggggtgtttgggagagaggggctaaactaaacataagtctctaagggagggacttatacttttgtgagagggactaatgtttagtccctagttcctaaacaccccttaattaggccatgattaaacataaatgctacaataacccacatgtgctaatggcggattaattcggctcaaaagattcatctcgcggtttccaggcgagttataaaatttgctttttttattcgtgtccaaaaacttcttccaacatccggttaaacgtctgatgtgacactcaaagattttcatttcaccaactaaacagcccctcctaagcaggtaaacgtgcaagacctggtaaaatgatattccatccgtcccaaaaaaaattattaggacagtaattaatcggacagtgaaacggactactaacctgtggccgtctccagaccagctgtcaatcataagagctgtccgtcctacgtggaggacgtactaggcagccgccgtgcttgaacagactagttgacttggatccaacagatagctcacttttactggaatcatctagctttcccaaaattgtcagcataattcttagctttctcatttccgccgtcaattactggtaattaagcatgcatgggaatgcagatgggaatgccagtgagaaaacatgcatggcgacatcacaacatgaaagcgaagtctgctgggatccaatcatctttccatttggtgggccaaagtagcgttcaccgttggatagttagcagattgttataattactcctgttgttgtgaagagaccacaacagaagtcagaaaagaagggaattaatctaagttgtggttgatcatcgccgtcaggctcgaagcaaaatggtactacatccaagtatcattttccatttgggtttcgtctccacctccaaatctccaatgtactcagtggacatgcgctgttactttcttcgtgccttttgtttgataatttcttcatgctatcttttttactagtcccgatagctttacagttcaataaacaaatttcattatactcgaattggctgattttgactgagaaaaaaaatatagggggtgtttggatcatatggattttttttagcccaccccttttagccttaaaatagctcaaggggatccaaacatgagagctattttagggctatttgcaaatagcccaccccagaaaattatcacccccaggggtgctaattggggctatttgctgtgggccccaccgattcccactttcccccacttgtgccggatccagttgcggcagaaatcgtcgctctcacccctcgctctcgccctcgctcgctctccagaaccctcgccgccgcccagccagcttcgcctccccctccccccacccgcgccgccgcccggccccagcttcgcctccccctccccccacccgcgccgccgcccggcccttcacccgcgccgcctctccctcgaatcgcgccgcccttccttcagatccaccgagaggcatccacgccggcgactcaccccacccgcgttgccggccatcagatccgtcgtcgacgcatcgccttgcaccggatccgcgcggagatggaccccaacggcttcgatttcttctcccaagatcccatttcgtccgccgccggcaacatttggtcgtcgcagccgtcggcgtccggcccttcccacggatccgttccccgcgccggcgtggacacgctggacctcaacacccaggcggcgtcgggccaggagttccctcacctccacgagtacggtgccttcctccagggtggcggcgaggaaggagctggccgcggccgaggctccggtctccctcccatccgtgcaccacgctctctgggagtgagggctggtcgagggggcgccgggccatctcgtgctgcaccgcgtgcccgccagctcaacttcggcgcggtaggtggccgtgctggacacggtggaaatggtgggtcgtcgtcgggcatcggcggcggcggccctgggcgaggcagctcctcatcaggggcaacgggtcgccgtcggcagcgcgccatggcaaccaaccgtggccgcgaccgcggacgtgggggccgcggttggcgtgtgccgaggagtgtcggcacccaggaagcacccatcggcgattacgtcgaccttgacgaagaaggtgcatgggacgatgaggtggaggaattaggcagcttcggcggccctccggtgagcattgctgaccgagctaactggactgataggaataatagtattttgttagcattgtgcatagagcaagtaagagcaggccactacaatggtagccaaatgaattctgatggctataatgctatagccgagggctaccatgccaaaa

SEQ ID NO: 55400 - DNA, 1008 bp, Oryza sativa
cccaatgtatgagggtttgcacggaacattgaactgattggggatttttgttttgtgggggttggaactttgattcggtgcagccgatagggaggtgaagaagagggacttcaccaagctagagctgaagccggatcacgcgaacaggccgctctgggcctgcgccgatggccgcatcttcctggagacgttttcgcccctatacaaacaagcctacgatttcttgatcgctattgcggagcctgtttgcaggtcaacttcagtcacctctagcctcaacattaaccttagtaccttaattgcatagtaggtttggactttcctgagactgaaattgcatccaccaagtggagtttagtccaaatctcaatatcttatacacttagaagccactaagttattgttaattctctcttatcttgtgaagtcacatcatctcaactgtttttagtttttttttcctttttgtggtttatcaaaggttcagattgtgctcaagcacaaagcaaaacctcctagctacaaaacaaaccacctcacatttcatgtttagcattttggtatgcaaatttcctgcagcattcatggggttccatctatgtggttgatttcccccaaaattagcatggtttcagcattcatgttggaataggcttgtttttgtcatgcagtgaaacagaagttgaatttagtgatattatcttcattgagagctgtggggatcatatcatattctgagggtttcactactttatcttttagggactttggtactgccatgtgattactcaatttgattttctgtgaaccacttggatataatttgtttagaataggttaatttgtttggaatttgaggggaaaaccaatggtttgtaatggaactaaccatgtattacttgaaaatggtgagcacagctatgtgataggcatatcattgtgccattagattgtttgactagatttaatatgccccatgtggctatctagaacctagagggctgcagg

SEQ ID NO: 55401 - DNA, 3269 bp, Oryza sativa
  unsure (1)..(3269): unsure at all n locations
atcaaatatttagacacatgcatgaagtattaaatatagacaaaaagaaaaactaattacacagatttgacaatgtgatttgacaatgtgatgctacagtaaacatttgctaatgatggattaattaggcttaataaattcatctcgcagtttacaggcggattctgtaattttattttgttattagaccacgtttaatacttcaaatatgtgtctgtatatctgatgtgacacgacaaaaaatttcactcctacatctaaacacaaccttactcatgttgacaatcttcccagtttacacgcatgtcacatttttgcagagggagaagttggaagtacctaggaaaaagtgttagggtctgtttggataatggaaaatgggggatgggattgggattgggaaataaatgaagggttatgattaaatgaaagagggggaatgaatggttaggatttaaagatgttttttggtgggtggaaaattatttaacatttccattagacaaacattgcctcggggtggtcaaaattacaacaaattcaaaaatacctagtctaaaatgaaataattgaataaatggattgccgaaagttaaatttcggtaataaaagattgccaaagtgtaattcacatcgtaaaatcacactttcctaagcctaaatctgtagtactacgtaaagtaacaaaaaaaaaagttgtactccgtatggattgtgtaattttacttcttttgactttaattttgttgttatatatgacttttatcagtttgaatttttttcatgtattttttttcaaaaattaagaatcataaatttatttcatttaattttataatttttgtatggttaaatatcttgttcaaccatttatatgggaaaaaaggagaagtagtgagataatggcattttggtacttttgaaatatgccaaggatttatagatagtctccgagtgtgtgagatagtagtcatattcttctatttcattttatccacatagtatatttgtttccttccttctatttatcatgaattcgcaactctcaggttaatccattactaaagagcttattcaacttattcatataattgtttactcctacttcaaaaaatacatttattcatttntaagctattggttaaatttattttcaaaagtatttgatttattccttttcgaacggtcaggccgttgccgacgttttatattaagaagaaggtgttccattttaaggagaaaacaggaccaaaccttacagtgtctagttaattaggaaaaactgagcgaaaactacaactacaacaccacatcaatagctaacctaacttacactaccatgacggagcccaacataagacatcggtcaagcttgccatagaggcgacacggcaacccacacatgttatcattgccaagcttaccacccaagcgacacatcagtttcgacttcactgcaatgctaccccaacgccaaataaacaaacaaaaacgacacccatgaaggacatcagcccaaattcctacacacagttagcatcaacaaccctataaggagatcgcggtgtgtgtcatcgttgccaagtttcgtcgcacccctacagcaaagcagctccgactctacccagtagtaaccaaacaaggatgatgaatacctgccacaaagcaagaaatgaaaccaaggcggcaaaggcctcgtcaaacacactaggcttgtagagcttcaaaggcattgcaggagcccaccaatggctaccgttgcacgcggaaggttcttggtgctaagagaagtcaacgccaaaacgacacctccaaggagggaaacgacgcctaatggtgccgtcgttgtcataccggcccatgccctagcaaggctttcgccagtgattcccaatcaaatccctacacaactgtcctgcccaacgaccgttgttggaccaccacgctatcccttcagcgcccctgtgcgtatagtaaagtagataatggtataataaagtagataatccgagacgatagtttgtccaattatctaaatcgaagcatgtgaaccgtattccagcttttgcgtgattgaactccgaaattaggcgaatcatattgatttcagatttgacaggctagctcaaagatgtttattaacgtgtgcttctcgacgccactgtcagccgtttggggtcgagctacaatttgagcaaaggacaccaccggcctttgttgtttaactgacagtattaatacgagttatttaatgcatagatcaagagattacatgcctcccatagttccatcgacagtgatactaactatgagttaacaattgaaccagaaataagggccctttaaatcaaaagatttatgtaaaaattttctaggattctttctatatgatttttttatttggccctttaattcaaaggattgaagcttttcgaatcctatgaaattcatatggtcatgggtagcaccttaggtcttgggtttaactcctcatgggagcaaatttcctaggatttaacggcatcgtgctttcagtggtaggtcaatctccaggatttgtcggccaagtcttcgaagatactcataggggtagcgcttacgtgcgtgcgtttaggttgcgtgcgtttaggagtgaatgtacgtgcgttgtgagtctctaggttatattgcgtaattctaaaaaaaaaaggtaaaaatggagattttgtggtaaataacagaaaatgatgttccctgccgatgtgaccaaaaatacacccatcgacatttcgatgcaccgatatgcttggttttaagttattacaataaatacacctacttaacacccacttaccaagctcatgccatgtgaatgtgatttacttcttttgatagaacaccttttctgattctacatcttttgcaaattacaatacttaacatccacagatttttgtacagtgttatgttcctaaatcctaatcggtcatctacttcaacatctactcgtaaatcctctactactccgtaggctgtagaagttgaaccaattacccgggcggccggcacgttccctaatcgcccgatctaaacaatacacaaaaaagtctcgacccgtttcgccccgaccggtcgccgcgccaccacccactccccctcaaacaccggcggtggtcatgccgcctccgcctcctcctccgccgccgccgccgccgtctcctcctcgccttcctctcaccgcccaccgcctccctctcccgcccgcgacctcgccccccgcctcgctcctc

SEQ ID NO: 55402 - DNA, 3586 bp, Oryza sativa
cagcagtaaggaagagcctgcacaagaagaatggaattcggaatggttttattgtgccaattgggcatggcggtagcgagggaggtggcaaacgagaagctgtttccactcgtgagtatccttaattttccttgaagctttgattctagtatttgattatcttagtgctataatgtgaaaaaggttgatcactatctttgtgaatgacacctaggttaggtagtatttgattgcacttagaaaaagtgcaggatataaggtagctctaatcttcttatagtgttgttgtttttgttatgtctgtgtctaggcaaagcatttgagtgttcacttagggtcgcaatagagcaagtgtagtgtggcggaggtaccgatagaacaggatataccttcagttgatttgtgcaaaactgatgatttgataaaataatatttgccccaacacaaggagcaaagttgggaactatttttcaatatagtatattttttctttggtaaatcccatgtacatgccctttgtagcagaaaactacgggttcacaaatttcacataactacatggagcttgatagtactattaagtattaacacaaaaacacattgtttgatacaggatttgtgaaatttgatattttctgtattataactctcaagtttttctaacaattatataatactttctcagccccattggtggtttcatgagcaaaatgtttttttttaagaaactgataacaattgtttggtgtactactttgtatttaaggctaatatttgtaaaggatgaatggagctaaataattgtctctgcaacatgctgatattttttttaactctaacatatctggttgttaaagtccacttggattttgtttgcaaccttgtagttcaaactgctaccttattccttataatcatgatctgtacaattctatcgattgatcagtaacttttgatggagttaatgaggaataatgttagaattttctttctgacttttgtgcttttagctacttgtaggtgcagacataagttgcatggccaattactagggactgtaaaactataaatttaacaaagagtgcattatatatattttgtctatggctaattttacaacaaagcgaagaaagagaacatgaaaagaagggaaacccaactgtgtaaaaacctgtgatcatgttttctaacaactaaaatcgctgtttatcaaccactcacgacgacaccgagatcttcgacttagctcccacaggtcccaggctcgtcaccccgggaactcgcagcccatcacaactactcatactaggagccacctagctagaatagaaggaagaatctcgtaaatctagactatgatagtgtactcaacttgcagttttccaacagtattaaccatttgttaaactgccttcatcagaggatctagattcgatcacacaacccaatcatatcgcaatacattattctgaggtaatacttaccaatcgatgtttggtttctttcagttgtgtcaatttacaggcatgactaagaacaaacttacagtagaattgctgctatttttgggattagttggttagtttttactatgtgcatgtataggctatttgcttgcacagacttttcagctgcatttcactaaatcaactaatattagtccaaaattactctttcaggtaagctggcaactttgagagtaaaacagacttcagggagctatttctctttcttttcctcatgtagttctgaggatcatcataactcacaaggtgccgtagaagtgaaaaatgtagtgaaagttgtttcaatccgtcctctttccaaggacaagtttttggtccttgattcagctggattgttacatgtattcagtcttcaaaacaaagaattgctctcagaagctactagcaagagatatagtggaaatcacacacactgtttggataatgccatgaaagtgcagctatttgctgtctttccaagtagctctacaagtgagtttttcatcctggatttgttgtttttgcatcatggtggtttacttcattaataaatgtgttcagagtgcttgtgcagagacagaaattttggatttcggatggtgggcattccatacacataatgtcagcacttgatgttgaaccccccaacagtgataatggaggtggtgatggagaaagagaatcaacaaccattaagctcacaggtttgtgtcgtaggtccttttttttttgtaccttaggcctttatttgtcctacctgctattttcaatcattcgattattagctcaaccacatctttagaaactgctcagataggcaagtttctagaaatttctaatttatcatgtaggtttcatattttattaattgtttttttaaaaaaaaattattgacctgttgtgttacattataaagtcatcccaggccattaaaaactgagtagtgttgcctattaagtcatgcgtgttggttaagctttccccagttagcatagatgtgcatgtttaacatcatcaggcttgcaaagtaattgttttaaaaaaccagcataatgtatgaagccctctttttcccattgactaaggtagtgagcttgtttgtttgtttttatcaggccatgatctatcatttatgttgtaactctctttctgtcatgttttttatcttgtgttttcttgcagctattgaagcaatctttacaagtgaaaaggttcaggacattgtgcctatctccaaggattcagtccttatccttggtcaaggtaatattcaatgatatcttgaagattgacattctagattgccatgaatctggatagtttgcttatcttcttctaaacctcctcctaacatcataaatattgtgtttgcaggcaacatgtttttgtatggaacttcttgaattttgttgattatatcatatattcggtaaatctatctgaaaagcttgatgtcattttagtccctttttgctctcattggtttgcctgcaccaacccacacattatctttggtatcaggtgggagatgtgaatgtttgtctagatcatgaatttgcagtttcgatgggtttttggctgaagacagggtgagtttggtgactacaaattgctttcaattatttaaccacttagagtacgatacttatttcttaaattccccccttctcttccatgatgcagtgttggagattttgaagaatgcagttgttcacctgtctttgaagtcatgagtatcattagtctttaatttcagttagcagatgaaatactcgagacttcaacagccagcaagagttgaaaggtgcaggccgttctccatcttgtcaactgtctgaaagcaacattacaaaactataggtctttcagcacagttcacaagccacagcaacttctgaacaggtgaagccagattattcccagaatacaaccacccagttgtttttgcatacacattttgcgtgccaggacaactgcagttctggttgcgatatctggaagaagataaggctgcaatcctatgcccagctcagctgttgtggaacgtggatcatcatcaagtgggtcggttatgaagctac

SEQ ID NO: 55403 - DNA, 2845 bp, Oryza sativa
ccccatggccatagaaattgtaacgctcccttttaaattgctagctccagtggcctcatatttcaggtgggatatcttcttccagcatcagaacgtactgtaccaatcatctgcacgatcgcacattcacaatggactagaatggcagcaaccatcaacccatcctttgttcgcccagccgtcaaatctcataggctgttcactctgaattctgaaaaccttacgacggtttgacaaaatttctcaaacaatctagtatatatatacttcaggtggaatctcctccctacatcatcagtagatcatccgaactgtgctgcaagcccgaaatgcatcctaagcttaccacagctgacaaatctcataggctgtttgttcattctaattctggatcctggaaccagacgactgtttgacatatgggtccccatggattgcttacgacttattataagccgtaatgtcttattagcaattaaaaaaataatatgtgagtaaaacttttgtatttatgttcttagagacttaaaggccaaagctgaaaaataatacgttgaataaacatcaaaatcaaattcaaaattaagttttaaaatttaaattttagctttggcttataaaaggcaaaggaaacaatgaagcccatagcccgttaggagtactatgctttccttctcacgccgcgcgagagaggggaaaagccagtgaagatggtggccatggccggcggcgacggcgcggggcggcgtttttcgccgtcgtgaggtgctgctttgtcggcttctctccgcaagacgctcccggcccgcatccgcgccgctccgcagattagcgggcgcatcggcaatgcctgtgacgggggctgctaccccgagtgagggctaggtatttggtcgccgagaatgcttccttgccttgatcagtaactaggggactgggattcgggaatgctggtaggtacgttcttcgcctcctcccgggcttgctttttgtggagaatttccctaatctagtattctagtgataatatgctttaaactgtacatcagtacatgttgtcctaaagttcatattacttcctgcatctagaacaccctattctaaagtgatggatggttcaagtatttccctcttagataatcatgatttgctaccttaagttgtgcgtggcctgtttttatctcagagctaatctcgcacggcaagacctgattgaacgcataggcattagctatttatttcctgcctttcgagtagtaccacactagttcagcttctgaaagaaaagaaaagaagctgcaaataggctgggcactactagctttatcacagaatgtatgaattttctttcttgatgaaaaatgaaagcagtacttgtcctctgtttaaaaaaagttagcattatgccgttttgattatttcatgataaggttaacgttctgtatgtttcaaggagaaattcatgtctcatagtattggtgattcttcttttcagttgctgctcaaagtaataccagaatatgttgtcagtgatattgtgacatgttttttcaaatagtaagacttgagctctactcatcagttcatcaaggaaagatgggactatgaagactactctaagcaggtaaaagtaaggctgtgtttagatccagaggtgaaaagttttggcgtgtcacatcggatatacggacacacatttgaagtattaaacgtagactaataacaaaacaaattacagattatgtctgtaagctgcgagacgatttttttaagcctaattaatcagccattagaaaatgtttactgtagcaccacattatcaaataatggagcaatagacttaaaagatttgtctcgcaatttacacgcaatctgtgtaattagtttttttgtctatatttaatactccatgtatgtgtccaaacattcgatgtgacagggtgaaaagtttttgtgtgggaactaacagggcctaagccaaaattcaaaagctacctagctttgctctgtggcataacctgaccctgtatgcgaaagcatttatatgtcaccttttgctagttgattagttgatcagagcatttttgctgcaaaccatcttctcaagccttcaacagagcctcaacctcctcctgcactatccatagttctgcagtgatttgcatttaatgaaaagatatgtctattcctctcttttgattcattacaagcgtgtggctcagatttgcaatttgcaactgatactacttacataaagccttttatatggacttgtcaattgtaaaaacctattataattcctcagagttcttttcttctgaaccattttgattagtttccagatgcactaaagagggtatttcaggatatttcaccaggtgagctccattgcttccacagagagtagtaatttgacttgatcttgtttaacttgataactacttcattcattggaactctgtcatcaggtgcatctcttgagcaaagcaagcccaactcaattatggatgctagacagatattcaagatgattgaatcctcagatagcttactcgaatcctcagtaccacccgtatgaccatcttgttgtagactacagtcggcgacatttgagagctcatatgggaatgcttgactaatccattgcctgaaggtcaactcattgacgaacattggatcagttggttttttccttgtgaagacttcgaggaggacaattccgtagctgtatacgtcacttctgcgtgatgcttttcctgttgatcctaactctgtttgcaccatgtcaaaagagaactggtcagcttaagttagatgaaacaagaatacagattgtacagacttt

SEQ ID NO: 55404 - DNA, 6031 bp, Oryza sativa
tccttggctcggaaggccacatagtgccttgtttcccatcaatgacttgacagtgatgtttgagaacacacctccttctggtatctgaccctccagtctattgaaagataggttcaaattggcaagataagtgagattggccaaggactttgggatgacacccgaaagcacattggaggaaaggtctaactcctcaatacttagtaacttgccaactgaatctggtattgaaccttggagtagattactggatagattcatatagatcatcatctggagttcaccaaaagaaaatggtatatcacctgatagctggtttcttgatagatccatcttagtaattgctgtcagttttccaacatcagcaggtagagaaccactcaaagagttctgtgataaatcaagctcaataagtttctgaagatgccacaaactaattggtattgttgaagacaacgagttttgggacaataccacaacttgtaactggtttaggctaccgatggtacttggaataggactgacaagttgattgttagcaagattcagcttaactagacttgttaatccagtgatttctactgggatggtgccagacaaggtgttgttggagagattgagttcttggaggttgttcattgatgtgatctgcgtggggatcatcccgcttagctggtttcctctgagagatagcatcagtaggttggtaagcttagccaatgtactggggatgcttccagtgatcctattgttgtctgctacaaaaatttcgatcagtgtgctaaggtttccaacacagggtagtaaactcccttcaaatctattgtatgacatgccaattgtgttcagattactgcaatttgataatgcagctaggaattcaaggttcccactgagctggttcccatcaacatagatgtcacgaagattccacaagttcccaaatgacattggcaccgatccagttaatccgtttacgaacaaatctattgtggtgaggtcagagattgcctatagattcgggaatggtacctgttatttggttgtttgcaaagcttatatacctgaggtttctcagctgtccaaactctggtggtatttctccctctagattgttctcgctaaggtccaaagcaagcagcccagtatgattgctcagttcaactgggatctttccagtgagctcgttggttgacaagtaaattgcagtgaggtttggcattgtcgccagccatgatggcacagaacctgtgaaattatttacagctagggagaacaaatcaaggttttgacatttggaagggcccgatgggataggtccatcgaaccaattttcaccgagagagaaaaattccaacatagggaggtgaaagctctcgtttccaggaatcggacctctgagatgttccgtgtgactgctatggcttgcaggtaggacatattgaagatagcaccaagcatggagcctgagagaagattattttctaggactagcatctccagcttcgacaatgatccaacgctaccaggaattgctcctgttagcctatttgacccgagttgtatcctactcaggttgggtgtgttattgaacaggccttgtggtattggtccgctcaagtcgttatctgacaatcttaatatctgaagattgttaagatttgccaactcttgtggaatccccccaaagaatttgttgctattaagataaagagactcgagccttgtgaggttgccaaggatggaggggatggtacctgacaggctgttgtatgaaagaacaagagtttgcagtcggggcagcctatcgagctcggttggcacaggtccgatgagggtggtgttgctgagtacaaggctggagaggaaggagagattgccaatctgcgggctgatggttccttcaagtgccatgtcttcaaactcaagcccagtgacccacttcccgctgctgtcgcatgagaccccaatccatgagcagaagggtgcactggcagtccaattgctggcaaggatgccattagggtccttgacttgctccttgaagtcgagcagtgcagcgaggtctgtgttgttgtatggaggggtgagtgaagtggcgcatggtgccaataggatgaggagcaccatgctgatgcagagaagagccatggtagtgaaggaatgaaggttgatgatgaggatacacaattacgcatgagcagtgtgctggttctattggtggttttattggaagtgtggccgtgtgggatgtgcaattgacatgtgcattgtgttgaatggtcaaaaagttgttttttttagtggaaatatgtgtgaaaggaagaaagcgttttagactttttcgtttgaaaacaaactttcatttttcagagctggttgtacactgcagtttcttggtacacttcaaagtttcaaaatagaaagaaggaaaaaaatgaattccttccaagaaacaacctcttccagaagtcaaggagcaaagctgtaggagtatgtcatttccgtcattgatagcttcgttttttttctgttctgtttttaataatagattaaaacccggtctctacaccaacatgggtgtacacagccaactttgatgcttcatgcttggcgccagtacttatgtttgtttgattttccaagaataaaacatctggtttaatttttttttcagaaaatcacttaaatagtcgttctacgctagctagatttttttttaaataaaaactgggagataatctaactccaagtatatttttttgaaagcaaactccaagtatattcatatgccatttccatctttgatactatcttggtatgcttggcaccattacttatgccttttcttttcacgaatgaaacatctggtgtgatttttttcaggacaatctttttaaaagtttgttcctggctgttgtttcaggtatcaaagaactgtaaaaatactgaagcgcttctatcctagagatccatttcttattagggcccgtctagttacccaaaattttttttccaaaaacatcacatcgaatctttggacatatgcataaaacattaaatatagattaaaagaaaaactaattgcacaattatgggggaaatcgcgagacgaatcttttaagcctaattagtccgtgattagccataagtgctacagtaacccacatgtgctaatgacggcttaattagtcttaaaagattcgtcttgcggttccgaaatccccttccgacatccggtcaaacgtccgatgtgacatccaaaaattcccttttccccaactaaacacacccttaacccttattcagcagttgactaagagtctaagagaagcaacactttccatgtgtttggtcaatcctgagtagactatgctctgaatcgtgctcaccaacgcaccatttcacaccaaccgccatttcacatgtctattattgaaggcggtcaggttcagcgaagcaagttgatgatagtcgctcttccccatgctagactatccatatccatggagccatcaaacagcgtcatgatcactgataattgatagtagtacattgaatacaagagaagctgtacgtgcacaacttcccttccattaagtatttaattgcttgcttgcattgtttgcttattttctgtacgatggagggtgggctgtgggcatcatgatggaatcgtggacctctcatatattgttgggttaactgaaatttttcagtggtcctttgaaaactagtagaaatattcattgcgttctttggcaggttattggaggattaagccctaaacaactctctaacacgtagtatattactttttgttagatggctgcaaacctgcaactcaactactgttacaggtatcttttcaaggaaggctacagctttcatgatgcagttcagcatttgcaaccaccacagatgacacatggccttgccagctttgggttatcatctgcagggctgcaggacaagactatctaggcttgtaatacctccttgatccgctgcagtttcacagtcacatccttcatcgtcaccctgtcctcaggcaagtctctggtacactgcagccccaaatccagcagctgcgctaagcagctcctgctgccggttgattcaccttgggcatcatcgctgctcaccgtgtcgtcatacagagagatgccaggatgtacgacgtcggcgagccttgacgggagcgctcggttgacccactccctcaagctcagctctccgacgaacatggcgtcggttggcttcttccccgtgaagacctccaggagcatgaccccgtagctgaacacgtcgctctttcgcgatgcttttcctgtcgacccgtactctgtgatgttcatggtaaacaaagatcaagggggatctgcagaaattggcgatttcagtggaaccaaagatgaacggtaaatcgacaagtgattacctggtgccatgtatccgattgttcctggcatgctcctggagaatatggaggtgtcctctcctagcaataaccttgcaattccaaagtctgcgatgcaagccgtcatgtctgcgtcaagcagcacgttgcttggcttcagatcacagtggaggactacctcaaagtgctcatggtgtaggtaagccatagcgagcgccgcatccaacatgatgctcaccctctgcatcaatccaaggcaatgcctgtcactgtacagcaaccattcgtccaggctcccattgggcatgtactgcagcaccaacgccttgaagtccagattcgaacaggtggtgagtatcctcaccaagtttcggtgccgagccatgcgaagtgcacggcactcgacttcaaaactcatggtagctctttccatgtccatgttgaggacttttatcgcgacgatctgctcatcgtctagattgcccttgaagactttgccaaagcttccagctcctagtaggtgatcactattgaagttgtttgtggcacgaaccagctcatagtaggagatagccctatggttgttgtttgactccaaactcatagtaatcggcaggcccttcagtttcttgccagtgcaaaatttaatcgaaaacagcaagcagattgctattattccagtagccaatatgcttggaataagaactacttttagaagccttgattttttaccctgaagaggatggtcatttttgcaatgggggaaaccaaggcgtggaagaccacagagtgctgtgttccctctcaaagattggagggtaatgtttgagaacacaccaccatttgggatttgcccatccaatctattgaaagagagattcagggtagtgagaggactaagatttgcaaaggactttggaattgttccagagaaggagttatatgaaaggtctaagtaggtcagtgtgctaaatagttcaagtgaggctggtaaattaccagaaaatcgattggaagaaaggttcataaatgttgttgctttcagattttcaacttctggcaaagagccagtcaaagcatttccagccagatcaagacccacgatattttgaaggccccataggcccatcggtactgctgaagtgagctgattatttgatagttctaaggtttgtagccgacttagattactaatgctatcaggtatggggccatggagcttgttgtaggcaaggcctagggcaaacagatttgatttgccaatatttgcaggaatggtcccaaccaactcattagaagaaaaatcaatcatttcgagatccttcatctctgtaattgataccggaatttccccggtaaatcggttgttgcgaagatccatgaacaacatgttgctcttatttgtcatatcagggatatttccagtaatttggttcttgaatgctcgaaagatctggagggaggaaaggttgccaatagaacttgggatgctaccagtgaagtagtttgtgttcatcacaagatacttaaggctcttgcaacctgacaggtcagccatgaaatcgacatccccactgagcttattctcgtcaatgtagagttcactaaggg

SEQ ID NO: 55405 - DNA, 4773 bp, Oryza sativa
gttaaatggtttgtgttgagattaactgtttgcagcatgggaaggttgaagcttccgttgtttgggatagagccagagagattgttcttgcccaggtacatccgtaccaagctggacatgttaaacagcgatgcaggtattggccctgaaagctggttccctgacagtacaagccctgaatgtttggcaagaaaccaatagcaccaggaatgctccctgttagtttgttgtaagcaaggctcaagaaaacaagctgtgacgtgccattgaacatgccacgtggtatctgcccgctcaactcgtttctgcttaatccaaggtacataatgttcttcagattgtgcaggtcgggagggatttcaccggtgaggttgttcgagtcaaggtcgaggatttcaagcacggtgaggttgccgagagacgaggggagattacctgagaggcggttgctggagagatcgagagacaggaggcgtggcaggttgccgatgccatcagggatcgggcccgagagccgggcgtcgctgaggttgagggtggagaggaaggtgagctcgccgagctcgggggccagcgagccggcgagctgcacgccgggcagctccagcgccgtgacgcgcagcgggtggcggtggccgccgcaggtgacgccgagccagccgcagtagggcgcggccgccgtccagttgccgcggcggagcacgccgctcgggtcggacacccgcgccctgaacgccagcagcgccgacagatcgtcggccgtggcgaacgccggcgcgcttgcgagcaggagcgcagccatcagcacggcgaggtggaagacgacgaagaagaagaagacgagcgccattggcaggaggagagctcgatggaatcggaggtggcagctggctgaggctggtagctgtgcatggcgtggtggccaagcttatatcctgggagttgcgatagtggagactggagaagccagaccacgtacatcgggaagaccgaccagagactttgccccccatggaaactaaggctgcacgcaaaatgatgcatcgtattatcatatgattaattaagtattagcttttttaaaaaaataattaatataaaacatactgtttaatagtttaaaaagcgtgcgcacgaaaaacgagaaagctgaattgggaaaactggagaaggaatacaaactaaggatccctttgaatcttaggaatgaaaaaacgaaggaataagaaaaacgtaggattctagagcctctttaatttaaagtaatgccaaatgattttttttaggaatgggatttcaaaggatttttttccttcaagcctctttgatttatagaaaaggcaagtataaattccataggattgcattcctatgagtggattccaaaggaaactaaaaaagaggtaagacctcttggaattcttcctggtgcgaattcctttgttttccctatgcctatatcaaaggatcttcttacgtttttctctgttttctcttcccgtaggatttgaaaatcctaccatttcaaatattgtgtttttcctattcctgtgtttttcatatcctgcgaatcaaaggggccctaataggaatgcaagtgtaaaatagaggattgcaaaacacaggaatgatcgtttgaatgaaccgcggcaaaagggaagaaaatcggatgaaagagatagactaaaaggaaagctttcaagaggttggagctcttgttaaatttcctcaagaaaatctctttagaattatccattccatagaaattccaaaggatatgataggatttgatcatttgtttcaaagggtgttatagaaaatttttctgtaggattaaaatccttcaaaatttctatgttttttctttaaatcaaaggcggcctaaaagttgatgcgagcgagctcgttcacaagctgcttccctgtacgtgcatgttcacgtttgtgaccgtgatgaaagaataggcgaaagaggaaataataaatcttttgccgaaccgatcgatcgagagtgcacagcttaattaatttctttttgcggggacacagcttaattaattagcatgacatttttttcatctcaccaaagaaaacagtgaagggggaacgtagtacggaaacgaaattggcatttgttcctgtgagtgtacagcttaatttgctagtgctaccttgaatacacagcgtagtacgtcatgttcgaatgaaactcatatagatgaagatgaagataaaaattaagtattttatataaaatgagatgatatcaacgtatgactaattaagtttttttattacaaacttgagaaaatatatttatctgatattttagagtaatttttcatatagaaaaattttacatgaaacgtattatttagcagtttgaaaaatatgccacaaatatctaaatttctatctaacttttattggagaaacgtctcatgttattttttctctagttgtggacaaaaagaaggctacggacttgttaatgcttccaatttccaaagattagactagtatgaactaaaactgttgctgccttgtctatttttccttcgggggctgactggtggtagactgatagttagcgccccccactggacacgttcttgctggaaagcgactggactggaagaaacacgaccgctgatcacactggactggtatatctctgctgcacttcatggcatcgtcagtgtgaaaccctgaatacgtgtgtgactcataaagaaccagttgacgggctgggaattagggaaagagtcttgcggtcttgcctaatcgacaggacatcccctgtctagtttgtacatcgtttagagagggatgggagtaataataacgcatgactgtcacattttttgtccgtctcatggagttttcgctaaactgattcatcttctggtgctgcttgagaatgtgcaaacgtacacgttatggcggggaagacttgcaggtctcgcggaaaacatccaccttggcaatagggtttagttcccaaattatttttccaaaaacatcacatccaacttttatttatagacacatgcataaagtattaaatatagattaaaagaaaaaccaattgcacagttaggggggaaatcgcgagatgaatcttttgagcctaattagtccatgattagccataagtgctacagtaacctgcatgtgctaatgacagactaattaggctcaaaagattcgtctcgcagttttacatgtgagttataaaattagttttttcgttcgtgtttcaaaaacccttcccacatacggttaaacattcgatgtgacaactaaaccgaccctgctgtgcgcagatccaatttctctctgcagagaactgcagaatgcatgacatgctgctttaattttgtcaattcaaatacggagtagctaggattccattagcacatataaaaaagcagtatagctagttcatttttttttcgaaaagaatacaaacagtagcgcgagactactgtttgacaacagcacgaacagttactactagcatggaagagtttgtccctcgtccttttcttatgtttataagtatcagccaaaatttaaatttttaactttatatttagagttgattttggggttttacatcgaagtttattttttcagcttttacttttaaatcgctaagaacacgtatataaaaaatatatttataaattatttttcgtttgtaaatataccgtaacgatgtggccattcatttctgatggcatgaagatagggtggaaatatatgtttaatctaaggagttgaaacaaggtaaatatttgctattcatgtgagaattgtttcttttttccgtgtaatcatgtagctcaaagagagtggctattgtagtaagtaccggttctatcctaaaatatagcaagctaggatgtttagagagcattagtaactagcggttacaactacaagcttagcgcaaaaaaaaagttatggcaatcttttttttaacgtaagttatggcaatctctttgacatggaaaagtgaaggttcaccgccacaacacctgcagttttcggctgtggcctccgacacgggttatgcaggacgcaagaattgaccttctaagagcagttaaaataacactcatagcgccggcgatactgactccacgtaggtttgaggagtaagctggagggtgaatggaaaagagagagaagctcggtgactaatttacagcccggttgtacactgctcccaatattgctgctgctctcagccaattgcaacattcaagtgaagattttaaaaaaaaaaatcaaacctagccatgggaagtgcgtagagatgtatatataggttctgtttggggagagtttctagttgctacagcttctcccagaactagaagtttccccaaacagtctagattttggtctagattttaagaagctatagttatagaatccagaaaataaactaacagtcagactcttagctattttcagattcttataagctggttaacaatcagctgcttctcatgattttaacctccccaaataaacccgcactctattattgtattgattagcttgtgtcattcgctagaatagaatgatgtggttatttttggaggtaacaagtagctgtactattagcctagctgtaacgatagcggcctagtcgccgacgatggcggctggctcctccggcctacgggctcgcttcggccgaacgctacgccagtgaccgtcgctttgcgcccttgcgcccaccgcgtagcgagagagaga

SEQ ID NO: 55406 - DNA, 10482 bp, Oryza sativa
tatattacaaaggagatctcactttgagggcagcaaaattcattatgcgttgctttttgaggcatctaattcatacaatgttttttcgtctgattctcagtttctatgtcttcagtatcagtttcgtggaatatatatattgcacataacttcagtcctttgttcaataaatggtcacgcatgacacagtcccaatatgagtgcaccaatgcattatgtatctaatttagttgctaaccttgaggtcgctcatattgttcacaggttggattcgagatgattgatgttatagcagaagctgaaggtatatccctcagcagtatgcagttcaaggcaatggtaggaaaaggtaatattgacaattaatataattcttttcaactgatacatcttgtgttgaaagaagccatgctatctggattcccagagctgtactttgttcctcaagtcttgcacattaccttttcaactctaacaatatttatgcggttttcataaatattacctataaacaaatgctatttgtttaagatactctatgcttgaatattaaacatgagcaggtgcatatacttatttgaaattctgaaggtagtgctatcaaacattcataacagaaaataatatttaggtcgtattggagatgcccctatcatgctggccaagccacaaacttttatgaatgcaagtggtgagtctgtaagtatactgattccaaaacaaccttcactactagttgttccttcttttttttacctttttcgtttgacaaatcgagttatacaggtggggcagttggtctcatatttcaagataccacttaatcaagttcttgtggtaaagtgctatcctcgagtttctggttgctgttttttttaacagattgctatattttgattcttcattcattttttattctctgcagatgtatgatgatctagacttgccctttgcaaaattgcgtctactgccgaaaggtggacatggcggtcataatgggtactccagctctcttctacttcttttacaaaatggtcgaaactcattacctgcatgtgttaactcagtgattattttactaactttatgctgaagacctaacttttggaggtagataactctgaagttcacctaagcaaaaggatattcttaatttctcagctctcttctacttcttttacaaaatggtcgaaactcattacctgcatgtgttaactcagtgattattttactaactttatgctgaagacctaacttttggaggtagataactctgaagttcacctaagcaaaaggatattcttaatttctcatcatataccgttggcaccatctttctacttgtcctaatgcaatgcattatccattgttacttaagaactgatctaaggtgcatagttgtgagaaaatgcatcagacaaactttaggatgttcaattgtacatttgtttctcccacatcttctcttggggaacctctcatccatatgttcaccacttgcagggtgagaagcattatcaaccatttgaagcagaaccgtgatttcccacgtctaagaattggtatagcgcttctctcctttttcaactcagttaccatgtctgaaaatattcttgcggtgatatcttgcaggcattggacgaccacctgggaagatggatcctgccaattttgttctccgaccatttaacagaaaagaacaggaagaggttttaattagaatgctttcaagaaacccttttttttttcatatttacctcattttctgttctgggcatagcactgtttgtttaagatgtacacatctctttttgcagcttgatttcgctttccataggggcttggaggcagttagaataatggcacttgagggattcaacaagagcgcaacttatgtgaacaccgcacagtcctctgaaatgttgaatagatgataaagtgttcaatttattcttataacataaagattcttatgtcagatctgaatgtttcctatccagtagacacttgcacacatggtggtcattttactctcaggaaatcctgagctcccgaggacggaagagattatttgagctgcagcaacttggtacggtgattttcaccagcagcttaaatacagggaagttagagacgtcacactacatgcgtacttctgttccttacatttgtagccttgtattgatttcaaaaaacaattgtagcactgtaatttggtgacctggtagggggagagagagagagaagcctttttgtcttggtaatctatactttggaaatcgtcagcatactgttaaacaggatttcagtgttccacagtaccttgtctcactttctatatgtatatacaagtgttgattaagtaatcactcatttgaatacgttgttacttgcacacactgaattgagccataccgggtgcattctcctcttgttcttgcaaggccgctgcacgccatgagctcataaacccgtagcaacggcggcacaagatattgttttgcagcacggcaggagccggctggaccgctggaatatgctgctgaaccgccgttcgctttcgccactatttgttgcgtagaaatgtagaatcgcgtccattttcagagatatggtgatcttgtgtgggagcagtgctgcagcggctctggtggggtccccgacgattcctccagcccgtagttactatccatccaaaatcattttgcatgacgttgtcctctcgatctcgattttccacgttccaaatatgcgatggtagttcgctcttgtcccaaaaatggaggatagcgtacagctcagtggatattcactttttttaaaagaaatacacagtacaacagacactcacaatgcacgcatactcacccctataaaaacgcgtaagcaacagtggcggattcaggaaatcgattcgttggtgtcataatgtgtctatcggtgctatagtatgctaatcatgcttagattatggtgttataacatatgggtaaacaattttgctatagttttgccaaaagtcgtcggtgtcgcctgacaccggtccttcttctactgtatatccgccccttgtacgcaaaccctacccctataagcatcttcaaagactggaccagcaaatcaaatcctagagattggtgaagtcactttaggcgtctcactgtcgacgggcacgtcgcctactactgaaagcacaataccgttaaatcctgaaaaatttgctcccatggggagtcgaccccagcacctaaggtgctaaaatttcaatgcaatatgaatggaatgcgaacagtaagctgctacctacatccataaatataagcaattttagaatgagtacacgtttatcgatctaaatggaagaaaaccgataattgagccttgcaatatccattaaagggaaccggatcatttcataaaaagtgaatcgggattttttttttcttagtgctataagattgaaataatgatcttccgatgcttcacgaccaattttgcatgaagttgcttactctctctgttccactgtaagtatatttttaaaaagtgtgtgaggaaaataatagagagattacctaagtatccctattaaataagagctggtagggactgagagggtaattgaaggtatgatggagaaaattttgagatgtaatgcgattaattaatgtgagcaagtaatatgtgggattgtatttattttaggataaaagttaaatttaaaattacatttatcttgggatgggggagtatatagaatatgaatgttgcaaaattgcgattgttgtccatggtattagcattatttatagatgacatggtatctacattagtagcaagccaaaactagcttgactactgttactgtatttggatttaagctcacggagagagtaaaaaaactaaacgcaaatataccatcacaaagaatctgccccacctgtcggcctcctaacggctgcgcgcccaattaacgtccagatcaatcgaatcatccctcccctaaagcctaaaacctccccatccacgtcacccatcctcctccctaattactccccccatcccctcctcctccgccgccaagcacctcgcctcctccgccatggcgaccgccaccgcgtcgtccctctctctcctcttcgcccacccacactcgtccaaccccaggcccttcgccggcgggcctcacctccgccgcccgctgcgcgccgcgccccaccgcgcgcgatgcgcctccgacgccgccacgacggccacgaggcaccgccgccccgcggaggagaacatccgggaggaggccgcgcggctccgcggccccgggaacgacttctcggcgtggtacgtgccgttccccccgacgcccgaggacgaccccgacgagcgctactcgctggacgaggtggtctaccgctccagctccggggggctcctcgacgtgtgccacgacatggaggcgctcgcgcgcttcccgggctcctactggcgcgacctcttcgactcccgcgtggggcgcaccgcgtggccctacggctccggggtgtggtccaagaaggagttcgtgctcccggagatcgactccgaccacatcgtctccctcttcgagggcaactccaacctcttctgggcggagcgcctcggccgcgagcacctcggcgggatgaccgacctctgggttaagcactgcggcatctcgcacacgggctccttcaaggacctcggcatgacggtgctcgtcagccaggtgaaccgcctccgccgcgcgccgctctcacgccccatcaacggcgtcggctgcgcgtccacgggcgacacctccgccgcgctttccgcgtactgcgccgccgcaggtatccccgccatcgtgttcctccccgccgaccgcatctctctgcagcagctcatccagccaatcgccaacggcgccaccgtgctctcgctggacacggactttgacgggtgcatgcggctcatcagggaggtgaccgccgagctaccgatttaccttgccaactcgctgaactcccttcggcttgagggccagaagacggcagccatcgagatattgcagcagttcgattggcaggtgccggattgggtcattgttccaggaggcaatcttgggaatatctatgccttctacaaggggtttgagatgtgccgtgttcttgggcttgttgatcgtgtgccgcgtcttgtatgcgcacaagctgcaaacgcaaatccgttgtatcggttctacaagtcagggtggactgatttccagccacgtgtagccgaaactacatttgcatctgccatacagattggtgatccagtatctgtcgaccgtgcagtggtcgccctgaaggcaactgacggtattgttgaggaagctacggaggaagaactcatggatgcaatgtcacttgctgaccgcaccggaatgtttgcctgcccacacaccggggttgcacttgctgctttgttcaagcttcgagaccagcgcataatcgggcctaatgaccgcacagtggttgttagtacagcgcatgggcttaagttcacacaatcgaagatagactaccatgacaggaacatcaaggacatgctgtgccagtacgctaatccaccaatcaatgtgaaggctgactttgcttctgtgatggatgttctccagaacaagctgaatggtaagatctgagctttagttaaccccccatggccgttatcttgcttattgtcaccatgaactcctttttctgcatcttattcaactgcagttgatgaacttggtgtgtcacagtaatctttaatttgtagtactaggttttgaggctcttctaactatacacataagtggatagagctgttccttgtactttatatatgtatcatataatatgacaataagtggttatgccctagcacttaattgaataattgtttcgaatggatacctgtgactgcctttccgattgcttttactcactattgtctgtcaaattgtcaatgacaataagaaaccctctttggttgcatggtttgaagtctgaactgatagaatttattaaacatttcagttgctgcaaatcgctttagttttgttagtcaagaattcttttctgaaaagcataatataatccttgttctcaagacagcaagtgttatatagcaccgttgtaagtatataagaaaatagttttattagaactacatagcaatgttccatgttcagagtaaactataagtggatatcctaaatttagttcggttaaaactgtaaaatctctagtgtgctggacctatcactatttctgaatagattgtcatataggttgactgcagtaccacagtctttccatttagtagctttaagcctttaagctagattgtgttacaaactgaccaatcattctaggtggtttgaatatcctgtgacaacaaataaaatgtgagattgatctttttgagttattatcatcacggcataatgtttctagtatagcctttcagcttgattctgagttggagtttttataccctatgatattggataacattgagtttcgtctccctgtaacttactactactactacctctcttttttttatttggcgttggttagttcaaattgaaactaaccaacgtcatctaaataaaaatggagggagtaccatttagtgtttgcataactcttccttaatttggttgtttgtggcttccacttcagtttactgtgcctaaaacagtaaaggtaataatggtttcccatcagaaaccggatgctacgttcctcactggagactacattgcccccatagacccaatagttatccttgttacgtgtttatcactgcaagtttgctttgcatgtcttactcagaacataggcacattgtatattgtttcttaatcaagacacacaatcttgtataatactcacaactgtttgttctgctaaaagtcgaaggccttctcgtcagtctacagaacttcggtgagcatgatacgatggtagacttagtttatcttcgctgtgagtcgtgaactgcacaaggggaagcgaaatatttgctaaccaggtcaggtcctcgttgatctgaagccactgttattaccacataaaagtcaggtcctcgttggtctgaatccactttcctttcgcaaaacggttgtctgttgagggcacacaaggaggagatgcagttatctcaacaatgtccgtcacttgagctagagctatggagtcttctgctaaccctcttactgatagttgattccttcccttccctatgttaattgtcaaggcgaggaaccgaggaatgagttgttggactgaatccagcttcacaaattgtagaattctttagatttgggctatctgttccatgtcaccttagttctaaccagtcagacatattgtgggctttgacactttgaccatgttagtgggcttatactactagtactctataggaataagttcatcggaggtctcttaacttgtcagtgaatccgatttccgtccttcaaccattcaaccagaaaaccagatataaagggtccctcaactatcaaaaccggtgcaatataggtcattcaaccagaaaaccagatataaagggtccctcaactatcaaaaccggtgcaatataggtcctatggcggttttcactgacgtggtgcctacgtggctaatttgactcggttttcatatgacgtagctagtgacgtggcgcttacgcggtaatttttatttggaaaattgctatttgtggtcccacatgtcagttacaccaaaaaaattcattcaaaaatggtgggacccatatgggccccacatgtcattcttaccccctcctcttcttcctcctctctccccaactcccctctcctttgtcctctctccaggccgggcgaggctaggcggcgcgcggtagtcgggagaggagggcggtgcgaagcggccgggcagggcggcgcgcgacggccgggagaggtgggcgggcgcgcgacggccaggagaggcgggtggcgcgcggcggccgggcgaggtggggaggcacccatgaccccgctccgccgcagcacgtcacgcagatgcgcgccacgccacacgaaggttgagatggcgctggcagttgaagccgacggtctggcgcaccatgttctgctccttgtgttggttgcccgcgcaaaccaacgtgacggggaactccacggtcaagctgttccatggtggcgagcaatgagtcgtcgagcaacatcgacttgttcccatccaccggcgacaaccgtcggttgggctccaagaccgactccgacgacgatgacgacatacccccggactgaaggtagttgtaccactcgcgcctcgaggtggagcctcccgtcaatgacccatgcgacgaggccacctctgacgcagtgacgcgtgggtgcgtcggcacccggtgctcgtctggctcaccggcaagcacccctttaactccgagccgctgctgccgtgcctcatgcttgacggtttcatcacgccgacgccagtccactacgtgtgcaaccacggcgccgtgcccaaggcggactggtcgacaaggatcgtggaggtgaccgggctcgtcaagcgccccgcgaggctccaccggcgcggagccaacttttattcaaccgagtcagccattgttgccgaagaggggagagagaggagaggagatggggagaagggaaaaggaagacgagagtgttaaccattggacgagagtgttggggcctgcgtgggtcccatgctaactaagcttatcatgtcagctaaaaccagacgtaaatactgcctaggacctcatatgatccggttttgtaaattgtgagggactcgttatatctggtattttggtatagggacgaatttcagactcgacaataatttgagggccgactcgacaataatttgagggacccaaagtgaacttattcctaccatatattggttaggaataagtccactttgagtccctcaaaatatatgtataatttaactcgtatccccaaactgtaataccggatatcttaacccctcaactattaaaatcaatgtattttgactccctcagtggcttcaaagcagtttttacaaaggtgtcatgtttacctcggttgacttagcatatggaaccatttgtcagtcacccttctctttcttctcttcatttccttacccatatttcctcactctctcacccatatttcctcatgacggcaaaatggcagcatggcagcggcgagataatagggtggtccggcaacagagggtgggagttggggactccgttgttttggcacccagagacgggcacagtagccatcgagcggcagcaagttgagggagatgggtggcagtggcttgtgagcttgtctaacgctggggatccaacttccaaggagggcaaatgaaggtggcaacctgtagatctcgctgccctcgatcgacacctatagctccatgccgttgtcgcctcaaccagttgaacgagcttttccttccaaattagttgcataaacggatttctctcgatttcctctcctttccccccaagaaaaccccatcaatattgtgttaaatcccgtgaatttcggccccgttctaatcccgaagaactcaggatgaaccctagtttttcgccactgaatccatctgtttctagcccggtctctttctcctccacctatatatagcttgcctaaggtcccctcttccgattctaaccctagtccgagctcgtcccatgccctagccgcctccttgcgcactcttcgccgaaggccaccgctccagccgagccaaccgtgccaccacgtccgtcgtcatcactgtttggttcgtaagacgaaagagaatctcaactgcaccttcgcttcacttggacatcaccggagcgccgccgtcgacatcaacccgaggccaccgccttttcaagcttgttgccgcttgccgtcgtaattgcatcagtaaggatcgtcgtgttcccctcttctcgcttgtgccctcaatttccgctgtcgcaccttcgtttgccgtcacgcatggccaccgccgcgcaccaccaccaggcactgccactgtctacaagacactgacatatggggtccatgtgctaactcagctagttaacggggtcaaagatgccacattggacgaaaccacctcccaaaccgttcgaggagtcgatttgcaacggtcttatgagttggaggatgggttgtatcggttttgcggtagagcaaggtttacgattccgacaggcccttccgttccgggcatcggcggaattcggaatttcgcgaaatccggtggaaaatcggtaaattccgaacaaattttataaaccaaaatttgaatataaattccttaagttgccgacaagttctcgaaaatcggtcggttttggcgaaattctgatcgaaatcatcgaaatttcgatcattaatttgtagggctgcaggaa

SEQ ID NO: 55407 - DNA, 1242 bp, Oryza sativa
ttttctgggcgagacttccactgaaaaagttcctatgggcctgtttggagaactatcccagggatattttttgggctaaagattatcccaccaaaatagccccctaacaaaatagccctcttgctgtttggatccaaaggctatttagctattattgtaccatcccaatcatttgcctccactaaaagtatacagcagccggatcttctatggctaatccaatacaggcacatacaagcatacacaattccttacaagcacaaacacataatttgtctcaaatatataagcaagtatgtaaaacaatcgtgtcacataaaagatacaattccatacaataatcgtctcacataaatatacaattacataaaacaattgtctcacataaatattaaaatccatacaacaattgtctcacataaatattaaagtccatacaacaattgtctcacataaatattaaagtccacacaacaattgtctcacataaatatacaagtcctcaaaccgtaaaaaaaaattacaatccattaaacaaagcatttgccaagtcatcgcggaagaaattcatgttgctatcctcaacaagaggttcatcttctggccagtcagagtgaggtgatgtaggcattggaaaataatctgcatccgcatcacacctagcaaattccctatccctaattttgctctctcgactgaaattatgaagaaccatgcaagcaacaattattctagtttgttttttttccgaaaacgatggcatgtccaacaacatcctccacttcatcttcaacacaccaaaagaccgctctatgacattcctaatccgggaatgtgcatggttaaaggtttctttcataccttgtggcgggggcccgtttttccattgctccacatgatacctagtgcatctatacggtgaaaggtagcccgggcggtttgggtaccccgcatcaaccacatagtacttccctgcatatacaagcacacaatgaggcatataggtacaagttaaaatgatggaaagatttgaaacaaaagttgcattactttaccttgtggtggatgtggaaatttgtgagcatgagttgtcgttgcatctttgaacactctcatatcatgtgctgaaccaggccatcccgatagcacaaaggtaaacctcatgtcaaaatcacaaacagccaatacattctgtgaggtttcattgtacctattcaagtattgtattctcttcgtctttgg

SEQ ID NO: 55408 - DNA, 858 bp, Oryza sativa
gtacgccacgtagaccaaaaccaccgcggattgggtcgagggggtaatttgtctagtttgcatagttgggggtgaagaatgtctggttttgtggttcagggggtaattcggtcgactgcgatagttgggggggggtaattcgtacttttccctttttgttatgtgttcttctactagaaccttattgcttttagtttgaaacagattattgagcagattgttgcggcaaattatctacttgattacacggataaattaaatattttacaaacaaacaaatagattgaacaagtggcctgatagaattaatttttagaaaatgtattttttggaagtgggaagcaaatattccatttcattaatccggtacataatctgaaaagagttgactcacatgtagtttctaaactttgtattgtggtaaaatctttagctcttttataaaaattgaatatgattctatactcatcgcgcacttcatccatcgtcgtgctggtttttcatccgattttatttcagtttcatgcgaccgacttcgtctcgtctcgcatcgcatcgcgccgtccgtcaaacagaagtgaacgagtccgcatagatcgtgtgtggtcccactcgcaccaatcctgttctattacgatttgctccatggctggcgattcgatcgcctgcatggctgcatggctgcatcgcctgacatagcgggagacaggttaatccacgcgccaccgcccgtcacgagccacgccgctgccgctgccgcctgggagaatcgggtttccgcgctcgccgctggaagctgccggcaacgggctccatcccgctatgacggttcaattccattccctcaccgcaactgcc

SEQ ID NO: 55409 - DNA, 1021 bp, Oryza sativa
tgtgtcagctcacggtgctcctgtgctacatcaagacggtacttggctttttcttaatctaaccatgctttgcatcaactgaatttcaacgaagatgaattgcatctcttcagaggatccaagcagaatccttccaacgggtgctacaaatttcatactactacgcagtccttttcacctgttcataacttccaatgggttctgaatttactgataattaacaatgagatgacactatatacaaggagtactaatattgttcttaagacttgctattacaggtattctttcagcagtactctatagtccatagcagaaaacgcttctgaatcagatttacatgaatgcaattttatatctgatctgatgaattccatgaagtcataaaattgctattcatgacatgaattgcattagcgcaacattgtattgctgtcagttataatgcaatttgaaaatgtgctcaattagcagtgcttaatttccaagatagaagcatgttttgcatgaaatgtatttgcattgaaggtgaattattgcttctacagcctgctttcagttgcttgttaactgcccaagatgggactgaggctggctacagcctctcttttgaaggacatggattgcatatatttcataactcaactgctagtcttcttcacttgttcataattgtgattccaagcttctcaaaatatccgaactgagatattttcagcatcagtttgagaagcttggcatcaccgtcgaactactactcactgccggcttggtttcccaagtaagatgagctttctgccgatcgatctggatgagatgtgcttgcctcacatcgaggcgtccgtgtgatgttgttgtcgtgctgatcagtgaactgtttttgttgtttccgttccagctctgaaccttttctgtttttctttgagccaacttctgaagttcacatatttgcagttgttgattgtccagtaatcccagttagtacaatgtacttgcaatgctggacctatcataacatctt

SEQ ID NO: 55410 - DNA, 1180 bp, Oryza sativa
atgccaagcaatgcttttgccgtgaatcactgattcacggggccatggcatgacaaccgaggttgattcagatttcagaatagctctggaatccccagaaattccttatttcaagagagagaagggtgtaatgtgctaaaatgctgtcacacgcgacactaatccttctggtattttaagcgtttattatgggcttcttataagaccaaaagaattatttgagagattaatgacatttagctctgcggtatcctgaattcctgatgaaatgatcactttaattctgtgtcgttttactctaaaaaatatgagtcgaatttgagagattcttgtagtacacaggctacacagcaaacacacagcagcgactcaaaccttcgggcccaagaatactggcccaataaataaggcctagttctatcgtttggtggcccacctcctcctccttccaaaccaacccaccatctcattccgcttctccctctcaaaaaaaaaaaaatcccattccgcttcgagaagcagaggaatcccgcacgcacagcgcatcgtctcgcctcctctcctcgccaccggcaagccgcgcctcccgcctctccaatggacgacgcgccatggcgcgaactcgacgccgacgtcctccgactcatccacagccacctcccgtgccacgtcgaccggcgccgcatgggccgagtctgccgcaactggcgcgtcgccgtcgcgccgcagcagccgccgccgccgccgctcccgtcgatcctcgtcccgcgcgccgacgtcgagccttccttcgcgtgcgccatcgccggctgcgccacccacgccttccgcctcccgctcccggccgacgcgcgcgccgcgcgctacttcggcgcctacgacggccggtggctgttcgtcgcgttcggccagaccaaggactacgcgctcctcagcctccgcacccaccaccgactccgcatcccctacccctacgtgtcctgggcgacggtggccgcgaccctctcttcgccgccggaaaacgaggactgcctcgcagccgccatctgccactactgccaggagaccggcccgcgagttcatagattctggcgcatgggccagcatcaggctgagttgatagtactaggatttctgttcctaccatcatgagtgcagcaaatctggaggatgtcataca

SEQ ID NO: 55411 - DNA, 932 bp, Oryza sativa
ccacttgtttacaagaaggtcgctggtatttcgcatccgaaagtactgagcaatacttacagagaaaagcggcttatgaacgacaatgtcgtgaacaacagagcgactggcgggtgctaactacggcactccctccatgggaagcccgtccaagatacaggtgtggtgatcgttgtcaggttcttcgttccataaatcctacaacattgggtcgaaggttctttgtttgtccaaatattcttgacgacgatttcatggtaagaatattttgattacatgattccttattttctcacaacatttactaactttgcttgctttacatctattctttcctcccaggaaccaccaaggagatgtcaatacagagaatggatagacaccagaagggttctaactccacctagccgtgttgtgcagcttgaactaccagagcaatacagggttactaaagcgcggtttgagagaggagagggatcctcacgtaggggttagctattatcggacaacttggcatattgaaatttctactgtcatgcttccttgtcccattattacatcgtcgttgtgttcaactattgcactacctccctcctagttcgaatctaatatcatctatgtaactgcaatgcaaatagttgtatcatgttcaaattgtactactatttcttcatgttacataattctccttgtttaagtccatataatgtttctatgacctagactgcgatatgcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtacttttttcatctgggtccc

SEQ ID NO: 55412 - DNA, 1940 bp, Oryza sativa
tcgcggttatgttagaatgtgcctctagcaaaagaaaaatattgatttttttaacttagcaaaaaagggtttcaaagtcagtaaaaccctgtttaaattctactattttcttttcaaaactttagtccctatttttgcattacaaaatgaaaaatcatagtccttaaaatgctccttaaggtaaaaaaaatattgatgtttaggaccagatttgattctcaaaatattataagtttaactaaatcttattctgaacattaaatatttatttatgatagaaatcaatgaaaaggataagtagtcaaagtcaatggacttgtttgttcgagcctatttgttgcggttcatattttcgttagtcgaaggcatgatataaaagtttacatttctacttttattggctctaaactaaaatcgaataccgggaaacctctaatgatgttatttcatctatcagagtttaaatcttgatgcacacgaatattacgcatattcaagtgagttttcaacaggattgcagttagatcagggatgtaacgttggtttccatttattagagcatgtgttaaggggacatattcgtgggagtgtgagtgtggcgttggtgtgtgtgcacgcgtttcgtgtaattaaaaaattaaatcaaatatagaaatgaacggaaaaaaaaatccaaaaatgaagtttgaaaatcttaaattgactacggcgccggatctgctacaccccaaaatcctgtggtgcacatgaacccaagagagtctcgaaccggcgaaaagtcaaaaattctctcgcggaatcggatagaaaccggaggggcggcgcggcgtcgacgcgtggcgcgagggggatattcgggtggcgacgatgaggtagacgacgcgcgtgggggcggcggcggcggcgtcagcacgcggcgtggtcggctggagattacgatggctaaacatggtttttattaggggagattattattattattatcagtggaagccaaggaaatgatcccatcaatcgactcgtacacccaatcacagtccgagatttatatcgttagctgaccaagaacgggtagtcaagttgcgttgatttttttctgctatttaggtgcagctctttttattattattattttagattttcatttcaagcttgccaaccttgtaaaaagttaattcttcgtttatatattttctgtataaaattatctggaaatttttttgaataatatctttttagttttgtaaaagttacttcatacggtcatataataacccatcaattattcataaatttcaactatatcaaacttgtagtacaacgatatgatacgagtttatatcgatcagaaatgcaactgtcatagctagcagaggggcagagacaaaaataggatagctagggctgcagccctacacatgaatctaaatatccattagcactgtactttaaaacttcaaaaagcagaaaattaaaggcaaagctacgtaaattacattagttgaggcttagacttaaaagaatatggcagctggtaattcgtattttatcgggtgaagctaaatgaccaatggtctagtcgtccaatggtacgaatccgcgacaacaaattctggtttaatttcttctaggaatttaaaatatttttatttttctctttttttatgttttttctttcatgtttatgttttttttctcctactagagtgtagcgcccgttccgtcgtggcgcctagcgggaaaattatctcctaaaaaccctaattgcgaaatttgtttcttcgcttgttgtctagtgtccgtgccatctcaagatctcaatccccgatctatcgtcgagttcaattccgaatccaaatccttccaaatcattcctccgcaaaagtccattttgcctcccccggggtcgatgggccgaatcccgctcggcccatctctcc

SEQ ID NO: 55413 - DNA, 5206 bp, Oryza sativa
ccgtgccactccatcgccgcgcctcccattgcaagccgcgcgcgcgtgccgtggtggccgaccgcccggttgccgccgccgtcagcctctgcacgcgcctgtcgccagtgtcgccgctccgctccaaaccgccccgccgtcatcgccgtcgtcatcgcccggccccgccactccgcgcgcaagccgccaagggacggaggcagcatccctcctccctctgccgcgtcgcccccgctcacctcctcctttttcccgaatcggcaaaggggcaagccccctttctccccctccttttcccctttttcctcctcgccggcgtcatcctccctgttgccgccttggccgcgaccgccgagcgccagctcgcgcccttgaccgcgcaagtcggttcccaaaccgacattgccgcccatttaaaccccagcctcccctttcccttcctcttccattcgcctccgtgccattgccgccgctcccgtgctctgtctcgcctccgccgtccatcgccaagcgccgggagagccggtgcgttcgtggacgcggaaggggactccgggcgcgccctcttcttcctcttcctcggcccgaggccggagagatcactcccgcgccgtcggcctctcgtcaccgcgcccgtcccgcacggtagtgcctccctccgttcttcctcctcgctccatctcccctccttagctttcggtagtagctcgagtagcctccccgaagttagccggcgccgccccgaccgttgccgtcgctcgccgtgtgctcgccgccgtcgccgcccgagctcggaagcgccgctcgtcgccggcctcgctcggcgtagttccgcccaatccgacgctagcatcggattcccgtaaccgcgtagatgctctcgccgccgggaattagcccctagtgacctcgtcgccgttccccccttctcccgccgccggttgccgccgccgcaatccgccgccgtcgagcaacccccggcaaatccgagccgttggttcgtctcccctcatcacgaacaaccgcccggtgtgctagcttttgcccgtatcgccgtagttcgctccgccgctcgccgccgccgcccgctgtccattcgcggccgggtcgtcgtctacctctcgccggcccgcgtggcagccacgtaggcgccacatcggcgccagctcagcctaaaccgggtcgagccgaccccggtcagtccctccccgtgcgcgcgttccaccgcgagccgtgaggctgcgcgtgggcccgccgcacctgcgtccaccgcgaaccgcgtgcgtgcaccacgtccatcctccaccctagcgccgcgccgcgtgctccctccgcacggtgagccgagcagctgacaagcgggtcccacccgggaccgcgcgtggtgagcccggtccaccggactctctctctccttccaccgcgcgcgcgcgtcttgggccgccttgggccaccttcttgggccggccggcccgttaagctcagccgagccgccctttctctcgggccgcgccctaaccgcccgagggaagtctatattccctccctctccctttttcttttcttttcttttccaaaaaggatttaattaaatccttttcctttagaccaaaaatccaataatcttagaaattcaatatcttccccaccgtaaatccgtttgactccgttcaacttccaaaattccccaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctctggatctcgagcaaggcaagccacctttgaacatcttgagcctatacttgaaatttaattatattgcttgcaaaatattatgcattgataggatcacacttaatctgttgttccgtctgcaaggcagattggcggacctgcctaatttgttgcatttgatccttcctttgttaattgttataccatgtccccttgtaaccacccagttgcgcctcgatattcgtgcactctgtgcgagtatcgacggtcgccttcaaacttaaaatctgagaaacaacttgggtaaaacttgggttttacaaaagacttggaaaacccgacacctgggtcggtgcttgcgaactaaatgaatttctaaaaccgcggaccggggaacataccgggtgtacggttttcccgctcccgcacttaaggaccgattccttggaattacatccgaacataggacaagtgcgaccacatgggtggaatgggacacccctggctgagtaactagcttatcaggggagccatgatgccgagagacatgtggattcgccggggtggtgtcagagaggacccctgggcttcctggcacagtatggtctaggacctaacctgttgttggtctgggacccctctcgtcggcatatggtaagcctgtgtcggctttggaaatgccttgtcatgaaagcttggaggtctcccgacgtggctgatccccacgggctgggtgatccgggttagtaatatcgtgtgggtaaagtgtaccccctctgcagaggttaacaaactgttcgaacagccgtgcccacggtcatgggcggatgtgaggtgattcctagcgtagttttgtttgacaactgcttgtgaaattactgttgtgaaaaagggttcgatgtttggaaaatcagcagctgacgggatcagctaggcccgggtggccacttgaaaagttgttggcccgggtggccgtttgaaaaactgttggccgggtgccaaccttgttctaagatctaaagattgatacattgcacatactctgaccggacgggacgcactgtctcaaccgtgtcgtttgagaagcactcacctagatgtttttagaaaagagttcaaataaaatcaattacgaaaacaacagccttcccttgaagcctgcattaaacacttatttcccctggcttgctgagtactcccgtactcacccttgctctatataaataccccccagttgctgatgaagatgaagcggaccctgctgatgaggagttcttccaggagcaagccggttacgatgacttttagggtttcggcctagttcccaagtcgcgcctgtgttgtttggtccaagtcccggcttccgtttcccttttgtaatgcagttgtgagctcgggatctgtccacagcccaacatgactgtactcctactctataataaagagacctctgttgctgtgatattctatcctcctgtgataccagcactgtttcctgggactggtatcgattaacaggttaatttggagcgtcacgggctaattccagtcgggactagctcggggcgtgacatagagtatactcatgtctcttgttatatttttaatacaatgtaattattttaggtgtgtcgaccgagtttttctctcttttattaaaacaatgtattgtctttttcgtgctaaaaaattcctacaattttttaaatttgaaagtgtggacaaagagggcagctgggcctcacagttaaccacatttaagacgcacgcacagaaaagatcttcttcaacattgcatcatccaccctgtcgattgaatgctgaaaacaacaattccagcttgggcataattacaggatttcaaacttactttattaagtacattgttttgtaatggcaactaacccgatatgtacattggccgttgaaaaccacacatccacaaatctaataaaacgcaattaaacatcatcctgtcgtacattcagcgtgattataaaataatgcaaagaggctgatatttttaacctgatgatgatcagatcacattacgagcactgcatgaaccatcaaaaagatcatcttgaattagtcagggtatcagagaaagccaggttacggatggctatataggacaaattaacacggcgataattacatagtgcgacgcatgcttttgcacatgattctctaaagaagaagaagaaaaagaaatgctcagcgatgccatcggctaagctaataatatagttaatctaactaatttttggctaacactatagtctaattattaatcatgggtgatgtggtgtgactggaccagagcatttttgggtggcatcggaggtagatctttggggtggtagctgattgtaactagtaggtgtagtacatgttcgatcgatatctggacttgttttttttcagaggaaagaaagtgagatccagctaactagtattatagtacttttaaaagtattttttatatatatgctatcagtttgttagcttttgcttgttgctaaattaaattattgtagcctgtaatggggaaaattattagcatttatttacaggttgtttatttgtgcagatcaattggtgttcttgtcctgcagacagatcaaatgattttttttatgagagaataattgattagtttaatttgctacggcagatcttcctcttaagaaaaattgacctcattatcatttctttaatataagtcccataatacaatctttgaagaatcaatattactaactatataaccaatcattagatattctcttatcattagtgtatatgcagaaaaatgtacagattacctgctagctgaatagatggcaacgttatcagccgtatcaggcaaaaataattccatcatgggggtttgatgaattggtcaggaactttgaagggaatttagtatttttcctaaaccccaaatgaaagtgattaaatgatgttctaagtcaatttatcacgtccatatccaggactaaataaactgatcttgcaccgatgttccagagcattctccttacctgggctctgaaactctgaaggtagttgggatatttgccatgacttctgaccttctgtcctgttgatgttgccccggcccttccccgttagcttcttcgttttcgatgaagatgtaaacaagttggctgacttagcagttgacacaatcattaaccattaacctcttgttcttggctgctctctgaatggtatcaaaattttttagacggtttataactttatatgatgtcaatcacatggttcttgaaaaccagcggttaccggccggtaaccgtccggagttgacgatcagttcgagcaagtgaccaaaaggatatggttgtttttaaaattgaattaagaactattttgt

SEQ ID NO: 55414 - DNA, 963 bp, Oryza sativa
gcagcgtcaagaccatggcgcacgtcgcgccctgcggcgtcgccctcggcgccggcggcggcggtggctacgagatcgaaggctcgtacctgcggcggagctgcgcggtgtacgacgcgcggcggcgcgcggtggtggcggaggtgcaggcgaaggaggcggtggggacggacgtgttccggctggtggtgcggccggggatggaggtgtcggtggccatggccgtcgtgctggcgctggagcagatgttcggcaagccctccctgctcaggagctggtcctcctaataattagcctgtttctttctttctctttttttttcttttttttttggccttgaatttccaacattgtttgggcctgagagcagaagagttgctcttggctgcctctttctctctgatcctgaaatgaaacctcaaattgggtgtcactgtacactgaaaagaaaatccctcttggtgagtatggttttgggtcttttttttagcagaaaaccagagggatgaaagtgtaaatatttctaagaagaagaagaagaaaagggggttaattaaagcaggaaattcttccctgtctatctttctcctccatttcttgttctaagctaccagccttccactgttgcgaggcaaaattcccccccccccccaattaatactagaattaactaacaatatattgtacaaattcatccaagatccacatgcccaaaacatggaaaccattttaatcgctactactatgtactccctccgtctaaaaaaaaactcaacctaagaggagttcggggttccttctagtacaataaatctggactatttttatccagatttattgtcttaggagggagatttctcttaggttgaagttttttttggacggaaggagtacatttctgcatcttcttcacacagcgtctgaaaccacaaactgcatgtctgaattgtgaacatcaaaact

SEQ ID NO: 55415 - DNA, 8345 bp, Oryza sativa
ttagtcattagcatcaccctacaaggattaatcgcgcacgaaaaacgagacaagtcattagcacataattaattgaatcgtaattattaaaagtttgaaaaatggatttatttgttttttatagcaacttatatatagaaaattttcgtacgaagcacactactttttaacagtttgagaagcgtgctaacgagtaccgaagaaaaaaaaatctttatcttgttagagtttagaaggagaccagcttttggactgaacggtttgcatcttgctcttgcgagcacgcagcaaccacgggcgcgttagtgcgttacgttggtacgctgcgtacgcacgtacgctaggagcaaacacggcgccggtattgccacagtgggggcagtggtgggctggtggccacttgttgctgctcgcggtcacggatcgcggcgaggctgggtctgttcgtggatatttagattttgagaagtggcgtgtgggaatttaaattgtgagaatatacaaaaaaaatcagttccatggactctgtaactatatcttctctgaacgaaaaaccgatttgtttaggagaaacttttgattctggagaagatgtaactgtctgaagctatcctaaacaaaccgatatctattttgggacgcggaatattttatcgattttctcgtggaatttcatatggaattcctacggttttttgagatgcatgtgttcattttcactcctatgaatctatgatcaactattaatcacttctgcttgctgaattattgcagtctgcggcaggataattaatggtttacgtcttcctgcactgtggttcagaatctagcttggtggcgatatcgtccccaagtcccatcactctaccaccaaaatgctgctacaattttgaagcattagaaattagttcaagatctacaagtttcagacttgaacttggcgtcagcaatttcttgtcacgcatgggcctagtttaggagagtaagcgggccgacatgataatgtttcatgggctgatctaaatgggcctacaggacccatagaagaacgggcctgaagaattgtttaggcagagaactgtcggtcgaaaatacagtaaaggcttcgcttttctagtcccaaataccctgttctgcgattgctagaattgtgaccttaatagcctataaattctattcgcgatagcactcgtaattccatctaataacaatttcgtaccgttagaaaacaatttcgtacccttaaaaaacatttcataccaaataggcagatccgctgatgctacaagttcaggaaaatggatggcgaatgcagattgcagataaacaatgtttggagggacgtctctccctccaaatctcagcgttcccggataaacatcctcttcgtgtctcaacatttactctcatttccccctttctttagagcagaaaaccatctgattactagtgaacaggttaacatggtgcttgtcaaaaggctgtgctactgaaaattgctgagcacttcagattagtaactaataaccatatcttgaccgtttagccggttcatctgctactgaaatatactcaatattctacaccatgcacataataggggaaaatcagggcagaataaattaagtggcatcaatagtagtcctacagaagaacaaacaacacaggacgaattatttactgtacgtttaaacttttttgtcacctttcaaccgatcagacaataacaagtatgaagaaagaaataaaaaatcatgtgcatctttcacagctagctgaaaagcctgaaaatgatgcgcagtgttatctcatctaagtttaaataaaccgagagcttgacatgccagattatgaaaatgcgaagaatactagaaatcagttatgatactatgtagcagcaactagaatcctgcttagatcgtcagaagagatgcagtagcttaccccagccccatcttggacagtcaacaagcaactgaagcagacaacattcagttgcttgttgacaattcactgtcattcttaaatccatttgatgcagagaatacttaattcttactgctaattaagcacattatgcactaatgcaatccaaatcatggctcatgggtcttggatctcgtaggcttatcaaactaactgttccagatgcttaacagtccgattctaaccgagttaacactagtaatcaagcgaccaaccatgaaccatctcatgaacaattgaccaactattagacaaaatggtgctacaagttcagaaaaatgaatatgcagagaaacatcctctccgtgaatttaacaaatttaccactcattctgccctgtttgcagagcagaatatcctctaatcaatccttagtttgtacaaattgtcctctaatcagtactagtgaacatattaacaaaagcctgttatctctaaatgattttggcgaccaagaagccctctgctactaaattgtactcaacattctacatcatgcacacaatctaggaataaatcgtggcacagaaagtaaattcagcaccatcagtagtagcaatctatagaagaacaaatgacattcagacgatcatacaacatcgcatgatgaaagaaaacataaacgacctgcatctttcacatctagctgaaagcctgaaactgatctgtgaacagttaacaaactgaaatttggcttcggagaagaaattcagctacattgcaaatccatttcatgcaaagaattcttctatcaagaaaattaagcacggataattgggcacattttctcattgcattattattaactgcataaacaatgatgcatagactcaatccaagtactgaaagccaaaacgttgctgcattcatacaaatcatcagaccagagtccagagatcacatcacatgcattgcgttcatgcaagtctgactcagcaaggagaattatactgattgatcgagaattatcataccggatcaggaagactacatcatccacccaaacaagaggagaaggacatctcgaacaaatcaatagcgaatcatacctgtaccaggacgatcaaaactaacatgagcaatctcaggggagaagccacgccggcggtgagtagtccgacgggccttgctccggcaagaacttgtccacacgcggaacccccgccgcatccgccgccggtagccacttgccggtgtctctgcaggggtatttccccgcgacggcgcgagaagcgaacactgtcgactcgcggtagagcctcccgtcatccaggaagtagacgccctcgccgaactcgtcgcccggatagtcacccgcgtcgtacgatctggagcagcctcgcgcgacgaacagcatccgctcacccagcgactccagctccttccagccgtgcagggccttgttccgcttcctcggcggcggctgcaccatctcgaacaccttgaacgccgatgtcgtcggcggcgcggcaagaggagcaggaacgcgcctgaccaccatgaggagattgccgcgggactccaccaggtagcgagcaacgacgtctccgccataatcgcgccggccacgccagaagcgaagaatcaccctgggcgccatcttcatgttgccgtcgccgtcttcatggaaatcccgtgctgtgaaaacatggaggtcttcttctgcggtgaggaaaaggaaggctcccttgtggtgtatgacatcctccagagctggctcgtcgatggcactagggccatgccccatcgccgcaacctgatcctgggaagcatttgctgactgaacgcgccagaatgcgtgagtgcgtcgagcagcctggaagggccagtaggtgatgatggcggcggcgacgcaatcctcgtcctccggtggcgaagagagcgtcgcggcgagcatgatcacaccagtgttagggacagggccgtctggccgccccaattcagcagccgtcttgtccgggcggacaaaaaaggggaggttgaagcgcagctgatggtcgcggaggctgaggagcgtgttgcggcaggtctcgccgaggaagatccagccgccgtcgtaggcgccgaagcagcgcgcggcgcgcgcgccgtccgggacgccgaggccgtgcccgccgcagccgcggagggcgcacgagaaggaagggccgtcggcgcgcgggacgaggatccacgggagcgggcggagatgcggcgcgttctgcagcggcttgacggcggcgcgccagtcgtggcagacgcgggccatggtgcggcggtcgacgaggcacgtgaggcggttgtggacgaggcggagggcttccgccatgaagtcgcgcgcgggcgccgccgcgtccatgggagaggcggaggcggaggcgggggcgggggcgaggcgtggaggtggcggtggcgagggttgggcggcggcggaggaggtggaacgcgacgaggacgcttcgtcgttgtgcgccatgtttgaacttggcttctggaagcaggggaagagaggggaacagagtggattggtttggaagaagaagcagagaaggccagccttttgccagccgagcaagtggttgggcccaatttatagtgccggttttcttgggcctgaagtttggatcgctgctctttgctgagcgtttcttcttgggcctaaatgttttttttttttgagaacgtaaagttcggatgtacatatggtgcagaatcgtgtctagcagacaggagaaacaaatgggagcagggaaggttaacccttttttttttttttgagaaaaggcattcaagcaggttaacagttcagatggacagatggttattatcctacaggaaaaaaaaagagaaaaaaaagatagaaaaagttattggtccaatgaggtcatcatctttagtaacataggcacacatgttttctgtaggcgatatggttaatcttttcattagtgctgaactgaaggatgctcagttcacagctcgtcctttacagagagaaggggatgaggaaatgttgatacatacacaggatgcttatctctgaattccttgttcactttttctgaacttgtgcatcagtctgatggtacaacaaaaacactagattagacgctcgccaagccgtgcttttgccgaaaatatacagacatggcacccatccgacctcaaaacaaaaatatgcatggcagagctggcatcacaaacgaactcccagtttgaattttaaattcccggaaggtcacttatgaaaaagaaaaagtaaagccttcataaattttagcccatttatccgcctcaagatttggggcccaagaaagctggccctataaatgaggcccagtcccccatcccccttccaaaccaagcacatctcctccttcttccagaagcagaggaatccatcggttccattcctcctcctcgcctcgccaccggcaagccgcgcctccgcctctccaatggactcgccatggcgcgacctcgacgccgacgtgctcggattcatcctcaagcgtctcccgtgcctcgtcgaccggcgccgcatggcccgagtctgccgcaactggcgcgtcgccgtcaagcctgagcagccgcggccggggacgaggccgctcccatcgatcctcgtcccgcgcgccgacgggccttccttcgcgtgcgccctcgccggctgcgccacccacgccttccgccccccgctcccggccgacgcacgcaccgcgcgctacttcggcgcctacgacggtggctgggtcttcgtcgccttcggccaaatcctggactacgcgctactcagcctccgcaacggcacgcgattccacttccccgacacgggcacggacatggtggccgcgaccctctcttcgccaccggatgtacgatccacgcgttcatgtacgatccacgcgtgatgtacgatccacgcgttcatgtgttctggcgcatggagcatcaagttgtggagaaggcgactgctgttgagttcgtcaccacgtcagttctggaggatgtcatacaccacaagggaagcttccatttcctcaccagggaagaaaacctccatgtttttcctgtagcgggcttccacgaagacgacgacggcaatctggagataccgcccatggtggttcgccgcttctcgcgtggtgggcgagattacggcggagccatcgctgttcgttacctggtggagtccggcgagaatctcctcatggtcgtcaggctcgttcctcatcctccccaactgccgccggggacatgggcgttcaaggtgttcgagatggtgcatgagacgcccatcaacaacgacggggcaccatacgcttggaaggagctggaatcgctgggtgggcggatgttgttcgtcgcgcgaggctgctccagatcgtacgacgcggacaagtatccgggcgccgagttcaacgagggcgtctacttcctggatgacgggagactctacgatgaggcgttccaaatcttgaatccctttgcccagttcccctgcagcgacaacggcaagtggctgccgccggcggcggcggcggcggcggaggcggttaccggccgcgtggacaagctcttgccggagcaaggcccgtcgtactacacgccgccggtttggattctgccgtgagactgccatgttcttagttagattgtctgatgacttgttgtcgtgttgatatggtttgttgatttgtgcaatcgatgatgtgttctcgagatccatgtgtgcttgcaattgcttgatccatcatagcatctcttcagtactctgctattttcaccatgttagactaatgcagaaattgttggttctcatgactcagattgcattaattagtgaatcattatattgcaacgaacaatgattcagtgtgggggatcctgttcatgccaatttttcaggctaatcctcctcttccctcgccgaaagtcgcttaatcagcatccacagtgacagttatgctgaatcagcttgattcatgtcgaatttcccatgggtcaataacttgagactcgtattattttaattttctggagtctgtgagttcttatcactttttgtttattgagttccagactgaacagtaaagaatctgcaagtgatacatcgaagtcgtagtgaactgccaaaattttctcgtggttattgctggtgattaaccaaccaaccatctaaattttaccaacattttcttaccatcattcacaagatcctgagtgcaaattcagaaaaatgaacgggcaatgcagagataattatcctcctctccgcgtgtcaactttttctctcatttgatccactcttctgtagagcagggagggcagaagaacatcataatctgatcagtagttcagtactagtgaacagaataccatgacgcctaacatcaggctgtgttactgaagtaatgcctaaatgctgataactttgggtgaataaccatctgttaactgtttaaccattcttcacaacgttctaccttatgcaccgtcccgtactgccgaagcgccgccgccgtccgagaagggagaggcggtgtagcgaaaagaggggggggggggggaagggacgcggacgacgacgacgacatggagatggcgcggagctggaggggattgcctgcacgccgccgccgccgatccggtggggaagagaaaagtgagagaagggagagagagagagagggggaggaataaaggatgatatgtgggccccacatgtcagtaggtctcacatatatttttttaaaattttaatgctatataagcgtcacgtggcatgaagaccagatcaacacccccacgacaacaaaaccacccttcaaaattgctagagaattcaaattacactggtttcaatagttcggtcttacccgatattttagttaagggtcacgaattagatttgatgaacagttaaggaagttaaagtggatttttttccgaaggtaaaatgtctttctacatttgagcccattaatcttcctcacggggaagatgcacttgggggcttggggcccaagaaagctagccctataaatgaggcccagtctgatcgcatgctggcccacccaccctcttcttccaaaccaagccgtcatctccacccgcttccagaaggaattttttcgtttttagatttttttttaatatttacagaaataatctatcgaccaaaaaaattgcagaaatagcccctgccgcccaaatggtgggcggcaagctgacgtagcagacggtgggtcgaccgcgccgtctgccgccgtcggccaaaattgcgattaggcccttgccgcccatacagagggcggcaaggggctaattgtaattttggccgcccattcagagcttgcggccatactttttcatctggg

SEQ ID NO: 55416 - DNA, 30987 bp, Oryza sativa
aagcgccttcctcgaatatcaggattcctcgaagccattagttggcatcgatcaccgcataggcagagaggacgctggcaccaaggtggtagtaggtatacacaaggatcgctacgccagtttggatcctcaacaccccggcgtctagccattgacgaaagccggtcggatttgtaatgaagcaagtggggaagagagtactgaatgtgactgagttctgaaagattgtgagggctcactctcaacaaaagcaaatgccaaaggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcccagggtttctttcctcgataacaccaagcaggcgtggcaaattatcatacgaggcttcgtaagttccaaatctcatctctattattttctgtttggccctccaggccttggcatagctaatagtatacttgtatgtctcttcaatgtgtcggattattgaccttggttcatatgtgagattatcgatgacatgcgcatacatctcagatgcaacaaatgcacatgtaatgttcatgtggtatttctgaacactaggtagaaaacatgtatgcttggtaacaactgacactgtccaataatccttccatttccccttatacgcgtgcactctccagggacaaccatctttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcctagaaaaatcctcactagcccattctgctggattaatatccgtctcatcatctgacgaatcaacttcctctacacgctcgttgtcagaatcctccctctccatttcatccacaatggcaccgacagtctccccctcgtcagccactccacctggttgaatgcccactggagctactacgcccccgtcctctcgtgcgttgacctcctccacagaagtctcgtttacttcagcacttggtccctcgccatcatccatgttcgtctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctcaagcccctcattaaccatccttttatagaaggtacactcctctcagccggtctctcaattcccctttctgatacaataaaatctgacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcagggcttcgccccttcttctcttctcctcccctctcttctttttttttcactggaattgaggagagaagaatgagggctgggggctgggcagcaggccttttataggcagcgaggcctgccgcccggccagagggcggcaaggggccgcctgcaaaatagccggccccgactggcttttttgcattcgggccccttgccgccccaccagagggcggcaagggttttcctgcaaaaaaccctccctccgtcaccgtccgttcctcccccgtttgccacgtcagcttgccgccccagaggtgggcggcaggggctatttctgcaatttttttggtcgatagattatttctgtaaatatttaaaaaaaaatctaaatccgaaaaaaattccttccagaagcagaggaacccattccccacacacacacacctcgccaccggcaagccgcgcctccgcctctcgagccctctccaatggacgcgccatggttctacctcaacgccgacgtcctccgcctcgtccacaagcgcctcccgtgcctcgtcgaccgccgccgcatggcccgagtctgccacaactggcgcgtcgccgtcgcgccgcagccgcagccgccgccggggacgaggccgctcccgtcgatactcgtccggcgcgcatacaggacgtccttcgcgtgcgccctagccggctgcgccacccacggcttcggccacccgctcccggccgacgcacgcgccgcgcgctacttcggcgcctacgacggtggctgggtcttcgtctgcttctaccgcaccctggactatgcgctcctcagcctccgcggcgacgagaaattacccctcgctgacgtcgagacgctcacggacatggtggccgcgacgctctcttcgccaccggacgacgaacactgcctcgctgccgccatcggccacagctgcgtgatgtacgatccacgcgttcatgtgttctggcgcatggagcatcaagttgaggagaaggcgactgctgttgagtccgtcaccacgtcagttctggaggatgtcatacaccacaagaaagccttccatttcctcacgaaagaagaaaacctccatgttttttcggtaccgggcttccacgaagacgacgacggcaatctggagataccggccaaggaggttcgccgcttctcgcgtggtgggcgagattacggcggaggcttcgctgttcgttacctggtggagtccggcgagagtctcctcatggtcgtcaggctcgttcctcatcctcccctctttccgccgacgacatgggcgttcaaggtgttcgagatggtggagacgccgctggggactcccatcaacaacgacgaggcaccatacgcttggaaggagctggaatcgctgggtgggcggatgctgttcgtctcgcgaggctgctccagatcgtacgatgcgaacaagtatccgggcgatgagttcaaggagggcgtctacttcctggatgacgggagactctacgatgaggcgtcccaattcgtgaatccccttccccagtacccctgcagcgacaacggcaagtggctgccgccgccgccggcggcggcggcggaggcggttaccggccgcgtggacaagctcttgccggagcaaggcccgtcgtactacacgtcgccggtttggattctgccgtgagactgccatgttcttagttagatcgtctgatgacttgttgtcgtgctgatatggtggttgttgatttgtccagttaatcgatgatgtgttctcgagatccatgtgtacctgcaattgcttgatccatcataacatctcttcagtactctgctattttcaccatgttagactaatgcagaaattgttggttctcatgactcagattgcattaattgcatcattatattgcaacgaacaatgattcagtctgggggattgcatcattatcctgttcatgctaatttttcaatttttcaggctaatcctcctcttccctcttcgaaagtcgcttaatcagcatggcatctaccgtgacagttatgctcaatcagcttgattcatgtcgaatttcccatggaccaataacttgagacccgtgttattttaattttccggagtctgtgagttcttatgactttttgtttattgagttccagactgaacagtaaagaatctgcaagtgatgcatcaaagtcgtagtgaactgccaaaattttctcgtggttaatgctggtgattaaccaaccaaccatctaaattgtaccaacaatttcttaccatcaatcacaagatcctgcatgcaaattcagaaaaatgaacgggcaatgcagagataatcatcctcctctccgcgtgtcaactttttctctcatttaatccagtcttctgtagagcagggagggcagaagaacatcatcatctgatcagtagttcagtactagtgaacagattaccatgacgcctaacatcaggctgtgttactgaagtaatgcctaaatgctgataactttggattaataaccatctgttaactgtttaaccattcttctgctactaaaacatacacaacgttctaccttatgcacagaataaaggaatacattgtggtgcagtaaataaattcagtagaatcaatagtactccactaagattcagacgattatacaacaacagaaccgagcaactagtatcaagaacaaacaggtaaactatcggcatctttcacagctagctgaaaccgatgtgtatcagtaatttggtaaacttaacatgctacattatgagttaggaaaatatgtagcagccatcgaaaattctgctaaaatccactgaagagtggcactacctcagcccatcctggactgtcagcaagcaactgaaattcagctaacttatgaacaagtgaatagttaattcagttaggaacatgtgtagcagccattgaaaattcagccaagtccatcttgcactgtcagcaagcaactgaaagcaggctgcagaagcaaattcagcttcactgtaaaatacatttgatgcaaaacatgcttctatcctgaaaaataagcactgaaaattacacattgcaatcttaccgactaatgaaatccaagccaagaatggcaaccattgtaattcatgtagaattcatcagatcacatattcatgctgagttgaatatactgcattcattattcatgtaattctggcttgcatactctttctgatagaagaggagaatttaccaagtacaatctccactgctccagcattgtagcagctgtaccaatccacgattatgacatcaaatctggactgaaactacactaatcgatcgcagcaagaggagacgggacagagtacaacggctgcaagctaaaccacatctcgggggatcgaatcgacagcaagcaaaaacctgtagctcgacggcaatctcaggggagaagccacgccggcggcgagtagctcgacggggcttgctccggcaagaactcgaccactcggggattcgcctccgccgctggcaaccacttgccggtgtctctgcagggatactcccggaaatcgggctcaccgagcatcaactcctcgtcgtagagtctcccgtcatccaggaagtagacgccctcgctgaactcggagcccggattgttgttcgcgtcgtacgatctggagcagcctcgcgcgacgaacagcatccgcccacccagcgattccagctcgttccaggcgtatggtgcctcgtcgttgttgatgggagtccccagcggcggctccaccatctcgaacaccttgaacgccgacgtcctcggcggcaattggggaggatggggaacgagcctgacgaccatgaggagattctcgccggactccaccaggtagcgaacagcgttgttttggccgtaatctcgcccgccacgcgagaagcgatgaacctccacgggcggtatctccagattgccctcgtcgtcttcgcggaagcccgctaccggaaaaacatggaggttttcttctctcgtgaggaaatggaaggcgtcgtcgtggtgtacgacatcctccagagcgtggccgctgatgacctttgcaggtttcgccgccttctccggcgcagccgcagattgacgccgcatgggccagaacgcgtgagtgcgtagatcgtcaatcaggaaggagaggttgatggcggcggcgaggcagcgttcgtcgtccggcggtgaggagagggtggcggccaccacggccatgccgatgtcggggatgtggagccggtcgccgtcgcggaggctgaggagcgcgtagcccacggtgtggccgaaggcgacgaacgcccagccgccgtcgtaggcgccgaagtagcgcgcggcgcgcgcgtcgtccttgagcgggtgggcgaagccgtgggtggcgcagcagccggcgagggcgcacgcgaaggacgggccgtccgcgcgcggcacgaggatcgacgggagcttgctgcgctgcctctccgcgacggcgaggtgccaactgtggcagacccggcccatgcggcggcggtcgacgaggcacggcaggcggctgtggatgaggcggatcacgtcgtggtggagcgactccattggagaggaagcgaagcgaggtgaggcgaggcgatcgattgcgacgatgtggctgcgtgggattgattgctctgtttctcgaagcgggaggtgggagatgggtggctttggtttggaagaggcagggggttgggctggggaacgaagctatcagactgggcattatttattgggccagttttcgtgggccccacggttttactttttcactgggccaatagggccagcctgctcgatatttcaaaacccatattccaatgtactcgtatcataatctctcaaattcaacacgcattttttcggagtaaaacgaaacagaaatactgaaatagggtgaccattgctattctgcatcaaccgggtgaacacaaattattcagaatcaaaatttcaaaactcaagcagggagatgggtgtcaatgtgtcattctcggcaaaagcattgcttggcgttttaccatataggtactgagaaaggggaaacaaccgtctgaagaacttttttttggtggtaccactaccatcagactatgctacaatttcagaatgaccaaatgagcaaccaatttttcctgtagagcagatgaccaaatgagcagaacatcctctgttcagtagcagtgaactgattaatgaaacagttatcaacatacatgtatctgtgtggtactatactgatagtaccactgaatttgtttttcccgtgccacgatctattcctacagaagaacaaataacacaaggtagattatttactaccccgatgcaactgatcataaagcaactaactagtcctatgaagaaagcaaagataaacgatctacttcttatacggaaactgaaaatccgtttgatccgaagcactgctgcaaatatgcaatctaagccattaacaccaaccattttctggacagcaactgaaatcatgaagtgaagtattgaagagatgttatggcagatcaaacaattgcaagtacactgcacacatggacgaaacatcacagactgaagtaaccggacaatcaacaactgtcatatctgaagttcagaactggctcaaagaaaaaagttgctatgaaacaactagtatgaagaaagagaagagaaacaatctgcatgtttcccagcagcaatttgagaagcccattaaaaattcagctaacttatggaaaagtgaatagataataaagttatgaaatgtgtgggagccattgaaaattcagctaactccatcttggactgctagcaagcaactgaaagcagggtgcagaagcaaattcagcttcactgtaaaatccatttgatgcaaaacatgcttctatcaggaaaaataagcactgaaaattacacattccattactattgactgcaatatcattgctgcatagatgtaattcatcagaccacactgcatttctgctacaaaaggagaatttactaggtagctccagcatagtagcaactgtaccaaccgacaattatcacaccaatcttgacggaaacatcaaactgttgactgaaactacactatagcacatttcagacaggtgaaactaacatgagcactctcaggggagaagccaagccagcggtgagtagttcaacgggccttgctccggcaagaacttgtccatgctgctacccgccgccgccgccgtccacttgccgttgtctctgcaggggtattctggggaatcgggagccaagaacgataacccctcacggtagagtctcccatcatccaagaagtagacgccctcgttgaactcagcgtccgggtagttgttcttgctgtacgatctggagcagcctcgcgcgacgaacagcatccgcccacccagcgattccagctccttccaagcgaatgcgggctccttgtcgtggatgggagtcctcgtcggtggctccaccatctcgaacaccttgaacgccgacgtcctcgtcggcaagagaagaggatcggtgacgagcctgacgaccatgaggagattcccgccggactccacgaggtagcgaacagcgacggctccgccgtaatctcgcccgccacgcgagaagcgatgaacctccacgggcggtatctcaagattgccgttgacgtcttcgtggaagcccgctacaggaaaaacatggaggttttcttctcttgtgaggaatttgaaggctttgttgtggtgtatgacatcctccagaactgacgtggtgacgaactcagcaggatcatgagtcgcctcctccgcaactcgatgcctcaggatcccgaatgcatggattcgtggattgtccatcatgcaggaatggctgatggcggcggcgacgcagcgttcgtcgcccggaggcgaagagagggtcgcggccaccatgcccatgctcatgtcggggacgtggaatcgcgtgccgttgcggaggctgagtagcgcgtactccagaattcggccgaaggcgacgaagacccagccaccgtcgtaggcgccgaagtagcgcgcagcgcgtgcttcggccgggagcgggtggccgaagccgtgggtggcgcagccggcgagggcgcacgcgaaggaaggcccgtcggcgcgcgggacgaggatcgacgggagcggcctcgtccccggcggcggctgcggctgcggctgcggcttgacggcgacgcgccagttgtggcagactcgggccatgcggcggcggtcgacgaggcacgggaggcgcttgtggacgaggcggaggacgtcggcgttgaggttgaaccatggcgcgtccattggagagggcgagaggcggaggcgcggcttgccggtggcgaggtgtgtgtgggattgattcctctgcttctggaagcgggtggagatgacggcttcgtttggaagaagaaggtgggtgggccagcacgcgatcagtttggacctcttttatagggctagctttcttgggccccaagtgtatctccctcgtgaggcagattaatgggctcaaatgtataatgggcctcatttattctctatgggcttttagatggccttttatgtagcccacgaggccatgaacgcccaatgcgagaaggatcagacgatcagtatcatgtcctcctagtctcctactgatgtgtgcaatttttcctactctgaatcagcctcgtctaagataatttttctcgtctaagataattcctaatcctaataaaaaatttcaaaactaaaacaggggagtcggttgtgacgccaactcgtcatgcctagtgttttgaggtcggatgggtgccatgtctagtgttttgtgtagcacttttttaacgaaccggcacttttgagtagcattgaaaggaaacatattgaatgatgttgaaataagaaactatgcgaagtaaaatatagaaaagactcctaactaaatacaaagtaattatattgagaggagaaagtaattttctttatttggaagtaatcactataaatattttgtaaagagtaatttagcgtcatatagaaaataactctttaggtattcaaagtaattacacacttggaagaaaataatctttttataaaaagaatagaagtaactttttatggtgttagatgtaagtacacttctagagggaagtaaaactgataagatagaagtactttttatgggattagaaaaaactttgaagaaatagaagtagcttttaacattactagagtaactatattgctagaaaaaaaagcaagtctggagaaatagaagttactcttcacggtattagaagtaactcagtgctagaggaaagtaactctaaaaacaaaataaaagcaaatatttaccccacgttactagaaataactatattgctgtaagaaagtaacttttcatggtatctaaagtaactacactgctataagagctaagaacaagaatacaattttaaaataatttaaatatattaaatattggacttgttttatcacatattttgagcggagtacaataggtcaaacggatgttaaaaataatatatctctatctctactattataaaaattgaagatgtttttaccggtattttggtaagtcatccgtatttgaatcggttattaagttcgttctattttggaaatacatatccatgtttgagtcggattttaagtctgtttgctttagaaaatacaaaagaagtcatataaaaaatttctttaaaaaaacttgtatggtcacttgagagtaaagttggactcctaattataactcatgattttctaaaaaaatattcaagcgaattcacacagtgaatttcatcccatgtaaatcgtataacaataataggattaaaataacattcacctgttgcaatgttgcaacgcacatgcattttttctagtaatttaaaagatataagtggagaagaacagcaaattaatagttatgaacttaatatgtagcatccgcttaaatggatcctgagaattgaagcaactgaaaccaatctcaagaagcaattcatcgatcttcactgcaaatcggttttgatgcaatgcaatgcattcttttaacagaaaaaacgctaagtaatgttgagtaaacacatcgcagaaaatgcattactaactacaacacgacgatgatccactaagcatgtgtttggtgtcgggactagatgggatgggatgaaaccattcatccctaattttggggttgggatgattccactcacatgtttggtttgtaggatgggacaatcccaatttttttgtttggttgaagggatgagggagaaatgggatggacgctgtttgccatcaccgtcaacgaccgttgactgcgccacctgcatccacgcgtggaacaaccggatcaagcacaacggcagcagcaagacggccaccaccgccggagcacccaacccgctggcccaccgtcgtcaccgcggctggatcgggagatcccctgcgccagatccgccgccaccgctctccctaccttcaagtttcgccgccgccgagtccccctcctctggatctgccgccgccgccctccctacctccaagcttcgccgccactcgagcccgccgcgtcgacatcaccgcagccgctctcgtcgagcatcgcgatgagtggcgggatggtgccgagcatctcgctcgtggcggcgaccagtgttgaggcagggggtcgtggaggagcgtcggcggtcgtggaggagcgtcggcggtcgtggaggtggtggcaggcggtcgtggcggagcgccggcggtcgccgaggagacactgtgtgctccgtccaagtgggacgagctcgtccggccaattttgccggatgggtttgtcccggatctgggaggaatattcctctctagagaccaacccattccactcgcccctcaacaaaacacctctaaaagtaagttcgtcccatcccgtcccatcccatcctattccaccaaccaaacattacctaatgcaatcgaactatcgaagacatgaacaccaaccaccatgaggctggccttctctgactctgcctcttcttccaaaccaagccactctgtgtctcttctcttcccctgcttccacaagccaagttcaaacatggcgcacacgattctgcaccatgtacatccaaactttacgttctaaaaaaaaaggggaacatttaggcccaagaagaaacgctcagcaaagagcagcgatccaaacttcaggcccaagaaaaccggcactataaattgggcccaaccactttctcggctggcaaaaggcttggccttctctgcttcttccaaacctcccattcactctgttcccctctcttcccctgcttccagaagccaagttcaaacatggcgcacaacgacgaagcgtcctcgtcgcgttccaccacctcctccgccgcccaaccctcgccaccatcacgcctcgcccccgcctccgccttcgcctctcccatggacgcggcggcgcccgcgcgtgacttcatggcggaagccctccgcctcgtccacaaccgcctcacgtgcctcgtcgaccgccgcaccatggcccgcgtctgccacgactggcgcgtcgccgtcaagccgctgcagcacgcgccgcatcgccgcccgctcccgtggatcctcgtcccgcgcgccgacggcccttccttctcgtgcgccctccgcggctgcggcggacacggcctcggcgtcccgcacgacgcccgcgccgcgcgctgcttcggcgcctacgacggtggctggctcttcctcgccttccgcgagaccttccgccacaagctcctcagcctccgcgacgttcagctgcgcctccgcctccccttctttgtccgcccggacatgacggctgctgaattggggcggcctgtcccttacattggtatggtcatgctcgccgcgaccctctcttcgccaccggaggacgaggattgcgtcggcgccgccatcatcacctacgggccctacgaggctggtcgacgcactcacgcattctggcgcgtgcagtcagcgaaggctttcccggatcaggctgcggcgatgggtcatggctccgatgccatcgacgagccagctctggaggatgtcatacaccacaagggggccttccttttcctcatcacagaagaagacctccatgttttcgcagtacgggatttccatgaagacggcaaaggcaacatgaagatggcgcccagggcgattcgtcgcttctcgcgaggtgggcgcgattatggcggagacatcgttgtccgctacctggtggagtcccgcggcaatctcctcatggtggtcaggcgcgttcctgatcgtctacacgcgccgccgaggacgtccgcgttcaaggtgttcgagatggtggagccgccgtcggggacgcgcatcgaggccctgtacgcgtggaacgagctggaatcgctgggtgggcggatgctgttcgtcgcgcgaggctgctccagatcgtacgacgcgggcgactatccgggcgatgagttcggcgagggcgtctacttcctggatgacgggaggctctaccgcgagtcggcagtgttcacggctcggcggcggcgacggcgatatccctgcagagacaccggcaagtggctaccggcggcggatgcggcgggggttcctcgtgtggacaagttcttgccggagcaaggcccgtcggactactcaccgccggggtggcttctcccctgagattgctcatgttacttttgatcgtcctggtacaggtatgattcgctgttgatttgatcctccgagatgtggtttagtttgcagccgttgtactttgtcccgtcccgtctcctcttgctgcgatggattagtgtagtttcagtcaacagttgcagtttcagtctagatttgatgtcataatcatggattggtagttgctatgatgctggagaaattctccttttgtagcagaaaatgttttcaagtcagaactacatgaatcgtgaacgcagtatgaaactatgaatttgtgtgatctgatgctgcagtgaatcaagaacgcaatatgcttccaatggttgccgttcgtcatgacttggattgcattagtacatcgttatgctgcagtcaataacaatgcaatgtgtcacttgcagtggctagttttcctgatagaagtatgttttgcatcaaacggttttgcagtgaatctgaattgcttctgcgtcctgttttgagtttcttgctgacagtccaagatgaactgaggtaggctagtgccactcttcagaggatcgagaaatgcccaggggtcttccggctagctccacaaggtggtgggctagacgacctggattcaaagcctcacccctcctaattatttgatattaggtccttccctaatattctagttttttttttctcttcagaggatctgttcctatgttatgtgcataatgtaaaatgtggagtatatttcttcagtcaagaggtatttcttcagatcctaagttatcagcatttcttcagtaacacagatgataggcagcgtgttaatatgatcactagtactgatcagatgatgttatactatcagcatttcttcggtaacacagcctgatggctgatggtaggttggtaggcatcatatctgttaatctgtacgggtagttttaccatcatatctgtgttactaaagatgatgatcacattggaccaataaatctctccttttctttttcctctcttttttatttttggccgggaggaccaataaccatctgtccaactctacatgctcccatgtgtccatatgaatcaacctagtgaatccgcatgcttgaatatgaatgcattttcctcaaaatcacggcttggcgttcccagtaagtaattaagcaatgaactggttttaactgcaccattggacaggatgccacaaagttgagaaaagtaaacaatgaatgcagaatttctgaatttctgattagatcctcagaagagatttgaagcaaaccgaaagcaagctgcactgctgcagaagcagtttcgtcttccctgcaatctgagtcatgaacaccaacaatttctgcattagtctaacatggtgaaaaatagcagagagtactgaagagatgttattatggatcaagcaattgcaagcacacatggatctcgagaacgcatcatcaactgccctaactgggcaaatcaacaaccaccatatcaaatcaagacgcgaaggaagggccgtcggcgcgcgggacgaggatcgatgggagcggcctcgtctccggcagcggctgctgcggcgcgacggcgaggcgccagttgtggcagactcgtgccatgcggctgcggtcgacgaggcggaggacgtcggcgtcgaggtcgcgccatggcgcgtcgtccattggagaggcggaggcgcggcttgccggtggcaaggcgaggaggcgatgcgctattccgctgtgtgcgcgccctcgccgggattggttcctctgcttctcggcacaggaggacatggaagaagtgggtgggctaccgtgcgatccgactgggcttcatttaaaaggtccactctctcgggccccaagagtactccgtagcttcctcgtgtggcagataaatgggctaaaatgtatgaaggctttacttttttttaatcactagaaaaaggaataagttcactctggtccctctatttgtcaaccagtccgattttcgtcccttgaccgcaaaaccagatacgacccgtcccccaacttacggggcaaacgagatctcttgacagttttgatagcggttttggctgacatagcgtctacgtggctaatttgactcggtcttcatctgacgtggcggcaattcaatccgaaaaaataataaaaccgtgggactcacgtaaaacaataaaaaaatggtgggacccacgtgggctccacatgtccctcatcttcttcctcctccctctccctctcccctctctctaactctctctcctcctctctccagcctccaggcgccacggcccacggggtcacggggaggtccggcggtggcggccggcgacgcgacagccggcgtcgccggcgagctccacctctcggcgcagccgtgcagccgttcccggcgcctcctcggatgccgcgcgcgtttctgaccccgccgcggcggacgcggagcaggaaccttcttggcggtcaggatgccggacctggtcacgaactcgaccatggcggcgtgctgctgcttcgctaggacggtggtgaagaggaagtgggcggatgccagcgtcgcgtggccgcagagatccacctgaagacgacgacgcgtgcggatgaacacacagaacacgagtaacaggaaacctagggttgggggaaggggaggcaacctcggcggcgggggtgaaccagcggaggcgtccggttcctacttcctactagcagtctctgatctgcttgacgatctgtttcgcaggcgtgatttctgttcctggatctctctctgatgaatggattgttttgcgcagatcctgacactgtggtacagggctcccgaggttcttcttggcgcaacacactactccactccggttgacatctggtctgtgggctgcattttttggtatggtgaactgatattttagccactgtaaattattatttcttcaggattcatgccttgacagtgttgatatatcttgtgcatttcagctgagttggtcactactcaacctcttttcgctggagattccgaggttcagcagcttctgcacattttcaagtactgtgcctgtttcctcatcaattgttctttgtgttcgctggcaaacttaaggggcataatcgtgtattcatggtggtgatttatcttgattgtttggttccaggttgctgggcaccccaaatgagcaagtttggccaggagtgagcaagctaccgaactggcacgagtacccccagtggaatccctcgaaagtgtctgatcttgtccatggtctcgatgctgatgctgtactcaacgacgtgaacaaggagctctactgaacgtctgcacggctgcgccgagaggtggagctcgccgccggcggcggctgtcgcgtcgccggccgccaccgccggacctcccctgaccccgtgggccgtggtgcttggaggctggagagaggaggggagagagttggagagaggggagagggaaaggtaggaggaagatgagggggtgagtatgacatgtggggcctacgtgggtcccactattttttattgttttatgtgtgaaaatgacatgtgggtcccacagctttattatttttccagatcaaattgtcacgtaagcgccacgttagatgaagaccgagtcaaattagccacgtaggcgtcacgtcagccaaaaccgttgagggacctcgtttgcctggttttcataagttgggggacgggtcgtacctggttttgcggtcaagggacgaaaatcggactgaacaacgaatagagggacccaaagtgaacttattccctagaaaaatgtctgtgcgctgcaacgggtgaaatctattttaatcttatatatttggtttagttaaaatgaaatttaacgtgggagttcgcttggatatatatatttttagaaaatcatgagatgtacttgggagtccgatcgtcccaagttagcatgcgagtttttttaaacatatttcttatatgattccttatatattaccaaaagtgaacgatcttaaaaccgactcaaatatatggatatgtctacgccgccgatgcgagcgtagacgaccctggcgccgccccggaccgcgtcggcgatgcctcccagggctgacgacggcacgtgccctcgtagggtgccgatctcgtccacgaaagggacccagaagaagttgttaggaactcccaacgattatctctcaggaactggaattaatcacgaattgcgcatataagatttctcaaccccgaaggatcgagccgccgccgcctacgccaccgcgcatattccagttcttagcccccttctacttgttcttcgttgatgtttatattacatagcttcggctgatctctctctcagacagctcatgctagctggttgtttactggacccattggtcccccttgtagcgtggattgggcctccttgctcttggcccaagctggactggtacttgcttcttcttagtcttgaagtctggttttcctccttgctcctgggcatcagcttccttgtcgtcaggctccagcacctcttcctcctctgctcctccttgtatcatctcttctgtatcttctcttgctcttggtggagatggaggcctgacagaagtgctcgcaattctccgcagatagcttcggaacatacatcttcacggaggaggacgacgaggtcaattcaacacacagaactaacaagcaatggttgcaagcatttcgatgcgagttggtgtgtgcgcatacctgcaaaccgtcgccgtcgtcgccgccgccgccgccatctccaccggcataggcagccagaggggctacctcaagtagcaccagctgtccccggatgcgcgccaccacgcgacctccgccgaggccatcgacgacgtcggcgtacacgaccctggcgccgtcgcggaccgcctcagcgatgccgcgaacgtccggtaaacgcaggtctccgcggtggactcccttcgcgtcgaccaaaggcagccagaaatagaggtcgctgttgcagttgttgccgtggagaattgggacggggacgccggtgcggcgccggcggggcggagtctggggcggaggtggaggctcatggagaagaggagcgcctcccagctcgtcctccatgtcttcgagaggaggcccgaggtggacgatgtcctccgcgcgcgcgcgcgcggcggcaaagcagctcgacgaagaagagagaggcgttacggcttgggtgggcccaccgaatcggcctttcctgcttccagaagcttcgagagccaagtgcgctctgctcgctgtgcttgatcatggcggtctccatcctctgcatcagctgtcgatttgatgccgttgtactctgtcccgtctcctcttgctgcgatggattagtgcagtttcagtttcagtccagatttgatgtcataatcatggattggtagttgctataatgctggagaatttctccttttatagcagaaaatgttttcaagtcagaactacgtgaatcatgaacgcagtatgaaactatgaatttgtgtgatctgatgctgcagtgaatcaagaacgcaatatgcttcaaatggttgccgttcatcacgacttggattgcattaatatatgctatgccgcaataaaaaaacaattcaatgtttaactaacttgcagtggttagttttcctgatagaagtatgttttgcatcaaacggttttacagtgaatctgaattgcttctgcgtcctgttttgagttcctcgctgacagtccaacatgaactggggtaggatggtgccactctttagaggatcttagctgaattttcaatctctgctatatattttccttgattcatttataatcttcttccattgttcataatatagcatgccaagcttctgacattacttgtacacaccggtttcagacttttagctagctgtgaaagatgcagatcgtttactttttgtttcctgttgttgtacgatcatctggattttatttgatcttcttagggactacttgtttccgctacagaattttttttttgtgccaggatggcacgatttgttcctagattatgtgcataatgtaaaatgttgagtatatttctcttgtcaagaggtattccttcagatcccaagttatcagcatttcttcagtaacacagatgataggcatcgtgttaatctgatcactagtactgatcagatgatgttctgctatcagcatttcttcagtaacacagcctgatggctgatggtagattggtagtaggtctgtacactaatactgatcagatgattttctgctaaatgctctacttaagtgtagaaatgagaggataagttgggacacggagaggtggatgtttatctccgcattgcccatttatttttctgaatttgcagcatctgatgatgactgatggttggatactcgttactagtattaacttgattaaaattgggaagttaggtaataacttgtttaattactgttcaggccgtaactcgataaacaaaagtgatgaactgataagcactcgcatcagagactccagggtaagttcttaaccgaaaggaaattccacgtgaatgaagctattatttgagaatatgcataaggtttgcatatctttgtatgaggactttatacatcagctataagcagaaaaggagagaaaatgttgtgactagaaggatcctgctactccactccaggacctcaacttgcaaaaattagtcatgactcagcggttttctgtcgtttgacgtcgtttagacatcctcctgtcgaaaccactcgaacaattggtgcaagcacgctctaggatagagttgggctttgtgttgattgtaatggcatttttttgggcgttctcgtctgtgttcctttgttggcctagcggcggtcggtcacacttagcggcggccggtccggtgctagccttctcccgaacctgtgttttggcgctgtcggtgtgtgggtggtggtattttttttccttttttctggttacgaccttttagggttgtaatcttgtagtttttttctactctatcaaatgaacttcgcactgtcttacgtgagtcgttcaaaaaaattagtcatgactaaattaatagttatgaaactaatttgtgtcatctactgaggattctgattggatcccgagaagagaagcaactgaaaccagtctcaagaagcaattaatgcaatccaagtcatgaacaccagccattatgtaatccaagtacacacatcacacatggatctcagatgaaacattcctgtgtggataacattcactcttcacgcgacgctcaagggagagaacttgtggcccaagccaattggcccaatataaggcctagtctcatcgcttggtggcccacgcctcccacctctacttcttccaaaccaaaattctctccttccgcttctagaagtaagcagaggaatcaatccccacacacacagcgcgcctctgcctcctcgccgccggccagccgcgccaccgcctctcgccaccggcctctccaatggacgcgcgatggtgcgacctcaacgccgacgtcctccgcctcgtccacaagcgcctcccgtgcctcgtcgaccggcgcaacatgcgccgagcctgcaagtcctggcgcgcggccgtcgcggcgccggcgccgccgcagcagcgcccgctcccgtggatcctcgtgccgagctccggcggccctaccttctcgtgcgccgtcggcggctgccgcagacacgacttcggcgtcccggactacgcgcgcgaagcacgctacttcggcacgtacagcggcggctggctcttcctcgacttcggcaacacccgcggccacggccggcacggcctcctcaacctccgcaccaagtactgcatcagcatccccggaatcgtctgcctcgacctgaatcctagcatcatcagggacatggtcatgatagccgcgaccctctcctcgccgccggaagacgagcactgcatcggcgccgccatcagctcgtactggcccgggatgaatggtgcacgcatgcacgcgttctggtacatgcggcgtcaggtcgcggtgatgccgactgctagcgagggcgtcttcggaccatttctggaggatgtcatacaccacaaggaagccttctatttcctcaccgcgcaagagcgcctccatgctttcgcggtaccggagttccgagtaggccgccgcggctatctggatataccacccaggaagattcccagcttcccgcatgatgggcgtgattacgacggacgcgacgttgctcgctacctggtggagtcccgcgagaatctcctgatggtggtcaggttcgtctctgatcctccccaaatgccaccgaggacgtcggcgttcaaggtgttcgagatggtggagctggccatcaacaacggcgaggcccagtacgcgtggaacgagctgcaatcgctgggtgggaggatgctgttcgtcgcgcgaggctgctcaaaatcatacaatgtggccgattacccggggttgggttcagcgccggcgtctacttcctggacgacgacagaatctacgacgagttcacggtcctcctcgatggcaccggacggcgctacccctgcagagacagcggcaagtggctgctgggggcggcggaggcggacaacttcttgccggagcaagccccgtcgagctactcaccgccggcttggcttctcccctgagagcgtgctcatgttagtttgatcgtcgtggcacaggtaatgtttgctgccgatcttgttgagatctgcttagcttagagcgagttttaacagttgctattttcattagtgagctgatttggcggctgttgatttgtgcagtaactacaatctatgatgtttcattcgatttcgagccttcgaggcccatgcgttcttgcaattgctcggtcatgttttctgtaccttctgctaattttcagaattgcattagtgcatcattgtattacagtcgattctgcagtgtgagaatgcgtttagttaacaccagcacttggctttttcctaatctaagcatgctttggatcaactgaatttcaacgaagatgaattgcatttgcattgttaatccttacaacgggtgctacaaatttcatactatgcagtcattttcacctgttcataatttccaacaggttctgaatttactgataattaacaatgagatgacatatacaaggagtattaatattgttcttaaggcttgctattacaggtatgcttgctgttgtactctatagtccgtagcagaaaacgcttccaaatcagatttacatgaatgcaatttgatatctgatctgatgaatttttttttagataatgggttaaaaacccggcctctacatccaacgggatgtacacagccaaccaagttcagacataagcattgaagctccacccattacatgggtaacaaaaacaaaataacttggaccacaaaaagagtcaagaacaaccaacaaaacagtaaaaccaccatccaggcacaccacatcaaacagacacgaagtgccaacctaatcttgaattctccttctgaagttccagccatagttggagtagaactctaaaactctcatctctaacattttgcagtattctttcaccaaagtgccatcctcttccttaagcaacaaggatcaaagtcttgcccaatatgtccccctgaaaatcacctgcaaaaaggagtaagcatttgatccattaaagaccacatcatttctactcaaccacaccgcccagcacaacgccgctatgcctacaaaaactcgatattttagcctaggattaacaccatttagccaactaccaagaagatgagacatattgagcagtggacgaatgccaaaggtaaaatgcaccgcactccaaatatatcttatcataggacaatcaaaaaacaggtgttgtatctgatgaattacatgaagtcataaatttgctgttcatgacatgaattgcattagcgcatcattgtattgccgtcagttataatgcaatgtgaaaatgtggtcaattagcagtgcttaattttccacatagaagcatgttttgcatgaaatatatttgcattgaaggtgaattattgattgtgcttctacagcctgctttcagtctcttgttaactgtccaagatgggactctgttttgagggacatggattgtatatatttcataactcaactgctagtcttcttcatttgttcataattgccatgccaagcttctcagaatattcgtactgagatattttcagcatcggtttcagctggctgtgcaagatgcagatcatttatctttgctttcttgctactagctgtgccactcttcctgtgttatctgctcttgcgatggcactactattgatgttactgaatctatttttctgtgacacaatttgttcatagattatgtgtgtgatgtagaatattgagtatattgtagcagcagaggaactggttaagatagttattgatctaaagtgatcgaatttttttcagtaacgcactggtattggtatgagaatgatctgctctcttgtcgacaggagagataaaatgagagtaaatattgatccacgggagagttgtttaaatctgcatttctcattcattttctgaacttgcagttgccggatctgtctaatgaacgattttttttttattttagcggggaggtacgaatttgttaacttgtttcagatggttggttgcttcattactagtgttaggatgattataattagacagttaagtactactatctgggttgatcagctataatagtcctacaagtacaagatcgctaggcacaagtgtaaagccaaattgcctatgccgattctttttatgtaagaaaaaggaaaaggataacaacaacaacgataaaacgatttctgattctgttcatgcgccgagctgcatgatgcacagatacggcattttgttgccattcccgtacgggatacgtatctgatacagggatacggccgatactcgcgcgatacggtatcagagaagtattggcgaataaaaagcgaaaaaaataatattttttaaacataaaaaatattttttaaaaaaattaataaaaataattgcttcggcatcccggagacccggacgccgcgcacgaggcgcgctacttcggctgcgtacagcggcggctggctcttcctcgccttccgccagatcgagcgccacgcgctcctcagcctccgccccgagcagcgctaaaagcaagctgaatttctggctagatcctcagaagagaattgaggcaactgaaagcaagctgcacaagcagtttcgtcttcactgcaaatccgatccaaagcatgcatgtgcactaatgcaatcccccacacagaatcattgttcattgcaatataatgatgcactaattcatgcatgagcaccaacaatttctgcattactctaacatggtgaaaatggcagagggtactgaggagaagttatgatatgatggatcaagcagttgcaagcacacttggatctcgagaaaacatcatcgactgcactaactggacaaatcaacaaccaccacatcaaatcagacggtgaattcgctgtaagccaagcacaatgccatgccagatcggcagcaagcaagcaatacctgtaccacgacaatgtaaccaagaacatggcagtctctcacgggagaatccaaaccggcggcgtgtagtgcgacgggccttgctccggcaagaacttgtccacgcggccggtaaccgccgccggcggcgccaccggcggcagccacttgccgtgatctctgcaggggtattcccggtactgggcaaagggattcaggatttggaacgcctcatcgtagagtctcccgtcatccaggaagtagatgccctcgttgaactcgtcgcctggatagtcgcccgcgtcgtacgatctggagcagcctcgcgcgacgaacagcacccgcccacccagcgattccagctccttccagtcgtatggtgccccgtcgttgttgatgggcgtctccaccatctcgaacaccttgaacgcccatgtcgtcggcggaaagaggggaggatgaggaaggagcctgacgaccatgaggagactcttgccggactccaccaggtagcgaacagcgaagcatccgccgtaatctcgcccgcctcgcgagaatcggcgaacctccatgggcggtatcaccagattaccgtcgtcgtcttcgtggaagtccggtaccgaaaaaacatggaggttttcttctcttgtgaggaagtggaaggctttcttgtggtgtacgacatcctccagagcatggccggtgaagaactcagcaggatcatgagtcgcctcctccacacctcgatgcctcaggatcccgaatgcatggattcgtggattgttcatcatgcaggaatggctgatggcggcggcgacgcagcgttcgtcgcccggtggcgaagagagggtcgcggccaccatgtccgtgcccgtgtcggggaagtggaatcgcgtgccgttgcggaggctgagtagcgcgtagtccaggatttggccgaaggcgacgaagacccagccaccgtcgtaggcgccgaagtagcgcgcggcgagtgcgtcggccgggagcgggtggccgaaggcgtgggtggcgcagcctgcgagagcgcacgcgaagcaatgcccgtcgtcggcgcgcgggacgagtatcgacgggagcggcctcgtccccggcggcggctgcggctgcggcgcgacggcgacgcgccagtcgtggcagactcgggccatgcggcgccggtcgacgaggcacgggaggcgcttgtggacgaggcgggggacgtcgccgacgaggtcgcgccacagcgcgtccatctgagaggcggaggcgcggcttgccgatggcgaggaggcgatgcgctgtgtgtgcgcgcggcgggaatggtttggaatggttcctctgcttctcgaaacggaaggagatggtggaatggtttggaagaagtgggtgggccactgtgagatcggactcggcctcatttgtagggccagctttcttggggcccaaaagtagcttcctctggaggcagattaatgggctgtactgtagaaagtctactttttcatgaccacattctgcatctagctatccccatgcaactgatcacaaaacaactagtatgtcaggagaacaaagacaaggcatcagcatgttgactggttagctgacaccgatgcaccgtgttatgtcagtatgattgaattagttatgaaactaatttgtgtcatacactgaggattctaattggatcccgataagagaagcgactgaaaccagtctcaagaagcaatccatcgatcttcactgcaaattccgtttgatgcaactgatcaaagaactcttctatgatgaggaaaacgcattactaacaacacaatatgatggtgcactaatgcaatccaagtcatgaacaccagccattctgcattgggtacacacatggatctcagatgaaacattattcctgtgtggcgtggataacattttctcttaactcgtggcccaagccaattggcccaatatataaggcctacatcgtttggtggcccaagcaacccacctctgcttcttccaaaccaaatcccccctttctccttccgcttcgagaagcagaggaggaatcaatcaatccccaacacacagcagcgcgcctccgcctcgcctcctcgccaccggcaagccgcgcctccgcctctccaatggacgacgcttcatggtgcggtctcaccgccgacgtcctccgcctcgtccacaagcgcctcccgtgcctcgtcgaccggcgccgcatggcccgcgtatgccgcacctggcgcgccgccgtcaagggggagcagcacccgccggagagcccgctcccgtggatcctcgtcccgcgcgacgcagacgggccttccttctcgtgccccattgccggctgccgcgggcacggcttcggcatcccggacgacgcgcgcgccgcgcgctacttcggcacgtacggcggcggctggctcttcctcgccttcggccagatcaagcgccacgcgctcctcagcctccgcaccgagcagcggttctacctacccgacatcgcccgctgggacttcgcggggagaccagccttcgacacggacatcgtcatggtcgccgcgaccctctcttcgccaccggaggacaagggctgcgtcggcgccgccatcgtctttcaccgggccagcttgtatagtccacgcgttcatgcattctggcgcatggggaagcagattgcagtggcgacgacctgtactaacaccattgctgggcgacttctggaggatgtcatacaccacaagggagccttctatttcctcaccgcgcaagagcacctccatgtttttgaagtagaagagttctacgaagacggcgatggcaatctgaagatagcacccatggtgtttcgtcgcttctcgcgcggtgggcgagattacggcggagccatcgctgttcgctacctggtggagtccggcgagaatctcctcatggtcgtcaggctcgttcctcatcctccccgactgccgccaaggacgtcggcgttcaaggtgttcgagatggtggagccgccgctggaaactcccatcaacaacgacgaggcaccatacggttggaacgagctggagtcgctgggtgggcggatgctgttcgtcgcgcgaggctgctccagatcgtacgacgcgaacaagtatccgggcgccgagttcaacgagggagtctacttcctggacgacgggaggctgtactgcgaggcggcggtgttcgtggatcaggctgccgccgccgccgccgatgagccgcgatgcccctgctggccctgcacagacagcggaaagtggctggcggccgccggggaggttccccgcgtggacaagttcttgccggagcaaggcccgtcgaaccactactcaccgccggcttggtttctccagtaagatcgagctttctgccgatcgatctggatgagatgtgcttgcctcacatcgacgtgtccgtgtgatgttgttgtggtgctgatcagtgatcagtgaacagttgttgttttcattccagttctgaacttcttcggtttttctttcagccagttctgaacttcagatatggcagttgttgttgattgtccagttagtacaatctgtgatgttccattgtatacttgcaaggatcgacctatgtcacctatcataacatctcttcagtacgttctgagtttctggtatgtttaccattatatacttcatgattacagaatgcagaaaacagttggtgttcatgagttggattgcattagtgcaccatgctgcatatatagaatgtattttcaatgaagaggaattgtttctgcagctttctttcagttgcttcaattcatttctgaggagatctagtcagaaattctgaatccttggtggatgctataaattagtttcaacactcagcttcttaatttgtcatactgagataacatcgtcatcttgcaagaatttgatcgtttctttgctttcttgatagtactagctgctttgtgatcaattgcatggtgtttcactcaagttaattacctcgtagtagtaaataatatgtctgttatttgttcttctgcaattactattattgttaccactggatttatttttcctgtgacataatttattcctggactatgtacatgatgtaaaaagttgagtgttagtaacaggtgagatggttatttgttcaatgtggtcatcatcttttgaaacacagccatacaggtatgtgataggtgctttgttgctctgttcactgaatcacagctactgaacagaggatgttctactcatctgttcagaaaaaaaagttaagtgctacacaatgagtatggttttctcagcgttgcccattacatttctgatttctctgaaagtagtagcatctgtctgatgtctctgatggtacaaaatagttctgcacgttcatgccaggagacaattgcgttaatcctgaaaagttcatacaagaacaccgcattgcagtggagcaggcggcggccaccaatgcaatccaagtcatgaacaccaaccattctacattgagtcatcatgaagttcatggtaaaaatgccagaaaagtactgaagagatgttatgaaaaggtagtactcctgcatacatgacacatggatctcagatgatgatgagatgaaacattccctcagcacaacattcctctgtagctaacattcatttctcggcatatataattacgaaagaataaacgggccaattaacttcatcatacagatccaaagttctttaggcccatgaagaaatgctcaacaaagtgcagctatcaaaacttcaggcccaagcaaaccgtcacgataaactgggcccaagcccaacttcttgctcggctggcaaaaggctggccttctctgcttcttcttccaaaccaaaccaccccaagcttcccctgcttccagaagccaagttcaaacatggcgcacaacgacgaagcgtcctcgtcgcgttccaccacctcctccgccgcccaaccctcgccaccgccacctccacgcctcgcctccgcctcctcctctcccatggacgcggtagcgcccgcgcgcgatttcatggcggaatccctccgcctcgtccacaaccgcctcacgtgcctcgtcgaccgccgcaccatggcccgcgtctgccacgcctggcgcgccgccgtcaagccgctgcatcctccgccggaggagaggcctctcccgtacatcctcctcccgggagatggggagcgctccttctcgtgcgctctccgcggctgcgccacccaccgcttccacattccggacatcccgcgcgacgcgcgctgcttcggcgcccaccccggcggctggctcttcttcgccgtcgcccagacaaccaagaacgcgatcctccgcgacgagttcccctcgggcatccccgacgtcctccacctcgacgatcggccgccggacaaggacacggacgtggtcatgttcgcggcgaccatctcgtcgcatccggaggaccaacgctgcatcggcgcggccatcctctcccacttccccgacgtcaccaacccgtccatctacgcgttcttccgcatgggagtcttgcccgcgatggtggcgaacggcgatgacgccagcaacgcggggtcggcatcaggcctggaggatctcatacactacgacgatgccttctacttcctcaccggaga

SEQ ID NO: 55417 - DNA, 9305 bp, Oryza sativa
cgttgtccgctacctggtggagtcccgcgggcgcctcctcatggtggccaggatcgctgctggcgctggtcctctccgcccctcgccgccgtcgccgacgacgacgtcggagttcagggtgttcgagatggcgaggcgatcgacggcattcgccgccaccaacaacgatggcgccgagtacgactgggtggagctggactcgctgggaggccgcatgctgttcgtcgcacgaggctgctcgacatcgtacgaggtggcgaggcatccggggttcgaggagggcgtctacttcctggacgacgggaggctctacggcgaggtggcaatgttcagggatccaaatctgcggcaatacccctgcagagacagcggcaggtggctggcgtcggcgccggaggcggttccacgcgtggacaacttcttgccggagcaagccccgtcgaactactcaccgccggcttggtttcttccctgagatttcccgtgttgagtttgatcgtcgtggtacaggtttgctttgctgttgatttgtctgagatgtgcttagtctccgatctgatggattacattagtgcagaaattatctgtttccatggctttgattgcattaatgctgcattatattgaagtcgattataatgtaatgtgaaaattatatgctcaattattcgtgcttttgttttcctgataaaatcgtgtgcattgcctgaaatggatttgcaatgaagctgaattgcttctggggactgatttcagttaatcagtttcaggcttttcagctagatgtgaaagatgcagatcgtttgtgttttatttgttcttctataggtactactgtagtactgtaccagtactacttttgatgctaccaattctactttctgtgccacgatttattcttatattatatgcatgatgtaatgttgagtacaatttagtagctgtggaattggctaaacagttaagagttggtatttatctgatgatatctgaagctttcagtaacacctgaatggcaaatttgagaatcatggagaggatgcttatctctgcattccccacgcatttttcttaacgtgtagcatctgtctaacagtacattttgtgattttgtcagactgcacattctcttgaaaagagagagaaccttttcgatgttccaaaactatgaatcaaccagatgtcggaaggggttttcagaaacgaataaaaaaactaatttcataactcgcctaaaaaccgcgagacgaatcttttgagcctaattaatccatcattagcacatgtgggttactgtagcacttatggctaatcatggactaattaggctcaaaagatttgtctcgcgatttcccccctaactgtgcaattagttttttaatttatctatatttaatactccatatatgtgtcaaagattcgatgtgatgtttttggaactaaacaggccctagttaactcgtatgggtgcatattcatgtattttcctcagcacggcctggcgttccaaataagtaattaagcagcgaacactccaatgaactgtttttactgcaccattggccaggatgcctcaaagttaagaaatgtaaacgaggaaattcagagaaagcatcctttcctctatgtgtatcagcttttctccttgtgtcgaagcagagcaggacattctctgttcagtagtagtgagatgatcacagtggaacaataacccatctcaaacgttaacccatccctatgtgttagtgcttactgacgtactcaacattctgcatcatgtatatgaatgaatcatagaacggacaaaaacaaattcagtgactaattacttgctacgaccgagtaacttgtgtatccatgaaatcgatcagaaatagtatcatcaagacagcaaagattttgggattttcatatatatttcataacatgggatatacgggtggatgcaactcttctcatatcctaactcatatttctttatagactcagatttgaaattggacagtatcagccatcccattttaatttctgtcgcatatttttcccataaacctctcgtcggacgtgcagtcggaaaatacctgtacccctacatatatggacacggcggttggccggtcagaaactctaagagtgtcaagagccaagactacgtacgaacgcacgaaacgcatcccatccgggaacatatcgcaccaacaaacacaatatacgatcgaaaagggtaaccgatcgatatatagtaagttccaatcagtctcgcgtcgcggcccccttaaaccttacgcacgccggcctccgcgttgcgccgtcgccgtcgccgtcgccgcggcggttgccgcgggagccctggtcatgcggcccggacgacggtggggatacaggcgcgtcgcggtcgcattggcggtgtgcgtccacgcggcggtgcttctctcggccgtcgtctacttgtcctccgtcctctctgcagctgggcctggggctagctcctcgtccctgcaggaaacggagatgatgagactgaccgccaagctggagcagatcatcggtaagttcatctctgtaattaattatcatacgcgatcacggcatcacgcgattgatcgatatcgattaaagctagccgctagctgcagcctgcatgcaacaacggctaatcaaattagttaccattgccattacgtgttgataattcatcgcgtccctatatactccttccgtttctaaatattttaggagtataatataagatgtttatgcagaaaaccaagacaaatacaactctgggatgatgcatggcttcgcaagtatgctgtccaaaaaccccggaatcattaaggagatgacttacagaatcaccaaccccgacgacacggtgagagttcaactggcggtgacaatgagagacgacgtccaggtccagcctctaagaattaatacttcaatttatttccgtgtgtatatatacttttattagcaaacgcactacttacgactccctcaattttatatataagatgttttgaatttttttaaaattaaaatttgaaaaatatagtaatatctataacaccgaactagcttattaaacccatcattgaatatattttaatactatatttgttttttaaaagtatttaagaattatattttgtctatgacatattatatagttttcgtttatcttcattataactgtgtgcattttattagcctctctatcccttgtttagattcactaatattcatataaattagactataaaacacataatagatgtatctgttgtttagattcgccaaacatgcatgcagtgagtataatgtaaaacagaggtagtagtattttaaaattgcataaggcatattgtaagttggcctccccagcatgtcgtgctgtgtggaccagggttttcatgtatgtttgtctttattccaaaagccatatcattttagctgacctctaaaaaaacttatattttaaagtataaagtaaatttatgagaaaacaactatgcggaaactgatattaatgagtagctttacctttctgccttttgtataattaagatttcattaattgaattcattttgttgttgaaattttgcgaccgctgatatatagaacacgtcttctccccagatatcaatcaatataatgttaattatgagagtgtttcaaatatccgataaacatgtcccttcatacgtattttcgaaaattagcctattgatttcactgaaactatacaaataaatatttaattgtttgcgtctttttcgatcactcacagaaggagacccaagagaagtgaagagaaggaaattggggcaacccttaatagcgaatagtcgtaggggagagaaatgacgagagagcgagagcctggggagctcgtcaacctgagcgtcggcggggcaaccgttaccggcgcccacagccctgcgcctctggtcactccgaccagggcggccaccgcacaaccgcgctcacctccccagtcacgccttcgccccaagcaagtcaggcctcgccactgctatccaagcccttgactggggaacggatgccgaggaggatgaggacgacgtcattgctccggagctacaccaacgttcagcggagacattcaatccgcaaaccgccaaagcacgcaaagcagcttctccatctccggcgtccaaggctttccatcaggaaatcaatgcccgaagccaggaagaggagctcgacattactgcagagagaggagagggacagagcgccattacgccccctccggaaaaggcacaagaggaagatgcagagaagaaggccagagaaaaagcaacattaaagtcgataatagtagccccggcaagagctacaagcaagtctcaaatcgaggcagaagaacaagatctttcatcaaaatggcaagcggtaaaaccaaagttttggtggcggaagcgccaaaatccttcttcatcaacctctcaggtcgtcttcaatcgcccagctacctccttcaatccactaaatctcagagaaaagttcaaggagatcttgcacggcaagtgcttccgctgcttcgcttcagatcaccaggcagcagcttgcagggatcccatccgctgctatacttgtagacgcagtggacacatctccttccgctgcccaaacaaatcaaagcaacccattcactcccgcctcaccttccccaagcaagccccctccattcaatcccgactcatcttcccaccacttcccagcaagaaccaacagcaaccaacaacaacccgccctggttcggttttccatcgtttgcacaaaccagcggtgaccatggatcacatacctggtctgccgaatcaacggccggcagtcggctatgcaacggtgccgatgacggagctcatgcagcacgagctggagcgccttcactatcatggcgcactcatctcggctgaggtcgagggacaggagacgtcccccagggaggtggcgcgtgcactgacccagcaggttgggatccccatctcggacctgcgagtcacgcgccatcacccggaagatttcttcgtcttcttcgatttcccagaggggcaggccgcggcagcgcggagaggcttcatcactctggatggaggaaggttcaccatcacgccatggagcgccgacaggcatgtgcaccacccgaactggtggtttcgtgtgcggctctgcctggagggattgccgcagtacgcatggaatagggcgggattggagggcgtcatgggtcccatctgcctcttcgatcgcatcgagcataagtcggttcagtggcagaacacggccatcttctcatgctggatgtggatgcggaatcctgatctcctgccatgaacagtgctctccaccttcttcccgccgggagctgggcgtgtcacctccggcatcacaccgccgcttccggacgagatcgcgctgccgccgagggggaggctgccgcatgtcatagtccatctggacgagatggaggactggactccaggaccgccccgctcgccttctttcggggtgagcggactgccctcctcggacttgtctgattcgggaggcccgatacccacggtgcgcaccttccagtggtacctgggctgcgccgacggaacccagcctcctcggcgacgggcggcagcgaggcggggatgcagggcaccgccacagagaagagaagacccggaggatgatgaggatgatgacgggcggcggcgccacgctgaggatattccaccacgccgccgctcgctgcgcgatgtcatcattggaaggggccggtcggttgagtcgcgggcggcggaaggggtgcgacaccggagccgcacgccgcatccttccggccgccagcgagcgcacggcgatggccgccaaggccgctcacagaccaggcacagctcccgatgctcctgccgctacagatcccgtcgcacgcgctccccaagctccttgactcctcgcgatcaggatggcacgggcgatgcaggctgcgcgacaaccaaggtggtcgctgtcagtggccaggctgatggcgaccagcagtgtagcgcccgttccgtcgtggcgcctagcgggaaaactatctcttaaaaaccctaattgcgaaatctgtttctttgcttgttgtctagtgtccgtgccatctcagatctcaaatccccgatcaatcgtcgagttcaatcccgaatccaaatccttcccgaaagtccctccgcaaaagtctattttgcctctctcgggttcgatgggccgaatctctctcggcccatcttcccctccctccccggctatctctctctctctctctctctcgctctcgctctccctcttctccgctctgcccgcgcgccacgcgcgcgtgcgcgtgagccgcgccgagccgagccctccctctccgctccctcgctgccgcttcccgcacgccgttgtccgcgtgcgcgcgcccacgtggtcgccgcccgtgccgcgcctgcgccgtctgcgccgtgagtcagcacgcgtgcccgagccgcgccgctcaaatcgccgcgccgcccgttgcttcccgcgcgcgcgtgccgtggtggccgaccgccgggtcgctgccgccgtcagcgcctgccgcgcctgcccgcgcctgtcacccgtgtcgccgcttcgctccacaccgcccccgccgtcatcgccgtcgtcatcgcccggcccccgccactccacgcgctagcctccaggggacggaggcagagctcctcctccctctgccgcgtcgcccccgctcccctcctccttttcccaaagaggcaaggggcaagccccctttctctccctccttttcccctttttcctcccgccggcccgcgtggcagccacgtaggcgccacgtcggcgccagctcggccaagaccgggtcgagccgaccccggtcagccgctccctccggccccgctcgcgggcgcggtccaccgcgagccgtgaggctgcgcgtgggcccgccgcatccgcgtccaccgcgaaccacgcgcatgcaccgtgccccgctccacaccctagcgccgcgccgcgtgctccctccgcacggtgagccgagccgctgacaagcgggtcccaccccggaccacgcgagatggactcggtccaccggcgccctctctctcccctccccgcgccctattgggccgtgtcctcttgggccggccggcccatttagctcggccgagccgccccttttctctcgggccgcgccctagccgcccgagggaagtctacttcccctccctcttccttttctttccaaaagggtttaattaaatcctttttcctttagaccaaaaatccaataatcttagaaattcaatatcttcccaaccgtaaatccgtttgactccgttcaacttccaaaattcctcaaatctcgagatctatctaatggcacgcttagggggtcattaatagggctttatttttgccgtttgttgagtcgtcccgttttgcgtgtagtttcggagcccgaagacccgcagtgcgaggatttcgaggatcaagctcaagatctcgagcaaggcaagccacctttgaacatcttgagcctatatttaaacttaattatgttgcttaaaaaatattatgcattgataggatcgcacttaattttcttgtcccgtctgcaaggcagattggcagacctacctagtttgctgcatttgatccctcatttgttaattgttataccatgttcccttgtaaccacccagttgcgcctcgaaaatcgtgcactctgcacgagtatcgacggacgccttcaaacttaaaatctgaaaaacatcttgggtaaaacgtgggttttacaaaagacttggaaaacccgacacctgggtcggtgcttgcgaactaaatgaatttccaaaaccgcggaccggggaacgtaccgggggtacggtttcccgctcttgcacttaaggaccgtttccttggaatttcatccgatcataagtcaagtacgaccacatggatggaatgggacacccctggctgagtaactagcttatcaggggagccttgatgccgagagacatgtggattcgctagggtggtgtcggggaggacccctgggcttcctggcacagtatggtctgggacctaacgtgttgttggtctgggacccctctcgtcggcatatggtaaacctgtgtcggctttcgaaatgccttgtcatgaaagcttggaggtctcccgacgtggctgatccccacgggctgggtgatccgggttagtaatgtcgtgtgggtaaagtgtaccccctctgcagaggttaataaactgtttgaacagccgtgcccacggtcatgggcggatgtgaggtgattcctagcgtagttttgtttgactactgccttgtgaaattgctgttgtgaaaaggggatcgatgtttggaaaaatctgcagctgatgggatcagctaggcccgggtggccgtttgaaagttgttggcccgggtggccgtttgaaagttgttggccgggtgccaatcttgaacaattctaaagactgatacattacacatactccgaccggacgagacgcactgtctcatccgtgtcgtttgagaagcactcacttagttgttttcagaaaagagttcaaataaaatcaattgcaaaaacaacagtctttccttgaagcctgcattaaacacttatttcccatggcttgctgagtactcccgtactcacccttgctctatataaataactcccccccagttgctgaagaagatgaagcggatcccgctgacgaggagttcttccaggagcaagccggctacgatgagttttagggtttcggcctagttcccaagtcgcgcctgtgatgtttggtccaagtctggcttccgtttcccttttgtaatgcagttgtgagctcgggatctatccgcagcccaacatgactgtactcctactctataataaagagacctctgttgctgtgatattctgtcttcctgtgatactagcactatttcctgggactggtatcggttaataggttaatttggagcgtcacgggctagttccgctcgggactagttcggggcgtgacaagagatggtatcagagcacaggcttggccctagggcgaaacccgatgcttaggacgaccctaaggatactcggttcaaaactacttgcgaaaagctaaggcttcttttggtttccttattttcaatagtttgtttctaaaatggttactgatcttttctccctctttcaaaattgtagatggcagtgaacgccagcttcagttccca

SEQ ID NO: 55418 - DNA, 738 bp, Oryza sativa
cccgcacttggtgatatgatgagctggctcgagtggatcctgtcgcagacacttctacggatagcggagtccaacccgcaaggaatggatgacttctggctgcagcagggcgcagatatgctgctgagtttggtgaagagctctcaggaggatgtacaggagcgtgcagctaccacacttgctacgtttgtggttattgatgacgagagcgcgaatgtggatgctgcaagatcagaggcagtgatgcgtgttgggggcattccaatgctactggaccttgcaaggtgttcaagggagagtgcacagtcagaagcagcaaaggtaatgatgtccattttagctgaatccctggatctaattgccgatatctactatgtttggtattaccattttcttacagttgttaatgtgacttcaggctattgccaacttatcggtgaatgccaaggttgcaaaggcagttgcagacgagggaggtatcacaatactaaccaatttggccaggtcaatgaatcggcttgttgctgaagaagctgctggtggcctttggaatctctccgtgggtgaggagcacaaggttgtcactccttggatgctgaatactctgattgcaatgtctgatgtgttgctggtactaacaatatattgattattctttttcaggcagccattgcagcagctggtggtataaaggctttggtcgatctcatactccgctggcctgctgggactgatgga

SEQ ID NO: 55419 - DNA, 1606 bp, Oryza sativa
ctgctgatgacaagtgtagcatggaagttgcaaaggctggtggtgtccatgctttggtcatgcttgctcgatcatgtaaacttgagggtgtcctagaacaggtgagcgggtacatcatgtcgtcatgcttgtacgcattcgttctagtcagctagttataccatagctttttttgctagctctgataatacaactaacggtacaagatctacaaaataggaagcacgataaagacaaaacgggatgacctgtgcacatgctatctttattttatgcttgcatattgaactttatcctgccaaatgaggatctcttggttcacgcctacttcattgattaagcactgggtgcaacttttcatgcatggacttggatgattttttatatttatcagatcgctcaatctcatggcatgagccacgtggattcccaatttcctataagaaaggaaagtctgtacctgccatacttatctcaaatgatttgtcgggatgctgactggactcttaccatgtacatgtaattccaagatacagtttattctcaacttgcacaatctatatctgctttaaaacaattggatttgtcgtggagccacttaaaattgctattttcttatagtagcagtttgctgcgttttaagctctacaaataaatgctccatctaacttgctacctagtgctttgtcttttacatgctcacaatcactgtatatgtactgcatttactttctaatactatcactgttgttcatgtaggctgcaagggcattagctaacttagccgcacatggagataacaacaataataatgccgctgtgggtcaggaagcaggggctcttgaggcattagtgcagctaacaagctctcaaaatgagggtgtaaggtatacttctagctgatgtgctgttttaagttgcaacgcctgattttgccattaaattatactttatattatcctaatttaatattgtgattcctgtgcatttaattagacaagaagctgctggtgctctgtggaatctgtcatttgatgatagaaaccgtgaaggcattgctgctgcgggtggcgttgaagctttggtacgtgccccatttgtgctttaacacagctttgcatcctttgatcaacattgtattaagcagtacatctagttcagtaaatagatgcaatccctctataaagtttttcatatagcagttctgaataaaaatattggtctgtagaaacctctagttatttgattaattctgattgaacatattctcttgaatatgtttattagtactgtgttataccgactatcaactaaataataataaatcttctatgtttacccgtggaactggttctaggacacaatgttttaaagatcatttgtgtgtgctcctcccatcttttcataaatagacttaaataagctgtttatatttttcacatagatggctttcatattttaggtttcacttgcacaagaatgtttgaatgcttcggaaggccttcaggagagagctgctggcgcattatggggactatctgtttcagaagctaacaggtaacttcatatgcttgctcatgaactgaacttgcaccaactaccagat

SEQ ID NO: 55420 - DNA, 2032 bp, Oryza sativa
agtattgtccatgaacaaacagacgagtttgttgaagtagctacttgattataagtaatttcatggttagtgcgccaccttcagcttgtgcttttacctaatgttctggttttatgaagctaccactcgtcgtgttattctttttgtacatgcctttcaggagttcaatgtagatatgtattaaacttttttagtcaactttatatccagtggcgatgattcatggggatatatttgtaccctgattttatttatttatttatttattttgggcacaagatcaagtatattcttttactaacatatacgcacatgtatgcaacttatatgtccaagtgactaaaaacattcatttatcttatcagattaaacatccttaatccatttcaacttaatttgttgcttcatgccattgttttctaaccatgcctaggaaaatcctggctgtgccactgtttatataatgttattccagtttatataatattattccaattgcttgagagaacatattctgatggggaaaacatcatttatttgagtattaatattgtcctgctgcctgctgcaggcatgcaatttatttgttctctaatggtttgatagtactttgatctcacgtcaatttattctgtttgtttgttagagtgcacagcccagcccattgtttgataaagagggtagtttttctctctctttttaatatggtaacgggtgtaagttttttttgaaaaaaaaataaaattatggataaaacaaggaacgttggcattgacagttactgtagattgttatatctatcgttgggaataaatgttttatctgtcattgggaatgaatgctattccttactctagatatgacgactttctgtttattcaggatgttcacgagacagctgcaggggcactatggaatcttgctttctattctggtaatgctctctgtattgttgaagaaggtggggttcctattctagtgcggctttgctcatcatcagggtcaaaaatggcacgtttcatgtctgcgctagcccttgcttatatgttcgatggaaggtatgttgtttttcaaaccgattatttatctgtttgcttttgaattatggtgtatttcattcaattttgatttgtataaggactttaaactctaccagcaggctaacagcacacagttattctgaatgccgattgatccagtagtgttatcttcataattctatctattcatgttctttgtgatatacctttgtcttgaatgcaatatacacagtgcttcgagccttattatgacgattagttattctacacacacagaaaaatatgcattggtttataaaagagtttggtgacttcaattaatcaccaagttgcttatttttcagcagcaacttagattgcaagtttagggctcatttgacattctgtttgtagctatgagcctacaagctccgtttaagttggtttgtatatattgcttctgttaattgttttcttagtaatgtctgactatagttaccttaactccttactctccttattgaagaataacatccatgagtgatacattgatactttaagggctccacatattctctctgagagagagagagagagagcgtctgtattcaatgattggtaaaaaccacttctgaggaattaaaaagttaacttaccattgtagatcagcctattgttggtgtgcatcccctgctaactttcctactgtcgtattaaattgtgcaagcacatggcatttttttggcaaataagatttatttttttgcagcagtatttgaattggtttcttttgcattgaaacttgacagcattatttttattgttgttgctattaagaattatattctttctgtatttaatagttatatttttatattaaatagttcccatttccttgtactacttacttgaaaagcagttaactgtagatgctaacacagtatcacaatgtgatgtacttggctttatctttcgcagcatactagcatggctagcagattacttgtataatc

SEQ ID NO: 55421 - DNA, 2757 bp, Oryza sativa
atgcagtgtttatacaagaagctggacacctgagatgcaggtttggctttattctttcactaaagttttactattcctgaagtttagctggctattctttaggcagagcatgtggaacattttaaaccggattcatgcttgtcccgttcatcttattttggacctgtcttggtagcaatgtagctaagaggaatgtagtactaatatagtcctttacttcccttcagtggtgccgagatcgctagatttgttgccatgctccggaatcctgcatcaattcttcgcgcttgtgctgcctttgcccttcttcaggtttgtttccttccgtaccatcttaatattctgaagacccctatctattgagaaccaacgtattccttggctattccgcatgcacaagacattatgaaagttgagcaccattgatctgttctaagaagaggaaccatacctcatgattaatatcatgcttgcatgtatttgtgtttttatctctcaaacacacgtgcgcacacaaaatactcagacattcacacaagaggacttccatctgctcttctatttgatgcaaaatgattttaccatccagcaaaacatacttatagatctaatgagaatactcccaacataatgcagttcacaatccctggaggtcggcacgcagtgcaccatgcgggtctcctgcagaaagcaggggcagctcgagtcttgcgcgcagcagcagcagccacgaccgcttctatcgaagccaaagtctttgcaagaattgtcctcagaaatttggaacaccatcagacagggacttcaacatgaaagcacagcagtggagcttatgctaatcttccaacaaggcatttcttcagcagccttctcagcctgttcaaaacatcgcaaaattgcggcccaaggtaatgttttggctttcaaagcttgtgtcacattaccactcggcatgtgcaggctgtttgtttcgggatgtaggtagaatcacctaaagagagctgtgagctgagtaaacatgaacgaggcaatcgggagggttggggagtcgcttcatgcctctccatgaggggaacccatagagtagtttttcttgccttttttgtttgcgacgtggggggcgtgtgcaattttcttttattcatttggtgtgtaaaagtaactttgaaatgtcaccggcgatgggaattcaggaccttcatgcggtatacagtaagtttatttgttgattaatgaggtgtggtggtgccagactaggctgctccacctgcgctgtaactttgtaaatgtactgattactatataaagtttatgtttctggaatttgcaaggtgtacagtgaaaactggtgcttagtggagtacttgggtgagggatgggaaccctcacctccagcaagaaaaatggagctgcacgattaattaagtgtgatttttaaagcaagaaaaatgagttagtatgatttttaaagcaatttttctacagaaaattgctgtaaaagatataccgtttaacagtttgagaagcgcggacgcacgggaacatgcatgcctcgtagttctttttaccaacaaaggtagttgtactactctctaccgtacgtcagcggcgccacacaagatactgtgcgaggagagggcaacggtggtgggcgtcgccggagatggcaggcaccatcgctgccggcgtgtttttttcccgccgtgcaaaccttccattgacatcaccttgatcggtcccttcgtcgacagtctgtggtgccatcaaacccaacatcgtcttcttcttcggcatggggttcttcactcgacacctacgatctcttctgcattccccggcctcggcatggagtacgtacatgcgtcgacgattgacaggaacccccaccccccccctccggaaggggtgggggggggggttctccatgcatcgttcgtcgggatcctcttcggctccatcgtcgccatctcggcctagcacgcgtactcggtttgtcgtactctgagaaccacacatgcatgcacatcaacggggcacacaccaaagctggcgttcttcgcaatggacggtgacggcaacaaggacaacggaggaggcagaaacagcagtgccggcatgagaggagggcgtggctggacggtggcactgtacgagcagcaagggatgaggaagagagggggaggatgacatgggagccttactttattttataaaaaaattatgactagttgctacgtcggcgtcacataccatcctgactactgagtcattctgcactgcacttattttagtaaggcctccttcaaaggttgagacaactgctagctcataaatcgtacacatctaagagatagaacaagagatagtttctctaatgaactctctaaggttatctcttcttgcttttatggcagcatgggtagtaaatgacatggtgataaactacacaatatctctatggtccttcatgtgatgctattcaaaagatctgtcgattaaaaatgaacatctcagcatagtgtgaatatagataaatagcacaacgtcgacttagagtatataacaatgaagtgcaattcttccaactcacggtccacaacagtaactagataacatcatagccatatcatggcactttagtacaatgcggaaaagagcaaactgaagggaaaaaaaagactgcatcacgtcacagaagtgatagaagagttcgacaaccaccaaaagctggacagcaaccagaagtgcttatcccat

SEQ ID NO: 55422 - DNA, 2536 bp, Oryza sativa
catcgctgaagcttgggtgatcattactccctgcatgaacttctggtggaagaacaattgatgttcctggggcagcattcaagtcaataggatcttctgccatttctccctcgtcttccactatcatgttgtggagaattacacaagcttgcatgatttttcgaagaactttttggctccatgatcgtgctggacgatgcacgatgttgaagcgagcttgcaacaccccaaaagcacgctcaatatctttccgtttcccttcttgttcccttgcaaacagcttgtgcttctctagttgaggagatcttatagactttacaaaggctgcccattccggataaattccatcagcaagataatatcccgtgttgtattgtgtcccattgacaataaattggatttggggagcttcaccttttattgcttcaataaacagaggggactgattgagcacattaatgtcattgttggacccaggaataccaaagaatgcatgccaaatatgaaggtcatatgaagctacagcctcaaggataatagttggatacttttggtcacctcgggtatattgtcccttccatgcggttgggcaatttttccatcgccagtgcatgcagtcaatgcttcccaacatcccagggaatccacgagactctccaacttggagcaaacgctcgagatcctcagccgtgggacgacgcaggtacctactactaaatacctcgacgacaccttccacaaaattttctaagcactctagagcagtactctggggaaccttcaagtactcatcaagagtgtcagcagcagtcccatatgcaagcatacggatcgctgcagtgcacttctgcaatggtgagtgcccaaggcatccagtacaatctactctatgtgtaaaataggaagaccacttgcctagttcatccacaatgtgtaggaacacatgccttctcatccggaaccttctacggaatgttgcagcagagtagagaggatcttcagcaaaataatcagcaaatagttgatcatgggctccttcatggttcctattgatgtacttccttggaccacttgtacgcctagatgtacctccttctagtctggccttaatccttctgtcgatccgcccggcaaaagagttaaggacactatgctctgccatgaacatatctgtagtgtaaatctcggctgggtctatggaattgtcaaactcatccgacatgttttactggatggaaggaacagatgaggaagtgttggactggatggaaggaacaaatgaggcagaatagaataggaagaatagtactggatagaaggaacagaggaggacagtgctggattgttttgctagactgaatataacagagcaatatatagtcacatggtacagattaatttgtggtacattgactaagaatacagattataatttatggttatttgtggtacattgactaataatacagattacaatgcatggttatttgtggtacattgactaagaatacatattacaatacatggtcatttgttgaacattgactaacaataaagtgcatggtgattgacagaaaataccttagattatatcaccaagcagtttctccctcaacatcttgagacccatcacgtgctcagcttatctcatcagtcatttgactagtgtccatgctcatcaatttttgatatgattccgtcaagacagcctctctcctaagccttgctacttcaacttttgcatctgaaatacggtgctgagtccctaaaaactcttcatgtcgtttgctagctgcagcttgaacatccatgtacttcttcatatcttcatgtaaactgtcatcatcatccttgcctttgcctttgcctttgccattgcgttgtttcttagcttcattcctccccattgggcgctccttttctccgatatcttttgtgatagtgtgtcacttccatcatccaagctccgcttgtgtggcttttcaagctcctccaaaacagcatgccacttgggttcatcacgaagaaccttccaacagtgcaaaactgtgaatggaccttcgttaggatagtcatccacataaaactgattagcaaagtctctcaactgatcatctgaatatccactagtataaactaatgcagccttcttccaggaggcgcagaaaaatcccacccatctcttaatcctttgccatcgatctttgagatgctttacttcccttttccggttaataggtgtagtgctgttgtataattcaactacatctccctagtagctctcattcttcttgccatttccattgatcggatcattagagtggtacagccatgcactcacctacatttagcattatgtgttagtaaagtttcagaatgatggtacaaatccctgcaagttgtctaaaattttactcaccaaccgcaagtcctcatctgatgcccatgtaagacgcttagcagtcctaacatcgtcaccatcatctaagttgatgatagtgcctgaattagttgttggtgccataggtggcatagg

SEQ ID NO: 55423 - DNA, 2962 bp, Oryza sativa
caaaacatgaggtgggactaatggctgttgaccactttgtaacatgcttaggaaaccaccaggtggatgtatatccataccactgaaatatcaggagccaaaatcatgactatgagcgaggaagaaacaacacatttcctatctgtgctaaaacattattaattctacaatctaaatagtctcaacaaaaaggaatttgcttgtttcttgcagaaacaacacacaagcaaattggtttcttaccaatctgaggatgcagggtcaaaggagttggtgtgtggcaaagatccgttccacaaccctgcacatcgttgagagcatcatcagcttattgttctactctaacatccaggaagcaagcaaggcagagccactgcaatccccatcaggtttgagtgtacggtacagtacctggttggcctcctagaggaggagccattgcagtactggcctgaaagaaggcagacgaggcagcatcgaagcacccagaggcagtcgtagatcccgacggcggcggcggcggcggcgacgacgacggtggcggcggccgcggagctacttgtcgtttggaccggcagctcatcctgctctacagctcgtcgtcattggcaagaggagtggattcgtcgttgtgctcgtggaaacggatacgtcgacgccgccgaggaagatttcacacactggagaagaaaagaggagggagggtgcaagggaaggattggcgcgcgggtggctggaggatttgcgcgggggagagcaaattggcgcgccagggggtgggggagcgaattgcagcgcgcgggatcgtgcgggaacggggtgcagcgtgcgggggtgggcgggaggtgcggcggggcgatttgggggaagggagcacgagatctgattttggtgtggaagagtcgactgctatctcttgcacaggctcatacggcatcggtaactgagcgagataggcgtgggaataggagatagatggattgattttttgccttctctttcctccacataggatacatgatgatgtggacatgttatgagatagcttacaaggcaccattggaggaagcctaactggaggaatcattatagctgtttctgttgttgaattaaatccgaactatatacgagattgtcgaattggactttttcctagtgaggtctgctacataaaagcccacaattgcgttttgctaataggcagcacaattctagcatcgccagttctgcagttcaggtacgctaaccacctgccctacagtacacgacgtattccattaccccattacctttaccaaggtatttacatggcatcaacaattaagtccacaattcagagcttacatacaatccatgtccatgtgacgttagaactggtcactcggaacgccttcttctcgtgaatcaatccgacaagatgcgacgaatgccgaacctggatgatccgtccggtttcaagtatggcactatgtacttcttcgtgtcacttctggagatgctcaggtgacctcctggcactgatacgaacttaacacgcccagcctcctccaaagccttcaagccgatccagtcctccgtgtacaactttgtctatcacacaaaaatggccttacttaatacacacccctaaataacagtagtttaaaacaaaaagcatgctatgtcttctgtacaacaactcaagatatacatataccttttgaggtggctgcactggactgaaggcgccatcgggatagtacccgaaccatgccgtttcccggggtattaacactgcgtcgtcctcaaactgtttagcagttcaaaagggtatcagcagatggattggtccagtatggtttcatgtttcttgtaatcctttatcttaaaaatcagctatttgagatacaaaaactaagctgaatgtgttgcaacttaaatccatttgctttgggcatgcataaatggcatttgagttcagtaagattatataaatcaacaacatttatacaaaacacgagacaaaatgcatgtgtgacttaatgaactaaaaggtttatgtagcttactaaaagcatattgttttacacatcgcgatcataaatagatgtattgtgccttcaaaaaataaatagatgttctatttgttttcttttgtttttgtgtagaacaacttttaattcattatcttgttcgatatgatcgtttgaatgcataatgctatatatataaagttaacaaggactgcacacagcatattccatctacaccacatacaagtacccaacccagagtatgtcaaatagcaacaattacgtgttcatcttaccataatcaatactagattttccaggctgctgaatctttgtttatacgtagcatttctttcacttggtatctcattgttaagctttggaagaaacttgcaacccttcaaataatctgtcatatcctggagaattaagaagatgggttaaactaactaaaaggtttgttcatgcatgtaaatcaaaatagctcagttttatcctgaaacaaggtggaaaggtcaaaatgggcttcacagttaatggttacatatattgagtagttaattaactggtacagtggtatttttacagctgtaagttgtatcttgttacagacagatttgcagtccacaagaacctgtactaatgaatagcccatgcaggataaccatgcacgttaatgaatatattgggactcaaccttctattgcacattagataccaatgtacagccatacaagccaataagaattctgagttagttaaaacactaggctgtgtccttcccccattttcccaacccacctctctcgttttccgcgcgcacgtttttcaaactgctaaatggtgtgattcatgcaaaaactttctatatgaaagttgttttaaaaaaacatattaatctatttttcaaaaaaaaaagttaatacttaattaatcatgcaataatacga

SEQ ID NO: 55424 - DNA, 6981 bp, Oryza sativa
attcctgcagccccaagcagtctactcttaaatactggtctatacgcatatgcaaaagaaggagaccaggggaggatagagtgagcttacaccgcaaagtggtactgatgccgtaccagcatgaggaccaccaatcgagatgaaattctttacctgttacagtcagcaaataaactataactgtacataagagaggtccaaggcatcatttggatcaagaaaggttgggacgcatatggtaaaccacaagtacatcaaatttctcaccttggtgttgttatgttaataacaaaccatataaaatatattattattgtaacatcaggaagcgaactagattcacctaccggtggtccaccatcgcagtactcaattactgcccgaccaattaagttcccctgtaaaaggtaacaaaaagggtacatatgagggaaattttgacatgcaacaagaaacaataaggtgattctctagtgaaatacatggcattgaaaacaaaactcccactaagtcaataacccaaataaaaatctatcgaagggtcacatagcacactcctacgttttatactcaagaggtccacatagaacaaaagcgagacatgtccgcacaggcctaaggttgcgttcggcagcagcacaaagagaggaaaatcactttttttttttccacacaggcctcgtttgatttatttttatttttattttattattattttttggttttgggttaaccaagactgatcaaataggcttaggactaaaagaagacataacaaaagaacagcaatgcatagaggtacaagaagcaaagaacagatctgcatgttacaataaagctattgtcatgaacataaaatagcataatagcatgaacacacctgagaaaggccaactatgctgtaacctttacggagttctttcattttcttcacctggaaaatcaattccagcaatgatatagtaccttgagaattcagcatacagtacataaatagaagtgatggaggttctgaatcaccttcttgcaaacagtgtctgcctgtagatgaatacataatctcagaaacttgtacaagaacagtctatttgattttttttttaaaaaaaggaaattatcaagggcaagaaatcaacctgctcttgaagtggcatcagccaagagtcccatgctcctcttccaatttcactgaggaggaatacatttaatctccataagtaaactagcaaacaaatgcagcatgtgccaaactttttaaaatttgtactgatatatgatgtaacacatctcaagaaacaaagttgtggcatcaattggttgtaaggtcacccactagggtgtacataccataatactagatgaatttttcaacaatagttgtttctgcatattttgttaaggcccattccacaggaacaaatacaaaattatgaagcatatcagaatcttcattatccccactatggactgcgacaggttaaattcacttccaacagccaggaaggccatactaagtaatgtaaaagcaattggaacagacaacatattagttcctcaacatggcataaagtcaggagacttctaagatgtattgaattgcccaaacttggcttcatacaacagttgacatttaactaaaaatagagagcaggatggtaaggtacgaaaaataagatactgaaacaacagattacgtgaatacccaaacgtgtaagaaagaggtgaatgtcgcgataaaatctccaggcatccaacaacagaaacagttattgtggttgactgaaacaaatgcagcatgggctaaactctcaaaaaagaagttgggacatcaattggtttggttgtgagatcacacattgggtgtacataccataacagaaactgtggttgactttgcaaatgtataaaactgtatatgttactcccagatcctcctcacaaaattgcagggacaagttaacaaatggaacttgacagtaatcgtctcatcatacttcattatcctcgtgatttgctaaatatgtgtggagtatttcaatctattcctttttaaacctccccaaccccaaggatatataattaaggctaccatatctaatttgggcatctatatttattcgcattaacaatttcacatggaaaaacaaagaaataattaattaatagcctgtacatatatattaatggaaaccagagcactagtattgcacttgaaacagcaactaatttctcgtcataacaaaaggcaacatcacaattcacaaatatcacagctcgaacagtctccacttccagaacacaagggagagagagatggggggagataaggcgccattacatgcagtatcccttggagccggaccattccccaagcatttcggtgaaggacgccatcccaccgttctcgcactggtcgccgatccctgcgtgcgcccggacacagacaagtacacacgaccagcaaaacctcagacgaaatccaagcaccagcagagcacaaaacctaggggggcaaacaagcgagagaaaaaaaaaaaccctaaccgtgcaggacgatgaagggcacggcggaggccaccgggacgagcgccggggaggccacgacgaggaggaggacgccgacgagggcggcaccgcgcagcgcgtaggccatcatcgctgctggcggcggcggcggtgagggtagctagggtttgggaatcgcctccccctcgtcgccctcctctcctctccgcgacggcgccgcgctttcgcctcttgtgcttgtgacttgtgacgacgaggcggaggtagaagacggaggcggcgtgacttcgtgggggcccacatgtcagtgtgatgggtggctttcgggtggtggtgaagtgggcccgggccaactggcccaactgccagtccggtagtcgcggagatagtaggctttgggtgggccccacatgtcagtttgatggggggctttcggttggggtgaagtgggcccaggccaactggcccaactgccgctccggcgacttggaagttggaggaggagcgccgtcgagagctgacgtggcgcgggacctacagtagggaaggggcccacatatcagtgaagtcgcttctaagctttgtgttccactttgcttacaagcttcattcagccttcagatcctttcaaaaaaaggaaaatgaaaagtttcaagttttgttctgaattagatgacgctaatgcagctaaagttgttgcccacaagcatcattttgtgcaaattgtgcccacataccacattggcaacattcatcaagaagaagaagagtagggcttctcgccaatatcctgattgctgacttgttgtgaccagaactctctcaagtggacaacaattcagccgtagttgaacgtagcttaactgtttagatttcttgtggtggaactagctcatccgagttcaaatcctagatttaacaccagtgctcgcatttacagctaattattcttttagtggtaggaggaactcatatagatatcatatagatatggtgtgtcccgcgcggcgttgtgaatgcctatgtttctaaaacggatttgctatacaactggcgacagttaacaggaggtgaaaactttcaaattttaagctgtctaatatgctttgagatttgtgctagtgagggaaccaactggcgacagttaacagggggtgaaaactttcaaattttaagctgtctaatatgctttgagatttgtgctagtgagggaaaacggcttaaaaaattcaaacgcgtgctgtagggatcaaacccaacacctccaacttggaggtttgttcccctaaccagttctcccatcaggctattttgagttacactcgagttacatattagttatatagtagttatatagtagttacaatgtaattatatagtagttatatttgaaattttttcatcccaaaaactatcaatagttgtatagctactcccatctaaaaaaaagcataatgcttatttggtcaatcttttcggctcacacgggattcctgcgatgtacatgggccgcactgctgctagtctaccagaggtccacgcatccatctgggccgtatccttgttagccggcccagggtgaccatccctgggccggaaggtggcacactccatcagttggcccgggatgggattcccgttgaatagtctgaatgctactcctactagtcatccgttttttattagaggtagatgaaatttgaccattatttctaagcgtgtcaaaccaaacatattcgaatgcaagagagtattagtaaagctcttagtacaaatataatgatacaattttgatgctagattatttgaaaaatattgttgatcaaaatatgccaatctaaagttaaaactgacatttacacttgaacgaagggaataaaatcatagagatttagtgttccgtttttactatttaaaatatgaatgaaataatccatcttagaaactcaaattatctctctaattttttaattttttagtgcaagaaatatataacttcgagaaaaattacagctaatgtttttttttccaaaatgggcctagattaaccacagctggcttaaaagtctagtccaataagcttaagcctaaacaaagagggccttagcagagcttgtttccagtactactccatgcgcctagctagtcttttcggtgatatgatcttgtaagacgaatatttcttctctgtttaatcatcaaatagcatagtcaaaagcaaaatcacgtgttctaaaaaggaaaagaagaaagcaaacatcacgacttcaacggtcgatgtcttacaagtactactagccaatcattccaaaaggagactggagttaacgagatgtgcgctcaattgctctgagcctctgatgttcttcattagtactcttcaacttgtaattaatacatatttatatcatttcattgacaaatcgcaatgaagctactatgatcatcgatcacctgagcagcaatagaacgaaagaattcaatatttggccgaaagccaaatcgattacctaatattacgaagtttagcgaattaatcaaagaacaccctatctaattcaggattaaggccatatccttcgcacgtgacgtcacggacaccaccacgcggcagccatgcgtgtaccgcgccgggcgcgcgccatggctgcactccaagctcgccacggcgccgtccatggccggagctagcgatcgatcagcttacgaacagctgcgggaaggccatgtgcgggtgcggcgacagcggcgagagcggcggcaggctgcagatccccttcagctcgtcccagatgtctccggctgccgccgccgccgacgacgacgacgaggaggagttctccggcggcgccatgatcagcctctccttcttcacctccctcaagtagtactgctcctccgacctcaccctcttgcctcttccggcggacatggcggcggcggggataggggcgacgggaggggcccacttgacggcggcgtcggcggcgacctcgttggggaagttgaggatggccttggacccgcggagctggaacgcggcgcggtcgtaggcgcgcgcggcctcgacggcggtgtcgtaggtgccgagccacaccctcgcgcccttcctcgccgggtcccggatctccgccgcgtacttgccccacggccgctgccgcaccccgcggtaccgccggaagtcgtcctcctcctccccctccccctcccccgcgtagccgccgccgagctcgaagcactcctcctgctgccgcggcgccgccgacgccgccgcccacaggagcggcggcctcgggggcagcgacacgggcgccggcctgacacgcccagtacccggtggcgagggcgacggcgatggcgcgaggacgtggtggtgggcgtcttcgaggaggtgggcgcggatgaggtcgaggtgctggtccaagccgaagccggccatggcgcgacgacgcgtaggtgctggggcttggaggacgcgatcgaacacgtggtggtggtggtggtggttcgaggagtgtggcgcgcgagcgagcgatttaaagggggagaggggtgggggttggcggcttcgcggagggttcgaggcgcacgaagggaggaggaggccgcatctatcatgtcgtagtgtttgtcttctctggtccgagtactagtcccggtctcacttgtgacgacgagatcaacatcaacgtcgtctcaacttgtagtagctgtagctaagggtggagagtgactgttctaatagccacattgccccttgcgtgcgatgcttctgaaaaccatctctttttttagaacattatgaaaagcatcttcttttcttatttgtcccttaaacccacgacacatcacaccacgctcacatatgcacaaatttgtcttgtaagacatgcactccctcggttgaaaaaaaaagccaacttagcactaagatatggcacatcctagtctatagtggtgtttgaatctactaggttggctttttttttttttttgacagatggagtatatgagatggagatgatccgcgaacacccgtatacgcgtggatacgtctatgagacaagcttatggtgacgaacgggatcagcgtgtcccattaaaattatatgagtaaatttcacaaaactacagatactatgaccaaattatcataaaactacagatttaactcggtgtatcacaaaactacacatttaacaccaaatttatcacaaaactacacatttaagatgaagtgccacaaaactacatattagtaactaaattatcacaaaactacatgtttagaatcaatttaatcacaaagtaatgatgtttatagctccaccataacaatggtgctagggatttaaactccaaaagtggtatttttgtgataagctcaatattaaatatgcatttttatgatacttaatctaaaatctgtagttttgtgataaatttagtgctaaa

SEQ ID NO: 55425 - DNA, 963 bp, Oryza sativa
ctaaaaaaaaaatcttatgcttcattccttatatcatttgtttaaaactatttgttaaatttgtttattaaagcatttgatatcctcataatcaagtaaataatttctaaaaagctctataatacgtttcaagctgagcctaacccttatacacaaatatttagacatgaatttagattttaattgggtaatcacttgtatatgaatcaatgttgatacatgcatggcatagtacctcttgtcacacgttgccgaccaagatgcatatgtgcgggctgtatcatggtcctagaatgatttgtactccctccgtgtattagaagttactcccactggattgacttttctaaacttaaatttttaaaaaagctcgactaaatttatgaaaaaaatatagtaatatatattcgtagcaccgaattagttttattaaatataacattgaatatattattataattattttgatttatgttgaaaattttgttatgtttttttaaaaaaattgataaagctaaataaattcgacttaaaaaaaatatggaacgaaggtagcagtacccaaaataaaaatgagaacgcatgttagtgcaacttggcaagtagcggaggcaggagatatcgatcgatcggctaatgaaaatgaaaccgcatcgttcgtctgttcctattgacgacacgacagttaagttggccgtgtccagaaagcatgcagtgcacgtgctactacacgtctataggcagtacgcgtatcaggtatgtgtaaccagtagaagaatgcaatttaattttataacagcaaaatgatatggcctacttttcgccgtgtttagttccagaatatttcttcaaacttccaacttttccattacatcaaaactttcctacacacataaactttcaactttttccatcacatcaaaactttcctatacacataaactttcaacttttccatcatat

SEQ ID NO: 55426 - DNA, 2311 bp, Oryza sativa
aggatagataaagcttatgctatagagtagagatgtgggaggcttctaaaaaaaataagagtagagatgtgcatacgaggctccaaggatgctattgatagagtttgcaatatgcaaaagacggaaatgaggtggaaagagaatatcacatatacgtggcctttcacatagcactagcgtcgttggaatgtatcttgagatttatgtgcacgtcaccaactcaaatcgtaaaagacggaagtgaggtggaaagagaatatcacatatacgtgatcttcacatagcatgagcgttttttgaatgtatcttgagatttatgtgcacatcactaactcttctatgtttggaccctttcagtattagctgagttgtgactatagctggctacgcaactaaagctttacaattttgctcaatgttgtagctgtggttgttgcacagctgcagcccaattgtataaaaaaaccttttttatatttgcataaatcttgaggtatttttgaggcacatatccaagagaatgtaaaccaaacaaccaacttggaaaaaaaaaagaatgtgaaatagccattgaggagcagcaagtgcaggggagcaccatttctacgcccacacgtggggtgtccggcgcactctcggcgtttggaattggaagtttcacacgttcgtcgatggaacttatattttaagtgcaaattgaaacataactaatttgtgccttttgtattcatcccattccctgctcttttccacacttccattatttgttctttaacaaattacggagtgatttaaaaaaaaagaatgctatttgtgctctggcaaatgaagatgctctatagtggtggtccacagggacagggatgccgcatagtcctacatggtcagttaataatatacttggatccctaattaagtaattaggactcacctaagccaatgttgacttgaaacacacggattatactgcacggcccatcgtaattagcaaaggctagctaagttacagtttttcactggtgctaactaatactccctctcttttcataatgtattatggcaccgttaacatttaacgttatgtttgatcatttattttattaaaaagtagatattatttattttgctgtgatttattttatcatcaaaggaactacaacatcaacatattattttacactttttttattaaatttttaaataaaatgaatggttgtgttatatgaaaagttaacggcatcgtgcgttaataaacagtgaaaggcgccgacacggcgattaaagaagggaaccgaccaagatcgtgcttcgaagtgtggccactgcagagtactgcactgcactgcacttgctcagccttcttcttcagaagaagccaccgtcgttaacacgttaagcacggcgttttcctggaataatcctacctgcaactgcataaaagtagcgagaaaaaacaccgggtgtactaatggcagtaatcaaatggaggagattagcaatggcaggggtatcattagatgccggtaattaagtaagttgatcactttgatctctctgttaatttactcatttgatcttttctttaccggttaaatcacgtttgtgatggtggttagagcagagggtgtcttttggactcatctttctccaagttgagcctttttctctgacgatgttgtgttctgacagtgtgcaacgtagtagtccttcattattgttcactgtattgggttggaccaattctgatgagcaagtatgtaccgttggttcctctccgttcgtcagagccactagatctgataataactgttgggattgcttagaggaaacttggtagaaaacttcagaaaaaaatcacatgtttgatttagattattaagcagattattattgcaaacatccacttgattataaatgtaaatgcatattttatgaaataaacttaacaaataactttttttagataatacttaacaaataaccaaaacaagttatctaaacagtagaaaatgctttttcttaagaaaacatgttccttttaatcacgaagcaaaataatcagttttaatattccagtaaataagttggaaaaaacaatgcctaacatacataacgggttaaacagaaagcctcttacaacgcaatgtttgacaagctgaaaagcaccaataaaaccttccctgtgatatgtctattatataagatatccttttaaaagcaaaaagggaaaacatgttgtgtcataagtttgatagagaaaaaaacagttatgatcgcacatttgtggtgtttcatggggagcgaagcagct

SEQ ID NO: 55427 - DNA, 2372 bp, Oryza sativa
gatgggaggacgacgacgaccactacgcgtctgacgaccacctcggagaccagatcggaggagggggaaatggggaacagatcggagtgcggcttcgcggccagatcggagtacggcggcacggcgccgtcggagtacgccgccgcgccgctgccactgccgctgaggaggagggacgagaggtcggaggccggggactcctcctccacggtcacggcggccgccgagatgcggatggtgatccgccaccgcacgctggcggagatcgtggccgccatcgaggagtactttgtcaaggcggccgaggccggcaatggcgtctcggagctcctggaggctagccgcgcgcagctggaccgcaacttccggcagctcaaaagtaatcagagattcatagcagacatattatgcttgaacaaaaactataatgtggtttgaattggtgtggcaatgtacatttttagtgaaaaaacgcaagcaattgcttaacaatttcacttaatttgacttcttcttttgcagagacggtgtaccactcgaacagcttgctatcgtcgctgtgtcgacatggacttcaaagccaccattggctgttcgctacaagttggacaccaatgcgttagagatggagtcaatggaagggaagagccatgggtcgacactggagcgtcttttggcctgggagaaaaagctctatcaggaggtcaaggtaattctgctcatcgacgcttgattacaatgccattcttgactgctggttagtggttatacttaatagatgagcacaccactaaaattgaggtgtttgtttgctgtgacattttttgttgcacgcctcatcattcgttgtcggtgaagcatcttcaaactattcacttggctccacttgaaaattatccagctatatatatttgctagagcatagtagtggactaaccgataatttaggtcactgcacaactttagcagcaatgcaagtttaatgaggtgtaatcttctagtagccacccttgttggatgctagaatagaatgcatgaactgttgcacttggcattgcagcataggcctacctagcagtcaaataatcaaggatgaattgaggctaactttaacacttctggtgtagcttctaatcgattaggtgaagcttcacctcatttgaaattggtgttttgagcagcccgccttttgttcagcaaatgtggtagaagaatctgattctattgcataaagcgtctttacagaggtcctgcacttgcctaccctggattctgaaacagctgtagcatttggttgataatttttcactactttcagtaaaggaagcaggcacaatacatggccattgatctctcaaccacaccttcatataccttcctttatgctctttttatatctaaactactcctgtcctttgagattctttgtggctttgtgggtgaaggtttagatcctcaagaaattgtctttactgcacataaatatacctcataatgccaaaggtagatttagcgtatctatgtctaaagcaccagagtccagagatgtttaggcctttaggggcattacccttggtaggcatgagacttataccatatctattcgataattgagtgagactaaccaatgttctttttatttctgcaatctagaacataatggattcttactgtccggtgtctactaaatgcttctattctctaagcagtttatgaaactttattgaaactattcccatatgtattaactttttactgcttcaggctagagagagcgttaagattgagcacgagaagaagctttctactctgcagagcctggagtacagagggagggatagtaccaagctggataagaccaaggcctccataaacaagctgcaatcgttgatcatcgtgacttcacaggccgcaactaccacatcctcagccattgtcagggtgcgtgacaatgagcttgcaccacagcttgtcgagctttgcttcgcgtaagacttgttccctgttctgacatctatgataccagattttgcgacattgtgtgcaagtatttaaattgtatctgaatattgatatgcaggctgttgagcatgtggagatcaatgaaccatttccatgagatccagaatgaaattgttcagcaagtccgtggtctggtagacaattccatggctgagtcaacatctgatcttcaccggcttgccacccgtgatcttgaggctgctgtctcagcatggcactcaaacttcaaccgtctcatcaagtatcaacgtgattatatacgtgccctctatggctggctgaagctcacactcttccaagtggacagtaatatcccacaagaggcttacacctcgctgatctctcgtgaa

SEQ ID NO: 55428 - DNA, 4869 bp, Oryza sativa
attagtgatgagaatatgggggagaaggctcccttgatgttttgccttgttgggagttggtcattttggttgtagataaatgattttactcaggattgttgatgttcttttgcttgtcctgtgaagtgcaagggaagattacattgtacagatgctgtggtcacttcacctagcaaatctaacggcgagttatgcttgcacttctcccatggaagatagtaactaaccatttgttcttctgggaaaaaaatgtcagaattctgaactgaattagctatgtttccagtggttggagacttggagctgtccctgcatctttgtgctgtctgactgtctggatggaggacattcgtcttgaatctttgatgtcccattttggcccccatgtaattaatgtcgtgctgcattgtccaagattaactaaaacatgatctagcaacgtcattgtagacttctggagttttggccaatgctctgatgctcacaactcaccacagcctctttttgttgtttgtctgaaacgacacataatcatatctgcttttgcacatgcatttcgttctaaagtttcgtctgttcttcctttcctacctgcatcaagccagcaagtctgcaacaactgtaaaaaggacctgccttttaaagttgctgtaacttagccgcgaagggattagtcaaatgctgtgtcactactcatgcatgcccctcttgtctgccatagcttgcattgcatggcatatctgaatatatctgaatatctgatcagtgataactagttgcccccctcttcaacaacatggtggcttggctggctgggagatgaatagcagcaaggctggcaatttggacctatgctggttgttggacacagctgcatcatgcatgacaaggctgttggtttgcaaagggcaactactctcctccctttctttcttgtgaaagggcatgaaaaagtggttgtggcattcatctccatggcatatgcatgatactagtaccacattgcttgatttgatggctggaagcatggagagaattcttggggcatatggtatcaacatgtgccaccttttcttttttgcaaacaaaaactgctcctcactggtttatgaaaaaaccgataaaaaaacttggtttacgaaaactgataaaaaaaccgatgactttcagttaatgctagaaaaaaaaactaaaaccgatcggtttccacaaaatgaccgctgacgatttcatgaaaaccgatcaattttgtgaactctggttgggtccccactgctgtttcatgcccaagttgtgagatgatttgtgggctagggcaagggtccaaaaaacacactctcatgctggatagagaatctggtgataaagaagtgtgtctggttttgtatgtagctgaaccttttgcaagtgtaggtgttaattgggtgttttggaccagacaataccatggcacctataagtgggtgcttctattgttacacgagagaggataagaacttggaagagacatgatagtggcaggcaagatcacagttttttttttcctttttttttactctggtcatgcattgtatgatgatgttctatatggaacagagctaatgatgtggtgtggcttgtgatgggctctacgcctatgggctatggccatgtgcatgacaaaaccaatgatgatgcatgctcactcgatcatttctgtgagcaataaggtcttcaaaatgaggctttgattgctaattctggttgcaaaacattagaaaaaagaaagaaattcataatatcatgagtccataatagtaaatttttaggcaaatctatgcatatgatttccatacaacatcttatcgaaatatataaaaaggatatcagtgttctgcattgttaaagaaacccgcctgcctcgaggtatggcatgcagtgtggaactaagtaggatccaaatacaagaaagtgaacactattgtgaaacaaatttctaggagataagttttttttgaccaatccaaatcggagtagagataaaatatatccctcctaagacccttgtatatagaggggcagtatgagacatctatgacgggcttgtatttgagattagatctatgatgaatagaggacttcatcccacacatgtgtacattgtctacttctgtaatgttcttaatgataaagaaaagcgccacaagtgttctacatcttctcatgtctctactgctgtacaagggacggggaacggatccgatgatccactaataggcgcattggtttacaacaaacataatgcggtgaaattataaatataggatccaagtaccagtatctctaggtagagatagaaagcgacgcgccatgcgtgccatggaccagtatgcaagtatgatcgagagagcaagcggtgacgtaccaacgagtgcacgaggccggtcgtcgccgacgagggaagcggcggaggcctcgctggcaccggcggcgccatgaaagcattggttcggcggtcgctgccctctttaatttcaagttttggaaccacaaccaaaaatgatataaaaggcccaaaataaaacacgctccaacgaaagtattgatgggcagtgtatgtatctatacaggcctagtattaatgggccggaccaaatggcccaaatccgtagctcattataatgggcctttcttccggcccagtttggcctgtcaaaaagtccaccgggttttgcatttcactgcactgcagcaagccagcaactcgtacaggcagcagcattgattgcatcagatcacggatgttgctgattcatggcgattcatccagtgcccgttacgaaagcgtcagtgaaagccatttactacgacctcgcgtaccacgcaatcctgacaaatcacatcgatccacgcacgaaagaacagatcgatccatccatcgagcagcaacacacaaaaatcaattcatggagtaattgcctgcacaattgcagcagaaaatcaattccgaattaattaattaggtcatgtttagattccaactttttttcttcgaatttctaacttttccgtcacattaaatatttagacacatatatggagcatcaaatgtggacgaaaaaaaccaattgcacagtccgactataaattacgagacgaatcttttgagtctaattacaccattatttaacaatgtgatgatataataaacatttgataatgacggattaattaggattaatagattcatctcgcagtttacatgcggaatatgttttgttattagtctaagtttaatcctttaaatatggagaaaatcccctgtgtatcattgaaagttcacctaatcccttctgtacctgtgaattttgctcaattccttacatacccctgaattttagtttgtatcccttccatgccctttccgttagttgaccgttaaattcttatgaaaaagtccattttgccctttggtataaagaagcatataaattaacatagtatattgttggagcatataaatttgttatatgagactattatgtttatgagatagttatgcaccatattatttgcgataaatatacttttagatatgacataaaaaattaatattaatttattagttattaaaagattttttttatcatatgtgttctggagtaataaacaaatctgttgtattactatgaaaacacatatgctacataaaagaacttttactttttatatcatatgtaaaagtaaatttgttaccaataatatagtgcatcacatattcataaatataatagtcttatccaataaatttttacattccaacaatatacttcattaattcattatgtttctttatagcaaaggtcaaaatggactttttcaaaagaatttaacggtcaactagcggaaaggatatggaagggatccaaactaaaattcaggggtatgtaagggattaagcaaaattcaggggtatagaagagattaggtgaactttcatggatatataggggattttctcttaaatatgtgtccctgtgagtaaaaaaaaattttggccaaaacaactaaacacggcctaattaacgatcgttcaatgcattgcaatttggcaaagtttcaagaatcattcatggcggcgttgcaatagcaggacaggagagatggagcatgagcccgccatcatggcggcatcggaatcgggatccgcgcatgtgatcgacgacttgaccatctccatctccctcctcgtccggccgccgccgggctagggcttagggctagctagctcgtcgcttttacagctcacaaagccggcgaccatgccggccacgcggtggaggctggagccactcatgccgactaaaatattccatcccgacctcgccaaaaagctccatggcgtaggtgagaaatcaaagtggtggtggtggtggtggtggcggtggcggagacaagccccaggaatcttccccctccgcgccccaatcatggcgcactaccactagctttgtcgatcacaagccctccctacttgttgccgcgccgccacgcctcctcgagcgcttcgtctcggcatcctatgatcggcatggaggtggaggtggaggatgacatggtggagtggtatcgctgcggtggcggcggggcggcggcggcggtggaggtggaggtgagggagctgagggtggagctggaggtggagcggcggatgcggcggaaggcggaggcggtgagcgaggtgctcgccgtggagctggaggaggagaggcggcggcccggggcggcggaggcggagtgcaggaggatgcgcggggaggtgggcgagatgcgcgcggaggtggagcgcgcgctggaggaaggcgaccaccagcgccggatgctgcgcgt

SEQ ID NO: 55429 - DNA, 20044 bp, Oryza sativa
  unsure (1)..(20044): unsure at all n locations
cgccgcctcccataacctcgtcctgtaacccactaatctagagttactaatgcttactaactaatgatgtactactaatgctgtgatgacttgtgaagtgtctccataattccttctcttgttcttcacaatctattgcccttatgtgtctctgggcattcacattttgatacgcaatgcttcccacatctatgcttgctcttgtaaaagaacatctatgcttgctcttgtaaaagatagtaacatttttgtatataatcatggcaagaactaatgtgtgattatgcatgtcactaacatgctgtacatggaaactttttgctactccattaagcctactattggagtatttataggtgctaagtgctaactagttcatctgtgatagaattgcaacagcagaggggaaaacacagtagtacaactggttggtcagattcagataatgccttttgcccaaatgttgaaagtatgggactcactgactagtgactacagttacaactcaaactaaaacaagtatatggttaaaaacttcatattttctcagctgcctgatgcaatatttggcagatctttgcattcaccttgctagaagaactcaaagtctaggtacttgcctccagactctacctctggaggccctgccattcttttgctgctgttggtgctgttgcaattgctgtggattgccatctcgacggtgtccaccggcggcggcttggacatcaccgtcgccggcaccgccgcggcgacggcgacgggctcgacagccctgggcacgccgggcggggtgctgcaccggatgagcgcccagttgacgccgtcgaagaaggggtgctgcttgatctccgccgcgccgcgcttcacgccgagccgcccctgcggctccttggcgagcagccccctgatgaggtccctgccggcgttgctcgtcggcgggtggtccgggaaccggagctgctggccgacgacgttgaacagcgtggcccggttcgtctgccccttgaacggcgtcctgccgtacatgagctcgtgcaggaacaccccgaacgtccaccagtccaccgcgctgccgtgcccttcccccttgatgatctccggcgccaggtactcgtgcgtccccacgaacgacatcgaccgcgcccccgtcggctccaccaccacctccggcaacgccgcggcggccagctgctgctgctgctgatgatgatacctctgcctcggctggctgctcttgggtttcttgccgaacagcttgggcatgaagcacgtcggctggatgcaggcggctggctgggcggcgcacgactgcgcattgttgcccctcttgggatcggagcccagggatgacgacatcaccagcgtcggcgagacggcgcagcggagcgagaggtcgaagtcggagagcatgatgtggccgtcgtccctcaccaggacgttctccggcttgaggtctcggtacaccactccgagcatgtggagatactccagcgcgaggagcacctccgcggcgtagaacctgcaaagccccggaaaagaaaagaataaatcgtatgcttcagtttaagatgagctgatgaagagaagaatatggcggatcaaacaaacgtcatgaagaagattacatgatacatcagaaatattgggaaaaacaagtaggataatcatgtttgttaattcagggacagatcggaaaagatgtctatgtttgagatacctaattcgaacacaaaatgggttagtggggaaaatgctactatcaacctttagcatgacaactgacacatgctttgtggtctgctagatttgttaattttagatatcctgttccacaacatagaaaaagcagcagacaggcaaaatgccccactcgagaagtcggagcataatccattcactatactattaatacactaatgtcaattgaaatgctgaaaaaaaaaactaagccattttgttaatgtgtcaatcatgcatcagttccagcttcaggcttggcaagattaattttttagagaagaaaatttctgcaatactgaaagatttctccagtgacagctctgaactgccatacctgatcttgtcactttaaacagagtatggtttcttgctgaatgctaatcctatcaagattaggagcctagagcaagagatggaattaaagtggagtgaaaattacctcgccgcgtgctcggggaagtgcttgccgggctggcgctgccggagagcatggaggtcgccgccggggcagaactccatgacgaggcaggcgaacctgtcggtctcgaagtgcgcgtacagggtgggcaggaaggggtggtcgagcagctggaggatctcccgctccgtctgcgcccggctcagcttccgccggctctccagcgacgccttgtccatcaccttcatggcgaaccacgccctcgccgcgccgccgccgccgccgacggcgacgttgctgagctcggacaggtacaccgtcccgatgtcgccgcacccgaggcgccggaggaggcggaagttgcccatggcgagcggcccgtcccgggctcgcgccgcgaggatcgccttccacctcgggtcgccccccttgtgcggcttcccgccgaagcctccgccggcggcgctgccggcgccggccgtgctgttgctccacccgctgccgtcgctggccgcgctgctgctgacgctggtcttggcgctgaggctggtgacggtgcagctgggcgcgatgctcgtcaccgtggccgccgcgccggagctgtcgatgctgctgtgcgggctcgccgcgccgctctgcggcggcgacgcgtcccacatgatcaccggcttggccgccttgtcccggccatccacggcaacgaacaccgtatccatctcatccaccggctccggcgggtggctcgccccggagaaggagctcctgggcggcgcgtccccgtcctcctcgtcctcgctcgacgcaatgctgagcctcacctgctccagctgagcaagaaccttcttctccgacgacttcccttcaccaccaccgccgccgccgccgccgacgtccatgtggaactggaacaccttggggagaagctggaactggaactggaaatcttggttgggcgcagaaatggcggtgggcagctgggagcgcgagcgcgcgtggtgaccgtggcttcttggcggcttggcgtgcagtgagcgtgacggatgcatctcctctctctgtgcttggattaatggaggtgaaatgcaacggacaaaagaggttggggagaaaggacagaagctgcaggatgcagatggagagagaaaccaaactgcagcagcagcagcaggcgttgcaggctttgcagaggagagagagagaatccgagtgagctgcagaggaacagaggaagaaccgaagaactgctgctgctgctgttgctgctgtcttcttcctctgcttcggctgcttagatgttgctgtttgattgcaatgcttatattaccgttagtgaagaacaggtacagtagtactagagggtttggttgataagctgcggctgtcagtgtcgtgggcctaaggaatgggtatgctataccggttttggagcgggtttcgcttgaaatggttcagttctcatgttccaaacaggtttgggaatcctttaaaaagcaggatttttatgggttcttggtagaaaacagttcagttcctatgaaattccttcgaaaatcatacgctccaaaggagaccttaactatatataagaggcagtgattcacaaatttgttctctctatggactggcaactccaacttcaagttttttttagctagatatatctcttgcttcaaaaattcctggagttgaatatgtgagtgaactaatattattgtttatattgtggacccaaattagatgactaaaccactttactttagtctacaaactctattttctacgagtactcgagattatatagtcatgacaaagtctttgagcactcaatggggactaatcctgaattttcaggacatcttctaatttgttcaaaccaactactattaatattgtacaacacgaaggtattactatacaatagtactactctagtactcatctactcattgtttggatggagcggtaaccttatgtattggcacattttaatggcatgatgctgtggcttacttactctgcacctaacctatagaactttgcgttgtgtttcagtttctatacattgagcattctatcttactcaatgtcattgctatgagtagcatattctttacctcctaaactgtccttcctagggatcatcttgttcaaaaccaacattccctttattctagaaaagggtgaaaaaaaaggggaaaggagaccatcaccagattcctttccctttctttcttgaaagaagcgagcatgtcttttgatgatttgatccaagagagattgaagttgcatttttttttgtagatttgatccaagcgagcatgtcttttgtagctgaggcaagatcggtcaaagggggtatgtggtgcttacctgtgtgtctcgttctttgatgcgccgatttcactttgtcagtcatcagagtttagtttagtggtgtgctacaagtttgttgctgctgcttcgtgtagggatcgatggagcttcggcttggatcatggcacacaatctgatgatgcatccttgcttcttttttccctagttttgtttgtagtggagtagcagcagcattgcagcagtagttggaagaatgctttctgtgaataagccagagaaatgacaaatagcttttgacctgtaaccatcaaagaagaagagacatcagctgcaagcctgcaacgtactactcctatgtagaagaagagccaaaataatcttctctgggaacaacgtctgcaagagagctggttgttgttgtggtttttgttgaccatgaaatagtgtgtgtaacaaaaaagacgagcactggatgagccttacggcagttggcacacagcaccatttaggtgttggtttgctggggaaaaaacagatcttcattctgacaagagacctaaacagagagatgttcatcacattcaacacttcgattactccattacttcatcaaaccaaaggaacacatgtatgcgcatggctttgcagactaactcagttgcactaggtgttttgattgatgataactcgtgtttttgtgccactaccgtggagtggtggcacagtcgggaagatccatgagcatatagtttttgacttttaacagtacgatcatcacttaagacttcaccaaggacaaattaataatcaggatgcaagttgcaaacaaggacaagaaatgcaagagcaaatcattagccagctagatcaatgtaatctacagaaatctacagaaatataaatatttgagctaatgcttgaaatctattgtcaaaccggacagttctatcaattacaaaacattagataggtttgaaccaatgtccttaccactgaagagtctgagtctgaagggcgttatccaaagcacattggcccatcttattcacgtaaaaccccaagcaaatgatcaccggctccaatcgccttctgaaattcaaacaagaaatgcatcagcaattcagcattgcccttaatcaccatccacacgaattgcggcatcgtggtagagaacatgtattggacctgcagcaaaactgttaacagtacattcattggcacacatgaacttccatgtatcgaaggactgaagaaatggcacaccctgaacataaacgaacaccaacaatcgcactaccaaatcccaatcccaaccgatgacggcagattcgtcagacgagaagtgggtggcgcagcgcagcgtagtgagggtgctgacgactcgcctcgccgccatggcgagatcgatgggggcggctgatcccgcccagcgatccgcccgttgatgacctagtgtgcgctgccgtggcggcgcggggaggcgagaggaaagcccatagatatctccgcggaatcgatcggaggcggcgtggaccaagcaggttggggaggaggaggataccatcgccgccgagcagagcaccaccaccaacctcttgatctctcctctcagcgagcggttccactcgggttggacgaattcgagggggggttgagagatcctgagatctacagaatttcccttgctggccatggaagaccagatcgtcggcgaaggaggcggcggagctcgccgggaacggtggcggaaacggcgacgagggcggaggatggctggtcgactacgtggagcatcgcaggccatccgtcttgatccgacggccctaagcgcggccgaacaatttgggccgtattcccaggagcaattcaccagcagtttgggccggaatgggatagcctcgaactcaccaagattaattgggccgagtatttaatgggccgttttgctgaaccgcgagcaggcctgccagtaatggcctccatgttgggccgtattcaattgcaacgcagcgagacaaggcaggccgacctgtaaatgggccttttggtcagactgggtatcttggcccagtagttcaccaagacaagaaataagtttacattggatcccttaatttgtcgtcgagtctaaaatttatacctaaccgcaatacatatggcgcatccctagactttcaaaaccaatacaaataagatcccaatatggtggttcggctgatgtggcgcctacatgacattggcatggcacttaaagtcaagaaaaaccatggggtcgacatgtcagtgagtgtctgattaaaaataaaaaaatgcagtgggtatcgccttccttttattttctttctcttttctcctttcttgcttcttctccttcccggcatccaacagccacccatggaccgccatccttctccatgccgaggagccacaaggttggcggagaaggggacccggtttagcactacgtcagccgaaactaccgttgaaaccgctttggaatcttatttgtattggttttgaaagttgatggacacgtcatatctggtagtacggttcaggacggatttcagattcaatgataaattgagggatctaaagtaaacttatatcccgaggcaacggcaagtggttacggtaatacaacatgatttacacagtatgacgacttcattttaaaaatctaagcttctttcaactcccatacatgcatacactgacatcaaaatatatacatagtccgtactacacaagtactgctacattattttttaagggactgctaataatttaattaatcaatcaaccatataataaactatattattacaaatctaacgcaagccacagcaggacaacaagcaggtgtgtctgctgaagcagttagatatatttttttatttttattagagctaaaaggtaaaataagccataggctagcacgtcgttagcattgagcacgttgcggtttgatagttggctgcttatctactccactaccactaaggtgcatttgcgtgatccatccagcagcatagtgtgcgacaaggtttgtttgggctgattgcattgcgtaacaaatattcttttcttttaatatattgacgtgcattccaattacacgtttgagaaaaactagatttgtttggagagttttggattcggagaaatagctagtgagaatataaaatagatgtggaaatgatcacttatagtttttttaatctacaactgtacagcttttgttataacttgaataaaagttaaaatatttaaacgaaaattttgatttgagagaagttaactgatggaatcatatatatcgtctccgacagtgcaaggggagaaagaatgtgtcatccactacactgaccactgttgacacgcacgccaccgaggcatgcatccacagatccacttgcattctcgctgtgaacgtggtagagagaggccggtttgtccctgcatgttgccactcctgtcactgtccttgttgcccatattacattcagccaccccccacacacatataaaaagaaagaaacatccacttatcatatcttaaaatgtatttatagagactttatataaatctaaaaagtaggtcaaataaaatgatgaaagattgttattggttgataagaaaacgtagcgggacattaaataggagaaaattatgattagttgagatgaaataggtgatgaaatattttaaattttggaaaaaaaaaactaaattccaaaaatagttatgtttttggacggatggaatgtattgttttcctcaaagagtgatgcatattatatatatggagtagattttctttctacggattttcagaaacaagcctctgaacgaagttacgaaactcatgtgaatatatgacctatcttgtacgaatggggggtgaatccaacatggatttcagcggttcaagcatttgaacgaaagtttgcacattgcttgcttaacctctttggcactctcttcatcgtagtaaaagaatagctcatgaatataaatctggacacagggaacagtggcggatccaggatttgagcaaagggtattcaaagctgaaaaaaaaatcatacagaactcaaaaaattggactgggaaatcatacaggagtggtaatgacatgtttaaagccttaaaggtacaaacagtagcacaatagtcaagatgtctatctccaactgcacacttggggacatatcactatcataggcattgggtgcttcaagtagtagctgaataggactagaaggggcattttctgggatctgaacttcactctcaatggttaatggttttggatcagaggtggaagctactttctgagacttggttgacctttcccacaaagacttcaaatctattgtcttcttcttcttcatttttcaaatttcaagacctacagttcaaatttctgactaatttaacttctaagcaatagcaattaagcaatggccaatcgcttggggaatttgacaagaggatttattttaccagtgccagtccactgtccagctgtctagggaccaaggggacgcgccgacgcgggggtgcgtcgccgcaaccggctgccgccgtgcgccgcagcgccgccgccgtccgtgcgaacctcagctgctcagcgtcgcccgtccccgaggaggcggcggcgtcgtcgcaggccacgccgcctccgcagcagcaggcccagggaccagggtccagggagatgaggctggtggcgattctggcgacgcgccgagccggcggccggcgccgccgagcgtcgagctctcgatgccccgtcgcccgtcggtggggatgagtggaggcgcggcggattggggctgggacgacagaaggcgtggggactagctgaccgggggatagggactagggttttgttcgtttttgggccagtgggcctattcgttgggccaagatggggaggaatgtatggtctgctgcgaataaatgggcttcttttcatttgggctatacatgctgtacttccttctaatttctcatgtatatatgcataacatacctatatatagttatttttttaaaaattctatgggtattcaggtgaatacccatgaatcacatgggatccgcccctgacagggaattcgttttttatttatagagggagtaacaaatagtcctggagctcttgtctaaataataataatggtatttgaggtacgaacttcagtagttcaagcatcaaatcggtactgtatgtcacatatgcttgtgcctgatgatgcacatatgcacccaatgatgcacgatcatgagtggttgacaggggcgaagctagcatcaaaataagagggtgcactaccattgagaatatagaaaattttaatacaacactatatattttagtctttttaagtgagaaattaggaattggggggttcatgtgtaccccaaacactatatagctttgccactgatggttgacagatttcgtaatgtccagaaaccagtcatttgataacgaccacctaatttgccaccaaaaagcatacgcataacgtacgactacaccaacaagttcatcgttagttctcaaaaaaagttcaccgttaagttgactcaaccgcatcacctcttgatcatatatgcagtagaattaatgcacatcaagaaacacgtgcagatacatctcaattacgagttaaataccattcccgagtaaattacattggtggtatataaacttgttaggtgtgtgcaatttagtatatgaacttgtaaaatgttctttttttacacgaacttatctaatacgtgtgatctaggtctaaaatggcttagcaaggttaattttacctagctgatgttgattaggatgtggcgtccatacgaatagtgagtatgcataaaatatgttatatttataaatttgttctctactttatcttgaatttcatatgtttctaacccatgaatcattgctcggtattttatatctttctctacgatcactatatatcattctatctttttattgaacaagtgtatgtctctacgtagtatcctaatcagcatctaaatcaacaaattagttatataatgtccttttgactttaattcatatgagcaagaaaagttcacgtatcaaaacaagcattttacaagtccatacattagattgcacccacataacaagttcttgtactatcgatacaatttactcctataacaattaaggtggtacacgacaatgcatgcatgctacagtggtagtagtacgcaacgatcatgttgggctagccaagtagccgtaatgcccctcggctccgccgccggcgccgttggcggtggcggtccgcggcgtcgccggctcgaagccgagcaccctggcgcgctcgacgtaggcgcccctcacgttgggacgctggtaggtcagcagccgcgccacgctgcggctcgcgtcggcgcggaacggccggccggagccggcgaagccgtcgagcaggtggaggtacgcctccaggtcgtggcagcacgccggcccggcgtccgggcggaggcacggcgagtcgcggctgtccagcctcagctccgcgccggcgtgcacgtgcccctccccctcccgcgccatcgccggcgccggcacccgcgtcaccacgtcgccggcgttcaccacgcggagcacgttcacgccgcggccgttctggaggcggtcggcgaacgcgcggttcccggtcttcgggccgccgaaggacaccacggcgatcggcggtggccgccggcgatgttcagccacgtccgcggacaggcaagcgctgagctcgtcggcggcgaggacggcgagcgacgcgccgaggctgtgtcccaccaccgtgatgctcagctcctccccctcgaagacctcgacgaggcgcctcacctcgtcgactatggcgtcggagaggctggggacgtggtcgccggccgtcttgtacaggctcaagaaccccttcgccaccttcggcgcgttctgcggcgagccgacgtcgtcgtcgtcgtcgtcgtcgaccggcacgaggccggcgcggaggttctccgcccactcggggcacgtcgccgtgccgcgcaggacgatggcgatgtcccggcggcccatgcgctggacctcgccctcgttgtcgcagacggcgacgtagccgacgaagctggagcgctgcgtgagccacccgggcgccgaccgccgccgcgcccacgccgggatggacagcgacgacgtggcgaacaggctgcgcgtcggccggtacgaccggtcggggagcacgagcgtccggtgctggctgtgctgcgacgccgccgccgacgacgacgacggcatggagtggaacgccgtgtacgcggcctgcacgaagtcgccgtagcggaggacctcgcggcggaggttctggtcgagcgggtcgagcagcccgtcccagccgccctcgctgtgatacctccgccactcgccggcgatggagcctttcggcgagggccgcggcgacagcgtgaggaggcgctgcaggtgcgcgaggctgcgcggcgacatctcgtcgacggccggcttgcggacgaagggcaggaacgtggacaggttgagcgcgttgagcagcccgcagcggccgctccggtcgtcggtggtggcggcgccgccgccgtcgccgaggtcatcggccggcggcgcccccttgttctggagcggcagggggagcggcggcggccggacgaggaggcggtcgaggttggcgaggtgcgtcctggtggtggacacggcgttcggcggcgccgcggcggccgccgccgccgcggccctggcgttcgggttgagaggagacggccgggcgtggcgcggcgtggcggtgaccgcggcggcggacatggccgggaacgcacagacagtgcactgacagtatctcagagacagcagtagaagctcgcgagtggcgagggcgcgcgcgccggtgtctggcttataagccgcgcggcgcggcgtggcgtggcgaggcagcgcgcgcgacatgtgcatcatgtgtgcatacgagcgtgtactgtgtatgtgtgtactttgtcaggctacggaaatttgtgtcattaagtctgactaatttacctcacttattggagcccttttgaaaagccaacttaaaaaatgattaagcaaaatcacaaaagcaatggagatcaccgtccaagactgggaaatacaaggtcgtaaactaagtcaagtcaagtcgaagtaaagtttagtcactgagtcgcatcgcatcgcatgccgacctaaatcgtgaaacaggaaacatactattacaccatcatcctatgtaagtattttccccaacatagaaaaaagttacacgacaatatattagaagaaaacaacgttttaattacataacacaaacaactaaagtgttattgtcgggggacgagaaataaaaaaccgaaaagaaaagacaacttatagacaacttaaaaaagatgaaaaactcctagagggcggagtcccactaaactcctagcaaaagtcctcaaaagcagcagttccagcagatgaccacatacggccttcctggaggatagactctagcaccattgaaaaccgaagagagtgagcgatcgaatactctaaagttctgctcattccacagttgtcaggagaccaggaggaccaaagagtcgaagcccttgcgaagatactcaggtaaacgagccctagcagacggtcaccaaacctagagagaacaaccacagaaaagagcgaggtcgggccaaccaggaggagacagaacatggtaccatacttggcaagaaaaaacatagttaagatggatgtggttcgccgtcttctgttattgggtgcagaggaggcaatgtcgagtgactgtcgataccacactttagcagaaggtcgaccgtccaacaacattgcagaaacgcaagccactcaaaagatcctccataagtatctattgaggccttgtttagttcccaaaatttttttccgaaaaacatcacatcgaatcttcggacacatgcatggagcattaaatatagataaaatgaaaaactaattgcacagtttgcatgaaaatcgcgagatgaatcttttgagcctaattagtccatgattacccataaatgctacagtaacccacatatgctaataacagattaattaggtttaataaattcgtctcttggtttccaggcgagttatgaaattagtttttttcattcgtatctgaaaaccccttccgacatccggtcaaacgtccgatgtaacacccaaaattttttttttcgcgaactaaacaaggcctgagtcttgaattcacactatttctgccaaacactgattttccctgtctttttttaagcaacctcgaatttgtccaagtcatgaccacagcacatacaattttggagtatcaatcaccattcattcagctaaaacatatccctaactattatctaaaaaaacatacccccaacttcgaaactttcactagttttttgtgtttggagaatgtaaagaccagcccagttcaaagaaggcattgtgggctgtaatagtggactaacctagacaaaccatagttgagggacgtcaaatggactttcccgttcagtcattaggactagctgggccatttctttatctattcaagtggcccactttaccagtgcagttttgttctacgtaggcgtgcgttttttaactcagttttgtactgcggcggctgtatgatattcctagtttcagacgaacaagagtaaacactagagttaagtcagtaaatccacttcagttactaagatcatctatctatctactactgagtaaaaaattaaggaggtttggataggtgataccatacgaggtagaaaaaccgggaggttgacaaatacgaggagaaaatgagaattccagggttgccgtttttcactctctgtcaaaagaccctagcttctctcgtctgcaatttgctcataatttgtcacctcgaggagagaccgatgaaaatccatcgatttaaaatgtgaattgaacttatccacggtcatgactcataacgaagataaaaacagttaaaagcactactagtcctaattggagtactacctcgtaaatggagtaactatacacaattgcacatcgatgcatgatttgattaatttgatgattggttacgaaactacggatttgacgatcgatgcatgttgctgtgcattccattgacaaacaagtcgatgaagtttcaaaaaaaaaaagacaaacaagtcgatgatgatatctattcttcttcagaaaaagaaaaggatgcaagaggaaaaatactactgatatctgtatgctagctagctgctcgattgtcctgctatacctatatactccctccgtttcaaaatgtttgacactgttgactttttagtatgtgtttgaccattcgtcttatttaaaaaatttaagtaattatttattcttttcatatcatttgattcattgttaaatatactttcatgtacacatatagttttacatatttcacaaaattttttgaataagacgaatggtcaaacaagtgctaaaaagtcaacggtgtcaaacattttgaaacggagggagtattctcgaccatacgttatgcctatgccatcatcgatcgatacattcaagggctagctagcaatgcaagatatttccaatgtgatgagagatatttatgcccacatatatatgcaaccatgagctaataattcattcatcgatcgacgagatatatagtaatgctgaacagaaacgaatgaacgtacctgcgtacgtacgaatgtacgatctgaatatctgaatctgttgttcatcgatcaacacgtggaatattcgaagctgcaggcaaattgcaacccaactggcaaacagttatttctttctttttttgtcgcaattgcaatgttctttctgtccagtgtggctacccaggcaatgacacaatgatgccctgaaaaaaaaaaagaagagaagattctgagttactgacactatacatgtacacgtagccaggttcagtctctgatcgttgccaagaaattgacgcgaaaactcctgccaacaattagatttagttcgatatgctaccacaggcacaaccaaggagatctttttttctctgagcatttcaagaagattttagacgtaagtaccgacgtcactggaagacagggaaatgagagggatggcatctcttccctttagccttgggcatgccagagatgaggtcaacgagtcctgtagttgcagggaaaccatctgattcgtcaattaacaatttaatactccctccgttttatagtgctagttattttgactactttaaatttaactaatttatataaaaatttagtaatatttttcaacacaaaacaaacataataacaggtagaagtgaaatgattgtgttcctctaattttgtgtatttctaaatgttagtgctgtgagaaagggaaaaatacacacacgttttttttttcatatttccaaaagtgtttttttcaatcgtaggtgacataccatatgtacaagatgcgctcacgtggatagtttgataatcaaatgatttacttaactcatattagtaatctaaatgtgtattttgaaagtagaatgatatacacgacacacataaacaagttaaatgaccctccatatattttactgcataataaatgttagttttaatgaaactaattttgtgttgtagaaattgctaaacttttctataaaattgataaagttaaaagaaatttgactagtaaaataagtcaaaactgagggagtaccaacaaaaggactaaaattttcgtccttttttgctgttaaaataatttaattttttattattattcttttcaaatacatatgcattttataagaaaaataaaccccctctataaataaacagagaagaggagtgggagcagtagtctcctccaaaccgtcgagagcccaacaataataatccccccttttcatcgcggcgacgatacccgccattttcatctcattctcaccaccaaaagcgaccacgcagcgaccggccaccgatcgagatggagcagcatgaggaggcagcggagaggaagccttcgccgccggtgatattccggctgttcggcgtcgaggtccgcggcggcggcggcggagttgacgaggaggagtacgaggaggaggaggtggagggtggattgttcatcaagaagagctccagtatgcccaacctcacctccatcgacccgctgccggtgccggccgacggcggcaaacggcgcgcctccgacgactccgagctcgcctccggccagcagaagcgccgccgccgcaaggtgcaggagaggaagaaaggtgagcaaccaccctttttgtctgttcttgtatctactgttcattacttgttccatcacctgattcctttttttttactctgaaacttccaactcactgttaattcttgacgcaatttgatgatccgtgaaagcaaaaaaaaaacaaaaaaaatatctttgattgagcaaccaacaaaattggttgaaaatcccctcttccaaaagagagagaaaaatgattaaccttttgtgtgtcagtcaattggtcaacaacacatcgataacaatccacaagcaggttctcagacctgaaaaactttttactagttaggagtaattaattattccctgtttgttgcttcctgtgaagatcatgtgacacttaattgcctttgattgattaatctgtgaaggggtaccatggactgaggaggagcacaagaaattcctggaagggctgaggcagctggggaaaggggactggagaggcatctccaagaactttgtgaccagcaggacggcgactcaggtggccagccacgcccagaagtacttcctccggcagaccaaccctggcaaaaagaagcgccgggccagcctctttgatgttgttgctgagtgcagtgatgatcaggtcagtgacagtgcacttctttgatcagatccacgcatgttgggatcttgcagctaatgctcttgtctgaaaccttctgttgcagcttccaagtcctcagagtgttggaactaagcctcctacccaggatataattcatacagatcgcggcgatgtcccggtaattttctactttgcttccattttttcttctttgtagccacaagctgagttgtaattacccttagatgattactggttgtaacttgagacaaacaatcctatctgaagactgaatctttaatattgctgcagatactaagctatccagttgctagaggctttagaggcgatagcgtgcaggtaaaatcagcatctgagaacatcttcatggaacccagcaacagtctgaccaaaactaacacaaactgatccttctgtcaggttgatgaactaactgaatatgtgaagagattaaaggccgccgaggacatgtcgctctccatgatctctggactggaaatggcatcatcatccatcagcagtctagagctcagtatcgcgcctcctcattgcgcgatcgaggcggccatcaaggtgctgtgatccagacgcaattctccaccgaaggaatctggatcggcttcagctactgttcttcgtcgccgctgttgttgtttgttgttgttgttttttttttttttttgcgggggttgtttgttgttgttgttgttgtagttgtcatgctaactttgtatttgggtcatgtggcgtttctttcagcagtcttatataatacagtgagaatgtcagtaccttccgagacatgtttaattaagccttggttggttggtataagttggtgaaaagaaaaccagatagtagcctgtctgtattgtacggttgcaaaattggagtatattgatgcagagatcatgaagggtctccatcttgttcataagtctagttgtttcctgttcctgtcacagtgagggcagctgggacccatcttcttnngtgtggctctgagcttcttccagtgcttcaataattggaccctccccttcatgtccttgtgaccattggtcccagccaatccattcatgccactctcgtaaaaaacacaacaatctctcttgtcatcatgcattcattccagacttatgcttgcttctaacagcagagaatgaaagccagtgaagaatcatgcagaattcagtttctttcttctttttttttttactgtcaggacatgctggtcacttatgcttgctttgcatgctaagaactcaaacacaacagtgaactacagctactccacaaagaagcaaagcaccagctttctttgcatcaataatggcccaactgttaagatctctaggcctagcaagataatggatatgcagaaatcatgccatatgctacgcagagtctgtctactgcaggtctctggagctgcataggaagggaaaagggagatggatgggatgtggtcgaatctaggccaggatatgtggatctcgataggataagtggtccatgatgaggagaaaaacacaaggagatgtcaagcacgctgcactgctgctgggtctcaacctttgcaaagaaagatgcatggcatgcctaggtggctcccaactgaatctctctgctgctgcttggtttgcatgcttgaaactcaccaaaatcactgcaaaactttgcctcttggcctcttcgatcgccgtcgtcggtgcggtgcctgcatgcccccaccgttgctggtgcagagtcgacggcaacctgtcgtcgacaaaaggaaggaaagagagagatgcaggaataaagaaatggatcataggattgggaaatatgatcttcagagataaggtggagtggagatccttttctgcagttgttttcttcttttcagggttgtcacaactttttgtttctcgaggtggcaaatcaatggaataatgtcactagcataggagatgatattgttattttgttggtgctaacctcgttggagatattgcggctgcaaattattgacaagatctcgaggtggatcgtttctgatcaggaaaaaagaattagccataaataagtagacagacagatagatagatcctagtttggcctaacttgcgcatcagcaagaagagccaaggaaattggcaaacagcaaccgaccatctggtcaaaatccagccacttgcacgagttgagtaccaaagattctgatgatatcttgagttaatgtattggaagattggtacttgaagtaggtttagtagtagtattccttaagtacgaggtcaagtcgtgtctttgtgattacgctagcgagcagcttcctagtacaagaatctagtcaagaaattgctacggccaacgaaagcatggcagcatttcctcctaattcccaagctcttgcctgctcatcgactgattctctagcattttttttttgttttcagtcaacaagttacttaccgagaagcttgggaagagtgaagaattacgaacactacagagtgaaatttcataggaatggagtgtagtacagat

SEQ ID NO: 55430 - DNA, 7511 bp, Oryza sativa
cagcactgaatctgaaatttctgaacatacatatgtgttagtccgacagtgagaaaattttgaagcaaaccagattcagaaacataaagatgcaactaattgtaggtcttgccctctcatcttggatggactgaatcactgaaaagtaccctctccgtttcaggttataagatatttttactttggtcaaagtcaaactgctttaaatttgactaagtttatagaaattaataattaaatatatttttataataaatttatcttgggtcaaaaatattactccctccgtcccataatataacaacctagtaccaattggatatttcatagtacaacgaatctggatagataggatggtgtctagatttattgtactatgaaatgtcacatccagtagaccagtactaggttgctatattatgagacgaagggagtactattttgttctataaacttggtcaaacttaaaatagtttgattttgactaaagtcaaaaatattttataacctgaaacggatggagtaggatggcatggcctggactctgaatttttctgaaagttgcaaatgtgcaacgagacattatcaattgatcatctacacaggtgtcattatcaattgatcttctcatcttaacaaatgggatgattgcagctagcttctccagaaatcttagcatttgatatcgcaggacgccagtcaaaacccgtttggtgctcagaaattccatccattattcagaaacgctctcaaggacttctctcaaaaccatcaatcggtgaaggctcatctcatctcgtctcatctatgagatgaacaagcagatccgcgtcccaacccagcgatgcaacagaagcccggtaaggggcaagagccggcggcagaggtttagcccatgggctggcaccgacggaccagcaaggcacggcccgctacagttgccgtgtcttagcgggcccgtgccgtgttgggctgggacgcccaattggcctcctatccactagctcgatcaatatggccattttatgggccagatttcatgtggccgttggatactatggacctgaacgtgggcccaacagctgcccacactcgtatgtcactgttacgcgggcccatatagtttctagcacacatagggactgaacgtgggccacaaaacccattcagaagcccacaatactcttggcccatgcctaatccagcacatatacctcgctgaaaaatatcaataagtccttgtttggtttggagggatcgaaggagattggagaggattgaagggaaataattccacaccatattaggtgtggaataaattcgggaccacctatacatttgtcgataaattttctcctaaaaatttgacagatgtaattatagtacaatcgtagtgtaattacactgtaacttatatgtaattacactgtaacttgcatgtaactacagtgtaacttatatgtaagtttcacataattttgaatcgttagatctattacaagatttattttggtgatgaagaaaacaaatcatagcacacacatatgcgaaagaatttattccccaacctccattttatcgaaataacatgttacggagagatttttgaaagttacatacaagttacactatagttacagtgtaattacatgcaagttacaatgtaattacactacgattgtactgtaattacatctgtcaaatttttggggtaaaatttgtcgacaaatatatagcaaaattgataaattccctccaatccctccctcatggagattaaccgaacaaggcctaaaggatcttgaataatttcatcatttgtatcttgtgaacgttctattttctattactaaagagcgtacagagatatgcaagtcttttgcatgttcgcggaaaaaatactaaggagaagagccaagaggatgtacatttttttcagtttgagaggttttctgaaagttgctagagcagttcgagcactggaagtcaagactgaactttagtcactgccatgtgccatggctgcttgcctgcttcacaataccaagagcaacagattctgtcgattcacgcatcaactgaagtgtgacactcgcttacaaaaatttgactgatgtagtacgaaaaaaaaaatcaaagttggcgtgcggtgatgagtcagtaaagagcagctgaattcccaaaccatttgaaaaagaaaaggagaaaagatgctcaaagccaaaagggaaccgagatgagtaggagcatctcatgctgccctcaaaaacaagatcaacgcaactaatcccaccacatgcatgcatgaacgccacactaccatcagcattcagaaacccacctaagcttgcagaaaagctatcagcagcagaagcagtagttgcgtacgccacccaaaagagtgaggaatctttggtttttaaccacgcaaatgttcatgttctttcttcttctttttttcaggtctccagatcaccttgcattgcattgctctctctctgtctgcatatccgatgttctagttggtacagagtttcagttgtgtgaaaaatctttgttgttccaatcaccatcgaagtatcgaactcatctaatcaccaatccatactgtgtgctggttaattggctctactttatgatgtgtctttaaattactactcctagcttatgcaggattaggtgtagtttactgcaaagtgttgaacgagcttatattcgtcttaatccacaaagatgtatttttttcatgaacctttagtttggatatgtacaagagtaactttagtgctcaactgacgatcaggtacactgtccagctggtggatacgtacgttctgcagctgacttcactgatgactagtgtgcagagtaagcagctgcttgatgactgaagtatatgttatgttaattcccatttcatggaaactaacattgtaatctcgcagtagttatgatatttgcagttttacctaaactgacttctcactgaaatgaaatgaagctcttctgcattttttttaaaaaaaaatatttgcagttttacctgaatttacttcttaataaaatgaaatgcagttcgattaaaaaaaaacctttgcagttttacctggatttactgtcctgtcctgaaaagagattaacagctgcagggtggttaatgcatatgcatgctcgatcagcatttcgtcagagacgcgtcagtgagagaagacaaagagctcgatcacgttgaagcagcacaatattcgcgtaacatccacgagcgaatcaaaggcgtacttgtagtgtaaatgctatgtttatctgatataacatattttatgattttgagtacttgctcacttttttcctataaaaaaaaagaaacaagtctcatatatatatgcagggcatgtgcatttggatattgtggattttgttataaaatctgataatcataatgcatgtgctgcaaaaataaggaccatagtttgtacaacatcttttttttgtttcagttcgtttcttttgtcgttctcacaaaaatgcatattccttcatatttttgcgtgttccaactcgcgtgtttagagctctttttttttcttttattcaaaaagaacaactctcatatatgcagcgcatgtgcatttggataataggaattttgttaggaatctgccaatcataatacatatgtattgtaaaaataaaatatcattgttaggacaaacatcttatttcgccgttctcgaaaaaaatgcatattctttcatatgttctttatgtttttgactcacgcgtattaaacggtgtgttacttgcatcacatgatacagaggccgagactgataaacgtgaaaaacaaaagaagaccaagagagaagtgcatatattcctttttctcacacaaaattcctcccttactagctaagttataccattttcctcaagcctccctcaccatctcaaactacacacacttgcctaggagagtagaggggaagaaaaacacaaaataaaaagagataatagatgagatgagaagagataccatctctagtaatctcgatgcatctccaacgcatggttggccataaagcccaagccaaagggtgagagaatttgatacaacttttattttgcgcgcgaaaagctatcaaagagagagaagaagaagagaaaaacttagcaaaagcagcttaaaaacagcgtcgtcacgctgcctcccgcttccccctcttcgtcttcttcttcttcctccaatggcggtggcgcaggcgtcgctgctgcagagcttcccgttcagggcggcggtgttcgcggcgtgcgtactgctgctccccctcgtgccgtcgccgcaggcgccggcggcggggggagatggtggcggcggcggcggccgtggggaggcgtttcttgccaaggtgtgggagctgctccacctgctcgtcgtcgggatcgccgtgtcgtacgggctgttcagccgccggaacaacgccgggaggcggggcgacgagaaggatgccgcggcgcaggcgaaggcggactccgccgggtacgtgtcgcagatgatccacgactcgctggtgttcgacgacggtggcggcgacgtggcgctcgacagcccgggtggcaacagggtgcggtcgtggagcgcgatgcaccaccccgacgagcctgtggtggtggtggcgaccggcggcgcaggaggcggccggagccacgccgtggaggcggcgcagcaggcgccgccgctgtcgctgcccgtaagaacactgaagccgcagggcgagtcgtcctccagcgcgggctacggcgacggcggcgagccgtgggcggcgcggccgcgcaggatctcacaggacacgcccggcggaggcggcggcggccatgaaaccgtgctcccttcgccgatcccgtggcggtcacggtcggggaggttcgacgcgtcggcgccgagccccccttcgccgtcgccgaagaggctctccccggcgtcgtccctgtccaaggagacactagccaaggccagtgaggactactcctccaggcggaggagcccgtacaagtcatccccaccggcgccgcctccgccgccacctccgttcctcgtccacggctaccatccgccggcggccgaacgccgcacggcggcgaagagcttcaggaggagctgcaggagcaaacctcccacagcttcactacctccgaattcagccgtagcagcagcaactcctcgtcggcgaagccaagaatctccatagatagctcctcctcctcctcgtcgtactacccagttgccaaatcggtgagaacaatcagaggaggaagagaatcactccagagccagagccaagaacaacccgacgtcgccgtcgccggcgacgcgccggctcttcttcacggatcggattcagacgatccgtacggtggctacagggcgtaccaatccattcccaggttccagtacgagagaggcagcagcgaccccatcctgggcaacgtgacggtgtcctcggagagcagcgacgacgacgacagcgacgtcgacggcgacggcgagctctcgacgagggggaactcgccgaggagggagtcgtcgccggaggtggacgagaacgaggtggacaagaaggcggaggagttcatcgccaggttcagggagcagatcaggctgcagagaatcgagtcgataaagaaatccgcggggccgcgtggtgtcaagcacggcaagtagctcgcccgccgcccgccgccggcgatcaccggcgccacttttttacttttttttttgttctcgttttgagcagagatagatagtacggtactatttgtatttgtgatagctaattagtagttatcaagaaccacctgtaaacaaattacattcatgtagatgatgaatgagagtgagtgcatgttcatgctcaatttctgggcaaggagatcgactgttgcatctggcaatcaaactggatatctgttccattatctaaaaatcttgccatgagctaatctgctagtaaaacatagcagtaatctgttacttctactgtatcttcttctgaacttaactgaaacaacttcaggtttcagcctgtaattcattcagttcagttcagttccctttacagcagcaagcaatctaagcattcagcattcagcttcagttagctggtgaagaatctgatcctgatcagaggctaccctttagactttagcttgctggtttgattccaatccttggttggatgagtggtccaaatttacccagttgcaccagtagctgtaattaagcctgtaattaattaacttgagagtttctttcctgtggtgaccaagctgcattcagtactgcatttctctgtacttttctctctactgtatactatgtcagcttgttgagaactagattagatcggttggttgttggaagcacgctaggctaatcttggtgcgttgctgacgcatcgttgtcggttgttttgtcagttatcatcctggcatcatgctgaaattgatttggggataagttttgctctgaaaacaaacaaacaatacaccatatcaaggcatcgaaaggaatgcccaatgtccatgggttgttgtgcttccaagaatgtgtagacatgagtgaaggagtgaggtgttacgctggaaagaacaggtaggcaaaaagttaggaggaatatcaacaggtcatcatcatgttaattgttttcaactttacaaatgctacttttgaaactcacgagttatttggatttccaattagtaatagattgaaataggctcaatttgaaacagattgaaataggcataacttgacatagattattaaccgagcgtctgtgatgcattatctacacggttgtagatataaaatgaatattttggtaaattaacaatttttttggaaaaagaaactttacaccctctcacatcgaacgtttgaacacatgtatgaagtattaaatatagattagaaaaataactaattgcacagattgcgactaatttgcgagacgaatcttttaagcttaattgcttcatgatttgacaatatggtgctacaataaacatttgctaatgatggattaatcaagcttaataaattcgtctcgcggtttacttacggattctgtaattagttttttattagtgcccaaacaccctatgcgacaccctatataatacatgatgtgacgtgcaaaaactttacaccctgaatcttaacaccccataagcaatacggcacaagaaaaatttcttaagaagaatgtttctttttaggcacgtaacaactaattcgccttatactttgagtgactacatcacaccataactcatgtccattacattagacatctctacttttattttcgtgaagaaatctatagctatacgtgcatttgttccaaaacgaaacaaacaaacgaaaaagaaagataatgacataaacacacagaaggcactgcgagatgaagcaatggattaagcgattaacgtcctatacaagcatggaacta
